United States Patent 7,868,149 (PLANT GENOME SEQUENCE AND USES THEREOF) - sequence listing, part 113

SEQ ID NO: 61963 - DNA, 33704 bp, Oryza sativa
  unsure (1)..(33704): unsure at all n locations
ccccccccccaccccaagcgcacttaccctccgtgcaggccactggcaccgtggcgcggtgttcgccggaggcggtgaggggtagggaggaggtagagaaggggaaggggatggggaaggggaagcggatattgccactggtacgggtctgctgcgggggccatcaataagatccgggtaccttgccatgtacagcatgtacaacatgtagggcacccccttcccctacgttggggtgacgtgagggcgctgtctcgagctcaatgaccgctagatctgggtaccttgccatgctccccttccctttccatgtcacgtcacctatccgtttgatgacgagaggttctgtttttggttgaatttgtgatttagcatgtgcaacagtttatttttctttttaaaaaaatgtgattaagcttgtacagaaagtttagcatgtacagaagtttgttttttttttcgatttgtaatctggggcaacggggagtgactcaaagcatcggattcgaccgaatcgagcctcttctcttttttttttttgcgtcgtgtgtgcctcaatttttttttttttttttgcatcgtgtgcacctcaaaggttatagttgcaccaatgacctaggatcatcagtgccttctccgtgctgccggctggaaaatccggtccctagctaatgtggaatttccaattgacacccgtcaaactttctgtcgtagaatatgctggcgaggcactctgaagcggaattagaagcttgaattctagaagcatgctaaaaaattcaaaagaacatctatagtttcataatttcacaataactaacagaattattgcaacacgatatttttacataaattcaagattccatagtcttgggattctgtagttttaacaattttagtttagaatttgttccatggatacaatggcggagccacatgggcagctgcccgggcttcaacgcacacagcagtagattaggacttgatttatgtgattatttaccatccagccacatacaacagtaggaagtacttaattaccgtacttaagcaaaccagcaaagcaaatgcttaaaaaatcacaatcacgttcatagtaaatgttttttgaagtagtatgaaattgtgtacatttgttatctatttttagctttgcggagtttcaagaaaattcttcgatccaccactgcgtggatacttgcaataaaaccataaccaacgtttagagcaatctaaaacttataaacttatagtgagaaaaaaaaatacaacaaatttaaagtagaataatattattcttaaagaagacacatagatatacatctcacatatttaagatatataataaaaagtttgagaaacatatgcctgcttatgtggacgggcttttcttctcttcctagtttatcaaactagggcgatgtcaaatattattcagatgcctggcttctttacacagctgttggatatagatatatagataagtaattttacagtctttataaaaatatcacgaggtatcattttttctattataattttgttataattttggtagatagacagctcgcactgggccacttatcttatggcttcgttcggtggacggagcgagctatttatttgctcctggttcatcgcctcatcggagcctggactgcgggcgcactacgcgacggaggcggtactgcagccacctgcggccggccgtcccaacctgcatatgccaatcgccaaagaaaacgccgttagatcttggggtttgcatcgccttggcagtgtcgtctaaagcggcacatgcatatatagcagggagtatactactcccttttaaatatttgacaccgntaactttttagtatgtgtttgatcatttagcttattcaaaaaatttaagtaattatttattcttttcatatcatttgattcattgttaaatatactttcatgtacacatatagttttacatatttcacaaacttttttaaataagacgaacggttaaacatgtgctaaaaagttaacggtgtcaaatattttgaaacggagggagtaagttccattcagcacgttgtatccacgggcggcgagctccctgtgctcctgagccagcgcgcaccagtggcagaagacatgggtgaggcagtccggcaggggcgattccggcaagccatactgcgccctgagctttccgcggtaccaccccgcgtacgcccaccacacgccgaaataagcggcaatgaggtagatgaagcagatacagcaccactctaattggtgaggagaccaaaaggaaattgacaagagagaaaacatgcatatcggtaagcaaatgtaaaaaatcttcacatacatatctgtaaccggatataataataagcgtgaaaatgcaaaattttgaaactgaataccgataattaattaaccacctgatcagcggatattaattcgatctaaattcagtttgatggtttctttaattttatatctgaatccaaacgctcttctgttttatcggtaaccggtccaaagcaaagcactttggatggggctatgggagaggagatgacccctacctgtgaagccttgatcgacgatttcaccgatgcaggaaatcgacaaccaagggaaccaagcactcaaacaaactgccaacaggtcgagaaattaagccatgaaacggaaaaaacattgcattgtaccaccaaaccagaaaaatccagtcagtcgtagctttgcatacatgattcgcagccgtctccgaagcagtcgcagaggctagtctgccaaccctgatgggcaggtaccattctaggcttgatgaccacgtccacattctcgacgtcgacctgcgtgttcatggcgttgctgtggatcttacctgcatcgttggaaattggaaactagcggtaaatcaattttgcatctggaattaccgagtgcgtgtaatggacgtacaatcgcgcgccttgaccacttacctgggatgaaaaaggtccgaaaacatcccaattgttttcttggaaacgaaaacggtaaattcgaaaataaaaacagtataataatatcggaaaccaaaaacagaacaatatgaacgaaaatgcattggtatcgacaaaaatcaataacaaatatctaaaatcacacattttatttcgcataaccatataatataagaaaattaattcaaggatacactatgcaaattacaaattgtctcccttttaactttgcactcatatatttggttgaggagttgatgggcttctaaattatgggtcaaataaagaaatagataataaatattggtgtatttagaaatacggtaatctatctatctatctattatattattaaaatagctttgaaaggaggcaccacgttcgctgtgggggttagaaattcccacattaatcggagaaaaaaaaaagaaaaggagagtccaggtagaaatacaatctaaaaataactgaatttcggaattaaaaataagcaatattgaaagaagtttccatataaaaactcaatacgagattaatcaaaattataaataaaagtaaaataaaatcacaaattagaaaaggaaaggagagtctaagtagaaatacaatttaaaaatagctgaaattcggaattaaaaataagcaatattggaagaagtttccatataagaacccaatacgagattaatcaaaatttgaaataaaaataaaataaaatccaaattagaaaaggaaacgagagtccaagtaggaatacaatttaaaaatagctgaaattcggaattaaaaataaggaatattaaaagaagagtccatctaataacccaatacgagattaattaaaattcggaataaaaataaaaataaatatgaaattagcaaaagaaaataaagaagagttcaagtagttagctgaaattcgtaattaaaaagaagcaatattgaaagaaaaatccatataagaacccaatacaagattaattaaaatttcgaataaaaatataataatatccaaaattagaaaatttaaaacagagttcaagtaggaatacaattttgaaacaaataaaattcaaaataaaaaataaaaacattaaaagaacacaatacaatattaactaattttttagaaaaaataaattctgaaattagaaaaaaaagatttatattaggaataaaatttataaataactaaaatttgtgataaaaataaagactattgaaagaaaagaccatctaaaacacatgacgaaataaattaagtaacatggctataaagtagtagagttggtggtggttaatacggcatataaaaattattaataaaacaccaaatagaatcctaatgacgattaaaaggagggacatcaggtatgccgtgaagtaaacaagtaaagcggttgccgggacttctagaaagtataaagaaagaaaaccacattgataatcattttcgatttttaaaatctcaatgacaataaaaaggagaagcaacgagcggggtgtataagagtatagttgcagagcctccgacggttgacgggacttctagaaaataaaaaatgaattgtaatgatagttatgttcgatttttagaatcacaatgacaataaagagtaggcggcggacgggctgcagaggggcatagtggcatcgtttgatgagacttctaaaaattataaaaaataaaactacaagtccaatttttaaagatttagaaattctaaaaagtaaaaaaaaccaatgataatcatgttctattttaaatctcaatgacaataaagaaggcaataaagaagggaggcagcgagcgagccgtagaggagtacaatggcaaaaccgctgatggtttggcgggacttttggaaagtaaaaataaacccaaactataattatgttacccggaaatttaagctattttaaaaattaaaaattaagtggcatatatcactaattaattagttaactagcaaaattgttggaaataagaataagccactcaaaatttatgaaattcacattcgtcgaagttaaacaaacaaacaatgtccaatatacaaccacaatataatagtgataattggaaatatagtacaaacaaacgccactgtaaacagtcagcatatacatacacttacactaataatacaatacatcatatatttgaatatacggttgcacaggacatgcatagcttgacccttttatgcacaaaaggtaatatgtaaataaatattgccgtcagacccatacacgaagtggtgtatattcaaccattcaccgagatacctagatcggctaataccgtctggcacccctcccttaagttgggttcgtcatccggctccggctaattaacactaagaagtcacacatctcatataaagaagtaacctcaccaaagggacctcaattcaccagcagtactaattttccaccaatcacatagctgcacataggaggactcacacaaggccacaaaggtagtagcacaacctcatcacctctcagtcaagcagtcaaagcatggctacagccatgcccatttgctcactgatgcatgcatatgagccccaagcacttggtgaggagtgagcagatcaggggaggaggagagcaatagggagcgaggagggaatagccaaagtcccaaaatccacaaatcagcggaatgcaagattctgcccaatccatttcaagaaccaatccctcaatcccaatagttagtagccaaattagttctcagccaaatactcataccatctctatgtcggctaggaaggggagaagaaaaattggctagacaaggagatgatctatcaaggaggagaagagaccaacacattggcgaggacgaacacgggagcacaaccatggaggaacttgtcccttagacaaaggtgagcccctcaaatcttgccattcttgccacctcatagagcagccatggcacgaggcactattttcctgcactttcacatcactattagtggcatcacatccatttggtagcatgagagagagagagggacacacacagagagagaaagcagacgctgttggtagggcttggaccatgggaggaagaggagaaatcgggagggggagaaaaggggatttgcagtgagctagcttggggtgtgtagtggtggtggctggcgtcgacctccgtgggcgccggggtggcagcgccatgggtggtgctgtagatggaagggaggagcagagttggggaagaagaaagccattagcagcagcaacagccaagaaaatggaagaaggggatgagtaactagatgcagcttgttgtatgtgcgagagagagagagagagagagagagagacataagtgaggagagcaggaataagggttaaattgcttagtgcacactagttgtctacactaacattaagcttagcaaaactctgtcaataaatctgtaaatcaagtctagtttaaatcaagtaactaatatatatactcaatacaaattaatggaatgctagaaattgtacatcaggctagaattttaggtgcactgtaatatagatagataagccaattatattcttcaagtttgaaagttaattgaaaatcaatgtatacaataaaatgcagggaaaaggctagagtcagaaattgggtcatttgatagtaccggctacagaaactcaggcaagtctctcttttgatcatgttggtagatgataattctatttcaacttaaaaatctatttcataaaaatatttctcctagtattgcatcaaaaagtattttctagaatataatgaaatgaacgatgatgatatgattgacaagccgatgatgatggagatcatcaggatactagtatggtgggtagggggagctcagggatgagatgattgatgatgatggcaggtcagggctctccctacatacggtgtataaatataaggactaatcaccccctcactcgtatcaaagaaccgtatataccgtgtcgaccatagattcgtcttaagacgggctggacctggtaccttatcaagtttattatactccacatgggtacgtagtagtaggatgggagatgatataaaccccatgaatgccgatgaagtgcattccaggcgcatatagtagcgcggtggtgtggagggctgataggctcaacacaaacgtggagtgtagtaagttgaagtaggggaaaagttctgtactcttagcatggtgccgcatctagtgaagtgcgacagtcaaacatgttaagagtagctatgggtacagtgatacaagcctgcgcagtgctaaattaaatcgtgattcacgactatctcctggatgggagtctacggggagttgctacaaactctattcaatgttatgagtgtactctagatggagtagagatgaccttaatgctcctagggatgaattaaaggtagttctaactatttctctgttgcgatctctgatggtggattattatttggcaaaataatggttgttaaataataatctatgttctcacacttttatcactaaagataaaagtgtggggcgtcacagttcgatttttaaaatctcaatgacaataaaagagaagagatagtggacaggctgtataggagtataatggcaacgtttgacgggacatctagaaattataaaaacgaaacccaacgtgacaataaactctaaaaactataaaatctaatttttaaatgttccaagatgaatgaatagaaatagtgatagatcgagcaagcaaataaagaagatgacataaggggtagcaattggtgtgatttttaaaactatataattagaaacacgaggatgataaggtttggtctttcaaagtcttaacaatgagatagctatttaataaattttaagtaaaatcatacttaaaaaaatgatttttttggctagccgcgcaattgcgtggaccacccagctagttatcataatataaaacagtaatttagaagcccgaaccatctgagcacaaaagccctcctgactctctttttttctctccctagcgtcccctctggccctctccatacctagctcaccctggagccctaactctaatatatgttggaatccgtttcacgtattagcccttacgggaattgaattaccgatgattctcattcttgacaaaatgttcacatggagaagcaagctctgaaatactactgccttcatcccattttaatcatcccctaatatttttaaggccttttcaaaataatcatcatcttcgtttatttgtgcaaattaagagtactaaatgtgtatcattggaatgtgttacttgcaaccaaacaagattaatttatattatatttaaaccattagcaatccataagacacgaagcgatggaacacttaatccatgagaggattaattttaagaatgatgaatattttgctgttattgttcttagcgcctttagttaggggatgattaaactaggatggagggagtagcctgctgaccaaactgtccattttttacgggtcctagctagagtggatcatggtgaattgattcctccttcggcgtgtttggagcagtgcagtgaaaatgttgcttcacacaggaatcagggcaaccatatatttttatatatttttggcacgacaatatattgatatcacctaccctttttctggcagctttaaattgatgacagttttggcatttcacaatcgaacttccaaaatttctggagtgctaaaactctggaatggattctattcttttttatatactccctccggtttcattttaattaacgttttggacaagaacacggtctacaaaatatatctttgacctttatttttctattataatatatataataaataaatatatgtttacttttattatggtgttttgaaagacaaatttatatatattgttctagttcctttaaactaaatatttttaaaattattgatggtcaaagttataaagtttgacttcaaccttatctaaaacgtcaattaatatgaaatcggagggagtaatataaaatatcctcgtggacattcatggcaagtatattgcaggaggcatggacgccaccaatcacagttaaatactagtatctaaaattgcgcaggttttgacacaacttttttaaagaggcatggtttagttttcaatttttttttcccaaaaacgtcacctcgaatctttggatatatgtatggagcattaaatatagataaaaataaaaactaatcacacactttgcatggaaatcacgagacgaatcttttgagcctaattaatccatgattagccataagtaccacagtgacccacatgtgctaatgtcggcttaattaggctcaaaagatttgtctcgcggttttcaggcgagttatgaaattagttttttcattcgtgtccgaaaactccttccaacatccagtcaaacatccgatgtgacaactaaaaaaattctttttgcgaactaaacacacctagaatttaagaattttagcgacaccaaagatttcctgttggcttccaacttttgagaatgtgctaaagggggcatattcgcaggtataaatgtgcagtagggcacgtgaaaaaacaaacaatatcaagaaattatattatatatgtatcacgcactttttttcgttttaaaatattgctgcctttgtatatcaaattaggccgctatatttaggccggagcaagtaactaatttgcttgaaatgaaataatattagaaactagctagtgcaattgcacggacaaattttaccagttacgtgtatatattacagacgaacttacataaggatcagtgtatagcaaggtataccttagaatccagggcaccactacctcaagctaccccggctttgtgagttgtgacgcgcagatcgctgggctgcgttagcgcattggaagcttcttaaatagtaagagcaggcgtagacttgtcagttgagtcaactaagagccataataatattgatattgctataccaacgaccaacaatccgttggtccatccgtaggtgacgcatcccattttatcaaacattaaaaaaaaggtgaagtttctatcattgatgctactctgtacggagtacgatgaacagagtaccttacttttacaattaataagtctgttagcgacgtggaagtggtggcaaccacacatgaaacaacccgctcttaaatgatactccttgcgcttttttaattagtatttttattgttattagatggtgtagtaaacataagatcgatttttaagtcatatgaaaaggaataggaatactgaagagtatgtcaggcgatggactgacgattctagggcgacgcggcggcgctccctgtcgccggcgaatctccggcggagatcacggtgtgagcgcgggaattcctcaggtcacacccttgggagacaggaagggagcggcgcgggagcctagtgagaagctcatggtgagcctgctactgtagggggtggacacgtatctaaagcaccgtactaaaaaattatctacattcaactaaccatctcaatattatgtagaaatctaaacatatatagagtagagaaggctgaagctaataagctatatataaaaagtttctgttttcgaaaagttttcaaatttatctccggaaagtttctgaccgattccggttttcgaccgatagtagcctcaccgtattcatttccgattttgaaaaaaaaaatctgaattcatttccatttctaaaaatttccgataaaattctgactgacactttccgtttcaaaaacctctcaggaaataggaaactttatgaaccattttcatacctagttacaccatcagaaattaatcttggctagttacatgcatacggttgcatgcgtgcagcgcattcagcgattcccatttactcccacttattgtatgatggtcatttagaaaaaacctcaaaatcttagtggacggtcaaattggggtagagggactactatatttctttcgttttgcttgtgcacttgtcaatcacgaagggatgaagccagggggcgggaggaggcctagcctcccccaacacaactgcttagagcctcatcggttggcctaataacacaaagcaaaagctaaagtttgaattttaaaacttgaatttaaagttgatttcaacttattttcaacgtaaatttctttatagcattggcttttaccttgctacgaacaaatatataaaagctttatatataaattaacttgtatttctttttttttttgcggggaaagaagaaatatattactctcttaaaatgtcctcacgcactaaacgtaagataaaattacaacttccttccaaccaaaccccagagacagagtcaactttggccctgttagctaacaggtgactaacactattctggcttctatggatcttactgactagaattctcctagtcccggctagcaagcgtttagcctcatgaacaatgttagccaattccgaccgatccctttccccatcatttaacagttgcactacagacatgcaatctgtttcaactagaattgggagcagggtccaatggagaactagattcagaccttctacacaggcacgcagttctgattcgagagcacctgtgcatctgttcagcggtttacaggacgcgaagattgtattcccactgctatcccgtaaaaccataccaattcctcccttacatagggcagcatcaaaggatccatcaacattgagtttcatccaaccaacctgaggtttcacctaatgcaatacgggattcggaactcgatgatcatcagaagctctgtctcttaccctgccagtgacagacaaactcgctacagacttccctttttccacatctttcagcggtgattccttgatctggaaaagcgggctatgtaactttcaacaaatcttttcgaaacttccagcggaggggctgctttatcatgggtgatttcattgcgaacatgccaattccgccatagcgtcattaagaacatctcgtgctcatgggcagggagttgctccagcatgtcaaatagccactcattaccgaaacgagatttttccacatcaagagagatgttgcctgcattgaacatggctgacagcaagttcctcgcgtgtgggcacctgcagagggcgtgagcagtatcccccttctcctgattacaaatgattcaggtatctgtcgactccaaatttcgtacctttttgttgacaatggttggtaaacagtttgaggcagcttttcaggcaaagacctttatcttctgtggcatcttacactttcagattgagtcccaggctttgtgtgtacccactacagatgagcttgacgaatcttcagtgtttgccagcttacaagcaaggctgtaggcactccgcactgagaaccggcctgtcttatctgggtgccaagccaaaaaatcttcttccaaatgaggagacagacagatagttgggatgatctcagcgtctataccaaggaagcatctattgatctctgtaatattccaagagccatcttggtctatcaaatcagacacccattttagccaacaattacctctcaaagaaataggtcttcttgagtgatcacgtggaatccagggatctctccacacgcagatagacttcccattaccaactctccatatgatcccttttttcaataactccagcccacgaacaatagcacgccaagtcgggaaaatgttgcaactgaaggtagtatcaattagggatccttgggggaaatacttcgccttcagaactcttgcatagaggatatcagggaattctataagacgccaagcttgacgggcaagaagggcttggttaaacagcctatagattctgaagcctaaaccaccacatctttttggttttattaaacagttttcttaataagccgttttggcttattagaaaatataggcaaccaataaggctcttaggctgtgttcgggagtgagggttgggaacctcactcctggcatataaaacggagcagcatttaatgcgcgattaattaagtattaactaatttttttaaaaaatagatctatatgatttttttaagcaactttcgtgtagaaactttttgcaaaaaaacacaccatttaatagtttgaaaagtgcgcgcgcagaaaacgaggaagaggggttgggaacttcctataccgaacgcagccttaaactacaacccaaccaaatagagatcctctaacttacttttctctaacttgtgtcactgatatgtgtgccctctatccagttggcccatgtcagtgactcaaagtcagagcaagtcataggattctgccgatgcatgcacagcttagctaacagcatcacatcgtgtgccatgctgaatttccagcttcttatgtttatcgtgtaggattaattagtcactaaccaaaagaagcacaagccatgccattctttttttccttttccttgtataatactacattttattaatatctcataatcataatcatgtcgttagatggctaccatctcaaatttctaaatattccttaatacttgcaagatagatagtttgttaatcattttatcaaaatcgatatagatgaaagcctatttatctagacttttatctcggtcgatattttcaccgcttatgatatatttgctcaacattcttatcatgctaaatttcataaataaataagtatatgcagtataacttcctgcctatgttttttgttgtaatatgtttttcatgttaatacgatgcatcattacctaaagaaaacattgaaatttgcatataatctatctattatatactaaaagtccattaaacttcctacaaacgctctaaggctgccatgtggtatcctataaatgctcttaagtccccatgtgtcactctaaaaaattagtaaaatctgaccattgatttttatttaaattggtgggcccattaattttcatatttagatctatcttcacaagaaaaataactccgtccggacgtgagcctccgcgcgcacgtacgtgcgattcctccaaccaaccgttcctctcctttttttaaatccccatataatttaaattaaatacctttttatgggcctaaaaagcccatcaacctactagatctagccaacttcctatattctcacctaataaataaatagttcaatcaacatcatataaatatttctaaacacatgtccaaattcgctgttctcgcatatgccacatcctattttaagttcaggttttatgggacgggatgagtatatagcactcttaaattagagaaaaccttaaaaaaacattcgaccatctatatacattattttaggttattagatttatctttttctaaaaaaatatatcccaaacctccctccgcgctcctatgcggcgttaaagcccattaaccatcttataaaccacacagtgacactcctaaattataaattagagaaaatcataaaaaattaagaacaaaacaccattttgacttaaatcgatggacatatcatttaggttgttattagatttttatttaaaaaaactcacaaaccttatttcctcactctcggcccctgcaatgttaaatacattaaacatcctataaatatttctaaaccactactggtctctcttaagttaaaaacaaaacatccgaccattgttttcgacttaaacatccaacacattattttaggtcattagatcaatcatttttttaagaaaaaacatcctcctccctcccttcccgtccccgtgcggtgtgatgttccttttctcttatttttatattatgataattaaaattaaattaatctttatggaggaaaaaccacaaattaacctccacatattaggtctagccatgtatcccactgtccctgtccttctctctcttactagcacttataggaacaatataaataaaatatttataacttttcaaatcatatattcaacttatgatctgttcgaactattatatttttagtgaaatcaatacattaatattcatattgtctatatttaaatgctaacataaaaattatattctagacccacatccatcttgaggccaacaataaattaaaaaagatactaaaattcgtcattgaaaatcagaatatcccaccttaatttttaataaagctggttgacccattacttatatcctgttagaccctaacactttctatcaaatttattaatttctctcaacatgtatatgggggctacttacctatataatatgaccttggtgcttttttatcaatcaatgatcaatttagaagataaataaataatcttaagatgatcatagagtctaaattatctatatgatctatgaagtcaccaataaattagaggaaaactttaaatgatatcgtgttttacgtcataatttgtaccccatctagcgttaattttttatagacaacataataatgtgtatttattacatgacctctattttaatatttcttactcaattgaagtgagataattcagaagagatgactttaccccatgtcaggttgtaggctcaacccacttatgtttttaacccaaattgcagaaatcaaatcatttcaaatatgcttcatagagtggaattctccaaatttctttaaaaaatgtacatgaaaagaatcaaaatttaacaaaaattatcttttttaaaaaaaaaattggtttgaaaacccattctaaacagaaacattcaaacttctagcaaagctaatggaatgaaaatatgtaaaacttcaaatactatctagcaaaaaaatgactttttgagcaaatgtttgggggtaagatatctatgcgagaagtcaaaatgaccaaaattttctcataggaactacatctattgtttcgacataatattttcttataaattatgaagtgtacagtctcaagtaattttagtttagaatttatgtgctgcaagggtaatcataagaaaattataaccagcattcaaatcacattaaataagttcaatttttatttagatagagaaacacccacacatggacatccctaacaaaatttcatgcacattaaataaggtgcacgcgcatgtgcgcgggctaccttcctagttttaagaaaaaatataattatgatcacttgtcaatttagttccccctcgtaattgtcacgcccagatattcacgaaccagaatttctaagctgaatgtgtattaaacccctgtccaggaccagccagggtacacaaacgacaattgttgacatacagatccacgttttacaaaaatataaaagattacaaatgcagcggaaaaaagaagaaaaaaacgagctaagcctgaagacttgacttctgcagtgggcgactccattcgataggcatccatgacggtagcgacgaaaccaacttctttgtgacatcttcaactgagaaggacttcaactctggtgtgggggaaaagagagcaagaccgagtggcgaaggctgtcttgggaatatcctcttcccgaattctcaactgatgatagcctgatcgcaggtctatattggaaaacaccttagctccttttagctgatcaaacagatcatcaattcttggcaacggatatttgttcttgattgtgacctcattaagggcgcgataatcaacgcacatcctcttggtcttgtctttcttttccacaaagataaccggagcaccccaaggtgaagtactcggtcggatgtaccctttctgcagctgttcgtcaacctgctttttgacttctgctagctcattagctgccattctgtacggcctcttgtagattggagcagttccgggtgccagatcaatctggaactcgatttctctcttcggtggcattgtagtgaggccttctgggaacacctcaggatactcttgtactataggtatatcctccaacttcttgggatttttttccgctatttctgtctgatcctcaataacagcctgattcagactcgctacggacttctgtgacactggagaacggaaggtgatcttctcccctttgtcgttgcttagggtgatagtgcgacttgcgcagtcgatcactcccttgtgtctggtcaaccaatccattccgagaatgacatctaggtctttggattcgagaaggatgaggttggatagaaaccgtgacctcttgatctctatagtcactgaggggcagtagtgtgctgtcctcatgtcatttccaggggtatgaacctgcatcagtattttaagttccactaccgataatccatgtgccccagcaaatctcttggatataaaagaatgcgaggcaccagaatcaaagagaactgttgctggatatgagttcaccggaaacgtgcccagcacgacctctggtgatgcctgtgctttctctgcagacgcatgattgacgcgggcctggacgaacctaggtccaacgcgctttagcttcggacacttgccagcaaagtggccgtgcttgccacagttgaagcagggtcttggctttcctgcagactccttcttgagctgttctgactgagctgacatagctggcggatctgactgagctggtgccattaatgggggtgaagtcgagttgtggttatgctgcttactgttgttgtgactgccaccgttgtagtcgttgttgaagttactcgggtggtaaggatggtgctgacggatgatcagggtggaaggctcacctagctgtcccgtcatgaagcgaggcttctaattgttcccctgaggaaagctgatctgagctacctttctatttcggtccattttgttgcgttgctcttcctgacggatagccttgtccacgagcttctcaaagtcatcatagactccggagatcagctggttggtcaatttatcatcgagaccaaacaaaaacttctcctgcttctcggcatcggtgcgcacatccttaggagcgtagcgcgcaaggcggttgaactcatgcaagtactctgtaactatcctggtttcttgatgcagtgcgcggaactctcttttcttttgtgccataatcccctcaggaatttgtgccttcctgaagctttgacaaaactctgcccaagtaacctccgttgaatctggacgggtcaccacgtagttatcccaccaagcagaagcgggaccttgcaactgatgtgtagcaaaagcaaccttctcttggtcattgcattgcagaaggttcagcttcttctcaatcgcacggagccagtcgttggcctacattgggttggtggtgcttgagaaagtgggtggctggatatgatgaaagtctaacagtttggacaggtgtgatgatggaggaccagactgctggttctgctgcgcctgctgcaacatctgatggtaatgttgctgcatctgttgtatcatcattgtcatcatctgagtgaccgttgggttctcgggcggtggagatgaactgctgtcagatgcaccactgatatgagctccatcggtctgctcttcgctgcccctagcgtcattggaggcacggggatcattccctgtcttcaccatctggacgaggataggtagaaataagagaaaggaagaaaacagatggcttggaaactaatctttcttatagatttaagtgcaattaatttaatcttgattaaaaaactaaaaagaaagcaaacaactcctaattaaggcagtcataccactaacacatgatatcgaccgccgactaacccacaagcaacaaacctaaacacagaaactagcaagcagccaaaactaagaaaatgttaaggataaaggcggcgactctgaagcttggagcagcgcttgcgatcagagaacaggtctgacatctaaagaggacagagggataggaaccaacacatgctcaaaaccaaattaaataaagcaacaaatgactcaaataactcgccgagcatgatgatttttatgcgtggaacatttttcatgaacccagacaaagatactaatgcaactgactaaacgataaattaatgcacaaaatagatgcgtagctataatatacacataaaaatgcccatcgaatctagacacgacttagtgcatatcacctaacaaattcccgactgaaggccaaataaattccaaataaagttttgctagaaccctagactgcctctagccgagaaatacgattaaatagcgatcaagatttttcccacaaatcaaaagagcaaaccccaaaattataccgaaacaaatccaagtgcaaaaggcatgtgcaaatgaaaaggtttaagaggactcttagggtttccagttggcttgtcctacggtcaaggtcggctctgataccaactaagaatttctaagctgaatgtgtattaaacccctgtccaggaccagccagggtacacaaacgacaattattgacatacagatccacgtcttacaaaaatataaaagattacaaatgcagcggaaaaaagaggaaaaaaacgagctaagcctgaagacttgacttctacagtgggcgactccattccacaggcatccttgacggtagcgacgaaaccaacttctttgtgacatcttcaactgagaaggacttcaactctagtgtgggggaaaagagagcaagaccgagtggcgaaggctgtcttgggaatatcctcttcccgaattctcaactgatgatagcctgatcgcaggtctatattggaaaacaccttagctccttttagctgatcaaacagatcatcaattcttggcaacggatatttgttcttgattgtgacctcattaagggcgcgataatcaacgcacatcctcttggtcttgtctttcttttccacaaagataaccggagcaccccaaggtgaagtactcggtcggatgtaccctttctgcagctgttcgtcaacctgctttttgacttttgctagctcattagctgccattctgtacggcctcttgtagattggagcagttccgggtgccagatcaatctggaactcgatttctctcttcggtggcattgtagtgaggtcttctgggaacacctcaggatactcttgtactataggtatatcctccaacttcttgggattccactaaaattatttccaaggctctgaaaattccactaaaattcctgttagcatattttgacatgtagaatccaagaaaaattccacatgccgattccaagaaaaattctctcttgcctttaaacaaataatttcttgcgacaatttattaattaaatttttgctagggagaagaacttcagggcgtgacagtattcaaatcctagtttcgccactgcaatcacggatggagggagtatgttttatatggaacagtggcatgtcaaacaatacctcgtatacatttatgggaaaataatatttcttcttgtgaattctacactaggatatcttttattatcagagttttacattggactagggaccaacaatattttctcttctacaagttttatattgaacatttgaattcggtataatatatatatatatatatatatatatatatatcgaattcatgttctgatctctgaacctttctcatgcaggctgcaaggtactttaacagcaaaatatgcccttattcaagtgataaaatgacctgcgcaaaaactgcgacatcctctgttgattgcaatcacgggaaggttgcatttgcaaatccgtttggaggggccaagcaaacttactcgtccagtacaaccacgaagtgcccacattgtgtggaatcccgtaatgccgagtaagtataaagtagttaattgtaaaaccttggacacgctctccatgcttttctatatatgttattgtattgtgcttcctcagtactccatccgtaaatccgttctaaatgttttttttaattttttttaaaaaaatgagaatttggtctttcaaataatctaatttgaaattcgttactatggggaactcagtaccttggggtataactcagttcattgcaacaactaggttacatacccttttgcatctaaataaaatattttttgtatattaatctggatattatagttgtctagactcatgtacaaaatttactttttttttggggatatctcgtttcttggctatctccagttgaaatgggcctactattaatttgataatttatcttgggagatcgatgctctttcaattgtgtcatttaatttccctaaataatttttattagtgcagagctatgaaggtgtagatgttactagagcgtaatggaaagactaatttattttgtcatgtatttttgtttctgcaggatagctgcagccatccgagccaaatctatcaaggcttcgaagctggcacatttcgctttaactgttacgatgtcagtagcagcttatatggtcactctaaaaatcattgccaaacctcaaaaagaaaaaaaacattgccaaacctgccgatgctgcaaatcctgaaatgaaggttctattttccatgcagccacgatatttctttttttttttttggtaaggatgactccccataagggaattgggactctgtaataaggtggtctctggatatgctttgtttcattactaataactgagcggtgcatgcgtgtatacctaataagtgactctgtaataaggtggtgtttggcagctatgattttttttaagaaaaaaatcatactcctctgtccaaagagactgcatattataagctctgcagtaaaaaagtttagttatattttgtgtacgtccgatgtggctgcatattatgaatctcttttggtcacccctacaagagaattacaaaagtcagtactccctcgtccctccgtcctaaaatataaaaacttttagcctctataatttgttcctaaatataataacatcttcaccaacatatccttctcaaccaatcacaaccctccaccattcaatttccctaccttcacttctcaaccaatcacaatcttccactatttaattctacctactttgttaataaccgtgtctagctataaaactcattatattcagcattcagagttatcgtggaacacatgattctgaaaatgcactgtcacaaaatatgcatgaatacaacgtctttttttaaggaaaggtaaaaggaccttgatatcgcctgggaggtgtgaacaggcgttcctaaaaaaattatcacaacttcataatatattagaatgatgagaacttccggttcaactcggaacttctggtatgggattgaaagtttcagtttcaaccgaaaattcagcggataacgaaacaacacactagctatgaacttgtagctcaaacaaataaaatgtatatgaatcaaaaggtgacaaacaagagattgaagcaagatataaggtcatcaactatattaattaagaatacaagtgattggataaaaaaaaactcaagcacaatatgagagatgacaagaataagcaaagcaagaaaggagacacattgatatgtttctcgaagttcagatccacggatcctacatctccgttgaggggccacaaaggctaggtttattttaaccctttcctcacgaggttgtgcaaatgcactccttgatttcacaattgatttcttcccttacagaggcgaaatcaaagccttcgcaaacttttcgaggcacaccacaatcttgggcgctcactggcaacacctagccgtttaggagaccttagtccccaagagtaactaacacaactgaagatttgtttgctatgaactcaagtgctcaaagtatggagtgaaactcgctagctcttaacttctcactctctcaatccaactctctccccttctcaaatccctcttacaaagaggcaccacaaaggtagggaaatgggaaaaagctatttggctttagatgtgtctaatattgccccagaacagcagccacttaaagggcggaagagtttacatacccaagcctctcaaaactagccgttggaggccaagactgtaattttcggaatttccaaaatgcattttcggacaagtgcaaaaaatcaacagaagcctatctcagtttcgcagccattttcagaatttccgaaaagcacaggataaaacgaccataagttttcgctcgggagtccgtttttgatgatcttgaactctatgaaaagctcacttagaggactacctaactcaaccaaaaacaaagttaaaaccactcaaaggatatgttaaagcttgagtgtctctcaaggtagcactatgattggtcactttgagcaccgaaacatacacaaacacatcgacgctgcatccctcttgatagtacgatattactatactcaaatttatataggaagagaattataccaattggaatgccttcttttcatcttcattcctttgtcttaaggaacagcaacgccaaaaccgtttcaccatatattcttcaaataattgatgcggttacttgtagcttcaaatggtctcgcacggtccatcatgacaaagctgtcactcgccattcaccaccggatttggctcttcggcgccaagccccttgcttgcccttcactgtcacatggtccatcgcgaccgagcatcaatcatttgaagatcgtcttgccataatagccacttcgtattccgcatcttcaatatctccactgtcattcttagtattttagctgtaatgatatcgattgagcatcaacaccttttcaatccttgggaccaatgtttctcattcaactcaatgaaattattggtctcaatgatctggttgtcaacctctacatgttgatcaaccaatcgcgcatataaaaggaagtggatgagtattaaccaatatcacaagtgtcatgtactcaaatgtaaagatcccaattaaatgcaagtgaaaaacttggatcaaatatgtcacgcccagaaattcactagtaatttccaaactaatttgtgcataaaatcctcgtccaggaatcagccgaggtacacaaactgacaatttaatatacaaatccatcataataataatgttacatacttacaaaagaaaaggaaaatagcagcggaattaacggtctagcgatggcttcagctccactcccacaggcagctcaactggagtataagccaaacatcttctccttctggatcctttttcttcaactgaggtttgatgattattgcaagaatgagcatatgacatactcaacaagccacacagcaaatatgcaaatgcacaaggataccaaaggatggcataatataggttcatttgcgaaagcagcattaagcaaacatttagaagtaaatcagtagagtaattaatcatcaattttaatcgacactgaacagcaccccaatgctgcacaggcccaaccaaacctgaacagccaaccccggtcgtacagatcaaacctccaaaccaggaattatccattccaaaccaggagtcaaattaattatcacattattaacattaatgagtaatgtgggactaatcacgaaaaacattgctcaactcacccataaccgcggacacggctattcgaatagttttactttgatcagaggtgtaccactgtacccacaagacgcaatcccacaacatgtcaccatgcgccttagcaccaccacggtacctcggaaaggaactgtgacaatacccctcgcacaacacaactcaccacagtgcaccgttcctggatcataatctccccctcaaaaccaaaggcaatggactccccagcgacccccatggacttctcgccgcttcacagtctggtgccccgtaatgaatcatgctatacaaaaggtaaagccgttgctcacactggcttgtggttggcacggtaaatgtttcacaacagtagctcgcgaaccggtccttaattgtcatgagcacgaccttcaaaaccatgtgctcacaacccaccttaatccagttttaattaccaattaatttacataacataacacgattaaccatcgtgagctaccattaaatataaccgtaattaataataatataatatgatttatatttaatcccctttaattagctaatgtttaagcatgactaagcaaacatacatatggcatttagctgaaccaatccaatatataaggtccaagctaatcaaattataacccataggaaaataaagtcatgttcggccattatttaattgggaaaggctcatcacccgatgacattcgaaaataatgcataagttgaaataaatcattagctttaaacgggttcaacatgttcaaagggttgtttgggatctgggtgacttgccttgagcttccgcaaacacttccgaaccttcctcaacgaaaacgctctcctccggaacgacggaaactaaagcaaatgaacaaaatcaacaaaacagtacaaaaacaatcataaacagtacatgtggatatttttaacatgtagatcttgattttagaaaaacttagcaacttgaaccactcgaatcggagctacgatgaattagttatgaatttccgaagttttaaactatttgcatctattaaaaaaactaaaaagaaaaggttatgacgtcatgctgacgtcatcaatgtcgactcgtcatcggcgacgacctcgccggcgctaggggactcggccggacttttggagggcacctacgcgtagaggagaacaacgcgatctcaccggtactaaccaatgcgacgaacgaccacggatggcgaccggcgacgagcttgtgcggcggcggcggttcggtggacggcggcggcggctctccggcgaccggtggcgacggcgaagggcggcggagcttcccctcttccacgcgcacccgacggcggcgtgaggaggcggcggcgacggctaaaacgacggcgcgaggcggctgttcgccggccggcgacggcggcggtttgggtggcgcggcggcggcactacgaggcacgagagagctcgggagatggggcaaacgaaagagggcgactaggggatgctatttataggcttggattgaagagatcggactccaaccgagaggatttgagccggaaaaaccgagggttagttggagagataaactcaaaaacgaattcgattccaggcacaggacggctggctcaggcttctgtccaagcttgaagatgaacagtgcccagggaagcaaactagactttcggctgggcttctacttccaaggactgattaaaggagggacacaaagcagacttcgggaaagagagggaaaggactgcaagctgagaggagactaggccgagagtgagaggactttccctaattcggcccgaaaaggaaaaggtgaattttaattacttttccaattaaattaatcactgaaatgatctttgaattgttaaaaatacttccaatgctcaaataatttcaagaaaaatcctgaaaatacttggacactcaaagtacttaacaaaattataatcagaccatttaatgattaatttaatatgtggataattactgaattgttctttgtatgattaaaattaagagttgagctccaaaaaatccgagaaaattccagagagtataattaaccatggagaatttaataaaaattaaatacatccatgctttatatttaggaaattttattttccacaattaacttcacttgtaaattaatgaacatttaatataaattctaataataatttattaaataatttataaatcctaagacgaaaatcaggatgtgacaaaatacatgcataactaaggtataggatttacccccctaaatgtatgcatacaatttttttgtgtgtgaagaaaaagtatgcataactagagataaaacatcgtgagcttaccctatacaagaatagaaggtatttatcatatgtagacattaaggtagaagcataccttcatcatctccatattctcaatgtgaagagactaaacaagatatggctcaacaaaacattagtctcaaatccatatgtcaatcacatgaaaatattatatatgaatatatcaatatgtgcatagagagaaagatgtgatttaggtcaatgcatttcatccttgtgatttaggtccacgaacaattaacatttctatttcaactcatatgaagtccgggaatcacctatcacaaacttcactttcatatccacatgacactaggcaaagaatgcttataaaaaaattagtctcatataattggatttatcattaatcaccaaaaccaaattaatagcacttgaactttcaaaagggaagaggttttgccttacatattgatagagcagagttgagggctgagcctcagaaaaaaaatatgtacaggacatggtcaaagagagctaatgttgaaaaaaccttgaatcttatggcttcattcatagagataactagaaagaaccttgaatccataatagagttgttgaaagactcacacatgttgttatcagcggagtcacaatttgacactagctggaagaatgccctgctccaatgctcaggtgtggtggtcatcatgtccttggctccttgaggggtgtcttgtgctagctttgctctattatagttgaaaagctccctacaagatgactttgcacagttttagatttttttctgaagcttctggtcagtgtccttttttctccagtttgcatatatttgccttgcacacatcctatgttctactctagtgataagctcagccactgcctttatgagtccctacaagacaggtaattcaaaatatttattacaacttaggacccattgcacattttgttaaaagataaatagttaaaaagcataccttttactggtcagaaattatcacccatccttcacctccatcatttatattgagatcttttttagctacccaagaaaccaataccatgaatcatatatttctttctccactgatgcccatgcaatgggatacatctaattattagcatctcttccaatagcacatattagctcgccattacaagcacccttgaagaaacaaccatctagcccaattactctcctacaaccagcaagaaacccttttctgcaagcatcaaagcatacataaaacctctcaaatactttcttgtcaagtatatctggattaagggtcacaactacaatactcccagggttgctccttaacaactccaattgataatcatacactcttgagactctcccctagttttatccaatgcttcttgtagcactaaggctttggcccgcttgcactttgaaatgggcacatcaacaagcatgtcctttagaactgacttcttaatatgttccactttccatgtcggattatccttgataacatcaaaatatttatttactatgatcctggatgtttttttttgaagtgaaagcggcaaaagatttgccggatatatttaggagattagaaagccaagtttacaaagttgagattacaaaatattcttaaaacaaccaactctagcaaggagccagatatatttaggagattagaaagccaagtttacaaagttgagattacaaaatattcttaaaacaaccaactctagcaatgagtacaggactttctcccttcatggaggtttgaaaaccatatcctgctcctgtatgtcgtcgaggatgagtgatattgttctttgtagacttggggcttgggaattgatttttttttccgttttgttgcaaccaaacatgccaccatgtctttaacaggattccgatccttgacctggtttggcttttaaggccagtggaccctagagaacacatccactgttagtggtggaaatgttaggattgggaataatccctttttcagcggcaattcttgcccatacctgcttgatgaagttgcattggcaaaacagatggtctgtatcttcaaaagcttctctgcataaagtacagatccagtcgcattcccagtgtctaattagcaggttttctgctgtaagagccttttgatgaagaatgagccttccaatttaggttgaaaatatgatcaatcaccgaacccatgaattggaagcggcaggcgcttttaaccgagaagattcatgaggcatttcttgtccaagatatttcatcatgatgttgatcagaaagagttatttgattgaggagggatcccaattgcactaattcatggatggtttctatattagtgatctgtctaaaagaatgtagccaggtgttgtctatcatttatgtttccaccttcctattctttatttttgccaatttgaagaggttgggagcaagatctttcgggcacaaacctggtaaccaattgtctttccaaaaaagagttttttttgccatctcctactgtgatttttgtgcatgcctggaagagttgtacatctcgcatattgcaaggcatctccatcagctcccaaggtctgcttgtatcaaacagccacaaccatcgtagcctaagcgtagatgtgaatttttccatttcgagaattcccagccctcccatgatgatcctggatgtgactagcttgttatctctcctaggtggacaacaatgctcattattaaaagtggccacttggaaccatttagacctacttgtctttgacacatatattagccatttacatcctggtcaatagcaggttgccctaaccttgtccctttcatcctttgggaatagaatatgtctgtgtgttgtcagcccgtacttcactagtgccttctttaactgcctacttgatctaaatgccatgctaagagagaacacaggaaatgatgccttttttgttaaacctattattagtgctcttccatctaattgtttctccttcactattctcctcataggagtagtcatcacttgagttataatacagactgccatcatcttctaagttgatattttcaggcaccagtgcatcatcaagtatctctacagcctggctactatgaactcctagcttccttgccctaatgtttctcttgattttctttgcaaatttcctaagttgttcagcttcttcatcatctccagagctatcttgctctataggctgcctataatcagagtctgaactatcttattttcaggtcatctatatcttcaggcactagtgcatctgaacctgaatcttcaggcttctctagaatttgagatgttgctcttcttggtttcaatcttcccttctttttatctttacatagaacaatagtaggaagtagctctgcctttgattctgattttgcttcatcatcagcttctgcaatgccatagccccagtcagcaatctaattatcatcttgcccctcatcagttgctacatgctcaatataaatgtctgcaacctgaccattattagacgtatgattttccatttctatgcaagcactgtcatcaagcaaaaaccttagcccatctgacaactgcttttcaggatatagccaatgcaagtgtaataaatcactaactagcatgtggtcaccgaggaaacctataatctcaggtaaagatatcttgtcgagctctatgtatgacaatgcggtacgctctgtcacataatgcaattgccccctagaaaacataaattccccaccatagtgaaacctgaccggaagaaaatccgatggatccattcttgcaaaaataagaaacaaaaataatcctaactcttgatgatattaaatgacaacaactagcaagatcatacgctatatattatctgaggcttctagcctcggttagtcttaaaaaaaccaaagcaagatcttacacccatagagcaaatttatgtgtcctttggtaccaacgtatgagctaatttttgtgttcataagccctaaatcctaaaatcatcaagacgataaaattaccgagaaattcacagagagtgatgagaattttactgcctacaacatagcactatcaaaatttcacagaaaaaatacataacccaccactaaaagaccttgtagaattagccctaatccttgaagagataacctgattgggaaaaaaaacatagaaacaggttgtggagactcacctttacctcaccctgcaatccaatcaaatggatctactccctgtcatcagcaggttgttcgcctaggagagagagagagagaggaggttccaaggagaacgaggagagaaccgctcatatttttattcaccccatcccccacacgcctgtcgatccactgtgccaggctggtcgagcgtgtcccgccagcggggcaaaaccagagtgcaaaaccactgtatggtattaattaaactgtatcaacaagattagggggttaaatagctggtttattaggtgagggggttaagtaatcacctggtaataggttggggggttatgttgacttaggctgtgttctttggtgagggttgggaaccctccccatggaaaacggagcgatggattagtgcatgataaattaagtattagctaaaaaaaactttaaaaataggttagtatgattttttaaagtaactttcctatagaaaacttttcaaaaattacaccgtttagcagtttaggaagcgtgcatatggaaaaggagggagtagaggttgggaacaaggaggaacggatgcagccttattccttttataaatatacacttagacaaacaaatatatctttttcttagcgcaagtgatctaggtgagatccgcgccaaagaaactagaaccaataacctatttatagaacaaattttatgaaaaaggttgaaatgtaaatactttttcttacaatagaccattaccgcaaaagagacttgcgctaagggcatgttgtagtaaaatatatttatattttaatccttttttaaaaaatattctacaaataggtacttatgtttcagtttttttgacaccgactcccttaacgtcagtgatttagctgccacagaaggcgacggtgttggtgccagtgcttgatgctaagacattgaaccttggcgctaacaactctagttggagaaaaatggtccattgctaaaataagtattttctagagatctatttgcaaaataagattttaaaaaggggtaaaatgtagaaaatccagacttgttacgctttgttacgctaggagccaaaggaaaagacaagcatgggaggccaaagcatgatctgtgacccaacgaccaagttggatggtcaatgcagccgggcaagaaatatggaaaagaagatttggaaaacatacttgaaactcacttgcagctgaattgttcttttgatgaaggcgaagcaactcgaatttcaacgcagacatggtcacaagtcagaacagaagcacatgtatggagcaggtcaactttacctactcggaatcttccaagtaggactatagcgacccaacagcaacgatatctttcatttctaatcattatctcatctaaatcgaaaagtctaagaacaaaagttcaaactgccgtctaacctcatcgagctcttcctcctgttcgagcgcagggcgatcgatcgagttgggaaacttcgaatcaatcgagagcgtcgccctatcgatccagtcagcgacgacaggggactggactaggcgattcacccacgatcgatccaccgggtgacgagtgagtctcatcctctccgagcttatcttctttgtcagtaccatccagtatccacccagggaggaggacaagatcttgatccatggagttggcgacgggtgcactgccaagcgtcatcgccaagctaggtgatctgctcgtcggcgagtacaatctgcagaaggcggtaaagggggagatcaggttcctccaatccgagctcgagagcatgcagggcgccctcgccaaggtctccgccacgccggccgaccagcttgatccccaggacaagatctgggccagggatctcagagagctctccttcgacatcgaggacaccatcgacgcgttcgtcgtgcgcgacatcggcaacgacaacggggacggtgaggccaaaccacggggcatcagcaagctaatcgatagaagtgtcggcctattcaggaaggccaaggctcgccatgggatcgcctctgagatcatggacatcaagagccgcgtcgtcgaggttcacgagcgtcgccgcaggtatgagatcaacattggtgctggtggtggtgataagactgctacaattgaccctcgtttattcacgcggtacacggatgagaaagagcttgttggcatcggtgagacgagagatgagctgatcaatattctgacggaagagaatggagtgtccatgcagcgagcaggcaaggtggtttccattgttggattcggggggattgggaaaaacaactctcgctaatgtagtatatgaaaagattagatcactgttcgattgttgtgctttcgtatcagtgtctcaaactcctgacttgaagaaattgttcatggacatcatttatcaacttgacaaggagaaatataaagatctcaatgaaaaaccattggatttggatgaggtgcagctcatcaatgaactcagagaattccttcaacagaaaaggtatatatggaagcacattccttccaccaatctgtacatatatatgatgttttttctcagcaactaataatttgctagtatgccatccatttcgtaatacttcctccgtttcacaatgtaagtcatt

SEQ ID NO: 61964 - DNA, 1080 bp, Oryza sativa
tgttcatggacatcatttatcaacttgacaaggagaaatataaagatctcaatgaaaaaccactggatttggatgaggtgcagctcatcaatgaactcagagaattccttcaacagaaaaggtatatatggaagcacattccttccaccaatctgtacatatatatgatgttttttctcagcaactaataatttgctagtatgccatccatttcgtaatacttcctccgtttcacaatgtaagtcattctagcatttctcatattcatattgatattaatgaatctagacatatatatttatctagattcattaacaccaatatgaatgtggaaaatgttagaatgacttacattgtgaaacggaggaagtactaattagcagtctacatactgttaattgttgagaatgttcatcatgtccgggttaaataaaaaaaaactacaactgcttataagcctttttacatcgttattgagtcggaattaaatagctatgtccaaatcttcttttcttgagtgaataatttatctctgttttggcaaagattcacaatagctagactagttttgcctacgaacttgctaatctacctggccccagtatttgaacttcccgttctaatttcattagtttttttcctaattaaggacttaatctatatgcaggtatttcattgttatggatgacatatgggatatctcaatatggaaaatgattaaatgtgctttgcctgataatgatgttggatacaaaatcattacaacaacacgtatttctgaggttgctgaaaaagctggtggtgtttacaagttgaaacatctttctttaaataactctcgacgattactatatggaagaatatttggtaactgtgaagacacggaaaaatatcctgatgaggagttggctgaagtatccgagagaatactaaagaaatgtgcaggtgttccattagctatcattacaatggctagtctgctggcttgtaaagcaagaaataagatggagtggtacaaggtgtacaactcggttggtactggtctcgagaatagtctggatgttaagaatatgagtaaga

SEQ ID NO: 61965 - DNA, 841 bp, Oryza sativa
cccgtcgcagcagtagacgagcagttagtaggcttgcgtgtgtgttcttctcgtttgtttttctgctagagtcgtatggggcatggttatgccggtgtgtggtataactgtgtcggagcctgtctttattttatttgcttaagcaacttgaactttaatggaccaatttaatagcagtaataaattcaagaattatggtagtcgtgggtggttagttttaattgtcagctctctctgtttgctggttctgggtggggttttcagatggtgacaaccaggagaagtgctgctaccggtgaaggcagtcaccccgaaggcagcaaccacaacaaccatggcagcccaccttcacctcctccccctccttcaccaccaccaccagacaccaacgccatcctcacccaaatcctcgcccagcaggccaacatgatggctgctttcctccaccacatccaaaatccgccacaacataatgctccaccaccacccccacaacactctaaactcgccgagttcctccgcatccgtccacctaccttctctagctccaataaccccgtggatgcgttggattggttgcatgccgtggggaaaaagttagacaccgtgcagtgcagtgatgaggagaaagtcatcttcgccgcccaccaactgcaggggcccgcatctctatgttgggaccatttccaggctacgcagccaaaggggcagcctattacttgggcccgcttcaccgccgctttccggagaacccatgtgcccgccggagtcatggcccttaagaaaagggaattccgagagttgaagcaaggcaaccgctccatgatggagtatttgcatg

SEQ ID NO: 61966 - DNA, 2204 bp, Oryza sativa
  unsure (1)..(2204): unsure at all n locations
nnnnnnnnnnnnnnnnnnnnnnnnnnnnnnnnnnnnnnnnnnnnnnnnnnnnnnttggataagtttgttgtggttttcattgacgacattctggtgtactcacaattagaggaagaccatcagcaccatctccgtctggtgttgggaaagttgcgggaacatcaattgtatgccaaacttagcaagtgtgagttttggttgtccgaagtcaaattcttaggacacgtgatatctgctaaaggagttgctgtggaccccgaaacagcgaccgccgtcactgattggaagcaacccaagacagtcactcaaattcgcagttttttgggtttggcaggatactaccggaggttcatcgagaacttctccaaaatcgctcgacccatgacacagttgttgaagaaagaagagaaatttgtgtggagcccgcaatacgagaaggcattccaaactctcaaggaaaggctggtttcctcgccggttttaatcttaccggatactcgcaaggacttcatggtgtactgtgacgcttcgcgccaaggattggggtgcgtgctcatgcaggaaggtcatctggtagcctatgcctcacgccagctacggcctcatgaaggcaactaccctacccatgatttggagttagccgcggtggttcatgctctaaaaatctggcggcactatctcattgggaatcgctgtgaaatatatactgatcataagagtttgaaatacatcttcacccagtcggatctgaatcttcggcagaggagatggttagaactcatcaaggattatgatgtgggaattcactatcatcctggtaaggccaacgtggttgccgacgctctatgtcgaaaaagccattgcaacactcttaacgtccgtggcattccagccaaacttaatcaacagatggaagccctgaacctaagcatagttggtcgtggattcttggctacgctggaagccaagcctaccttgctcgatcaaatccgcgaggcccagaagaatgatccggatatgcgtggactcctcaagaatatgaaatagggtaaagccgctggtttcacagaggatgaacacggaaccctatggaacggaaatcgggtgtgcgttccagacgacaaagaacttagacagctgatacttcaggaagctcacgaaagtccttattccatccaccctagcagtacgaagatgtacttagacttgaaagggaaatactggtgggttagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccagggcggttatgattctatatgggtagtcgtggatcgactaaccaaggtggctcggtttattcctgtgaagaccacctatgaagggaacaaactagctgagctctacttcgctaggatcgtgagtctccatggcgttcctaagaaaattgtatctgataggggaagccaattcacctctcacttttggaagaagctccaagaagagctgggtacccaattaaatttcagcaccgcgtatcacccgcagacagatggacagaccgagcgtctaaatcagatcctagaagatatgcttcgcgcatgtgtcctagatttcgggaagacctgggataagagtctcccctatgccgagttctcctacaataacagctaccaagccagcatacaaatggcaccctatgaagcgttgtatggacgcaaatgccggacaccgctattgtgggaccaagttggggaaaacaagtgttcggggctgatatcctgagagaagctgaagctaaagtcagaaccattcgggataatctaaaggtggcacagtcccggcaaaagagttatgcagataaccgacgccgtaatctggaattcgtagtggatgattttgtgtaccttcgggtcacgccattgcgaggtgtacataggtttcagacgaaagggaagctcgcacctcggtttgtgggtcctttccgtatcattgctcgacgcggggaagtcgcttaccagttggagctgcccgtttccttgggcaacgtgcatatgtgttccatgtgtcgcaactcaagaaatgccttcgagtgccgtccgagcaggccg

SEQ ID NO: 61967 - DNA, 724 bp, Oryza sativa
ccggccctcggtacagagtgatagtgcgtcttgcacaatccactactccttggaattgagccaaccaattcatcccaaggatcacatccaagttcttggtgtctagaagaatcagatccgagagaaaaggaattccctgaatttctataggaacggcatggctataatactttgctgtcataacccctccaggggtggtgatgagcagagggttcctaagcctttctacccccaactgatttctccccacgaatggcacagacataaacgagtgggaagctccagagtcgaacaaaatggtagcagggatggaatgaatggggaacgtaccaaagatgacgtctggagttgtcagcacgtcctcggccatcacgtggttcacacgaccccgaatgacatccttaccaccgttgttggagcggggaggcgcttggccttgctggcgcctcggctttgggcatttatccgcaaagtgcccaggctcgaagcagttgaagcacagacgctgctgaccttgagcgtcccggcggccttgaccaggctgcacagctggcgtaggaggacggggcgcacgagtcccttgctgactctgctgttgctgcggctgtgggacacgcaccacgaattgaggtcggggcgcggagcgaggttgttgctgctgttgctgctgcaaggaggatccccctggatagggattggtgtagcggaccctttggttagcccc

SEQ ID NO: 61968 - DNA, 1234 bp, Oryza sativa
  unsure (1)..(1234): unsure at all n locations
nnnnnnnnnnnnnnnnnnnnnnnnnnnnnnnnnnnnnnnnnnnnnnnnnnnnnnnnnnnaggaccagccagggtatacaaacgataattgttgacatacagatccacgtcttacaaaaatataaaagattacaaatgcagcggaaaagataaaacgagctaaacttggaagcttgacttctgcaacgggcgactccactccacaggcaacccttgacggcagcgacgaaaccaaccctaacaagacagctccaactaggaagatcttcagctctggtgtgggagaaaagagagcaagactgagtactacccactgtactcagcaagtcataccggaagaggaggtatgatgcaggatataaccaaaggaggctaagggttcatttgcataaagcaggcatttaaaatcagtagttgaaagcagtaaaaacaattgtagtaattaatcagtattaaccaatcactgtccaacactataccacgttgcaacaggcccaaccaacaatctgaactacaccagttcattaagctaaactaggggtgagactaatcacggtgaatctgattgatcgcccataaccgcgggcacggctattcgaatagttttactctggccagaggtgtacaactgtacccacaagacacgtcgccatgccccgaagtatcaccatgatactacaaagggggaaatcgtgaaaagacccttcgcataaccctccctaaccatccacactacgctaaggtttcacccccacccctcaaaaggcagtggtgaatccggagttgggcagtcccctcgtgcgccgcggtgaatccggcagctggacaaccggataccccgtccaacccaactccatcacgcccaccctcaccaccggtgcctaggaaagggtcgagctatacttcagatcaagcagttacccactcccgcttgtggtaagcacggtaagtctcccagggtttccagcaaaccggtccttaattgccatgggtgcgactagcaaaaccatgcacccacagcccaccattcagtgtattttaattaactaacaccattgcggtggcaccaatacaaagctatgctaatagtcaaagtctatgtaataatgtgattcccatttgtgtactacttgagctaagcatgactaagcatttcctaaaccaacatctagtcattttgacacccaaattatcaatggcataaggtaaacaatatatggctgagtaataggact

SEQ ID NO: 61969 - DNA, 938 bp, Oryza sativa
tttttcccaaacccagaagaggagcccctggatgaggaaggctttggtgtctagctcgtgcctgccgtcaagcgcctgtggtcgtcgccctagtcttccgctgtttcccgtttgtctttgtgtgtgctgggccttcgccgcccatgtaataaattaactatttacgcttccgcttgttaaactctgaactgtgtcaacttttggtgtaccttacctcccgggacaaggaataatgcacacacgtaaggaacgcccgttgggttaattctggtcgtgacaatgcccatgcacaagtgtcacacttcaggttgtgtgcggccaaaaatcctttcttatttgtaaaaatcctttagtctctctctgtcctgctgcttcatttatcgtcaaaatctgatctttaaaatgttgcttttctcttttgtttgaagatggccggcagcatcaaccgtcgtggtctggacctgaccggcttcgttttggagctgcggggcatgtgcgttgtcttagggtattcgcatggagtggactaccagggcaagcagctcccggagcaggagggtgacgatgcagagccccacgctgcttgggaggttactgtagtgatcctcactggctcacccgagaggacttcgttggcagtcaccgtgggtggagattctttctccgccgcttgccagaacgccgctctccttgccatcggcactcttcaccagctctacccggacgagttgcagcactcgccctaccgctaccaccctcgccgcggaggagcccgcgactacgccaccttccgggatgctagctcggaggatgacgctaccatcaggcacctggcacgcatggtggaggcgtacgacgcggcccgtatcgacttccatcagatggtgcgtcgcgggttggtcgagaacaacatgaagatcctggagctgcgtcaggag

SEQ ID NO: 61970 - DNA, 1582 bp, Oryza sativa
caatggatctccattcaccataatgagatttttacaaaatggtatgtctgttacatctccatactgacattataccaaaaaaatgcacatgaactaagattttttacacaatccaacttttctttctccaaatataacaaggtcagaaattagcatcactaatcactgatccggaatcaagaatcccagctcacttgctctgccatcttaatcagtcgctccaaattcctgctcacgcagaaagtaggaacgcggccaccacatgcctcacctcatggccgcctcgacgcgtgccctcaccatcgcagccacctcgctgcttgccgtgccagtgctacatggtaaaaacgccagcctgctcctcctcccttctggcttgggagctcaaccgcgccagccgccaatcccgcaggtcctaggagccgagccccatgtctatgaagccattgcagagcgacaactggtgcagcggccatgaaagtggctgcctgatccggcgacgaggctcccgtcgacgttgacctcggctgttccttctacttcctcaccggcttcgtccgaccgtgggggatcgggagcagaagggcatttgagaactggagaggggtagagagatgattgaggaacaggggcgtccacactccacaatttccccatggagatgaaggggtcagtggatgaagggcattttgggaaggacacggtacaaagtgcaccatccatcagcaattccgcagcgcctaaagggaggaaagcaggcatggtacatcctattatcatcagtcccaagattcgtgcaggggaatggagggtgtagattgcgagtgcatgtgcactcgggtgcaaataatccaattcctatatatatatatatatatatatatatatatatatatatatatatagacataataatccaattgtgagtaataactaaaacactccccctcacaccctacccccacctagggatgaaaacggagcggatagtttccatccgctccggataaaaacggatacggatacctttcggatcggataattctcggatatttcatatacggatacgaatacgaatattttctcccggatacgaatacgaatatggtatcagggtttccgtcggatacggataataattcggatatccggtgaacagtgttattcggatatccgcaggacccatgagacataccccatttctttctaactctataaccttcaatatacctttatagattttaatagtagtttatctcttaacattagtccatactattaatattatttaaattttaaaaaatatttataaattatacctcattttatataaaatgagctaattatatatgttgatatttatttctattagaagttgagttggttttcgtgttccgagaaaaatttgtttccgtattcgtgtccgatcatattcgattcttattcgtattcaagataatccgtatttgtttccatattcgagctatccgtattcgttttcgtatccgataaaaaatatgaaaacgaatatggtatgagcattatccgtccgtatccgctcctttttcatccctacccccac

SEQ ID NO: 61971 - DNA, 1876 bp, Oryza sativa
tgttcttgattgatttgcttggctcagaatagtccaaggctctgtccttgtttctcttcgcatactgattcctggttaagaatggtcttcgctttgtgcactcgttcttctgtctccacgaagaaaattggctttctcaaaaacctgcaaaactggaaacaataaaaacgaaacgaattgcatatgattattatgttgctcgcaaacggaatagattgaatcagcacgattgatggatacagtacatagtccttgcttgtctctgactttgctctctactgataggtacagatgagcctggaaagcaagtcgatctggagtgctgtcaagatcaagaacatcagcaagtctaaatgtagcatttaaggtaattaacagagctcctctctgatggcttcttcatcaaattaaatgctaataccagtggttttgcaaatgatggtagttaccagtaactcagtaagtagtagccagcagtccagctcctgttaatttcaaagatgctgctcggattaatgataacatcaatcctctcaataactcaggttgaaggtgaactgtattttaggatgaaatcaatcctctcaataactcatattaaaggtgaactatattttaggattatctgtcaatttagagatgttcatattttaacagatgactatgtattgatctccaccataaaaatctgttggttcagtccccacctacactaatttgatggctactaataaagcactaatttgatgcatgccttttgttctggttccaaataacagcaccaaagagttgcttcataaaacctccaggtggcatacttgttctagcagtacaaacaatttcagcttttcctagtttagagatttgattctggcatgactggtatggggaatatgattagtgcttggcttttgggctatcggctcataagtcttcggacaacatttaattgataagccaatagtttctgaaattttctatttgatgtgctagtagattcttagattttctagttgatattttattaggctattagcttctgaaatttcctagcttggaagagtattacttgataggcaatacagttctctgaattttttttgttcacacagacatgtgcagaagtgataattttttaatccgtccagtggttgctctcaactcacctgttgatttgcagtggttattgctgaatgaaagatgggagaattttcgttcagagaaattatattcagagttctgagtgtcatgttctctcagtttgcaagtacatgcccttctcataaatttttagtttggtcggctggacaatttgatacttacagttgtgtcaaaagctctgaaatgttatgaaaattatggggtttatagacaaatcatgctctaaatgtcaattagaaatatgtcatttgcaaatttgtgtgtgcagtattctgagaaatctgctctcatctgaattatcatcatcatgttctctcatatgttggcgggttccagggtgaaggttggatcctcggtggagcatgccgatgctaccgactccaccatggatgtagctggcagtgggattttgacgtcgaccgtgagtcttcggcaccggcgatggtatttggcgagttgggatgtactcgcttcatctcaatatgtagcaacctcttccagatttgtagttctagtattggtttaatctcatcctagattgtaacatattgcgacggagggagtagtcattggttacaatcttcttgattttttttatcaaaatgaatatgtgtatgtctatttcccatctgtaatttttattggtaaggaaccagccaacaccgtaatatggtattcatgaggggtaggatatataatttgaaaaaaaaactct

SEQ ID NO: 61972 - DNA, 1032 bp, Oryza sativa
tgtcattgggattttaaaaatcgaatgtaataatcgttcgggtttattttttactttttagaagtcccgccaaaccgttagtggctttgccattgaaatcctctatggcttatctgctgcctcccttctttattgtcattgagattttaaaatcgaacatgattatcattggtttttttttactttttagaagttccgaacctttaaaaattggaccttctagtttttagagtttattgtcttggtgggtttcaattttcataatttttagaagtcccgttaaacgatgccactatactcctttacggcccacccgccgcctactctttattatcattgggattcttcgaacataactactgttggaattcattttttattttctagaagtcccaccaaccatcggtggctctgcgactatactcctatacacccagcccgctgcttctcctttttattatcattgagattctaaaaatcgaatatgattattaatgtggtttattttttttactttctaaaagtcctaccaaccgccttgtccgtttccttcacgacatacctgttgtcccttcttttaatcgtcgttaagattctatttggtgtttattaacagttatatgtcgtatcaaccgccaccactctactctcttataggcatgttacttaatttatcttgtcatgtgttttaggtggtcttttctttcaatagtccttattttctatcaccaattagttatcaataaattgtattccttatggaaatttttttttctttttctaatttcagaatttattttttttttcaaattttaaccaatactgtatattgttcttttaatatttttatttttcaattccagttgtttcaaaattgtattcctactcaaccctcttttactttttttatattattttattttttattcagaattttaattaatcttgtatcgggttcttatatggattcttctttcaatattgcttatttttaatttcgaatttctgttaattttaaattgtattcctact

SEQ ID NO: 61973 - DNA, 5430 bp, Oryza sativa
  unsure (1)..(5430): unsure at all n locations
nnnnnnnnnnnnnnnnnnnnnnnnnnnnnnnnnnnnnnnnnnnnnnnnnnnnnattccagttgtttcaaaattgtattcctactcaaccctcttttactttttttatattattgtattttttattcagaattttaattaatcttgtatcgggttcttatatggattcttctttcaatattgcttatttttaatttcgaatttctgttaattttaaattgtattcctacttgaactcttattttctttttgctaattttagattttatttttatttttcttctgaatattaactaatatcgtattgggttcttgtattgactcttctctcaatatttcttatttttaattccgaatttcagctatttttgattttgtatttctacttggactctacttttctttttctctgattaatgtgggagtttctctgattaaaaattgaacataactatcattggaatttattttttattttctagaagtcccgccaaccatcagtggctctgcaactatactcctatacactcaacccgctgcttctcctttttattgtcattgagattttaaaaatcgaatatgattatcaatgttgtttattttttttactttctagacgtcctggtaaccgtctagtccatttgcttcacgacctacctgttgtccctccttttaatcgtcattagaattctatttggtattttattaacagttatatgtcgtatcaaccgccaccactctactcctttataggcatattacttaatttatcttgtcatatgttttaggtggtcttttctttcaatagtctttattttctgtcaccaattagttatcaataaattgtattcctaatagaaatctttttttctttttctaatttcaaaatttatttttttaaaaaaatttaactaataccgtatagtgttcttttaatatttttatttttcaattccagttgtttcaaaattgtattcctactcaactctcttttactttttttttaatttttgatattattttattttttattctgaattttaattaatgtcgtatcgggttcttatatggatccttctttcaatattgcttatttttaattacgaatttctgttaattttaaattgtattcctacttaaactcttattttctttttgctaattttagattttatttttatttttcttccgaatattaactaaaatcgtattgggttcttatattgactcttctctcaatattagttatttttaattctgaatttttatttgtcttccgaatattaactaaaatcgtattgagttcttatattaactcttctctcaatatttcttatttttaattccgaatttcagctatttttgaattgtatttctacttggactctccttttctttttctctgattaatgtgggaatttctagcccccacagtgaacgtggtgccttctttcaaagctgttttaataatataatagatattgtagtaacacggaacatgtatgtagtagtaacgatacttctacagactacgaatgttgttactacgagcaagtaatcatatgttagtacagtatggttgtcttgttactgtgcaattcctgcgagatgaggatacgaaagaggtgggcgtggagggaagtgagcaacacaaaagatacataatagcaaactaaacacaagtggattatttgaaattctaatctttaaacaatcgtatctctcgcatcatatataatatttttgaaccgtttccaccataatgctttaaaaaaaaagctttacaaaactagatccgtcatcactatattttgacaacgttataatattgttactgcaagaaagtaaccctgttactgcacgatggtcgtcttgttactgctcctgcgagacgatgacaacaaagaggtggacgtgggggaaagtgagtgggcgggtttgaccgaggtctgaccggggggaggatgctttgaccgacctttgaccggggtgggaggggggtttcgggctctagggagggtggggaaggtgggtttgacccatgggaggggggtgtagaataattattctaggggaggggtgtagaatagattatatatatatatatatatatatatatatatatatatatatatatatagagagagagagagagagagagagagagagagacgtttatcctggataatcctgcagtcctgccaatcgcgctcaactttctttttcccagactcaatagttgagccttttttgcatgataaaagaatcatttctgagatagattgcttggttttgtttttcgacccatcatggttttatgaattggaaccatagttggttgattagcagcacatccctgaacataacaaccatgaaaatagcagaacacacgctccaatatatttttagaaagtgcatatctcggctggaacaacgcacatcagctattcccaatttttcttttatatgctattcccaatcttctggatacatgattattacctgctcgatctcagtataagcagcagtgtctaatcactgagacatacaaagtgcagcagttagcctttgtgtcctctgctcaccttttccttgtagttgcactttggaaggcattgctcaagggttggatagcacagctggtcctttgaacagcaatagaacccaccggcggtcacggcgcaaacattaagtttaactccaatgctggctgccttttttactcccatcaacatattgcttccgatcttgcttgcagtttgacctagagatgcaaggagtcattatgtttatcttgccagtgcaaacaaaatgatgaaacggcatatgaatcacggaaaaatgcaatctaattttctaattacctcttgcttgtgtaggaatagaagagcacaccacaagaaccaagaaaaagaacaggaccccttgattggtgtgcttcacacattttgccattgtgaaagatatgtttactagtatgttctatatctgtcttgttgtgactaatgagtgtgaaaaagtatagcagttatatatcgaagaagactagcgtgtcaaaataggtgtatgtcttatccttgaatccctaagtaatctgctattaaagccacttctaaatatgggttttgaaaatggttatgattaattgcctgttttatgacaagaaaattatagctctagcatcaaacaagggaaattatcctaaagtctaattttaatagcggctaaatatgtctgtgtcttatcctaacttgtattatcactaatgccattcattaacaatgattttcaaatgggcatatccatacttttctgattaatgatcataaattaatttttattttggtattaaatctgctaaattgtcctaaagtctaattttaatttcacttccaaacatgtactgtcaagctgcttctatccattgcactatacaatggtcttctaaatcgttcgtctattcatacttatattgattgggtactttctaccgatttttttacaaattgacccttttagaaaacttatttcaagaataaactatgccaaaaacttattgcaaaaatagaccgtcagctcagcgccatagagattgacgctgaggtataacggtttagcgtcatagatattggcgctgacatttcatccgacgtggcaaaaatttgacaggtcagaaggggtcagcgccaatgtacttggcgctgagttattggcaataaaaaaaatctacagaacactctgctgcatgtacactgctggtggggtggttagatgctactgctcttacttttttcaatgttttttttctttcatcttttttcaccaaatcctactcggtactaactcttgttttcttttgaaactacacattttccctggaactatatattttaagtattaaatgctatatactacatgctctcgtatttttattatggttttttcactcctaagtatggaaatatgtactatataatttatgttgacatttacctcctgatgtttattttaaaattatcatgtcttatgtttacgtaatgttcttgttctaaacatgaaacataggaaatgttaaatgccgtatactttcaaaattttatgaagatctttccctttgatgaatataagtattaatgctatacaatatatgttttcaaatttcgttgttcctaatttgtaagactaatataatattttatgaattagaaactaataatatagtatacgtattattgtaatcaaagattaactacaaattagatatttgtatttcgttttttgttaaaatataataatttgaaaaatatataagttaataatacttaaatattctgtaatatataagattggtagtaaacaaattatcaaacattacacaacctggaactcgaactgtggaccatgaactgtggaccatgaggtgagatggtaggcttctagccgccacacgaagcgagcacatttgactagtttgatccagcaaactactttagatagccaatatctcagcgccaagcaagccagctctgaccccttctgaccttggcaaatttttatcacctaggatgaaacgtcagcgcaatatatatggtgctaaagagttatatttcagcgtcaatctctatggcgctgagtcgacggcctatttttataataagtttttggcatggtctattattaaaataagttttctaaaagggtcaatttgtcaaaatttcggtacttttttggagctctcatgttatctagaaagatctaaccattgattagaatgtttgtatataaaattgagctcatctttactgactaacatttgctaacaaaactaatctttttgactgaaatttgattacagaactagcctatgttgactcaaatgtactgacagaactaattattctgggtgctgataaaactatacagatatgttggtgcctaaaattgttagaggcacacaaaactaagcattgattagttgacatttgcacatattttcagtgaatcaaaatgacctaaatagaactctgaaataattatagtgaaaaccctcctgaatttcttcaggccaagaacaaaaatagtgaattgtggataaatgatagaaattaaattgttgttgataaaacctaaaatcataaagtagtcatcaagggcatccccttgctctaattccacaaaatccatgtattgttaatgcatatatcaaggatcgatattcaagcaggtcttgttaataaaataatctcaagaatatcgaacagaacaaatatgcccccattgccagtacttggaaatgcttaacccttccccaaccctgttgccagtactggtacttctacacatacaaatcagcatagcacaaaaaagataatagaatcactaacctaataaaagatcaaatacatcctccccaacaggggcggatccaacgt

SEQ ID NO: 61974 - DNA, 1776 bp, Oryza sativa
  unsure (1)..(1776): unsure at all n locations
ccaccaccagtggaagatggaaaaaaaaaaaagtaaaaacctgaccccccccgtcgaacaagggtggaaaaaaacagatccaacccgaaaatagctttcgggcccgatgaaagaagcgctaatcttgaagagattggacggctggaaattcgagtgcgagttagagaaaaaacacgccggtgatgtatagcaaataccaataattaatatgtattacctagaaactcaaaacagtaagaagaatntagcccgtgtttagtttcccctgttcccaacttttcattacatcatatcacataaaaactttcctacacacgtaacttttaacttttttccgttaactctcactttttttaacttttaactttttcaagaacttagcacccgttatatcaatttcataatagtaagaattttatggaggtatttgccatatagtttggccagtccaggacctagacccaagaagttcccggattaaattagaaccaaaatgtaatggtcgcaatattagacgaaaagcgtaagtggtaaatatgtaagaagtaaccgcttttaatcccctgtgaatggtacatcaaacttacacacagtggcacagggttattatgacttccttattttttttttttagggagcactcctcttctaaatctaaagtgctacctccatttcaggttataagatttttgattttagttaaagtcaaactgtttcaagtttgactaagtttatagacaaatatagtaatatttataatactaaattagtttcatcaaatcaataattcaatatattttcttaataaatttgtcttaggttgaaaatgttattatttttttctacaaacttagttaaacttaaaccagtttgactttgacgtctcataacctaaaacataaaacggaaagagttgtcgctacttcaaacttcttgtgatcgtgcaatttctcgatatacgcctccttctccgtaggttccttgtccttgagctcctcacaatcttcatgcatcttcacagtatgttgccgatggtaaacctttgttgggtccacatagccaactggttttctcaacctttcagcgtcgtggaagtgtgacttacagacaacagctagcttgtgttctagttacttttgctttattgtataaaaatataataaatactttattgattgattaagatgtatctttttagttgtcttttcataaatatatttatatgtatacagtagatattaaaaatatgtacactacaaatgtaataatattattttaacttattataatgtcagaaggagaggagtattttttggaacattaccaagacttaggttcatttagttttttcatcgtatatccagtttaattattattaagttatatacggtgataaaatctattcattattttttctcataattttataattttttgaatcggacacaaaggtcggaaaatataaccaaaagttacatatatttttaaaagttgaattatagtgaatgtggacccttaaatgtaaaattatataaagaatgcggtgcgtatgtagacatggaggtcttttgattaaaataacattatttatataatttagatgtcatagctgcttaacttttttgcacaaaatttgatttctaactaatatattttgggaacattacttctgtgttctttgctaaacggtatgtttttttaaaaaaaaaaatctatacgaaagttcctttaaaaatcatattaatccattttttaagaaaatagctaatattaaat

SEQ ID NO: 61975 - DNA, 1167 bp, Oryza sativa
agtatgtcatatactcaccttgcaatcattcatcagaggaagagttctacagagatgctgatggtgtggaggattagacgtagccctggtcaagttgcctgtggagtggagtcgtctgcgccgtttatcttattttccgctgcttagatctttattgattgagaggaactatctacctctgtaatgacattttattcgcttattaattagagtaataatggtactctattatcaatttgttattgtgtgcctcggctgattcctggacgagggtatacacacatgtaagcgtttggaattttggatagaaattccgggcgtgacaagttggtatcagagcctccttgaccctaggttgtgccaaatggttacccatagaagccctctaaaaatattggaaaagtagaactgttctcctccctttctcttttaattaaaccaaactaatggcacatgcacttcataatctcttttaatggttctcattcaaaatttattccagtgtaattagtactgtacatctattactgtactaatggctcattttaccagcaaaagttttacaatattgctttatttaatcttgctgcaattaaataaatttcgcatgttaatttataactttcttttatttcttttggaacctgttgttcaaaagtacaaaatttgtggccttgtttccaactgtttcaaattatcctgcaagtttggtttactttttactttgattttccaactttattcaaattaatccaaaaacttgtgctattaattggataaatgtcttaactccctcctttcatttgtctttagatgccgcgctacaagcctgagtacttgtttggtgttgagggatttgtccaagagttgtgtacgatgtcctttgccataggatttgggactgcccctttttatgcccagattcctcatgatcgtcatgaagagaagtgccgagtcaaagtcactttgaacagtaatagtgatgaaatcccctcagtgatgttcgaagctggaggaagaaactacatccatgcgtgtcaggaggtggcaaggatcgccataggagagctccgcgatcgctattgtgatcagttggccgacactgagtatcgctaccatcctcgccaaccacagggaagtgatcgtggcagctaccttgagactgaa

SEQ ID NO: 61976 - DNA, 2608 bp, Oryza sativa
catttggttgagatgctgtgggctatggatgaaacccgtgcggagactgtgttagcagctcaagatcgtgaagaccggaatcgtggtaagatttgcaagctagaggacaaagtggatcgtttggagaaggaactagccgcattgaagggagaagcaccaccgcagaaggccagggttcgtcttaccgcaaggaagagagctctatttgtccctcgttaccaattggcgccaaaggtccgtgtggtggagaaagaagttaccccagccctagcagatcctccggttatcattataagtgatgatgaagaagaagaatccaagcacgcccattacaagatcgagtggggagcaactcaagatgatgaagatgagccgaacgagccttcaatcaactccgatgcccggaagacttagaatgccttgtcaaaccgttgtcttagatcgttgtgttagtttgcttgttttaagtttggttgtgtgtgtctcgcatgtgatttacatcagtggtgggatgtaagtgcgtgcgtttgtttgctttcgagtgttaggtagttggtgagttcagtggtgtgagaatcttcagttttgtaataatgaaactcacttaagatcaataaaagctaaagtaattctcggtcctaagtagttttccccggtttctcttcttgtgctcctgtccatgccagatggtgctcactcgtagcaacgggaatggccccaacaacaacaacaataacaacaacaacaatggagagaatcccacacttgcccaagtcctggctcaacagacacagcttatgaacataatgatgcagcaactccagaaccagcagaaccagggaaataaccatgcacctccccagaacaagttagcagaatttcttcgtgtgaggccgcccactttctctagcaccactaatcctgttgaagctggtgactggctgcacgccatagaaaagaagttggatttgcttcagtgcactgatcaggagaaggtctcatttgcatcacaccagctgcatggccctgcctctgaatggtgggatcatttccgccttaacaggactactactgaacctatcacttggcttgagttcaccgctgctttccggaagacgcatataccatcgggagtggtgtctctcaagaagaaggaattcaggtcgctcactcaagggtctcgctctgttacggagtatctgcacgagttcaatcgtctggctcgttatgctccggaagatgtgcgcactgatgaagagcgccaggagaagttcttggaaggacttaatgatgagctttcttacccactcatgactggggattatcctgatttccagaagttagtggataaggctattcgtcaggaggacaagtacaaccgcatggaacagaagaaacgtcagattgctcaattcatggcacaacaggggaatagtcagaggccgcgtcttactttaggaccccagtccatgcctcagggaggttcttcgtctgttgttcgtccgcagcgtcagttcttcaacaacaatgctggcaacaacctccgtaatcaagctccacgccctgttgcagctccaacacagcaacagcctgccaagagggagcaaggcagcaagcccgtggtgtgtttcaactgtggagacccaggacattacgctgacaagtgtccgaagccccgacgcgtgaaggttgtccctgcccagagcaactctaccgcaccagcatcaaaggcccgtgtcaaccatgttgctgctgcagaagctcaagatgctccagatgtgattttgggtacgttccttgttaacctagttcctgcaacagtgcttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattcagggagtaccatttctggccaatcttatcctgttagaatccaaagaccttgatgtcatcctagggatggactggttagccagatataagggtgtgatagactgtgctaacagaaaagtaactctcaccagcaatgatggtcgagttgtaactgttcatgcattgtcttctgagtctttaaggtcaagactgaaccaaataactttggaagaaattcttgtagtccgggagtatcctgatgtgttcccagacgatttacgtggtatgccgcctaaaagggatatagagttcagaatagatttggtaccaggaacaattccgatccataagagaccttatagaatggcagccaatgaattggcaaaagtcaagaggcaagtagacgaaagaacgacagttgccattggagttatgtaaggaatttgaaagattaaatttgggaattgtcagtagaggttttgttgcggctttagaagcgaagctcactctaattgatcaagttagagaagcccaaattaatgatcctgatattctagaaatcaaaaagaatatgagaagaggaaaagctatcggtttcttggaggatgagcaaggaactgtatggttgggcgagagaatctgtgtccccg

SEQ ID NO: 61977 - DNA, 3862 bp, Oryza sativa
  unsure (1)..(3862): unsure at all n locations
nnnnnnnnnnnnnnnnnnnnnnnnnnnnnnnnnnnnnnnnnnnnnnnnnnnnnnnnnnnaacataaataacttgcaacccacatctcttagttagcacctaatgcactcctcccatcaaatcccgactaactgttaaataaatctcaaataattttactaaaaccctagactgacctgatttgacaaatctcacttgaacaagcgaccaagatttttcccttgaaccacaggaacaaatccaattgcaaagaacgtgtgcaatgaaaaggattcagactcttaggttttccatttggcttgtactacaatcaaggtcggctctgataccaacttgtcacgcccagaaattcccgaataggattccaaacagaatgtgcgttaaaacccccgtctaggaccggccgaggtacacaaacgacaaagttgacaaacagatccacgtcttacaaacatcataaaatcttacataaatgcagcggaaaattaaaagataactggagctaagccttgacttggactgcagcgggaacaccactccacaggcatccttgacggcacggacgaagcctactcctcggagaagccaccatctaacgcatactcaaactctggggtttggggaaaatagagcaagactgagtactacccactgtactcaacaagtcataccggaataggggtatgatgcagggaattaacaagggatagctatagaggttcgtttgcatagagcgagcatttataaatagtagttgaaagcagtaaaacagttgtaataattaatcaatattaaccacccactgtccaacgctaccccacgttgcaacaggcccaaccatccacctagactattcaattccattagactagacttgggtgagaataatcacggtgaatctggttgaccgcccataaccgcgggcacggctattcgaatagttttactctgatcagaggtgtacaactgtactgtcacaccctaaaaatccaaaatatataaattgtcgtttaattggaattattagaatttattttaaaagtctagaagagaagatctaattttaattaataaattccaatataaaatgggaccagataaaatttcattaaatactttgcttaattctataattcctagatttttttgggatttatttgagctaaggaagtatttttaataaatggaattgcatttcatgaataatttaaattgaaaaaggattttaaaagtctcttttggctttgggccgaaagtcggcccaaaaccgctctctctccttctcggcccaagtcggcccaagtccagccgcagctgccctcgcgcgcgctcgctgccgctgacaggtggggcccacctgtcaggcccgtcgtctacctctggccgccgccgcccgaaaccctagcgccgccgtctccttccaaatccggccgcgtctttccgtttccggtgaaatcaatagaggggaaatgatcttcgggatctcctctaccttttctcttttggaatccccggctaaaatcgtttggaaagtgttggtttcgaggtcgattcggattggtctctctctctccgagccctaactttccttctcgtcgccggtcgccgtgggccctcgccgccgcctccttgcccctataaaaggacccccggtgtctcctctacccgccgccacccttgctttcgtctctcgccgtcggaagcgccctaacgccgtgcaaccttgagccgccgtcgtcaccgtcgctccagccgtgcgccaccgccgttccggtcatcgtcgtcgctcggggaggtcgccattgtggtcgccaagtcgtcgccgtcctcgtccgccccttcgccgctgccgaagaccgccggagcaccgtcgccgtcgtcaagccgaaggtcgccgccgcttcttcttcgtcgccgtcgccgtccgttgctcttccgccgacgttttggtcaccggtgagttcgccgcgtcgccctctacgtcctggtgtcctccgttcatgccgaagcgccgttgttcgccggcgagtttgcgccgcccgagccgccgccggtggtgacgtcatcgccgatgtcatcggggccgtctgccgtgagccgctgtagacccgatcgatctcggccgtccgttttggatggatcgatctcggccgttcgtttccgtgaaccgtcgccatgcgcccggtccaccgaaaaccctagccgctgacgcaataaatccctttttccttttcaaaaataattcattattgcgtcataattcaattaaaatccatataagtgttttaatccgatttaatcttcaaaaattcataactaattcatcttagctcggatttagttggttcaagtctctaaatttttctaaaattgagatctacatgttaaaaatatccacatgtactgttcatgcttgtttatgtgctgttttggtgattttgctcttttctgcttagattccgacgtttccggagagtccgttttcgcaggagaagaatttgaagaattctaaggccagcaaggcaagtcacacagatcccaaacaaccctttgagcatgttgatcccgtttaaagctattgtttctattcaactattgcatttattttcgaatgtcattgggtggaattaacctattgtttgttatagcccttttgttcttgactactttattccttgataccttgggttattataacttgactagttgggctttatatattggttcaactagatatattagatatgattgcttagccatgcttagaaacattagcacattactgggataacttatgactcactattatttaatgatggcttaatgatagctcacgatggtcaatcgtgattggttaattaattaatgtgccaattaaaacctgataatggtgggttgtgagcacgtggttttgagagtcgtgctcatgacaattaaggaccggttcacgagtttcggttgtgaaacattaaccgtgccaaccacaagccagcgtgggcaacggctttaccttttgtatagcatggtttattgcggggcaccagactgagaagtggcggagataagcccacaggggtcgctggggagtccatgccttgtttataagggggtgattatgatccaggaatggtgcgttgcggtggattgtgttatgcaaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacctctcatcataataaaagatgttataactggtaataatttgattagcttctggtttggaatggtatattcctggtttggagatagaactgtgcagccgggatggttgttcagaatggttgggcctaggcaacagggtatgttgtgtagcgttggattaatactgtttaattaatacttaattgttttatcaatttctgaaatatttgttaaatgttgtttatgcaaatgaaaccctactatgccatcctttggtatccttgtgcacttgcatatttgctgcgtgacttgttgagtatgtcatatactcaccttctacaaaaggttacaattgattgatctattagatgttccaaacaaatatatttttttaagtagcctccttacatactatagaagtgtgtttatatttcaagatttttattttgcatgtattaaactgtttgcagtaataattttctaatgcacttttttatgccagcttcgtgtggaaatgttactgtacaaagaatggacccaacctcgcaa

SEQ ID NO: 61978 - DNA, 1005 bp, Oryza sativa
  unsure (1)..(1005): unsure at all n locations
gcaccagactgagaagtggcggagataagcccacgggggtcgctggggagtccatgccttgtttataagggggtgattatgatccaggaaggtgcgctgcggtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtttttcgtgattagtctcacacctctcatcatgataacaaatgctttaaatggtaataatttgtttagctcctggtttggaatggtacattcctggtttggagataggactgtgcagccgggatggttgttcagaatggttgggcctatagaacagggtatgttgtatagcgttggattaatactgcttaattattaactgctttattaaattctgaaatgtttattaaatgctgtttatgcaaatgaaaccctactatgccatcctttgttatcctgtgcacctgcatatttgttgcgtggcttgctgagtatgtcatatactcaccttgcaatcattcatcagaggaggagttctacagtgaagctgatggtgtggaggattaggtgtagccctggtcaagttgcctgtggagtggagccgtctgtgccgtttattttattttccgctgcttagatctttattgattgagaggaactatctacctctgtaatgacattttattcgcttattaattagagtaataattgaactctattatcaatttgttattgtgtgcctcggctgattcctggacgagggttcacacacatgtaagcgtttggaattttggatagaaattccgggcgtgacaagtggggtgtaacatcccggtctagggcttaataggattnnnnnnnnnnnnnnnnnnnnnnnnnnnnnnnnnnnnnnnnnnnnnnnnnnnnnnn

SEQ ID NO: 61979 - DNA, 2373 bp, Oryza sativa
gtcgccatcaacatcaacattggcttgtccttcagacattgccgtagacccagtgggtcgagcggaatgattgtttaaaataatctcattcggcctttttgcaactaaaaggactgaaataagctcagactactttgagttcttgtattgttgttgaagcaccatgcatgttgttggggtggtaggtggataactttttctcaatcatctcagtatcagtgatcttttggtcacataaacataaccaagcactgatccaatatagggcagagttatacgccactataaatttgtagtcttggaagcatagggtgattaggccatgttgtgcccatgggagcaaaattgacccttgatggtcgcagcgatccttcagggattgccataataccagtggatcttcctcggtcatatactcagacttcatctctgggtggagatggtggcacaagaatgcaattcctttgctttcttcgcctttgtaggatcctctgtgccagcttcgattagcacaatagtatgaccaagacccatggagtctagcttaatttcaacatccaatgcagtgaggtagttgctaccatccaacgcaagctcgatgaattacttctttgttctatctgacatgtcccatggcatcattttgtatttataacaggtaaataatatgtgcagggtcgatataaactggtcatgagtaatttttatgatcactagcatgtgtaatctttaggattaccacacagtttaccataaaaattaatttaagtaatccttaggattacagattgcgtgattaaatattatgaatcatgctaggaaattaattatataacattaaaataaaatggtacgaaagatcatgcaaacaatatagtaagcatgtaaacaaaacgaagagcatacatgggcacaaactccatgcatattgtgcaaactttaaaaaagaatagaaaccagtaaacacttctccactatgagcccacgagccttgacggcaaagttgaccttagtgacagcaaggccccatatgggtgatctccatagaaccaaaggacatccataacacttttagggtcgtgtagaaggtttgtttgcctccactatttgcgggcaacggcggtagagccatccattaagtttacataccgatgcttcaggaacctttcatcatctctagcattttaacgataatggtagcagagccgccatcatgtatcaactaatgctgagaggatgtatcatctcaagcctttggatggtaacggcggtagagccgccttcatgttactaggcattgctgagaggatgcatcatctctagcaattggacaataacagcgatagagccaccttcatgttatcatgtattgctgagagaatgtcagaggatggtacttcaggtgccatattgttcttctgctcatttcaactatagtagaaatattatttgcatattaagaacaagatgatcattaggcattggtttctcagctgtttacctgtttagcttggtggagactcgtgctggtaacattttaagaagccattctattctactgatcagcacaatagcagacaagcacagagttgtggaacacagaaaatatggatgaatgaaagctttatttcatcggattgcgtacaagttacatgaggagattaagtatgaaaatataattcaaaatgatgttttagagaagattgagtatgaagatataattcaaaattttatttcaaagaatatcaaaaggattatgtttttcagtagaacatgaggtcaggtcaaactattttagcattaatgttttatatgttcctaagaagaaacatatctaaaaattttatgcttttgttatgctccgttttcatatttttggggcccattttacgttttgcacatgggccccaaaatcatagatactgtcctattcatctgtaacaagacgcatcacctctagtacatgtgaagcctagattctggtttctctcttcacctctccctaccttttctctcccctttggaccacctatatacccatggttgatgttagcttcctccggtactaccccatttgagctgccaccgtattctttgaaagccattaattatctggaatttactattaatttggtaaagcatgattttctctttatatatactaccgggagtagctactcctgcatcatctattatacgtgctttcaaaccgatcgctattttcgtgggaaacaaacttttgaatgcattatgcacgtcagttgtttgcattatatgcctgacggccgcatatatatatagagagagaaaatcctctatgtacccatgaaagttcacgtaatcccttctatacccctgaattttgctcaatcc

SEQ ID NO: 61980 - DNA, 1221 bp, Oryza sativa
  unsure (1)..(1221): unsure at all n locations
attctgctttcttcttgccanagcttcctataagtaaccggactttgttttttggagcagaagatatatattctgctttcttgtttctagaaacagagataatttcaggtacaaaattcaaatctctttctgctccctttctaaccgatgttctgctcctttggtagtttctgctgattttcaagttttggatcaaggagcagaacttaccgatgatgagatttaattagacgagcagaagttgaatatgtactacttatctaagtacgtacacagcagaaactatacccagcagaaactcggttatgcagaatatgtactacttatctaagtacgtatagatgacatacagtatgttagtaatcaaccgacagaacatgtactgccgtcaaaaacggatacggagaaaaaataggtggctgttctgctaatttttttatgttgatgttctgtcattctttttaattcatggtctgccattttttctgttggccggctaatatatatgttccaccggcacgagcagaagataatatgtcaggacgagcgggtgggaggaagaaactgcatccgagaagttggtttgcatgcagccgatgatttagcaactatctgaactaacaaactatttaattaaacaacacgggtattcatcgttattggatcctcgtcactccactaactgaatccgatccataataggagggagtaactaccctcggtagtaggaaataggtgtcctatctatctatctatctataatataatagatagatatagatagatagatatctataatagatagatagatagagagagagagagagatttgagctcggcattgacaattttaatgtggagaacatccaggacgagaatagtcacgtgcaaggcattgtcaacaaattagatgaaagtctgaaaccatgttactttgttgaaatgttaccgacaagagatacttgattaatcgattttcttttggccaagttccgagagaatatggttgtgcagcatatgaaatttggttcgccatatgtacaatatattgaatattgaatattgaatgctgcatcaagacacgggatgaatcatcacgattcttgagttacattgcatcaatatttttctgaaatgttcaacatctggtcctattttccccatataacagctggtaacgcacatcacgtatgaccattctggtatatatcatatatgtgg

SEQ ID NO: 61981 - DNA, 718 bp, Oryza sativa
cgcggtgggtcacacgcgtcagccgcacctaagggcgcgggcggctgacggccgggccccacccggcagcaacttggcgcgcccgagggcggccaagccggagcagccggcgggaggcagcgcccgcgcccctatggtcgccggcggcggccataggcacggcggagcggcggccgagagaggggaagggaagggggaaaataggcggcggtccatggctcaccctaggtcgacggcgacgacgaaaaaggtggccggagcgagggaaggcggcggcgcggctcgggtcgacggggtcgacggcgttccggcggtcggtgaccgaaacggaggggtggacgaggtcgtggaggatgcggcgaagccgaaggaggcggcgccgaggtgggaggtggtccggggcgacgacggcgacggaccggagctcgacggcgacggcggagagagagagcgacggcgcgagctcgattccggcgaggaggaagggcggcgagaggcggaaacggacggaggaggtgcggggagggtttaaatagagccgggtcgagagagggtggcccgggaagggaggaaaccggcgcgggaggtccggccgccatcaatggcgccggcgagatttgcgggggcaaatccgcccgtttgaacgcgagagagagagggaaaaaatggggggaaaggaagaggggatcacggggagtgatttccctctctttattgc

SEQ ID NO: 61982 - DNA, 2157 bp, Oryza sativa
aaaccatcctccaaaaccgctaagggagtcaaatttaactagttttaatagtttgggtgttgaaatatctggtattgttatgggatgtgaatcatattcggtcactagttaagggagtcactactagaaaatcaatttttcatggcgtttggaaaatatttttcatggcggccacgtggaaaaaccgcaagcgcaaaaaattgtgggggtggggggtcaagggccgccagtggaaacacatcttcgctagcggtctacttaagaaggccgccagagaagatataggatatcttctctggcggctctcttaagctcacgccagtgaaggtattgtatcttcgctggggtaaggggatgtggcccgccagcgaagatgtaggtgtcttcgctggcgggcctcttaacttaacgccagcgaagataccatatcttcgctggcggtgtgatgacggggaccaacagcgaaaatacctgcatcttctctggcggcatccttaacctctgcaccatctcaaataattttcaatggcagttcgaatgaaccgacatatgacgaccgccagggaaaatgcgctgaactatatgaaccagctacagtaacctcgagcaccattaggagcacgattttctctctcttaagaacacatacatagggggaaggttttgatctcgaatcttttgaaagatttattgtaccagacttactctttttgtcaactttttttttcatttttattggttgtatgttgagatttttcatcgcaaaaaatacatgacatggaggaagaaaaacattttttatttgttatttggagctcaaaatggcaaactttgcaagaaatattgtgcatgatcgatgttccatatatatatctagtttttgtcacgtcctgatttttcgctttctgttcatctcgcctatttgcgaaaattcacattttgtttattcgtctaaaatagcttaatgaaaaattcattaaatcaaaaggttttaaagtgattaattagttaattacgttgttcgctttgtgattgttaattggagttagttggatttaatttgtatttcgaaagtggagctcaatccctaattcaaattccatccaaatccaatattccttttcaaatcctaaatccttcccaaaaattccaaatactttatatttggaattttccagagaagaccctgtctttttccctttttccttcctctctttttctctattctgcccttttgcagtttagcccttattcttctttcttttttctttttcccccaccttcttctacctccagctctctctctccttcttgagctgcaggcccggggaggccaagccccgagcccacgtgccgccctcggcccggcctcctcctcctctctgcgtcgccggcccaagccgccgccgaccgagcccacgccggccacgccacaagcccaatcgggcgccccaaatcccgcaagccgcgccgccaaattcggagccgccgcctttccaaagtttgcgccgtgcgccctaaccctagctactccctcctctataaatagcactggccaccacccctttttccccctttttccaaagccgccgccatctccaccgtgagcagccgccgccgccgttgctccgtgccgccgccgggagccacgccgtcgtcgtcaccatctccttccggtgccgccgccgctggtaaagccccgaggctgagccctctctccctttcgcgccgccgtttctctctccacctcaacttcggcgtccgcctctcgtcgccgtgcgccatctccacgccgtcccggagctcggtgctgtgccaccgcgttggcctcgacctcctctgcctccgccgctgttttccgtagccgccgtgcaccttcgccgacgaacgccgccgacgccgccgcgctggagccgccatggcgccatggccagagcacgcccaggcctgtggtggagcagctactcctcctcttccctgtgacactgacgtgtgggacctgccatccaaaaactcaaaataatcacagccgtccaaatccctagatcaaatcccaaccgttggatctacataatccctaacatatgccaccttagccctagatccaaccatgtcagtaccaccgcatcgccttgtgtcgccacgtgtcattccacg

SEQ ID NO: 61983 - DNA, 2698 bp, Oryza sativa
ggagaaagagtaaatttcaaagccatagttaatccaccttggaaaaggagccctagtgcacaacatggaagtttttgagctacagaaagtacctattgttagagaatatccagatgtcttcccagaagagttgccaggcatgccaccacatagagatattgagttcgtcattgatctagttcctggaatatcacctatattcaagcgaccttaccgcatggcagcaaatgagttagctgaaatgaagaagcatatataagagttgaaagagaaaggttatgtcagacctagttcgtcaccatggggagcaccagttatctttgttgagaagaaagatggaactaagagaatgtgtattgattatagaagcttaaatgatgtgaccatcaagaacaagtatcctttaccgcggattgatgatctatttgaccagatgaaaggagcaggagttttctccaagattgatcttaggtctgggtatcatcagctcagaatcagaacagaggatatcccgaagactgcattttctactagatatgggctctatgagtttacagttatgtcttttggattgacaaatgcccctgcttatttcatgaacatgatgaataaggtattcatggagtatttggataagtttgttgttgttttcattgacaacatactcatctactccaaggatgaaaaagagcatgagaatcatttaaggcttgtgctagaaaagctaagggagcatcagttatatgctaagttcagtaagtgtgagttttggatgaaagaagttgaattccttggacatgttgtgaccgccgctaaagttgtagtcgatccaaagaaagtaagtacagttatcaactggcagccgcccaagaccgtgacacaagttcgtagtttcctaggtatggcaggatattacagaaggttcatagaaggtttctccaaagttgctcgtcctttgacacagttgttgaaaaaagagaagaagtttatgtggacatcagagtgccagcgtagttttgaagccttgaagaagagtttgacgtcagcaccagtgttggttttgccagatatccacaaagggtttgatatctattgtgacgcctctcgtacaggacttggatgtgttctgatgcaagaaggcaaggttgttgcttatgctttgagacaactacgtccacatgaggagaattatccaactcatgatttggagcttgccgcagtagtacacgcattgaaaatatggagacattacctgataggcaatcgatgcgaggtctacactgatcacaagagtctgaaatatattttcactcaacatgatttgaacttgagacaaagaagatggttagaggtgaccaaggattatgacatggggatccactaccatccaggcaaggctaacattgtcgccgacgccttgggcaggaaagcatactgcaacaatgtggagatcaaggagagccagttgtcactctaccgggagtttgaaaggctgaatttagagatagtacctaaagggtttgtggctaatcttgaagtcaaacccacattggaagatcaaatcaaagaagctcaaaaagatgatgctaatgtcaaagaaatcaagctcaacatgaagaaaggaaaagccataggattcactgaggatgagaatggtgttatatggttacatgagaagttggttgtaccagatcagccagaactcaagaagctcatattgtcagaggcacatgaatctcgttattctattcatccgggaactacaaagatgtaccaggatctcaggaacagactatggtggcctagtatgaggcgtgagatcgcagaatatgtggtactttgtgatgtttgccagcgagtcaaggcagagcaccaacaacttgccggacttctacaaccattgaaggtaccagaatggaagtggtatgagattggtatggatttcatcaccggtttgcccaagactcagttagggtatgattccatttgggttatagttgatcatctcaccaaggtagctcactttattccagtcaagataacttattcaggtgacaagcttgccgaattttatgtgaaccggatagtatgtttgcatggagtaccacggaagatagtctcagatcgaggaactcagtttacctcacgtttctagcaggctcttcatgaggcaatgggaactcatcttaatttcagtacagcatatcatccacagacggatggtcagaccaaaaaagttgatcaaattttggaggatatgcttcgagcttgtgctttagcttatacttctaattgggacaagaatttaccctatgtcgagttctcctacaacaatagttaccaagcaagtttgcagatgtcgccgttcgaagctttgtatggacgaccttctagaacaccgttgaattggaatgagactggtgaaagaatggtttttggaccagatgtaattcgtgaagccgaagaaagagttgctctaatcagggatagattaaaggtagctcaatctcgtcagaagagttatgcagataatcgccgaagggatttaacttttgagaaggaagattatgtgtatttaaaggtaaccccaatgagaggaaccaagaggtttcaggtgaaaggaaagctagcccccagatatgttggtccattccggatcattgctcgtcgaggagaagtcgcatatcagttggagttg

SEQ ID NO: 61984 - DNA, 3181 bp, Oryza sativa
  unsure (1)..(3181): unsure at all n locations
tgacactaacgtgtgggacctgccatccaaaaactcaaaataatcacagccgtccaaatccctagatcaaatcccaaccgttggatctacataatccctaacatatgccaccttagccctagatccatgcatgtcagtgccacctcatcgccttgtgtcgccatgtgttgttccacgtcatcgagtccacatacaccgagtccacccatacactctatgccactgacagtgggcccacatattttcctatccaaaattaattcaatttcagaaattaaatatccagagaatattctcggaatattccttgttcttttaccttcggattttccctgaattcaaacttccggaggccataacttttccgtttgaactccgattcgatccattcttcttcctaaattcttctaaaatcgagctttacctcctggtctaattggttatttcatttgatgttatttagttagtttttctttgtgtttatttgtttttcgtttgcaatcgtgtagatgttggagctgaaaagcatttcgcttcagaagacgctgtgcaaggacagtactgggatcaaggcaagtgcactctttgaacatattgaacccatttgtgaaatgttttgttttgaatacatgcattgttttgtttataaactatcgaagggtagcgtgacctaattgttattattatcctacctttggtaattattgattgcccatgataccttgtcaccctagtctttgtgagttgaacattaggctcaactcaaggtagagtagttatgcttagccgctcaaggttattctacaagcaaaatataattttgattaatcatatacttataatcacttttatatgaactgtgtggctatgtgctatcttttcggtagcatgtgttgcaccgtgtaaaacaacgggcggataaaacatttttgaccggggtgatgggtggttctgtgtgaacctggttaggtggtaatgtatctgtgtgatcgttgccgggtatggtctctgtgtgagcctactgttgagctgtgtgctattgtagtttggcaagttgccttggtcaattaaggacttcacttcataagtcatggatctgagcctaacgtgcaaccacatgttctcatgggaagaacctggcccagtaggattccgagtcttggcactatcggcccaggtggctagatgataggagtttaggttcgccatggggactttcttgtctgtgagggaaaggtgtctcatgggggaaggcagtgttaggacggagtttctaaaaagccttgttacagactccttggccgcacacaacttgaagtgtgacacttgcgcatgggcattgtcacgaccggaattaacccaacgggcgttccttacgtgcgtgcattattccttgtcccaggaggcaaggtacaccaaaagttgacacagttcagagtttaacaagcggaagcgtaaatagttaatttattacatgggcggcgaaggcccagcatacacaaagacaaacgggaaacagcggaagactcgggcgacgaccacaggcgcttgacggcaggcacgagctagacaccaaagccttcctcatccaggggctcctcttctgggtttgggaaaaattgagcaagactgagtacaaccaccgtactcaacaagacacacccacaagtgcaggataaatgcaagggagtacaagggggttataatataatgggttagagtttgcagcaaacaacattaaaagacatttagttgctcaaagctattttgtaaatacgatcctagagctatacattattattaaacaaggccatgaacccacacgaacctgccttaacccaaggcctacgatgattcagaccgaactggcaacccgaccctgggtcccagctcgtcccaagccaacctaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcatgtgtaaccacgtgccacataccaccacggtatacggacggaagacgtgacatagtttccaacccatcctagccatagacaagagtaccgacccaaccccacctacggccggaacctccgggacaggtaggcaggactgagcccctagcagcaggacaccggccctgtgccatgacatctcgactaccgggccgcagctcgtgtagccttcctttgccctagagatgtccatcgacccccgacttcatccatctccatccgtgtacttttgtttataaccagactgagccacaaactaagccttacccactagacatgtggaagtacggtagtgctttgcaacagaggcccgaagaccggtccttatatggccgaggtgctactaacaaaaccatgcaccccgagcccagcctaaaaccattttgaggattttgaatagagggggaggtgtgaatccaattctacaataatccaaccattccatagtgtccaggtgatatgaatatcccaaagtctagagttgtaaaaccacctaatgttgcctaattaaccagtgaagcatctacctaaaatcatactagtggtaccatgagtagagtgtccactagttggggttttgtttattctagggtgaacaaggtaataataacaataacaataataaggtcataacaaaggtacataggcatggctagataaaacagtgataacgcgggccattcaaataaagcgataatgcaatattttaaatcaaaataactttataaactaggattcaatatgttcaaggatgatgtgacttgccttgctcgctttcccaaacgtcggcttcaacttccacgaagagcgtatcttccgaagctgcagcatctacacgaccaacggaaaagaaaaggattttactctaattttaaaagggtttattgcgtcagccgagggaagggggcgcgcggaccgggtccaccccacgcggcagcctcacggtccacggtggactgggtgcacccgggctcaccggccgacgccgtgggtcccacgcgtcagccgcacctaaggnnnnnnnnnnnnnnnnnnnnnnnnnnnnnnnnnnnnnnnnnnnnnnnnnnnnnnn

SEQ ID NO: 61985 - DNA, 1670 bp, Oryza sativa
ggccgaatgggccgcgaggagaggagagggagggggagggagatggtccgggccggcccaagagggagagggagggaaaggggactttttagagcttttctttttataaaatcattttaactttgtttatttcttaataattattatttatactctgaaaattccactaaaatttatttacgcattttaggcttttaggaaatatacaaaaatcccccaagccttatttgacttttaactttgcaccttttaattgttggaggctttcacacggattttaattattctaggcataatttagaggatgtattttagagtcgttttgggacgtgacaggcattaaaaggacgatgtatcttatgggtcaagctgtacaacctagtgttaattaatctattcgaatagccgcgtccgcggtcatggacatgctcaatgatatctcatgaggggtagtttgtgaaaactggaaatgaactgtgtgcaggttaatgaatatagctatgtggtcctgtgtggacgaatcctgtgtggatggatagttggtaatacccattatttataactattgttttaaacctgtttataaattgattataactgcaaattgctgtgttatacaaaatagccattgcctttgttgtcagctttgcatatgcatatttctgtgtgcttgctgagtattccatgtactcaccttgcaattcccccaattctagaagaaaggttcccgctgtttctgaggagtttgttgctgaagacgaggaataggtcgtgagtcccagttgactgctgtggcaagttgaatggagctactacgcatttatcatatttccgctgctactttaatattgtccttaggccctttgtggcagaataattgtaaactttagccataaggcttaacacagtcattattattgttaaatattaggattccttcgtgatgttggctgtgatattatcgttgagtctgtgtgtgctagcttgatcctggactagcacttatacacaagaggtcctattttgggtactcacagttttcgataggtttatttttagcagatttatatattagttaactgcaaaagaatgagctagctaggaagagaagaagagaaagaagggtagtttggtaattcgtccgagggatagatgtatgttttatatatgcagatttttggttagctttaattatcttgttcaaaatatttgaactaactaaagttgtattattttttccgcaattaattaattaatacatagatggcggacagggcatgggtgaataaagagagatatcgggcgtcatacattgaaggagtcgacatattcatgaaagcagctaagaagaatgttgcatctaagaagaccaaagatattagatgtccatgcgtgcattgcaaaaatcagaaaagttggaacgatccatctgtaatcgagcaacacttggtcacacatggatttgttgagggatacacaaactggtcatatcatggagagatcccaagcaagcaagttccgaaccaggctacagtacacgacgaagtgttgagctggaacgaggatgtcattgtagtagctaaagaagaagaagaagaagaagaagaagaagaagaagaagaaaaagtgcatgcagtagaacccgttgatgatgatgatgttgttggtgg

SEQ ID NO: 61986 - DNA, 2703 bp, Oryza sativa
  unsure (1)..(2703): unsure at all n locations
gtgtgttaaccactgtatcctattccgtaaagagtacgaggatttggacagatgtccaacatgcaagagtagtcgatacaaaacaagccgtagccagtccgagagtttggatgttgcccttgacgatgtagaagagtccgatccatgcaaagacagtaacaaaaagaagattccccagcttgtcatgtggtaccttccggtgaaagatcatttgaagcgtttgttctcaaacccgagggatgccgaattgatgcgctggtatcatgaaaagcgaaaaaaagatgggatgattcgacatcctgcagatgcaagacagtggaaggaatttgacagaaagtatcataagtttgcagaggacccaagaaacgtaaggtttgcattgagcaccaatggaatgaatccattcaatgacttgagcacctcacacagcatgtggccagtactcctaaccatgtacaacctcccaacgtggctgtgttagaaaaggaagtatatcttgttgaccatccttgtacaaggaccacgacaacctagcaatgacatggatgtgtttctagagcctttgctggaggatatgcgcgatttgtgggaacacgggatccgagtttgggacgaattcctgcgggagtacttcacgctacatgcaattatctttgtcaccgtcaacgacttgaccgcactgttttccctattgggacagatcaagggaaagacgggttgcattatttgtgtagatggtactgtgtacaggtatcttaagggatcgaagaagctagtgtacatgcgacaccagcgtttcttaagaaagaatcactcgtaccgctcccaagcaaaatatttcgacggtactgttgagaaaggtgtggcaccagaaccatggaagggtgataaagtgtttagaatgaccaaaaatctgaaggttggttttgggaaggtaaaaaagaaggaaacaaataagcggaagagaaatgatgccgaagtgccagcaagccctagcgttccattcaagaagcactccattttctttaagtaccttccgtactggaaagatttagacatacgccattctatcgatgtcatgcacctagagaaaaatgtcttcgatagcaccattgggactatactggacatactaactaagaccaaggatggactaaaatcacgtaaggacctcgtggatatgcaaataaggaaagagcttcatcctgtggataaaggtaataatggaaaagtgtacctaccgcctgcgtgctacaccttgacaagagaggagaaaatggcattgtgcaaatccctacatcgggtgagagtgcctactggcttctcctcaaacattaaatgactagtgtcgatgaaagatctgtcgctttcaggctacaattcccatgactgtcatgtaatgctcacagtattcctcgccattgcaattagagcagtcgaaccagttcacgtaaagctggtcatcacaaagctctgttatttcttcaattccatatctcagaaagtaattgatcctgaagagttaggtcctctccggactttcgctatacagacagtgtgcgagcttgagatgtgtttccctccatcatttttcgatatgatggttcatatcgtgcctcatagttcatatcatgcctcatagttcgatatttttcttcaacgcctcatagttcatatcgtgccttagataattgcacttgggcccctatacctgcatcagatgtggcctttcgaacgatacatgtccattctaaaaggctacgtacggaaccgcgctcacccagagggatccatgatagagggatacacaaccgaggaggtcgttgagtgttgcattgattacctaaaggatggaaaagcaattggtttaccggtacctcgacatgaaggtagattatctaggaaaggaacaaaagggaagaaaagaatccccgacaatgactacaaaaaagtgaaagatgctcatttcactgtgctgcagcaattcgcaatagtggagccgtacatagagcaacacctgcatgaattacaagcaacaaatgtgggtcgatctaatagatggatcatgaagaaacaccagcatcactttactgaatggttcaagaacctcgatctaccagatggccataccatggaagaaagaacaattaaaatgctagctgacgggccatcaagtgtgtatacctcgtggcaagcatacgatctgaatggatacacattttacacaaaagcgaaagacaaaaggagtgcatgccaaaacagtggcgttcgagtagaagcaatcgacacaactgggcaaaagagcacatactacggattcatagaagaaatctgcgaactagactacgggccaaatatgcagattccactgtttcggtgccaatgggtgaaacacccagccagcgtgtctgtggacaactttaggctgacaatagttgactttgacaacgtaggccacaaggatgacccatgggtgcttgccgatcgggtcgctcaagttttctatgtgacagatccatctcatttgaagaaagacatagttattntcggaaaacanaggatttttgngagttgatgatgtcgaagatgtcgaggcatacaatcaatatgagaacatgatactattcacagattttcgaaacaagatattacgcgtcgaagaatcaattggtgaatcgccgaagccatacatgagaaatgaag

SEQ ID NO: 61987 - DNA, 940 bp, Oryza sativa
atacacacttgttaaattagtcgctaacttgtattattgtgaatagttaatttccttaattctgtcatgatctgatgcagcttccaaaattccccaagtctgcaagagagctcaatgatacatccattcagaatattcaggcggacatgtgctacttcatccaccgtgagtgcgcacatcagcttgggctgtttttcgacaacgaaggagtcttagctctactggagaacgaatccctgtctaactggaccaggcgtataatatagctagggtttcgtaattcattcaaaatacttgtaaatgttatgtcgtcggtcgaatttaatttgtcaatgtatatatatatatatatatatatatatatatatatatatatatatatatatatatataggcgcttccgaatatttatatatatgtacattattctgcttcatatatactcaatgcgtggctctaaaatacgcgaaagagaacatactctatcgatacctcgattagttatatcaaccacgtctgactctgaaatacgcgcacgaagaaaagaaaaaatagtatatataataatgttttatttttttaaaaaaaattgcatcttcactggggggccacgtgtcagaactaggacggtctatatcttcgctgtcgggccacgtgtccatccacagaagccttacttcatttttcctagcgtgccacgtggcctaaaatactgtgagtcgccagcaaagaattatcttcgctggcggccgacctaaggctaacgcaagtggagatacttctttgctggtggctgcgttatgtccgccgccagcaaagacatgtcttcgctggtggccgtcctaaggctaccgccagcgaatacatctctttgctttgctggcgggcattcctttcttggccgccagcgaagatgcattttggctggcggtaaataacc

SEQ ID NO: 61988 - DNA, 3334 bp, Oryza sativa
ccctggaagtgcgccatcttctcagcgtacgacgtcgctcgagcccgactcgatcactgcgtgttgtgtgtgctcgcctgctcgagaggcgatgagttgatcaactgtttcagttggaaatgatcggtgtggtgggtgaagcgaggaggagaacgaggcaaagcgttggacttataggcgaggcgcgcgcggcgcgagcgcgacacgtcgagggggcacgtgtgagcggggtggatgcgcgacgcgtggagaacggtggggagccgacgcgtgcatgcgcggtgtgctgggatggggggtggagcggcatggaagccggtttgctttccacctggatgaggatgagtgcggacgtgggcttcggcggagattctgcgcgtcgggggtgtgcgtgggcgacgtcgagtagaacaggcgttctgccaggtggttaggttaggcatggatgcggctggtgacttgactcgactggaaacaaacagcctcggatatatatttcttttaaactgtcgaaaggtttggagttcaaatcttaacacaattctaataaataaacatagtctattttaaataaaatattaaaaatgataaacatttaaaatgtcataaatatagagaaaaaatagtagtaaactttatttttggtgttttgtactaattgagtttaaccataagttcggtctgcaataacacatctagaagattctacgactgaaacttaacccaaaatctattgtaagcggaatagtaaaatcgttttttgctaggtattgttttgtcaagaaattttcaagggaaaatcacatggatttttaaaaccaccctacacttggctattagaacaatataaagctcactaagaggataaagacgtacacaagtatcttagttagaaaatacaatataattgaattttgttttaaaatttctagatttaaaaagttacaagcatattaacaaggtacaatgtaattttatataaattacatcgtagcttaaaataacttacaacattctcattacactgtaatttgaaatgtggcttcaatttatttttctaataacgtcattaagctcatgtatacttataataccaaataggcatattgcatactttaatttgctggatcattttattacgtaactgtttcagctgggtctcacttattaaccagttgccagcctgattggccctgctctggttgctgcacgcacgccaggacatgacatggctctctatcagttgcagtctgtttgtgatcaaacgagaaaagcaaggatcttatacgtaaaatcaatggtgaaaattccgtctgattttaaagatgaaatctgttgaaagatatatagcaaaccagtaactgacatagtcccttggctcgtgagcttgtaactacatcgcatcccctagaagatagtatgctaatgggacgctatgaaattgcattgtcattcttagaaataaaatacacccgtccaaactcggataaaaatatatatttcttgctctgctaaaaaaagatcatggtaagaaatatggctctcatgaccgtgtaaaataaccaagtgttgaatatttcggaacggaggaaatatatatgttttgtggttagtctccatcttaaattaactatggggagaactgtgtaaaatataaggtaatctttatccatcaaacggtctcttggatatataggtcaaagataagttatgactccggttgagcctgtaatgaaacaggtcaaagataacttgggtggcctatcaatggtgggccaggctttacactatattttttccaaaaaaaaaatgatcaaacttaatgaaatttgacttagtacacaacaaaaacatctaaacctatgaaacggagggagtacagtggcatatgtacctagaaagttttatagatcatctctaaataaaaatggtgctgacagtagggtataatccatccaaaaaaaaagaaataattgtggggcatctttgctttgtgttgcgaagtttttttttcttgtaacaaggctgttttaaaaaatatattttttgaaaacgttggtactttttttagaacatgattttttttaattgtaattttgtttgttgacgtgcaatatatatgtacgcatatttttttattatcatctcatatgctccaatatgtttctaggaaatacatatggattggagcatacaaatcagttattcccagacactggatgtgattactaccaatcaaacactataacttcttatgtatccaattcaaccacaaaatggagcgcacttaattaatttgccaattagtccttcgctcgctttttagttgtaggtgcattttgctagacactcagaaattgttgaatagcacttcttgtcctttgaacagcaataggcaaagtccctctcttcctgatagcaaacattcaagctcgcatggctgaccacgtttttcagtcccatcggaatattgcttccgatcttccttatggtttgacctagagatggaaggaatcatatgtactatatgttttaaaactgaaaaagaaatgatgaaatgacatataaatcaccaaaaaaaggaatttagttttcttattacctcttatttgtgcaggaagagcggagcacaccacaagaaccaagcaaaacaacatgagtccttggtaggcaggcttcatacatttcaccattgcgaaatatatatgacgttactatgttttacctgtcttattgtgatctatgtagtgaatgttggtttgcgtgaacttgaggagccatggttcatatatatagaacaaatatggctgctatatatggaataaataaatgctagcttatctggaggattttaatcataatctaaaaggatctggaagattagcctgaattatgattaattgcctatttgatgacaataaattgttgctgtaaaatgaaatatcgtaaagcctaattttagctacatggacaaacttatcttctcggtcttgcccaaacgtctattgttgattaattccaccttaaaagagcgattttaaaaatatatcacccttattcttctgttttatgataatagattaatgtttatttttttttgtcaaatctactaacttgtccgaaagtctaattttagtttcactctaaaacatgtcaggctgtactatagatttcaccatcaaaaggttctaaatgtttcttacttaattgcatttttatgacaataaattagtgcctacttagcatcaaatctggtagattatcctaattaaaatatactttcaatagcatggctaaatctagcaggtgactctcccaacgtatgctaatagca

SEQ ID NO: 61989 - DNA, 1164 bp, Oryza sativa
ttgtgtacctcggcccgtcctagacggggggtttaacgcacattctgtttggaatcctattcgggaatttctgggcgtgacaagttggtatcaaaaccgaccttgattgtagtacaagccaaatggaaaacctaagagtctgaatccttttcattgcacacgttctttgcaattggatttgttcctgtggttcaagggaaaaatcttggtcgcttgttcaagtgagatttgtcaaatcaggtcagtctagggttttagtaaaattatttgagatttatttaacagttagtcgggatttgatgggaggagtgcattaggtgctaactaagagatgtgggttgcaagttatttatgttcctattgttattgttattattagtatgtatctaatttctcattattttatcgctatgtaagtccgtctcacttattcgctctcatgcaaaaatgatctatgcataaaattccgctcttattcgcttattttatttgtgtcctttattgctttatttaaattggatttgagcatgcattgatcctacccctttgccttctctagatggccgaccacccacccaaccaccgtggagaaggcatggatgattttgtggctgaattggcttgcatgaccttggtggtgggctaccccaacgcgccagagtactcaactgttccaccgctcagtggcgagcttcctcaccgtgttcgtctggaggttcatggctatgtggacacctgccttgctaatatggtggttcaggcatctggaggcaccgcagatcacgcctgtcaggaggcagcatatctggtgatggccaggcttcgtgatcgccacaactacactttctgcaacacggcgtaccgcttccaccctcgccgagcaagcggtgatgacgtcagcacctttcgcccgacggccggcgagaacgacaccaccttcggccacatgtgcgccgtgatgaggggaagggacaggatgcactctgacctgcacaaggcgtccaaggccttgaatgatgggaagctcgtgaggatcatagctctgaaggatgagatagcacgcctgaagaaggaaaacgctcagttgaagggtttcccagcgccaggaggagtccggatccgcaccacgcccctcaagttgacgactgtacccatgcgcattca

SEQ ID NO: 61990 - DNA, 1401 bp, Oryza sativa
  unsure (1)..(1401): unsure at all n locations
attaggcacgttttcccttagtttatcgactgttagtttttgtctgttagtttgtgtgtttaggtttgttcgcttgtgggtcagtcgacggtcgatatcatgtgcctatgatatggctatcctaataagtattttgcttgctgttttaagtgttttaattctgatcagaacaattgcagtttaaattcctataaaataaagcttagttcctgagcatctgtttttcttcttttccaccccctccgtctgctcttccttcagatggtcaacaccaggaatggcagccgtgcagcaggtgagggcagcaacggcgaagaacgcaccgacggtgggcatcccaacagcgactccgtcaatggtccgccaccgctccccgagaatccgactctggcccaagtaatggctcatcagactcagatgatggcagccatgatgcagcagatgcagcagcagcaccagcagatgcaccagaggatgtagcagcaaaccaagtagcagcagcagcagtttggtccccctccccctctatccaagttgccggagtttctacgcgtcaggccacccaccttctccagcaccaacaacctcatggaggcaaatgactagctccatgccatagagaagaagctcaaccttctgcagtgcaatgatcaggagaaagtcgccttcgccacacatcagctccagggtcccgcgtcagcttggtgggacaaccacatggctacccgtccgccaggtatggaggtcacttgggcagaattctatcgcagctttaggaaggctcaggtgccagacggggttgtggcatagaagaagagggaattccgagcactccactagggcaacaggacagtgactgagtacctgcatgagttcaatcgcctagcgcggtatgcaccagagaatgttcgcactgacgcagagaagcaggagaagttcctagcaggcctggatgacgnnnnnnnnnnnnnnnnnnnnnnnnnnnnnnnnnnnnnnnnnnnnnnnnnnnnnnnngacaacgcaatccgtcaggaggatcaatgtgggacctaaaatggacaggaagagaaaggtagctcagttccggtccaaccaaggaagccatcagcgaccgcgcttcacacccggacagcagggtggacctaccaccatgattgtccgccagcatcgcccgttaaactcaagcagtttccaccagggcgcaagtggcagccagagccaccagggaggtcagcccaaccgcagtgcagctccgcgcccaccaatggcaccagcacagtcagctccattagcccaagccaagaaggagattggaacaaagccagggtcctattacannnnnnnnnnnnnnnnnnnnnnnnnnnnnnnnnnnnnnnnnnnnnnnnnnnnnnnnnnnnnnnn

SEQ ID NO: 61991 - DNA, 3897 bp, Oryza sativa
  unsure (1)..(3897): unsure at all n locations
actcatagactatcatttttgccaagtttcgtgcaatttgcatatgtggttctaatcaagagatagaatctgccatttctttgcttgtttgttgatatacctcttgtgtgtaacttgatgttgtagctaattgatggttgatgttgatgataccaagtgtgtaacttgatgttgtagctgctgttgtgatgtacctctacatgttctagagaagactccatttgtacccattgttgattattgtggaagcttggagtggaccgttggttccatggttttttactcctcacaccgaggaggttttttcacgtaaatcaccgtgtcttgtgtgcatgtgtttattgttgtttcgctgctgatttgctagttaaaactatcctcaaagttcatggaaagatgaggggttgattgtgtgaaatacgtttgtcggtttgcgaattgtagtttgcagattgaaagtgtattggttcagcccgaacaattattatactcattatttggaattttcattagttttgtcaaatattttaaattaggatatatgcagccttttgaaattaggaacttagcctatcaaatagggaacttagcctttaaataacccaaaaattcgctcctatgaagatttgacattaggacattcagtgctactcagattactgcaaccactaggctatataccctttcataatttcatcaaacataaagctttctattttgtgctatacttgagttgattaatgaattgccatccaaaacacagcttgcattgaccttgttaatttgctgcaaagtgtttttcttccaaatatccttgtcgatggtaggattcatgacgaaacaaatgagaaaggtgcatccagtgacaataattacagatgaagaattggttctttgaatagtggtcagcattctcccgtctgtctactgcatcttcaatccaagattacaaatttttatcatatctaacgttcacgtgttggtgttcagtaaggttagacatcacaacatcacaatgtgtgtgttctctgtaccttttcataaaatagagacagagaatgttattgttactcattgtactaactgtttatatttatgttgttcaatatacgagattgttaattccaaatgggcacatcgcaattatttccatggaggtgatttctattgtgaatcaataatggcacaaccaatatatactggatgttgcttccctaacagtggcaaacaaaccagacaatatggttggtgtttgacaattaatgatgacacatgctgcaccatgctgaactgatccagaagtgttaatggttataacaagaggattagataattttgaggcattagagaatgcattgagggatcttctatataacaaatcacatagatgtgacaatgctttaaatcctaactttttgccagcctaaccgaatctaccacgggctaagctacccgagtcaatcttgtccaagtgcttgtattagatttttttttcatcatgtttcattgaacttcttttgtggatatagccatactcagtgcgatgacatttaagctctcatcaatatttctgtttgtcgaatctccaaaaacgtgtcaagactatactatataaatatttaattctggtaaagattgcattgacatctcataatttatgaaaacatcttgatgtggttaagcatatgcgtacgggatggttcaacaaaactaagtgtgtgggtaagcatttgcatcaaaatgacttatagagtggaatatcaaacttcaagtgccgtatgggatgttttttgcaaattcccctagtttttaacaaaagcttttaggggtgggcctggctgtcattctctctcttctctctttctccttttcttctcttctcccgtctgcgcgcgcgcgtgcgcgcgcactctagtgtgtcggtggtcctgttctaatttgggccaggcaattgttcctagagtgggtgagaaaggtgccggagtggtggcttgccatggaatggtcggattgtgatgattgggcggtcgcgatcattatcactgtagggcatagcagcctgtccactagtgagcatgcatgcagtgctgcggtgttggccaagagcacagtggcggcgtcactgtaccatggcggctgcggcatcaatgaaaggtgtcaatgagggggacagagtggaaggcaatgagtgctcaccgggcagcagcccgctagcgcatgtgagggcggcgagcagcaaaactatggtcattgacgtatgggtcgggaaagtgttaactcactggttatccatgcgctcttgccgtggtgcgataacaaagcacgcatgggtcatcctcattcacgacgaccccctcgctccaagcgtagtgttgttggattttattacataatggtgctcggttttattacgaccatagaataatctgcaagtatacagataccattatagtctttacctaagagtattctagggtatcgtatccacagagaacatgtgtgtataatttaagaacaggattcttccaaggacaacaactaaattgtatagcatatcaataatgatgtatatagaagaacattaacacaagagcattatattagcctataaaacataatttatattttctttaaaagttaacacatgcaaaataaaaatcttgaaatataaacatacttctatattatgtaaggaggctacgtaaaataatttaatttttttcgtaactttaattgtaacctcttgtaagtcttgaatggcattttgggtattttttttaaagtatcttggcccccncccaaaacttttaaagggcccccccaattaaaatttttttggggggcagaaaaaatagataaacgcaattgtgttaagggcaaatccttgaactacagtaaactccggtgggcatagaaccaattctctcagtagtttaatgaagtggttgtcgcaaggaaccgcctacactaataactgtttagtgcaagctattctctatgagaacaatatacccaaatctttttgtcacattcattgataatacattaatactaaactttaaaatttaaaaaattgctctatgaccgattgaagcgaacaatctaaaggtttgatcaatgtttaatatggttagatcaatatttccctatataaatattttttttctaatgtttcttcgccaatatcaagttgcgacagaaggagagaccaaaagatttcaaaactgatattagttggcaaacatatcacaaatgtacctcaacatctagctagacaaagaacaaagcattgatgtgtccatttgcataaaccccggctgaacacaaaactaacacggtgtacaatcacctccttctccatgggtttcaactaaagagagcaagtggcatgttattgttgagaaaatatcatgaaattaaattgacaaaaatgagagaaagaaagggttcaaaccaatatttcgaatgaagtatatttaagaaagaatgccatggaactaagcgatttagcatcaaatgtttcgaaaatccatgtttggaagtgcgatgaaattgacatcataatagatgttgggataatacacttgctattcttagctgtgcattgaaagtacaatttaagtagcataggacacttaaaatatttagctgtgctatagaaagtatattttaattaggaaaatctgccacatccgaagtggctttaataacacatcacctaaggataagatatacgtgcatgctctgacgtgcaattaaactatatctcagcataatcttccagattctgttagagtaaaatcctcaagatatgaaagtaaataattattaaattctttcatatataacatcttctatgttctatgtatatatatgtgaaccgcagctcctgaagtg

SEQ ID NO: 61992 - DNA, 1712 bp, Oryza sativa
actataggcgaattcgagctcggtacccctagtatatagaaggagttttggataaggaaggaaaaatagagttctacatggaaacgacaaggactattcggattatatccatattgcacagtcctatctccaaaccaggaatgtaccattccaaaccaggagctaaacaaattattaccatttaaagcatttgttatcatgatgagaggtgtgagactaatcacgaaaaacattgttagacccgcccataaccgcgggcacggctattcgaatagttttactctgatcagaggtgtaccactgtacccacaagacacaaccccacatcatgtcaccatgtgcctcaataccaccacggtacctcggaaaggagctgtgacaataccccttgcataacacaatccaccgcaggcccaccttctggatcataatcacccccttataaacaaggcatggactccccagcatcccctgtgggcttatctccgccacttctcagtctggtgccccgcaattaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgattgaccatcgtgaactatcgttaagccatcattaattaattaatagtgaatcataagttatcccaaaagtgtgctaatgtttctaagcatggctaagcaattatatctaatacatctagttgaaccaatatataaagcccaactagtcaagttataataacccaaagtatcaaggaataaagtaatcaagaacaaaagggctataacaaacaataggttaattccacccaatgacattcgaaaataaatgcaatagttgaatagaaacagtagctttaaataggatcaacatgctcaaagggttatttgggatctgtgtgacttgccttgctggccttggaactcttcaaattcttctcctgcgaaaacggactctccggaaacgtcggaatctaaacagaaaagagcaaaaacaccaaaacagcacataaacaagcatgaatagtacatgtggatatttttaacatgtagatctcaattttagaaaaatttagagacttgaaccaactaaatcggagctaagatgaattagttatgaatttttaaagatttaatcggattaaaacacttatattgattttaattgaattatgacgcaataatgaattatttttgaaaaggaaaaggaggattattgcgtcagcgggctagggtttcggtggaccgggcgcacggcgggcggttcacgcgaacggacggccgagatcgacttgatccaaaacggacggccgagatcgatcggtccacgaccagctcacgggagagggcgacgatgacgtcagcggtgacgtcaccaccggcaacggcgactcggcggctcgggcgcgcatgctcgtcggcgaacggcgacgcttcggcacgaacggagggcaccaacgggtagagcgcgacgcggcgaactcaccggtgaccaaaggagcggcagaagaccaacagacggcgacggcgacgaggttaaaacggcggcggtcttccgcttgacgacggcgacggtgcttcggcggtctacagcg

SEQ ID NO: 61993 - DNA, 898 bp, Oryza sativa
tgaactatttcccggggtatgaaccctcattggtgtactaagctcttcttttcttaacccatgcatcccaacaaacttctttgaaatgaacgaatgcgttgcaccagaatcgaaaagtactgttgcagggattgagttaacaggaaacgtacccagtatggcctctggtgctgcttgcgcctcttctgtggacgcgtggttaacacgggcttaagcaaaccttggcccggcacgccttggcttcggacacttgtcaacaaagtggccatgctcgccacagttgtaataggaccctggctttgttccaatctccttcttggcttgggctaatggagctgactgtgctggtgccattggtgggcgcggagctgcactgcggttgggctgacctccctggtggctctggctgccacttgcgccctggtggaaactgcttgagtttaacgggcgatgctggcggacaatcatggtggtaggtccaccctgctgtccgggtgtgaagcgcggtcgctgatggcttccttggttggaccggaactgagctacctttctcttcctgtccattttgttacattgatcctcctgacggattgcgttgtctaccagcttctcgaagtctgcgtaatccctggagatcaactggatggtcagttcgtcatccaggcctgctaggaacttctcctgcttctctgggtcagtgcgaacattctctggtgcataccgcgctaggcgaatgaactcatgcaggtactcagtcactgtcctgttgccctagtggagtgctcggaatttcctcttcttctatgccacaaccccgtctgggcacctgaaccttcctaaagctgcgatagaattcttgcccaagtgacctccatacctggcggacgggtagccatgt

SEQ ID NO: 61994 - DNA, 923 bp, Oryza sativa
tattatgttctggttgcctgccctatatcttttaactagtaatggagggatagagaaaagagtaagcatactttaagttagtacggtgaagaaaaacccagaaatatttttgagggacatgaaaacaattgccttgttgcattccgcatggagcctaacatatttagagcaatagcgacatatcttcgagagggcaagaagtaatgtgcatgaggatgagttcctgatcccagtatgcattgctgttgtggacagcatggaagatatgtcagatgatgagaaggtcctggcttatgatgtcttcaaagatccacaaaactgggccattttcatgactgcaaaagactctacatgactcaagtggttaaggaggaagattacaattgcgtaaatctggtattgctcctttcgtgttattgcctctatgaaactgatgaatatattaattagtactacactttagtcatattaaacagttggattttgtttgttgtatcacctaaaacttcaattcagtgatgctcagcaaaactattttttggggtaaatgttgtgcagattggcagatgatacatttgtagttttcacattgtagcatcacctgagatgcaggtatactatttatgctaaaaatgatgttcattatgccttacatattattcatgctcttttgtttttttggaagtgtaaactttttatacatatattctaaaatattgttgttgctctctccgggtgagcagtactgggctctgaaagtatgatttgaatttgctgaatgaatgataacgctgatacttggagtgagcttatctattcaaatttgaagatgcatagagtgaatttggttaaatgtattacatccggtctaaaatataagcatttctacttatttatcaagatatagcttgtaaaatgcacaa

SEQ ID NO: 61995 - DNA, 2084 bp, Oryza sativa
gagaccaacagggcgatactaccttgagtgccaatgtgttggttgatgcacaattacacaaatccgtacctctacagcgaggcaaatgattactccacggaatagataatcaacaatccgatggcatcattctccagtgctgccaacactgtactcgaggtcgacaccaccactggcatcatgcattcaccccctaacaccatctcctttgctgccgccgaggatgtgctcgagcttggcggcacaatcaagctcatttgtacttctaataacgttgcttggtggctgccgctgtgacgtgtaggagcttgtcactgctgctggcatcaatgacgctttgccgacctcgtcgttgtactcgccactgccgccgatatcacactactatagaaaagcactttggtgccggttagggaccctctttagatgccgttagtcccaaccggcaccatggaggtggcactgatgactttggtcattggtgtcggtttcaaaaccggcatctatatgtgtaatagatgccggtttgtagttttcaaaaccggcacctttgagatatacgcgagccaaaaaaaaggctggatgcaccagctcaaatcgagccgatgcatcgagggcatccaccccgcattgccccaaaatattaatccacaacatcataaaacaacgaacaccgaatcaaccaacatcagtcacagatcaacaaacatgaagaataagaccaacgcggaaagagagaaggccaactccaccgctgctcaccttcgccatctgccagatccgccgcgggagaagccgacgccatcgccaccgctggatccgcccgcggaagtgttccttcccaccacctgccctccctccagatctggcagagggagggcaccgccgcctcctacactccctctgttgcctgagtatccgtcgctgccgtcgctcgtagatttgccagtttgccaccgctactgccgttgcccgaggatcagctgtcgcctggccaccatctgccctccctccagatctagcggagggagggcgccgcaactgggccaccggcgcttctaccggatccggcccgcaggagttgccgcctcctatgttaccgtgagtcagaagagaggatgggggggagagggagagataaacgggtgagtggataaggcggagacgggaggagagacgggatcccacgtggtgttatctcggcgctaaaagaaaaaaacggctctccgtcggctcggctcgactcgtttacacctataatatacatatagttgtcggttcttgactatgaactgacatatattccttttaccacaaagatgcgggtttttagatgggccccatgccaactactccgatggaatgggtactaaaaggtaccagattttcaataaaaaccgacatctttctctgacaccagtaataggtacccggttctttggattttggcacgtgaacggacacggtggcgggaaaagtaatataggtacccgtttacatattccggcatctataatgcaggcatctatttgatggtacgtggtagtgtcatgctgagtcctcacccttgctcgcgtgagtcatgaccatcaagaatgccgtttaagacgtctttgtattcttgctcccgcgctgcggacggccgctggcggtgacctcgaactcgtcgctgccgccggtatcatcctcacctgctcatcaccacagtcaacatcattctcatgctggcctaggattgccactggcagtgacgatcttcgacttgctagctgcctccatcagcatatttctcatccatcactgctgtttgcgacaacagtaccctgtcttcaccgctgctgactatatctgcatcaatgacttccgcagtgacagttcttaccattccatcatgctagaatcaccgccatactaaagtcacataacttcgtgactacatacaggcaggcttatgcatgcatgccttactgttaatcaatggacccttgcaagtcttagaatcattatactaaataactttatgcataaataaaatatttttctaagaaattttatattagaacaaataaactacttccacaaat

SEQ ID NO: 61996 - DNA, 1089 bp, Oryza sativa
tgtttaagcacacataaagttcggaaaatcatagtgtgatttcaagaagaactatgtgcataaaaccagtcttttatgtcctaacatgaagctagacagcagggtagctgcatccgccaattgcagatcaaaatgcatcaaaaataaattatatagaagggataaactggagttgcgatgaattatgtggcactacatgatccaacaaaattctaagcagaaagcataaaatattgaagggaattcttcaaaaaggcaaaaaaaaacaaggaacttatacctttttctccaaatcaagtgcttcagaagcaagacaggccaaaacagaatccacggacataattgtgtcacaatgatctttgcaactaaatggcaatcctcttgattggaagttgacggtgcctatcaacaaagatgattcagactttaggtgaatttacatatatgacttccgaggacaaagtgtgcagataaatgaacttaatgcattagaagctataaatgtataaatttccattaaaatcgtataaggtgggttgatggttccttagcgtgcagtcagcactactctacaaaacaaagagatcagtatgcttgtcacattttgacaaataacagattagcagtgaatttcctgcttgctaaccaaccaaccttcatttatctgaaattctgaactgataatcgtggagcacaacaaaacaaaccaaataaaggcaaaccgcattgccactgccacattttggaatcgctagatgaacaggtgaaagtacagaaacctgttgtcttcagaagtaagggtcttcacatatagagaaaagctgtgcattgaggagctgtgttcttggattagagctaacgaaccttttttgtctgccctcctgattgttggaccaacgcttctcctgctgctgttgttggtgagtggtgacaagaggcgtcagttccctccatgctttgtgactgcacacatcattttgacacaagcatcggatataaaaaaaacactaattcgtgcacaaaatcaccagagcaatcagaatcaacagctggtggtaatcgatgtagtgattatcaaggaatttggga

SEQ ID NO: 61997 - DNA, 2639 bp, Oryza sativa
  unsure (1)..(2639): unsure at all n locations
ctatagttgctttaataaaataatctcctttattctatggggtccatagtggatatgctaattcattagttatatgctctatgaatagattatacttcatttatatgattcacttgattaaattagtcgatctatgctatggtaatggtccagtgaccttaacgggttgcactagttctaacttgtccatccgaagggtgggagtgccaggggaattagtgtcattatttagtaacataagcatggtgcttaggtcagcaaaatgttgttggatgcgggtatgtcccacggaaagtgaggtagatgagaggtggtgacaaacatgtccgtcctttgtgttcctccacatctgggtatgatgtaagagttcgtaaaatgccataaccacgctggcaaaccaacaaggagtggtctctcggtagtacctaggtgcctagaactaagtcctaaccttctaagcatgtatgtattaagtgtaaactatacattataaatacaaaagtacatttaaaccatagatctctttagttcttctccactacctagtgtatcatttttagagatgaatctcctatgtatcacactacccttatccatactatcaattaacccctatttagaaaagtaattatagcttgattaaggaatgcatgaacttatttttttacaccgccgcttttcctgtgaaaagataaatgtgatacccttggaatactccttgggtgaaatgctacatatgtatccatgcgcttgcggatttatctaggaccttaagaaataccaacagttgctctaaactatcctaactagatgtcgttccacacactagaaaattcaatccgcacaaatcacactaacctatccagactacacgtcattccatgcaccggaaagtccgatgtgttttcaaacaccgaattacgcagcanaacaaaattacaaaatgaaagtgcgtctctgcaacaatgaggggccaattttggcatgtgcattcatctagttctcaccactacaagtttctaaggggcgaggagaacactctttgacggaggtaccgctctcctataataggcaatgtggtactaaagatttacatgcatccattcttttaaagtgggcatttatgatatttaaagaaattaatcttcatatagggtcttcatccacatatcaattccaatagcttcgagcagttttgcgaagtaaaacgcaaaatctttgctataaaccagtcacatggctatctgttagcaaaaacaagggaaacttaatctgagccagcttccctcataaaaatagaaggatgagagattggttaccttgggtgagagaaaacaatgactctaccatctagtgtcattgctggtacactgcagaaatagggaatgttccaactgaacaataagttgatctgaggcaaagtaccagtagctatggtgaagcacttggacagatttgacatctctcaagaggagagagagggtgctgatttcaaccagcagcaagccaaagggcgaccggcaggtgatgagcctcatgtggtgggattaaagcacggtggctaccattaaggttttctttttcttttagaacgactagtcctctcacgcatattcctttactaccaaagtaacgcatatacgtggaccttttcagcatacttcttttcctctatcaaaaagccaataccgacgctcgcttatcagcgaagttctatcgatagagcaagaaaaaattacaagattacaaccagaggagatcataaccagaaaaacgaaaaaagtataccaccacctacacaccgacagcgccaacacacagacccaagagaagttgctaccattaaggtgaacccttcagttttgtttctgtgcttcctagatttgtggcataacgaacgtttgggtttctgactatacatgcatgctgaagatggccaattcttggtttcctgctggcagttcgttagtgtacctctgggttaattcggccacattttgggcctggtttacaccaatggtggaaaagaacactcatctagcggttcacatcaaagatagatcatgttgatccaacggctaacacaattttgatgatgtgccaaaccatggaggatgctttatagtaattaatactttttagaagaaagggtaagttgtttcttttttccgttcaatcaagtctttttttttatttttatgtttggaattatggttggtcgatccacaacacatctcctgaacataagcacccggagactggcatctcataaagatatttctagataacacatattggttagaacaaacatatcaggtatcataattaatttcagtcctcagctgctcgatgcagtactttttttttttgcggggaagctcgatgcagtatatgattattactgatcaatcacttgttaattgtgaacctctgtgcacctttggtggtgtgcagtttggtaagcatccctcgagtgttggatagcagagctggtccagcgaacagcaatagaacccaccacgggtttgaacgcaatgatccggtttataatcaagtcccagaaatccgtttctggcttttactcccatcagcaaatcacttctgatcttttgtggtgttttgacccattgatgtataag

SEQ ID NO: 61998 - DNA, 775 bp, Oryza sativa
  unsure (1)..(775): unsure at all n locations
tagcccctcaaggggtgctaatggggctatttttgtgtggggaccatcaaaaagaagctctctctctccttctctctcctctctttnnactctctctccaccttttagccttgaattagcctatcgatccaacatacccaccntaggctaatgttgagcctaccaattcatgactaaacatgagctcccaacattagctctgggctaatcttccaaacagggccttaatttgcaaatattagacaactcataaagccaagtggttcaccgttcagacttgatggaagtaatcaattgattagtgattagggctgtcaaccaggcagccagaacagtaggactacatcctgcatgagccaccgagccaggaggaatggagtgagcggcgttgcggcgccgcgacgggaccgtttcggctagtgcgcgggagcgcgcctactccctatagggctagcacctaccggcatgctggcgtcgctgcgtcggcgcttggtcgactcggtgtctcggtgaaggctgaagggggaagccgcgaaggcgaattgatggtgtggcgccgatccaggtcgaaagaaatgaggcgtcgctcgcgtgcggcttatgcgatcggcggttagactggtcactagcgcttcggctgctcattttgggcccaatgttgatagagccaaggagggtggggggtggggcggtgcgggccgtagctgggtcggnnnnnnnnnnnnnnnnnnnnnnnnnnnnnnnnnnnnnnnnnnnnnnnnnnnnnnnnnnnnnn

SEQ ID NO: 61999 - DNA, 1807 bp, Oryza sativa
  unsure (1)..(1807): unsure at all n locations
gcctttggagttttgtaaggaatttgaaagattaaatttgggaattgtcagtagaggttttgtgcggcttaaaagcgaagctcactctaattgatcaagttagagaacccaaattaatgatcctgatattctagaaatcaaaaagaatatgagaagaggaaaagctatcggtttcttggaggatgagcaaggaactgtatggttgggcgagagaatctgtgtccccgataacaaagatttaaaagatgcaattctgaaagaagctcatgatactttatattccattcaccctggtagtaccaaaatgtaccaggatctcaaggaaagattttggtgggtaagtatgaagcgtgaaatcgcagagtacgtagcagtatgtgatgtttgtcagcgagtcaaggaagaacatcagaaacctgccggtttgttgcagtctttgaagattcctgaatggaaatgggaggaaatcggtatggatttcatcactggtctacccagaacgtcatcaggccatgactctatttgggtgatagtcgatagacttaccaacgtggctcatttcatcccagtaaagacaacatattccggaagtcggttggcggaattgtatatggcaaggattgtgtgtttgcatggcgtccctaagaaaatagtgtctgatcgaggcagtcagtttacttcaaatttttggaagaaacttcaggaagagatgggttctaagctgaactttagtactgcttatcatccgcagacagacggacaaaccgaaagggtgaatcagattttggaagacatgttgagagcttgtgctttagacttcggtggaagttgggataagaatttaccttatgcggaattttcgtataacaacagttatcaagctagtcttcagatggctccttacgaagcactgtatggtcggaagtgccgcactccgcttttgtgggatcaaacgggagaacgtcaggttttcgggacggatatcctgagggaagcagaagaaaaggtgaaattcattcaagaaagattgcgtgtggctcagtctcgtcataagagttatgccgacaatcgccgcagagatttgagttttgaagaaggagattatgtgtaccttcgtgtcacgcctcttcgaggtgttcatcgttttcacaccaaaggaaaattggcaccgcgttttgtgggaccttataagattgtcagtagaagaggagaggttgcttatcagttggagttacctcaatctttggcaggagtccataatgtgttccatgtgtcgcaattgaaaaagtgtttaagggtacctatcgaagaagctaatcttgaacagatagaagtccaagaggatctgacctatgttgagagaccaatccgtattttggaaatagatgagagaagaactagaaatcgagttattcgtttttgtaaagtccaatggagtaatcattcggaagaagaatcaacttgggaacgagaagatgaattgaagtcagctcatccgcatctgttcgccagttcttccgaatctcgaggacgagattctgtttaagggggtaggtttgtcacaccctanaaatcctaaatatataaattgttgtttaattggaattattaagaatttattttaaaaagtctagaagagaagatctaattttaattaaataaattccaatataaaatggggccagataaaatttcattaaaatactgtgcttaattctataattcctagatttttctgggatttatatgagctaaggaagtatttttattaaatggaattgcatttcatgaataatttaaattgaaa

SEQ ID NO: 62000 - DNA, 1358 bp, Oryza sativa
  unsure (1)..(1358): unsure at all n locations
nnnnnnnnnnnnnnnnnnnnnnnnnnnnnnnnnnnnnnnnnnnnnnnnnnnnnnnnnnnnnaaaaatatttgtaactgtaatcagcccgcttttactttcttatgaattatatcatttttaactggaataatgtgttaattttctgaacgttcaacgctgctcgcaagcatttccccaaagccccccttgccgatcaattacattttatatttgttgaaacttccacacaaatttcgtgagctataacatcgtaaaaagtttgaaaaggaagtctaatcaacctctttgttaagaggacattaccatgtaactctgcagcggaaaaaaaaaactagatatatccatgagctccattgcaggagggcaagcagataatgaagtacatgaggaatataccttaggagttatcatcaactcctcatataatggatccatgagctccattgcaggagggcaagcagataatgaagtacatgaggaatataccttaggagttatcatctgctcctcatataatggattttgacattttacttaggagtcgtattgtttgaccacttctcttatttaaaaaaatatggaaaaaaaataaaaagttgtgcttaaagtactctggataataaagtaagttataaataaaataaataataattttaaaaaattttaaataagacgagtgcttaaacagtgcaagtaatcttttatattagagacggagggagtactatcaataacgtgtgctaaaaaagaaaaggtagcggaagcatatactccaccaaataggctgctcgtattggcacctcatcaaatacaaaatacagagcataaaaccgggggaaaaatagtaagaccgtaacaaattccaagttctacagttattttaattttcaaaacttatactgtaattccaagttgcaggtcacaagctgagcaaaatattgtgaccgagttgctggaaggagtacgcgcctaccctagcagattctgatacctttgataggatataaaccggcttattagaaaaataaattgcgggcaaaacttttatacatgtgtacttagcgatttaaaaaccaataataaaaaataaactgcaataacaaactctaatataccaactctaaaattaaatatttaaattcaaaatttgatagctgcttataagctgaaagacaaacgatagaaacatgccgattcttttctccgcattagattggcttctccttcgacagagataactaaatatggatatgtaaaatgagaaaaaaataccacatacactaataaagttttaattattccaaacacaaaaatttgatttatccaatatgggtaccgagctcgaattcgccctata

SEQ ID NO: 62001 - DNA, 1849 bp, Oryza sativa
aatatatgctcaacaatggctaagttgcatgatcacttgacatggatcccaagatatatatctatccagtaggtgcaacctgcatggttggtgtagtctagggtggcttctttccttgtactattcccaacggggagaaggatgcttgacccaaccagaccgagcgctgcaacatttttcttcgtattatattgactcgaacagaagcatgatcaacagtaagatggcatcgccaaatgcatctcgcagttcgtaccttttcagacacttcttccctgttgtttgtttatttggaatgctcaaagcatataccttaaaggcttttataaaattgcaaacttagtatatacttcatccgtcccacaatataagagattttgagtatatgtaacatatcctgaagtactacgaatctggacaacctaaagtcttttacattttagatggaggaagtaatatagtatataggaagtggattttgatccctcgagaggatatcctctcgttgtttgcaatgccattcaaatggttatgaaaaatttgaaaaaatttgagatgatgtattaacatgtgatatatcactccacaaacatgcaaagtaaaaattcaacttctatatcttgcaacgaaattaacaaatttaactctaaatatacgttaactagctacggtttaatttgatttttttcgttacttataaaattaaatactactagtaaaacaaattgaacaaaaaccagtcattggttggtaggttccttatggtataacccattcaactaatttcaagccctagttacggctctaatgtttatcacatgacaacgctatattgttgtatctatcgtatattattaagataggaagaaaagtaaccaccacacttttactctaggtccagaaattaacgcttagtagaaggaaaagaagaaaaatatgcactatttgataatgatagatctagattataacggctaatcaatatagttggatactactactgtatttgtgaaaatataagcaatatttgcatgtcaaatccagttgtattttgaatataaaatctatagctacataaaaaattgcccgggaaattctactagttaatatatgtagaataaaaataagttatatagttcttaaccaaagaatacgaatatataatagctcatctgaaacgacatgctttattcagaagcaaaatgtgatatattatttgttatttcgttagtagcatcgtggaaatccatacccattacttttgaatatgaattgcataaaagtagtgagatatagggaaaaaggcaatcaagattttccattcgagtatcatctttcttcaacatgtgtgtcatgagtatggataccatatacctaatagtagttgactaaatctcggcaggacccaccacataccatgtcttctacggaaacaaccttcggatataggaggagttccgcataaggaaggatgaatagagttctacatggaaacgacaaggactacttggattgtatccatatggtttccttatttctactagcttggacaaggggacacctatgggtataaatacaagaccctctaggaggagaggggagacggaatgtagcgcccgttccatcgtggcgcctagcgggaaaactatctcttaaaaaaaaccctaattgcgaaatctgtttctttgcttgttgtctagtgtctgtgccatctcagatctcaaatccccggatctatcgtcaagttcaatcccgaatccaaatccttcccaaatcaaatccctccgcaaaagtctatttcgcctccctcaggttcgatgggccgaattcctctcggcccatctccccc

SEQ ID NO: 62002 - DNA, 6830 bp, Oryza sativa
cacgccccgcgtgcacctcgctcacggtgagccgagtcgccgacaagcgggtcccacccgagaccacgcgggatggacccggcccaccggctctctctctctcccctccccgcccccgcgcgcgctttgggccgccttcttgggccggccggcccattaagctcggtcgagccgcccctttctctcgggccgcgccctagccgcccgaggaaagtctaatttccctccctccttcctttcctttcttttctttttcaaaaaggatttaaataaatccttttcctttagactaaaaatccaataatcttagaaattcaatatcttcccaaccgtaagtccgtttgactccgttcaacttccaaaatttctcaaatctcgagatctatctaatggcacgcttagaggtcaataatagggctttatttttgccgtttgctgagttgtcccgtttcgcgtgtagtttcggagcccgaagacccgcagtgcgaggatttcgaggatcaagctcaagatctcgagcaaggcaagccacctttgaacatcttgagcctatatttgaacttaattatgttgcttgaaaaatattatgtattgataggattgcacttaatctgcttgtcccgtctgcaaggcagattggcggacctacctaacttgttgcatctgatccttccattgttaattgttataccatgtcccccttaaccccttagttgcgcctcggtaatcgtgcactctgtacgagtatcgacggtcgccttcaaacttaaaatctgagaaacatcctgggtaaaacttgggttttacaaaagactcggaaaaacccgacacctgggtcggtgcttgcgaactaaatgaatttccaaaattgcggaccggggaatgtaccgggtgtacagtttcccgctcttgcacttaaggaccgtttccttggaatttcatccgaacataagacaagtacgaccacatgggtggaatgggacacccctggctgagtaactagctaatcgggggagccatgatgccaagagacatgtggattcaacggggtggtgtcggggaggacccccgggtttcctggcacaatatggtatgggacctgatctggtgttggtctgggacccctctcgttggcatatggtgaacctgtgtcggctttcgaaatgccttgtcatgaaagccttaaggtctctagtcgtggccgttctgcacgggctggatgatccgggttagtaatgtcgtgtgggtaaagtgtaccccctctgcagaggttattaaactgttcgaacagccgtgcccacggtcatgggcggatgtgaggtgattcctagcgtagttttgttttactactgctttgtgaaatttgctgatgtggtttgggattgatgtttggaaaatctgcggctgatgggatcagccaggcccgggtggccgtttgaaagctgttggccgggtgccaatcttgatcaattcaaaagactgatacattgcacatactccgaccggacgagacgcactgtctcatccgtgtcgtttgagaagcactcacttagttgtttcagaaaagagtttaaataaaatcaattgcaaaaacaacagcctttccttgaagcctgcattaaacacttatttcccatggcttgctgagtactcccatactcacccttgctctacataaataatccccccagttgctgaagaagatgaaacggatcccgctgacgaggagttcttccaggagcaagccggctacgatgagttttagggtttcggcctagttcccaagtcgcgcctgtgatgtttggtcgaagtcttggcttccgcttcccttttgtaatgcagttgtgagctcgggatctgtccgcagcccaacatgactgtactcctactctataataaagagacctctgttgctgtgatattctgccttcctgtgataccagcactgtttcttgggactggtatcgactaacaggttaatttggagcgtcacgggctagttccgctcgggactagttcggggcgtgacacagaacaatagatcaagacaaaagatcaacatacaagccaacatatgccaagacaagctgccggatatcgacatcagagatatgcctggatcaaccctatccggtacctatagagaccggctgtagggatttaacgttgtctctgatctcgccgggcacgaactcgaggaggaaggctaccctgttgtcgactacgagtcagaccttcagaccgccatgtcgataacagttagataggttaccccaaatattgtactggtgcgattatggtgaatatataagagcaataccggcttcggccaacaggatgtagggttattatctgacaattcaggggcccgaacctgtataaaaatccttgtatctatcttttttaccttagtctgagatctatcctagtaccaacgatccccatactatgcaaataccggaatcgcgacatcaaacatcgacaatgtgagttatgtatccacatgtcaataagatcaaacagaggtgcagattgatgtcaaagtgtgaagagcagctagattgtcattaatttattattcccaaatttcatgacagtacaatttattctataatcaagcagtaattaacctcaatgattaactctaaacgggttatgttcaaggcttggaaccagtgtactttaattttaacagtatatggatgtgcatgtttagtgggttgagtaaagattctgccacactccaggagatatttgatgactgaaaaattcctagcatacggtggaagccgcacacacgtgtgtttggtggtttgcgttggtgactgcataggagtctcgttgtaatctcttcaaaaaaaaaatgtgagaaagaagtcgcctcctaatttttcaagtctctgtcccaaatcaaatattttttttcttggaaaaaggtgataacgataccgcccgttattttcattgatatgaaatgttttgtaacctaagcattgtgtgggtcaggttactacctaaatattttgattggctgctttttattgggtcctgcataacagttaacgagtgttattattttttcttagaaaatttaacaaggtagactttggggacttggatacactttgtaggccttttattatttaaacctttgatttgatttcactcctgtgttgctggagctgccaaaaacagacttgccacacaaccacaatatattccttatcagtaaagtgaattggcaattttattgcggtattttttttaaaaaaaagtgaaactttgattaaaaaaaacattctcaagcaaccacaatctattcctgtcatagcaagctaatcccctagtcaatactagttacaccaaaatcaccgaggtaaatgagttactccaaaacaatataacaaacattgattaatatgaaatagtacataaaaaaatcctttgccgtacatcaaatgatggtacaaattattgggatgaacgtggatttatgatccagctccctcatatgttacaaaaggtgacaaataataatgagaagcccaaaattaaaggccttgcgtctgatcaagaaacttgcccatgatcattcgtacatcagctaaccagatgacgacacaacttcggaaaggcacaccactacaagaaaagcattccatagcaccaaccgcgagcaatcaacagaagcaagctagcaaaagcagaggagtatccgagtatcctacagggaagctgatgagcaagacgcaatctctgtctctggtcggccggtgtcgatcggttagcatttggggagatcggacggcggagggaggatcttctggttgggtaggctcccgtcctgcaccacccatgccatcttcaggccccagctgacgtgcacctccaagtggcaatgcatgaaccatacccctgcacacgtccaagcaaaagtagcgaattagttgcaaatttcaactcatgtgtgcgcagccaaatctgttttctcgcttattgatcagaaatgcaatgtaagaataaaaaaaatcaataaaatgttgcaataatgcaatgattctcacctggattgtccacgaggaagcgaatggcaacccagccggccgccggcacgccgacggtgttgcgctcgacggggtcgacgaggttgtacttggccgggtcgttcacggggtcgaagttgccgaacccttggccgacgacgaagaagttgaagccgtgcaggtggaacgggtggctctcggcgccaaggacgctggtgccctgcatcaccagctcgaccgacgcgccgtacgggagcacgaccagcctcgtcccgttggacacgttggtgttgttcggcggcgtcccggtgtagttgaacggcgacagcggcatggccgggaagttggaggcgtacaccccgttggacctgccggtgtagtgcgactgcagcagcgccgtggaggggagcacgaaggagacgttgttcacggccgccgcgaaccggctcccgttgggaccctggcacgtcccgttcacggcgcaggggtgcgtgcccaggccgacggtgaagaagaaccgcgtgtccacctgctgcggcacgttcgccgggtactccgccgtggcgaagctgcggagctttgcggtgtagttggagacgaagctggtgtcgttgatctgcggcagggtgggcctgagcaccgggaggttcttgttgaacgccgcggtggagtgggagctggggtcctcgtactcgaggattcccgcgacggtggtgttgtcgaacgtgccggacatcgccgtggagtatggcgccgccagcatgtagaacgtcgcaccggggtacgacggcttggtggtgaggagcacgttggtggtctggcccggggtgatgaggagggtgtccacggtgaatggcttgacgtagaccgcgtcgacgtcgaccacggtgagcgtgtgcccggcgatggagaagaagagctcgtcattgagcgcagcgttgatgagccgcagcatgtacgtcttcccggcctccaccttcagcttgaacgtatctgcatgccacacaatgcgtatgcgtataatcaaaatgtactagctagctagcttatagctgcaagtgtacagcacagtgcaccacctttggcagagcagttgtagagcggcccagggaggccattgatggtgaacgcgtcggagacgttcgggcctccgccggtctgcgtcgcctggcttatcaccgcctccgtgtccgccttccaccactcgcctaccacccaaacaaaacaaacgcaatttaacccctgatcactgatcagtcgccatgtttgttacgcttacgtacagacccacgccacgcgacagtacgtctgtcgtcgatcattacataccgaagacgacggggacctccttgtccggcgccgggaacgggtaggggacgccggccttggggaggatgatgatggggccgtacacggtggcgcggagccaggagatgtgcgcgtgccaccacagcgtgccgcgctgcccggtgatggtgtacttgtacacgtagctgccgcccggctggatcgggcactgcgtgatgtacgccggcccgtccgcccacccgctccgcagctgccggatgccgtgcctgcatcatcgatcgatcgatcgatcgtcacaatgcgcagtgatgagctcgatcggtaaaattttgcaccggaaaactgatcgatcaaacggtgaagcgtgcgtgcgcgcgggtgtgtgcgtaccagtggatgctcatgttgtagggggagtggttgatgacccggatgacgacgaggtcgccttccctcgcgaacacagtcggccccgggaactgcccgttcaccgtcacgatgctcttgctgctgcacagccgtgtcacgttcgtcgttttcacctgcacacgtacacaccatacgcacaaacacatcgcaattaacgtaccattacactattgccacgcatgcatgcaagttggttctctcgatcatgcatgcatcgaacgtaaagaaaacaaagaagaaacagaggacagcgactcacatcgaattggtattccctaatgtcgcccttggccaggttgacggagaagagcagtagcgcggcgacggcgaggatggaggaacggagaaggtaggagatagccatggatgcctcctcgagctctcgacttacgtacactgagagctctcgtcggctaatgggctatgaatgtgtttgagatcgatgctagatgagtgtctaaggtgtctatatataatagtactagaggacaggaggatgagatcgagaaaatgattaattaatctgtacgcttctggtgattctgaacagaagtttttttttttgagtttttttcaactcggccagcttagtaagctttatttggtgcgttgttggttaatgaactgggcacgaggtcgatcttcccaactcgcaaggcacaaacactgagagcggggcccatgcatgcatatagctgtgtatagcttcggagtgtggctaaagtcaactactcttctgtttgcatgtcaccttgaccaccttttatctttttctcatgtcttaattaacacgcagaatgccgaatatacaatataataattagatcatgctgcaatgcgaatatgcacttgttaatttgtgtgttttggttatctttgtcacgttttcttgttgacttgggtgcacgaatcaatttagctcagctctactttgaaaataggggattttatagccagctgaagtgcgatttactcagaaataaagaacttgtgtggatggtaagaactttcacatttaatttctagtacttgtgtacttatgttgaactt

SEQ ID NO: 62003 - DNA, 828 bp, Oryza sativa
atacatagtaatagtctgctaatatattgttctatgagtgattttccaggtgttgattaggtaccagaagttaaccatatttcttgtacaatataataatgtcttacttccttaatgaccgtaaaatttcttttgtcatgtactttagccttttttttatgatacataaaagttttgcgcatctttatattgagcattgggagaataccaattcaaaatataagagcaatattgatatggtctccgaattatcctttttaatagagggagtatggtctccctattccgtttgcttgtaatgtaaactcaagaattcctttaaccggtcgatcgggagagatcatcgaggttagttcgagttttctgcacctactattagaaatgtgttaaatcaggggtagttgaattttcgctttaaaactaaaggtcagaggcggcaccaagtggatcagttgcaaatcacatacttttttcgtcaaggcccctaccatattatccttacatgccaagggatgagatcacgagagccagtgaagacaacgaccttggcctggacgagagggttgttccaagcccgttcttcgattggcaacacattcgcgtcggccagaaatggccaggcatggagtacattactaatatatgtcaatttaaaaatgggggattcttgatttgtaagctgtttatctggtaggtcgtcgcccgcggatggtttggtaacggagctgtgcttcgaacagttctcttctttttgcccccccaagtctccaaaggaagagaaggatgcctgacccaaccttacctgttgctatccatggacacagcaca

SEQ ID NO: 62004 - DNA, 1206 bp, Oryza sativa
tttgaagatgatcaacacgatcataatccgaacgagaaatcccactcaaaagaatattgcgagctttgcaatttagttcaaaagcagttttttcagcagcagtattaatagcttcaggaatcacacaaggaagagaaacttttctccaaatatcataattctcagccataatgtaagattgcatcctactacaccaatgagaaaaatccgttccatcgaaaacatgaggcttagttaaaaacttattagaagcagccatggcaaaaactctagatcggttaaaatccaaagaagcaaacaaagctttgataccacttgtaggattgaatcacaagaactaagccaaccaaagggggggtgaatggttgagatacccaaaaaccaaaaacttttagcggaaataaaagttaccctcgaaatcgatggatcgcggtctgaccgaggtagtcgtccggtctgaccgtctgaaagccaccggtctgaccgagattgaaactccggtctaaccgcctgatcagctgtcgcttgctgtcgccaccgccggtctgaccgcccttacgccgccggtcggaccgccgcgatgccgccggtctgaccgccactgagatgccggttagactgccgaaacccggtgaaacacaaatcgaagaactctcaaagtagatgacaactttattgtttctctctgtgtttacaaagtgcaccaacaacactccttacaaaaatctcgactaaactcaaaaccctaactaaactagctctcaaaagcaatacaaaagcgatacaaagcgatgcagggaagactcacgctccccctctatttatacatgaggtaggcagcctaaagccacgaatcaaactcatactaagagtcctaaacaccttaggaaaccctctagtacaagaaagaacctttacataaccaatcgtaccaaatttgactccttccaaattcgactccgcatcccatacgcatacaatacctccatcatatgccatatggaatctccatcaaccacgtgcatcaactctagccttagtatcccgcatgatatttgaccaccacggacatcgtcttaccaccaagccgactcccggtccatcaccgcaaatactctcccgaggcatcgagtcacctacacatgaaacaaacaaagaaaccatattccgagactaagctatctccaacttgactcattagtagca

SEQ ID NO: 62005 - DNA, 971 bp, Oryza sativa
gtcaccagctgaatagggtggagattcacctctaagaaaagcctttatctgcaatttaatacatcttccatcagcactcaaatttaagtagaccataagtacgacgctcggatcaagatacaatgaaactagactgcactcataacataaaacacaaggtgggaaattgataataggaaagctctttgtaaattgtaaccatcatgttcctggaaactgttaaagttctccctattagcaggaataacagaggcatatttacctgataatgagctagcagatcaacatatcttcgaataggggaggtgaactgtacataaccaggaataccgaggacaccatgtggtacaggtttttggaaatccatttctgcagcacggagcacactgatgttggcaaaactcctggcaggcccttcagggagatgagtaaatgctgacacagctgtgttagactggggatgccctctgtatggcaaagcaatattgttgtcagaaccaaaagcagccacggcctccccacagagtatcatcatctcagatacaagctgcattgctgggttggattggtcttcaacatatagattaatgtttggttcaggatcatcaggatttgccaccttgatacgtggttctatcatagcagtatcaatcgaaccctgtgaacttcagagtgtcaattttgtcaaataacaaatgcatcgtagtactgatgtaatacttcagaaagtctttgaaaatacaggcttgagctaattggtaagtggcaccagtagtccagtactaatggtgaaatgaacagccgtggcattcattttgtagaccttggtctaggaaaggaatctggaagggagttcccttgtccatagaaaaccatgtgtatctcgctttataagaaaattacagttgcatttcattctgctttcatttgctaatcacagatgactcataaaaagacagatgtattgataa

SEQ ID NO: 62006 - DNA, 1417 bp, Oryza sativa
  unsure (1)..(1417): unsure at all n locations
tagttttgaatgactctggtgtagctgtagcaggttccatccccatgggagtgtaaaatctatcagtatttgatccactgatcttcatctcactagctgaaacaggtgttgatttatcccgttttcttctttttaatattgaaggagtacctggcaaaactgttagcagcactcttcaaaattgaatcaacactaagctggcttgttaattttccctttgttggagggggagtagtgcagccagcaggtgacaatatatcatccccacaatgttcagatgtatggttcccagtaagatggtcagaaaagagtgaggaactcacagggactacatcttccatgttagggatctggtaacaaagtggaccaagagagcgtgcctcattcttcaaagataattctgcttcacctttggatggtgcagcttctagttgaatggtccaagagttcccggtatgatcaggtgccgagttaacctcaagacctttctcatgaacagaatcaatttccaagcccttaccacggacagaatcactttccagagcttgcgccactaaagtgacagcggaaccatcaactacagatgcctcacgggaagtaagtggctgagcagttggtaatgaggaacgagatagaaaccctgagcaattagaccgatgagctgttccaggttggtcttttgaattgataatgggtgccttgttcaaatcaagatgaccctccatagccatcagctttggtttatccttgaacttatcatgaacaagcagtttcggaactaccatattattgctggtattgtacatatcttgcttctttctgagagaactattccaatgattctttatagaattatcagtcctggaaaaagcaacatacgaagcactgtgaaggtgatgtaaagtgtgtcttttcaaaataataacacaactcataattctgatttacgaacaaccaaccaatattaaatagtttaagaccatcgcacaggtatataagcagttgaaagtagaacttgaaacaaaaatcaaacaaactaaattgcaacagcgcgctaagagatcgagggcagcgtgattttgacctagctcgatgaactaatgaaagcaaaaaattccgagggaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62007 - DNA, 2866 bp, Oryza sativa
ttcagcaagcttttgcatcatatcagaaacagtacgtgccactatgcatgcaaattaatcaacacagttcaggcgatcgatccattgcatggatggtacatacaacaaaacacgcatgcatggtcaaaagactgaaaaacagatgcatggttgccgctggctttggctacactccaaaaacagagcactagctagctagctcaagctcaagctcctcccttgatcgttcatctaccgaatcaccaaacaagaggtgtcgcctaagctgcgtatctcctcgcctacggccgcgcgtgtagaaaaaaaaaaccctcaaagaaatggcggtggtggttgcgacacacttggcatgtcctatatatatgtagacgactcgagtgctttttcccaacattcattccatccttgccaggccatctcccactcaaagtctcacagagctagctgatcaagagccattacagattgtggctcaaagcttaggctacacaaattaagatgaccatggctatctcctctgctcttcctagccctctactcttggcggcttccctactgcttctcatcgtccaagctcagggcatcactaggcactacgaattcaatgtatgcctgcacacgcatagccaatgcaaagtgatctcgccttgatgaaaaacttaattgattgattgattgattgatcgatcgatcgatctgcatgcaggtgcaaatggcgaacgcgacgaggctgtgcaacaccaagagcatggtgacggtgaacgggcagtgccccgggccggagctggtggcgagggaaggcgaccgcgtcgtcatccgcgtcaccaacaacgtcgcgcacaacatctcgttgcactggtaagccaccgtaccgatcgatacgattcctcacgctttagttttttgatccgatcgatggtgcattcgtgcgtacgtgcaggcacggcgtccggcaggtgcggaccgggtgggcggacgggccggcgtacatcacgcagtgcccgatccagacggggcagagctacgtgtacaacttcacggtggccgggcagcgcggcaccctgtggtggcacgcccacatctcctggctccgcgccaccgtctacggcgccctcgtcatcctccccaagctcggcgtcccctaccccttccccgccccgcacaaggaggtccccgtcatcttcggtacgtacgtacgcacgctgcacgcattacgtcgtcgtacgacgtcgcgcatcgcgtcggtttgcacgcaacgtcgcgacatatatgcatacttactgatcattgcatgatcaggggctcgctaccttttaatttgattgttgcgtttgtcgcgtaggcgagtggtggaacgcggacacggaggaggtggtcaaccaggcggtccagaccggcggaggcccgaacgtctccgacgccttcaccatcaacggcctccccggccctctctacaactgctctgcccaaggtacgtgcatttcgcccggttaaccacaaattaataacctttttttttgtttccaagaaaaaaaacagagacaaacgttaccgtgcacgagtactgtgcttcctcctgcatcttttttggcgcgtgagagaattcggctccggaggttggtaacagatcaaatcaccaaaggtggacggagaagattccgtgttcctttctcgtaacggagatgcatgggattgtgcatttgttgctccgaattaatgcggtgtgtcactgtcgtgggatctgagcgtggtactcgacctaacatttttggtccattggaaaagcaaactctgttattgggtccggctggtgtcacgtaaacaaaatcttagttgcgacatagctaggggagctaggtgcgctttccattcatgcacgtcgccgtcgaagaatttagctggtgattagtgaatattgaaacgtgctgactctggttaccgttggcatgcgtgcgtgcgcgtggatgcagacacgttcaagctgaaggtgaaacccgggaaaacgtacatgctgcgcctcatcaacgccgcgctcaacgaggagctcttcttcgccgtcgccaaccacacgctcaccgtcgtcgaggtcgacgccgtctacgtcaagccgttcaccgtcgacaccctggtgatctcgccggggcagaccaccaacgtgctcctcaccgccaagccgtactaccccggcgccaacttctacatgtccgccgcgccctactccaccgccaggcctgggaccttcggcaacacgaccgtcgccggcatcctcgagtacgagaaccccgccatgtcgccctccgcggcgagcttcgtcaagggcttgccgctgttcaagccgacgctgccgcagctcaacgacaccgacttcgtcaccaacttcaccgacaagctccgtagcctcgcgacgccggagtacccggcggccgtgccgcagtcggttgacaagcgattcttcttcacggtcgggctgggcacgctgccgtgcccggcgaacatgacctgccagggccccaacaacacgcagatggcggcgtccatgaacaacgtctccttcgtgctcccggcgagggcgctgctgcagtcccacttcaccggactctccagcggcgtgtacgcgccggacttccccgtcgcgccgctgtcgccgttcaactacacggggacgccgccgaacaacaccaacgtgaagaccgggaccaagctgctggtgctgcggtacaacacgtcggtggagctggtgatgcaggacaccagcatcctgggcatcgagagccacccgctgcacctgcacggcttcaacttcttcgtgatcggccaagggttcggcaactacgacgccgtgaacgacccggccaaggtcaacctc

SEQ ID NO: 62008 - DNA, 2532 bp, Oryza sativa
atggttcatgcactgtcatttggaggcgcacacgacgtggggcctgaggatggcatggctagtgttggatgggagccatccgaaccagaagctgcttcctccgccgtccgatctgcccaaatgctagtcgggaccttaccacagatgccgttgattcttctttcctcatttcatttgttcgccaatttgcgattgctttctcctgaaggagattttagtgtgttagcccgttcttagctaacttttgtgacattattttgttcttttttcttttatttgtgtacaactatacaatgacactgttttgatgcttctttgaataaaaaaatgggcattaattgcatgaaactgttccagaacactccttgtacgttgtcctttttgcctatatttttctttcatgagtatccattttctttcccaattaaacaaatctgtggatttgtttcccacaacttgaattcaaactatctaaaatcaagagaaaatatattacttccatcatttcacctacagttaattatttataagcgtaacacttattaccaataaaaaatgatttggtcgtaaagtttttatatatgtattctcagagaagtcaataaaacaaataaactatgatggaaaaatcaactcaaaaattgagttgtaaaatttaaagtttggctacagctgataagttaaagagtaaacgatggttttaactcctaaagaaaggtgatgctgtatttacataagaataaaaggggcaattaaaaatactattacagacaggtacatggatcagctcacagatcctgagacagcaacaagaccaaccaaaacaagtccggtgcacggatcatggcacaaaaactaatcaagtactccaactagaagaaaaggtactatcaaatagtactaataacctggaaatccatataacaagctttatagttctaaaactagtgactgttaaggtagatgggctattatatctgattctgtacagatagccgcagttcagcagcacaacgcagagagacgggttaggtgtgttcatctggccttgctgacaaagcagagactccagctaccacacagttttggaacagaggctgggaaagctgcacattagctagtccaaaattgcgatggcgctgcttgcaaaactggagaatctggcatccaacataacacgtcattttcgccttgaaggaggaggtaagctttatccttcacgcgaagtgaatagcttacactttgcgcaatgaccacactgtcagaggttggttgtgctcggcgctggcgaggaaggggacgaggtgcagagacgatcgatgtaagagcgatataatactcggaaactaaagggggtttttgaagaaaatacaccatccagtcctagtgagcgacgtggaccgtgcagtttagatctaacggtatccaaaaaaaatgtctgcttggccaccaatttttcatctaatggatttcaccaattcaccctatccagatttggatgttacacatgattacggagggaaaaatccagaaaattgctcctgtagttcttcgagttcacgaatcaagtctccagagaagacgccgtatgacgatgacggccgccgtgcttcgccgctcagctatctcttatacgcctgcgactgcgagacgcacatcgtaactaaaccttttccctctctggattaattgcctttttactactaggtgagatgaggcgataacattgatacacagctgaacacaatatcaaccaaatgcgggcgcgaattggttttgaacatagttcattgctctgggaattgttgtttctttagacgcaggaaacagaacatcagaacatggttacatttaatctgtatttctctgaatctttttcctatttttttaaacctgaatttttttcctgacaacagtctttacaggtagtagaaattaactttgaaaggctccatttgtagatgtcaaataccttagttacagcatgagtctaatctgaggtgagggaataaataaaatagtacaggtggatggaacctctcaatttcatggttgtgcactttgttccaaactagataaatatgtggatttcacttgttttttttttttgaaccgccttgaaactactaggagagaattgattgaagatatggatgatttccaagataaatggtaactctgcattacaggttcacacatgtacatggaccaagagacctacggaggcaatactgcctcaaactccagcggaggaccattcttggggtataatcttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacagtgatcacccaatatgacctgaaacagcagaaaaatcaacaaaa

SEQ ID NO: 62009 - DNA, 11219 bp, Oryza sativa
ggtcctaagtgggccttcatttgggcttcatagtcctaagcgggccacagcatctaagactatgggcctgtggctcacccggacttggcccagctacgagtttcacatcttcttcctttagccagtcgtactctttgcgaattccaaatgtaatttcgcctcgtcaacaactcaacactgtaatctctccacatccgtcgctatcaacattgaccaaagcagggtcatctaggcttcccagagacgttgacacttgattgacactaatccaaatggatcaatcggttctcccctgtttgctccgtcaaacgcctatgggcagacaaaaccaattttcttttccgtcttaggcgcgagttgacaccacaacttgcatgacggcattcttgtacatcctgctgcctccctactttcttcacgtgtacactgcacggagacgactcgagggaacattatgctgcaaacaaaattctcaacttggccttcacacaaacagtaccaccgctgtcacgccgtacataaaaaaaattataaaaactgatgcagttgcgagttttgtatatacccatctgatgcgaaccgaatccagttgagcagtataatacccagggcagacaccaaagtactactccctccgtctcataatataagtgattttgagttttttcttgcaacatttgaccactcgtcttattcaaaaaaaatttaaattattatttattttatttgtgacttactttattatctacagtgttttaagcacaacttttcgttttttatttttgaaaaaaaaattaaataaaacgagtggtcaaacgttataaacaaaaacttaaaatcacttatattatgggacggagggagtagtatatctttctgcttgatcgcattgttcatttcttcctgccaacatgtactgctgctagtcgtgttcagtgaacctgtattgagctgaacctgcacttgtggtgagtggtgacctagtgtgaacggtatatttttctttttttggaggggagcacggccacgtgtacttccttcgtccggtagacaggcttggagtgtccgcggacttttatcatcttggtttagcgtcttggccgcgcacgacagatttgccgatttgttcgcgccaagccgccaatgtgtgtgacgagtgacgacgacctggcttgtctgtaattgtttatcgccgagctgggcggtaactttctgccgtgaccgatgcttcttgctgagttgctgtgctatgtttgcttcttatacgtggacgtgttgtgtggatgtgtctttgttgcgtttactgtagccacaggtttttgtgtgtgtgtgttactaccacggctggactctccctgcaggcagcatccatcgctgttgcacttttgagcggtagttcttccttgcaatgcaggcgcgtctagattcattgcaaagttggactgatcttatttttcctgctattcgtgacgagacagatcagcacgacgcatacggcaaaaaaatggctgctctaattttggcatttagaagatgcgccgtgattttcaggagagagtgatgcgcgtggcgggctattcttccattccagcagtagctagtaggcgccagatcattcgtgtgatatggcaaacgcaacagttcacacgttgccgactatccttctatggataaacacattgcctatatgcgacacggcgctaatgcagtatcaagttgccatggtggcatacttgcctttcccaaccccagatgtaatgtaacagaacagatgccagccaattcaacaaacaggtcgaacaattcaacaagtacgaatagagaatgcacgtgcatgatagattatccagaaccagaacttagtgacaagtactgaatgtttggaagaaatactgtacaaggctcatccatacataagacaacccaaggtctacaacttcaacatatctagcagctccaccaaaattgaaccaactgttcccgtcggaagcaacaataatgatcacaacaaatgtgcagagattctaggaacaggcgggttcatcttatgtacggacagagatgaaccagatcatcatataagacaattcctaagcagaagtttcccattacttggttgttcaaataacatacctagcaatatattgcctaccaggaacaatcggtccaaatgccccccaaaaaaatatgaacaggtctacatttacaatatcatgcaataattagagctgaacaagctatgaagatgatcgattatctggcttccatgtcgacagtgcgaacaaaatgcgccctttccatccttgtagtaaccacctgttgtcctcatcgatgatgaagtccttgtggtagcacctgaccttctcccgcgcacgcttcatcatatcctggttcaatggcaactgcttgaacccaaccctctggttccgtacctgccattgcttgtatgtctctggcctctccatcctctccagtccctcacaagagatcacattgattgcctcccggctaaatagagcagactcaatgagcaacctctgctcattatccttgggaatgttagtctccaacatgtcgaagatagcagaatagtggaacaaggcctcccggaagcgtgtcacaaaaaatggtgcattgtaagatccattcaccaccccatgaatgaacacatgtgggttcatcttcctaattgtcttcaatgccatgttccttggactctcagccaccacactctcatccatcaaattcttgaatttgaacatgcagttgacaatcagaacctcatcctcctcaatgtggagatcctccatccggacagcctcaaatcgagacgcaatagcttggaattcaaaaggaacattgaaggtctgagcataatcacttagatatctccccgtctcctctgtgcgttctgctgggcggaaaccaggctgaggtgtgtcaattccagtgatcctaagctttggtgggcctccaggcctgttagatagccgctgaataagacacggccactgaaatccatagtatatgccataatcgacaatgtgaactttcttggccttctccacagcattcaaaattgtttgattggcaaagtaatgagagatcttcttaaatgggcaagctgccaaataaagctggtacgctttcagcacatcagtgcatggaagccgagttatcgtgtagttcttgtaaatttgactaccagtacctgccagcctcgcctcgaggccgttggcgaagcagtgtgccaaacgctgatcaccatcaccattggcatgagcatgctgcctgatctgcttcaggagctcagttgcactgcgcctgtcatcagtggccacagactgagcacaatggatgagaagggtctccaggtcaaccacctccttcttgggttgtttctttccacgacccttgccatggctggaccctttgccatggcctccgcctgaatgtttcgccacatcatgctgcagagcctcacgcaactccttaacaccttttgagcatgtctcaccattgcatagcaagaccttgtccatcaaatccctcacaaggtggtcagtgtcaatcccttgcgcggaatgcttgctgcacctcccttcctccgcatccaggtcatcaccatagaaatgcttctttcctcggtgacctgctgattcaacatcagaggtttctgtcttcaccttcacaagcttcttctcttgtctaacctcaccaaggaacctactcccctcatctccactgtagagcttatccacatcaatcacaagcttgctctcatcaggaagaaacttgcttgcctcttgaaacccgcggcggaactgcaaagcctgttggttctgcacaacaaaatcattcaggctaacatcaggcaagacaccagccgggctcagcaacgactcgaatccttctgagaaagtaacactgctgccgttcgaagacgcgaacgacgaagattgcgacgggaggttctcacgaaccggcttggtctggagctgatagaattccgtcgggtcgtacggccaggcgccgcccgattccaccatgccccccgtggggatcagatccccgtacagctggggcgtctgcgagaaggcggccgtggggaactcgaggaccggcgtctgcggcacggcgccaagcccgtcggaggacgagctacagttgcagggactgaggctgttacaggagttggcggcgctgctgccgtcgggactctcgaccgagctgccgcccgagtacggcgactggtcggcgaggatctcgaggaacggcttctcggcggcgagcagatcatcggcgttcaccgggtagtgctcgaacttctcgtcgatgtcctcggccatgagcatgcggttgatgtaccccaggacgatatccgagaaagcctcggagtcgtcatgctgcgccgccgccgacgacgccgccgaagcagagaccgagacatctctcggcggcgacgcgccgttggtggaggccgccgagatgggctgcgcggagacaatattcaggtagtcgccgccgccgccgccgcaaaccgcatcgggcgaaaggaacagcagcgggtcgaactcctccgccgtcgcgaacccattggcggcggcgatttgggggtagattggcagcggcaggtgcgcgtcgcgcttggatccgggcagcatcgtgcacacgtcgtgcaccccagcatccatgaccatctgtatccaccaccaccaccaactctaccgccaccacagagcatgcaaacctcccaacactcgaatccccccacctagcaaatgcgccaaaaaaaacaccacgaaaattaaaacaaaaatcagaaacccgcggcgacgaaggagcagcgcctcgtcgagcccacgcgccggctagtccgacccgtcacccgtaaacagcacgcacaacatcgcagccgacgagagctcgcgtcgcgtacctgctgcggcgggagggagacgagcgaaacgaagggtgagataagagagccgagaggagaggggaacggaggcggaccagtgttttcgagaggcgcaggttggcctggcccgagccgttcgccgactattaaaaccgaggctatgcgctcgcgcagccgaagtgtcgacaccttccctgcgcctggtccacggccgcggaggtgggatgcgggcgggttcacggagaggggttgcgccgtggggaaggttcgtggaacgagcgcgagcggcctcctgggccgagagctgggtgcggggggtggaccgtgtccgtagaccggattgttgattactggccgacttgggccagaagtattttgttgttgtggtgatccacatcatcaccggggacgtttgttgtggtggtcgatactttgacggtttgactgattgagcagcttggtgactctagccagatgggtgtgatagcagcgtgcagctgcaaacatatcaaatttggcatcagtttgatagaaagggttgtttttggtttgaagttgtatcaaaaacttgccgcactaaattttaaataagttttggtactatcaaaattttggtagtgttgtattgtttcaactctatcgaattggcaagaattggtttcaattcatataggtagcaggtactattcaaaattaaggttgtgttcgaaagtgtgttcaacctatttcttctgcacgaaaaataaggtagcccataattaatcaagtatttgaagaaaaaaaaccttgaaaatggactaatataatttttagaacaactttcctatagaaaatatttgcaaaacacatatcatttaaccgttcgagaaatgtgtctgtgaaaaacgagtgagtagaagatcccaacctacagagccaaatagtctaacagatgattggtagggtaagaattgttaacctttttaagtctatacaaggatgatgagtgtataaggagaaaaaaaagagcatcttacgaatgggaaaatatacatgcggtgtttaattgaatggaggacatgcatgcagcatttaatttcgtcgtgtcgttaataatagcgagagcaacccacgtacatgtatgcaaccaagtagcttacggtcgaagttttatttctccttggttttagtaataaaatatctaattattctaggagagagtaagtgggtcgctaaaatgctagactttgtaactctattcatacccttatcttttttagcggggaaatgtaaaatggatagcctcactgaatttgatgaaatatgcacgccattaacacccactagcttgcgtgttcaatctatgttctttctgacacgttcaggttgaagtatataggtcatgcgcatatttattttacacatcgaaaggccaattctagacgaacttggtttttttttttttttgaaacttagttgtctgcactataaactcgggagacgagcgtagacgaagagtacaagtgtagacgtacgttgtgatcaagtattgagtgtatttgagtagctagcaaataaccaagtatttggtcgatgatcaattcgctgttcccttggcaagagatatttaattaatcagctaactccacacaaaatgtcttaagcaactaagcaataagactgagtgactgactaactactactccgtactacttaatttaccaattggcatatagaataccgatgactcgacatggattgctccatattataacctgtacatgtgaccatccttacgtactgtacatacattagcatccgtatgtgatcatagtcgcagagatataaatcgtgacgtcgatagaaaacaaggcatcggtccatccatggccatcccctaactgtggcagacagctcatatagtgcctgcatgcacgagctacatctacatcaagtatagtagtattcttaactcatggtggtaatttgattttctttattaatatgaacatttttttatttggggagtttctaaatttcagttgttttaattttatttctggaatacgcaaatagcgtgtatatatctttatactagggttgataatttgttttttttattaacgtgaacattttaaatttggggagtttctaaatttcaactgttttaattcttttctataatttgtaaagcgcatacctttgtactagggttgagtacttgagtatatcgctttacacacttggctgtattcttttggaacccctccccaccacacggaaaacagagcgataaattaacacgtgcttaattaagtattagctataaaaatttgaaaaatggattgatatgatttttaaagcaactttcttatataaactttttcaaaacatgtgccgtttagcagtttgaaaagcgtgcatatgaaaaaatgatagagataggttgggaagccataagaaataacacagctcaagagcattagatatgtacagacagaacacaaaaggaaaagtagacttgagtgaggaagagaagggtcgagggatgcagaaggtgatgtctcctaaagtttggactttttggtgcgacttttaaacttcatctgttttaagttatatttggttaccttatgcgttttatttctatgattaccgtgagaaaatatccagagtactataaattagaagcatagatttagatggtactctaagatggatatatgctactagtacgtagtacccacgaaccgcccgtcgtcgctgtatttaggattagccgtaattgacccgcttggtcctgtacactcccgtgtgcagtggccgattgaccgtgtcagcgagaaatctcgccaagttaaaaataaaaaaattctcgcggttcctggactgtgattggcgcggtgcgctgtgtcatgtgtggattatactatacggcgcatgggccgggttcaccgaaggccacggacacagaattgccttggccaccaagttcccccacggccccacgtggtggtcccgagccagacacgccgctcccgcacgccggccgcacgctggcccgaggcagcgcgagcgacacatcagcagacggcgtggtgcgtcgcagcggggctgcggggcccttcctccacgtcggcatgtggacacacgcactttattacgcacgaaggacagacaggacgcgtccaggatgagcggggtcacggcgtcacgcactcacgcatctgaaacggcacatgaattacaccgtggagtacgtcgtgcacccagctgagcggcatccgtcgtctaccacgagcgaggcccggggaacagtgccagtggttaccaccacataccgccgcattttttttttacaatgaaacgagttctgttatttgctcaattacttgggtggtatttgctcaatcactgaagtttagtccctccttcccaaacacccccttacttcctctatcccataaaaaaccaatagtactggatgtgacacatcctagtactatggacaagtactatgatgtgttacattcggtactaggttcgttttttatgggccaattgcatatttgttattggtttgaattgttattgtgaatctgccattaagaaaaatgtgattgcattgccattaaaatacagtatgaacctagactatctgccatcggattgacagattgaacaaacatcattagaaatcttggttttatgaaaattataaaagccacagtaacagctgccacaactttgcaagattaacagccatcctcatgttgttgttgttgttgttgttgttgttgttgttgttgttgttgttgttgttgttgttgttgttgttgtagtccatgctgctcatctgctatcaccatagttagctgctgcgcctgcggcttctcagccgcaatagactgcataatcgaccgccgcaacacccgcctccgccatcgtcgtttttatttgtagctacctccataattgaccgcctcagcgcctacctaggcccaagctgcagtcgcctgctgctgctactgcccaagccgctgcaaacccgaccgctgttgcgcgtgcctccgcagtccgtcacccaagccgccaccgccgcctgctcgatttgctaccggctaaaatacatatcctgtaactcttccatcgccatcttgtaccttattatgaccgatctatccgataatttgctctcgatttaaaagaacaggtaataaggggatttgggatctaggtttcctcaaggaagagaggaggggatgggcaaagggaacaaatgagtgctgccagggtttgaagagaggcagatagggaatcggtcttattattcccttgatttttcacatttgttttatgaattatttttagcctcttaattgcacacatcaaacaacaatggtaaatggaagctattctagtggtaaatttgcagtttttttaatggctattccaagttaggaggtaaaattaagtagtggtatatttgccattctcccatcatttattacaagcaactaaacaatttcaacaaataagaagataaagtctaataaatccaataaataagaagaaatacttttattcaagaggctgatgtggtcaagggtctgtttgattgccggacgcaatttctcatgattttgtcacacctaagattaatcaagtttaaatatcatgatttttattccttctagcgaattagacagtacatactattactaatgactccgaaaagatgacaagattatcttaatcttgctaaggtgtgctaattagattttgagcacataatcttaatttgagtttgacagtttgatagcaacttatgattgtcaaccaaacgggtcccaggtgtggcaaagaccttctcgcagtttggttagattgcaggctttgagcaaattaagaagcgattatatcccataaccaaataaacctggttgttcattagttttctcaaaatctcggtatatggcgatgattagttttcttgagactcgttagtttactcctatatactccatgcgagctgcgtcacatgcatgcagatgcaagtggagcgagcccccatagattccttctagaaggtcttggtacattggacctgagccacaagaccaacaacactgacaggtgggaatcttttcggatcaacatgaggatgttagtactatattttggaggggcttcaggcttttcttttgtttttaaggtttttttaattcatggggcaatcttcttttggtgtttatatatagcaagttgatctttttatgtgtgatcatggacaatcggacataaacaatcgtgtcattcatcatcacgtacagtatgcattaatcgtacgtatagtactagtacagtagcagttacgattgcttcatctgtaaacaaaggtgtgctaggtgcattatggctgaagaaagcttgttacaactactaataacgaaatgacagcatggacatgctcaattagcaacctactacacgtacgttacacgacgtagcatcaagcaccactcatatatgtactaatacacccatgcgtgtcgtttcatcgtgacaccacactctctggcagtgtaaatccgcgagaagctcacaaaattctcacgcactgaatttaattaaatacataaacatcagcatggaaacgttctattttaaattggaatcgtatatacactcgtaaccacgtagaccatttaaagttgcttccccaagtctagacttactccctcataaaaactaacctatctttcaccatcttatttgtcctgaaaataatttgtatcttttaagtaatcattacattagagtttataaaagtgagaaaaatacattcgaactagataaagtgaggaacaattatattaggatttaataaagtgaaattatattaggatttgataaagtgaaagatattttttaatttatattggtatgtgtgaaatgggtaaaaaagcgatgttattattttggatggagggactactcctcttgcaaaaaagaaaaaaatcaatcgtgaagatgtatctagatagcatgtatgtgtgtatagacacacacacacatcggattgaataatttttaggatagagggaatatatctttaaaataatctacaaaggttgtaaaataaacaaagaaggctgtcaaatataaaatggagaaataacgatattactgtcttatccttaaacaacatatatactccattcgttttaaaatagagtgaattacactttaggcaaggttattttacccaacttgcactatgaaccagggtctacctcatgctttcacttgagaccag

SEQ ID NO: 62010 - DNA, 2588 bp, Oryza sativa
aaccataggagctcacagtggattcgattgaatcgggagggagcagggaagcacgtaggggattgaggattgaggaagaagacatcagtggttgacgcgtgggccactggtccaacttgcaaaatttggtgataaaatcttgtctaaagtgaaaagttttgctaatgcctagcctaatgtgcaacttaggtaataaaacatgaaccaaagtgtaatttactctttaaaatataaaaacctttaactgaatatgacatatgctagaactataaatgtgtatgtaattttaaaatatgtatcatataactctacatttttttgttttgagacagaaggagtagtagacaaagctagctaattaatactactagggctgagtttagtttcaaactttttcttcgaacttctaattttccatcacatcaaaacttttctacacacacaaactttcaactttttcatcacatcgttctaatttcaatcaaacttctaattttggtgtgaactaaacacaccctagctttcggcatttcttttggtcagatcactccatgtatgccacgacaaatagggtataattcagataattgacacacggcgcttattggctagttggatatctacatggacagctagctctagctgttaccgtagaagtttgttgtaaaatacgtggtccgatacaaaccgtgcaacacttcactgtcagcaattttaacacgagaaaaactgcacgcctttgaaaattcctctttaatttatataattattagtctgtcatgtgcccactgagtatattttatatataacgccatgcatcagccatcagaaaaacgtcacttaattttagttgatgtcgtcagtttagtttgatcagctagctggccgggaaaccagactttgctagctgcggttttaagtcttgatctctctgatatatccatcgatctcaatcgaactgatatactctgtagaccacacgagtatactgtatactacagcacgtacgaaatgacatgctcaatgtccataatccagcaaggactggtcgatcatgcatgcaactacggtcgccgtcagaagtcagaaaaatctggtcatatagcgctctgttcttcttgacttcctgtgaagttctgatgctgtgacagcgtacaagtgcactcgttgtttgtactttcggatctgtttaattatcacgttatccaaaacataaattaatgtttctgatctacctgcttcagatcatgctgtcatcgctaaacgctaattggcgatccagtaatgataaagtatgttgctaataaagcgttggtgccaggtgtcctgatacagacagtgaaacctgatcaggttagtctcaataatttcgttgcatgtgtttcgttatcttgtggtggaagaagcctaagcaccttcctggtagtttggtaccatggttgctgcaggtccttgcatgcaggtgtgagactgtgagtgaagaaactgccttgatttaaacaatcatttctattttctatgcatccatgaaacatcgcactaacaaagcacaaacccgttctatataattaatcgctaatcactgaccgtcagctgaccgccgactgtcttgtgggctaagcagccatgtaagaattgtttaattaggcgcaccaaacagcgtcccggtgcagtgtactcgtatgccccaagctttaagggtgctttgctttgcaatttttttttcctggggatagcagaaagtagcatattgaccacgagcgaggttagatggggcttggagatgtcgcctttgacttggctttcctgcagcttcggtctcggagttgtccggggcacgtagctcgagcagataacgaaaattttcttgatcagtttgggagaagagttgggtttgaccatgacatgttgccttgatgacataatacaaggacatcagttgcattcgcactgttctttaattatgacatcattaattttcccttaatactaggtgtattgttagaattgtattttttttacggaggtggtaatacactattccccagccaaataggaccaaatttgaaaagaaaaaagacaactttttactgagaataaactaggcacctaaattatctcgacgtgagcttaaagtacttttgggtgcagtttgctgcgatataatatttgctgtcatgtcatcctttttaattttgaagcaatttatttatttttttattgtaggcagcgtgcattctagctatgcagaagtcataattgattttagagtaattgtatcactttgatataattgtctaagattaataaagctttctttataaaaaaatgattaactgaattagtctcaattgtacactcttattcatggtaactgtatttctactattatttaaatttatcctaaaataaatgtcacaataaagtactaattgtcctatcaatcacttctcatttaattttcttcctagtattctacataattattctttcgctatatcctatacatcatttagagtacaatacttttttctttctcaaaccttaatatacgctaaataattagagttacaattattttgggacgg

SEQ ID NO: 62011 - DNA, 1442 bp, Oryza sativa
gctcatctcaaaaccatcctccctttgagggaaagaaagaaggccaaccttttcgctgaagccatatactgcaacctgggcataagtcatcttagtaactttctccagatcattctgtgcaccagtcgagatctttccaatcaagacctgaaaaaaaatcacataattaagtcatttgcttaagaataaactctactgataagttagaaaatgttgtgtacctcctcagcagctcggccacctagtgtcatgcaggtcatgtcaaaaagctgctctttagtcatcaaaagattgtcatttggcacatactgagcaaaacctaaagcagctgttccacgaggaacaattgtgaccttcagtagtggctcggcatgctccaaaaaccatccagcaacagcatgaccagattcatggtaagcaacagttcgccgctccaacttgctaatcacctgtggtggacagattgataagtacataaccgctacacatgaatgtccaattgttcatgccccatataatactttacatccaatgcaacagcacttaattatgcaatgatttctgctgtaacaagtaacaaagagaacactgaaatcacttttaaaattgtacaaaccaacctaggctctcaaagcaaatgtgaaggtttcaaagtgcgcctcagtcacatcaagaataaaatatagcaattatttgcaatttaagaaaaaacagttataagcagttctcatatagaattgacaacattgaccaagccgatattgtttaacatatatataataaaatttgctacctcctgaattgataaaacaaaaagtatggcagcccaacaacaaagtatttgcaacaattttgtttatttatgtactcgtagcctagcagcattgtggatactggatagtttggcagccaggttgcaaaattcttatgtaaaatttgataaatcaactagtagaggcaaatgaaaattggcgccgtaaaaaataccttgtttttcttttccaagcctccgataaccctatcaattgcagattcaaaatgttgcattgtaatgagtgtgccctcacttcttgcagcaattaaagctgcctcattacaaacattggcaatgtcagctccagcaaatccaggtgtcaaagcagctaatctttgtgaataaaatgatggttccttgtccagtttcagctttttaaggtagatgcgaaatatttgatcacgaccctttatgtctggtttatcaatacttatctgacgatcaaatcttcctggtacatagcaaagccttatccaggatgtcaggcctattggtaccagcaagaacaacaacaccagatgtagttccaaacccatccatctctacaagtaactggttcaatgtgctttcacgctcatcatgtccaccagaaaaacctccacggcctctagcacggccgattgcatca

SEQ ID NO: 62012 - DNA, 16649 bp, Oryza sativa
gggatcctcaggaaatgaacaaattccataatttcttgtttggcttcatcacagccagctacatccttaaagaacacctgtagcacacaagaaacaaggttacttcagtagaattatatgaatatgttattgtatgttctttgtcaatggtgaataaagctacagaacaaacatttacaaaaaaggatatgaatttcatgttttgttcaaaatagcaagagatggaaatagcaaataaaaactaaccttatttttggagtttttatccaattttgtcacttgaacttttccaatactgaaaatgctacggcctcctttcccaggaccacccccaacagtaaatccattttgtatccttttcccaagcaaatatattaatccaataattagaacggttgggacatacttcattacttcctcaaaccattttgcttcagtagtgtaagtgattgggacataatagtgtggatctatctccaatgctttctgggcctcttgtaacttctcttcaaaggagtcaacacttccaatattgaagtaatacttgtagctgctaggagactctatcccaggaagatgacttgtagttatatggatatcactatcctgaattcgatcaattgaaggtgaactcctgacgtaaaccttagcaattgacttgtttgaaacaacaatgtggtcaactaaaccaggttccaacaacttattcttgaattcttggaagcttatctgaaaagaattacaattaagtgggtatcacaagttataatggactaggaaatgaatgtatgtgtcgcacagaaaaagaaactggtagggaactgaagtgtggatatatgatatagttatacaggattagatgattaataggatgtagaataccaaccatattgcatttcataccaacatggcactaacaacatacgaagctcatgctaaaatgccctatatcaaactcttaggataggatatgatatgccatcagtaatgaagtactgtagctagggtcacatgctgcaccaaataatcacattaatgctctcgagcaaaagcataccatctccatcagtacaactatgtgatttaaatcttttcagtcaaccataacttcagtcatactccctctgtttacatttgcttgtcaccattaaccggtgctgttacaactttgaccacaacttttttaaaaatatatatatatatcatgttttgatgaatgaaaacagtatgatcatatttagcatgtaatataatttcataatatagtactccctctgtctctaaatttaaggaattctggctataaatatatggatctggacatgcacgtgtccagattcatagctagaatcccttacatctagggatggagggagtatacttttaaatatttacaagtttcttgataaaatatgagaagtcaaacttaggatatgaatagtatagtgaaaattatttaggaatggaggggggcagctaattaattatcatcaattgtgttatgtacaaataaaacataaactaaggactacatgtgaaagcataatttttttttccttaccactttgctaggccagcgaaaccaccaaatatttttttcaagataaaaaaagtaaccttatatataacctcatatcacctctctaattggactgcagcaaaatgaacactgacaaaatttatataccacacagaattggaatgattcttttctgaaatttataaggctgaccaaaggcgaggaccttcagtaaagtaaatggggattttgataacagctatcttctatccacaagtgtgaacaggtaaaatgacaatgaaacacacaagccactactgttgctcatgtttaacagtcggtttttcagtaggaacagacctcctgctctgatgaagatgctgatgcagataacaataataggccaaaaaggaataaaggagcaatcatgtccttgaattgtttaatgctctcctcgaaattccattgatcacctgaactggattgctctgcacaccagaaatgaccacattaagtatgtggtttgcagtataatgctatatacggatgcatcaaactttacaaattgtacgcaaccaacttgctttgggctaaaggctcatgttgtcgtattccacaatactcatgctagtacctctcccttaaaggtgagcgggcagtttatgaggcactaaaactcaaatattagcattttcagctatacatgatacttacatactgttaggggtatttgtgcaataaaataaaacatcaactagccccactctgtttaacatgtattgccacttacaaaagctctgcatatcatcttcttaacattgttttctattatcagtatactaaaactagaaatcacaagttatgatatagcatgattttagggcagcactcggaaggttaagtcgccactggtatgtaaaagtctactctctttcaaaatattttgcaaagctcaacaccttaataaaccatatccaacacaagagcgaggaatgcaggttaaaataagcacttactctttgagtcggacttgtcactctcatcccctttacctttattctcctcctccgaatgcttcccgtggtctgaataaaaaaggcaacgttaaatattaacagagtcaccagatatccccaaaaaccacctaaccagccagaaagcttacttttcttcgacttgtcggagaatagccgccggaactgccggctagcaagcaggaacctccagtccccacccttccctgccccggaggccaccgctgcccgattcccgataactgacgtcacatagctgcgcagaaaacccaactcgccgcagggcagcggcggcgacgaagcacggagcccgccatgccccccgagcagagaaccctacggcaacgacatccgcacacgccgcccgagccattagggcgaggacgcgcaggaagaagccacaccaatcggagaggggaaggggagggggtgcggctcgggcactcacctggcgctgccgggaggagcgcgcggaccgggcgagggcgcgggagagggaggagaggctcatggcggcggcggcggcgagcgcattggacggagatcgaggcgggggcgggccgtattagggttttgatcccgcccgcgctccgcgtgcgtgatcgatcgaaactagccggtaaagtgtactgtgcccccgttttctcgcggagagagcgacgaaccgacgagacgaggtcacgagggacgcggttgatggtggcggcggagagggctcaagggaaatttgttggtgtcgatgaaagggcaggtggacacgcggcaagggattgccaccaatctggagacagttcggagcttccgctgccagtatgggtccatgggccaccctgttggataggccacgatattggaccgctaccaaactggtccatcacgatatataaatgaggaataggttcattttaggtaccttaacttaacagtgagtttgattttcgtcctttcaaaccacaatatttttctacaaatttcatcgaatttttaaaaaattgactataaaaagaatcaaatgatttataatatgaaacagagggagtagtagctagcaacaaccaaattagtttgattggtaatgaaaaatatcaaaccaaatatgcgtttgataccagcaatgtacacatttagcctccaaattaagtggcaaactagtatatttctaatattcatcaggtattagcaattaagttcgttagttgtgcaacctgtttatagctagctcggtggtctttccagcgtcgggcgaaccccacaagttgtattcttttttcgtagctacgttcagatcctttgacctgtccactacttatacgtatccatcagtaactaattacaccttgcaagtagatatccagtactgtactatcgagtcatcttcccaagtcaactccccactcacttcagctacagaaacagtgtttcctgggaccacggccagtccaggcacgaccatatggtcggcggcgagtcagaggacagcgccgtagcggcgtcagcgcgcgccacggacgacgaggccgaggtcgagccgccgccgccgccatcgtcgcacgagcgatccgtcgcgacacgacgcggcgcggcgtgctccgcgtcgccacgtcgtcgtaactcggcgacgtcacacgacgtcccatcgtcttgtggccactctggccgtagccggccggcgccgtcgccgtcgtcctcggacgtcgtcggcgagaaggccgccctgacatagttcttcctcttccttgccgccgccgcgggcgacgacggcggcgggccagcgccggaggcggcggagaagcccactaccgacgtcggcggcggtggctgggcgatgtgcggcgggaagagcggctgcgggccgtgatggtgcgacccctcgtacgtgacgatgagcatctccgggtcatcggtggacttctcgacgtgcttcttggcgctgcatcgggagctggtgcacttgtagtaactcctgcattttcaccggagatgatgttaccattgccgtgatcctgcaaatttcggcttctctgaaaaagactgctcatctgaaaacatcgctgttgtgttcattagccgccgttttaatgcgatgcagatggatgttaattcttgcagttcggcgttcgtgtaattaattacgttttcggtgatgacgtgcacttggagattattcaacagcacagtgattcagactatatatggcatgtgcatgtatatgaaagcatgcgtgtcttcgcaccatcctgtatttctctgaacatgatctggaattaatgtctccggccgcttgcttccgctggtgtgccactacgccagtgaacaacctacctgcggcgcgcgctttcaaccccgcgtgcacagtgacactgattgactctagaactccacgtggtgctactagttgggccctgtttatttctcacccaaaaattttatatcgtatcgcatcgaacattttaacacctacgtaaaatattaaatatacataaaaaaaataactaattacacatattgcgactaatttacgagacgaatcttttgagactaattgctctatgatttgacaatgtgatgttacaagaaacatttgctaataacagattaattaggcaacaaatttgtctcgcgatttactgacggattctgaaattagttttttattagtgtccaaacaccccatccaacccatatataatacccgatgtaatacgctaaaactttacacccatggatttaaacacccccttactgatataatatatatatagctttaatttctctggaatctgaacacacgatctatcaatctatcatggttgttgtgaattaaaggctcctcacttctcaactgaaatgctagatcattcacatccacagagacagggcaatcaggaccgtgtccccccactcccccttaagacaataaggatatttaactctattttttaatatatgacatagttaacttttaataaatatttaatcaatagttttatttaaaaattttgtacaaatataaaaaaaatcattcttaaaaagtatttaacgataaatcaagtcacaataaaataaataataattgtataaacttttttgaatacgataaatagtcaaacgtatctaaaaagttaacgacatcatatattagaaaacgtagatagtaatttctttcgttagaaaaggtaagaaaattgaatggtcgaagcgaatgaactgctaagaccacaacatgctactcatcacatttgtgttagttacatgcaggatctcgtagtgtgcagtaggtacctaattaaagagtctcctaaacaaactccatcagttttaaaatacagaaactttcaacgtttgaatctggtttcaaaatataagaatatctagcacactattctagggagtacatactacttgtcctataaattattatttcccgttcaaatttcttcacatctctcactcccacctacccatacaccctacctatccatcatttatttattgtgggatttctatcttttcttgtctaccttaatatctgtccaataacctagaaatatttatatttacaaataaaggtagtagtaattattgagtactccctctgttttcgaataacatactgtagaaattttcaccaaaacacgtagatcatggtaacaaaatttataaccaaattgtcattggtagttatttggagatgattttaaagaatggataaagtggaggtggagggcaagaaatggatccaaaatagaagcacctagaagtttgctctatggtgaagattgatttatgttcacaagtatagctacggagagtagggtcaaaattaaaattctgctaataaaagtgtggtggtgataaaaatattttgaaacaaacgaattggaggaaaatgtcgttatttaaaaatggataaagtataaataaaaatagtatatcatccttttgttttgagaatgtttatatgctatttgacggaaaaacaccttacaaatcatgcaaatcctaaaccattggatcatattaagaatcgtgcaccatatttctaaccctaacccctcatttcttctattgtcattcccagcgcaaccgctgccactcgcaagcttgcatgcatgcgatgcctctgcctcagccccatgtgccgcagcccggccttgccggttggccgaatgaagtcaactgtgccggcaactcccccttcatcccgggccttctccccctcccacctctcttcccaagtcggcggcgcaagtgtccctgtctcgttgtcttccccgtcttcggcagctcctcgccgttggatccgtcaccactaatcatcgtctcctaaccataagctctggtttgcccccgtcatcaaggccaacccatcatcctcctccatctccgtggcttcgatgtggccgccgatgcctcacctccaactcgtgtctacctcccactgtcgggccgttgcctccgacatctctttaagcatggcgatgtccctcttctttgccctcccctaccaacctccaaccctaccacaatcaaaaactctaaaccctaacttcactaccttcatagaggttgctagagttggtaaagaaggtatcgtcggagctagaggagaaaaactccggtcttctgagcacgaatcacgaattaaatttcaaaatgggtaatatacgtgattataaaaagaatatcgccagccatttaaccatctttttttaatgtaagagtgttgcacggctaagcgttgacttccccgtctagggaattcgtcaatcccttgttctgcaccgtatgacactaatcgatctgtactgtacgattggcacacgtgtatacgtatacccgcgagtccttccaagtcccactcgcggaaacacgacacgtacacacgcgcgccgccgtgggcgatagcaggcggcggcgagccgcgcagctagccatattgttcatgcacggattgcacgcacaggcttgaccgcgcgcgctcctggcggcgtttttctctcgatttcgccatggtacggtgcagctgcaagcggctgcccccagcgctagcgccgtatccggtgtaaatgaacgacgtcgacacgcgcatattgcgccattcttatcaggactaagaatacatcttcgttgtcgtcgtcaactcgtcacaactgtatgtacggctacagtacatctttaccacgtcgtcccgttccgctcccttaattggttaaattttctttttcacaacctaactaagaacgatttttgaacgcttttgagcatgggcgtaagtttaatcagtgcactatggtcaacttgtcactaaaaccgtgccatccatatcgcaaaatctaaaccgagagcgctctcgatttagtgttaaaagagcgacgcactcattcgtgagagaatgtccagtgctactagtacgtgagagaagatcctgtgctgccagtacagctacgtgagaaaaggtccaggtgttactagtgcacataatgcatgtctattttttttctttttatagaattttctctcaaattacttatccgatctacaatctgattacaccattacgttcgttgcaattaaatctttacaacaagatcttacatgattatattgcgatgaaaaatatttatatttataaattacttttattatatacgtaagttacttttatcacgtatataagttacttttaaatttgactaaattacttctatacattcataatgctctaagttgattatttttattattgtttttagttaattctatattttgtggactttataaatcttctctacactttacttgtgaatttactctacataatttcttatttcagctcactcacaatataataatttctactacagagagttactcctcccgttttataatgtaagtcattttagcattacccacattcatatagatgttaatgaatctagatatagttctaaattaaagttactttaattctttttgttgtaattcaattttcttaaccgaatatagcaagaatccgacaattgacgacttgacaaatctcatcgactaatctcaggacttcgaagccgatgctaactctaagccgatgactactccgggcttaccaaatttcactgttaacagtaagttacttctataatatatgtaaattacttttaagctttactgaatttacttttatatgtctaagaagtaacttagtgaaatctagaagtaatttagacatatcataaaagtaatttgttatttttcatcaaaatataatcatgtgagatcttgttgtaaagcttctctaaatcggattaaatcggattttattgttacgaacacaacggtgtaatcggattataaatcggatgagtaatttaagagaaacttctctaagaataaaaaaaatacatagatattgagtatactagtagctttttttttttaaaaaaaaggtgtctctctttagcactatccagatatcactctcggtgtaaatgtgtccctatgtcgcaaaatctaatgcaagccagtgaaagaagggtagagctggtggaagaataattcggattgaaggagaatgataaagcgagcagagttagattggatcgatgatactgcgcgtggcgcacctgggatgtgggttgttcttgatcgacttctgcccgtacttcctccacttgtacccgtcggccggcatcttgccgccgcagctcctcaccttgctcgtgtacttgctctccgcttccaccctgcggcttaatttccaagcaaaccaacaacataatatcaatctccggtaagaactggagttagtttagctctatgcatgtgtgcacaattgtgcatgcacctacaaatacagagagctgtagcggcggccggaggggtacggcggccggggcgacgccgacgacgacagcgccttctcgatgtcgcggatcgtcgggcctgagtacaccgagcacagatccctgctcaccgccggtgccggccgcggccgccgctcgtgatcagcgctgccgcccccgttgcacggcgcggcggcggcggctgctgatgaccccgcgccgaacgagtagtagagggtggggtgttcggcggccgggacgaacaggccgtcgtcaccgaggagctcgcctatgaggtggtcgtcgagctcgcagggccagacgccgccggccacctcctccgccgacgcggtggcctgagctcgcagcacatctcccatcagatatggtcctggaaaacgccgtcgttgcttgtgaggggattggccatacataccacgggccggtgcaacgtggttagttagacacggcgacgaagtaatggaacagctcggagagtctgatatatacggatcaatgacatggacacatggagcctaaggtcaatgtcaccctgggactagatcggtgtcatgtttcaacggaaagtcaacctgtcattggctttggtgcacgacagcaagctaggttaagagccgtatgataaagttactccctccatctcaatctacagggcgcctacttttaaagaaaaattaaactcgatagcttttaattaataatcatactaactatatttatacttaaataaatattatgtatattatatcactattatattttaaaatactttcatatgatgctaattttatatttgttgggatcatataataaaataaaatattggtcaaaatatgttattcaagaccatattaaaaaatataaggcttacaattagggtagagggagtactaattatataccagagttttaaaaaatctatttaacagatactaccttattacaaacatacatattataaggatatatatcaccgttcgaatgtgaggctgggcttaagcttagcgtgggcacacaaaacatgaataactaattaaggctgtgttcggcagcccctcctaccaacccatctccctcgtttttcgcgtgcacgctttttaaactgctaaacggtgtgttttttgcaaaaagtttctatacgaaagttgcttaaaaaatcaaattaatatatttttgaaaaaaatagcaaatacttaattaatcacctgctaatcgctactctgttttccgtgcgagcacttagtgctgggaaccaggggttccgaacataccctaagtattaactctattagctactactacaaatatcaaaaattgtgtaaactagatttttaagtacttctatatgaaacttattttataaaatacgaaccgtttaatgattcggaaaacgttcacacgaaaatcgatgaagtagctcattctataagccttgccaaaaggtgcataataagtaatataagtaaaagaatgtattttcaagaaaacatattcttataaatatatagagcaaatcatccatgttgataatctctaatgaagtactacctttgtgctaaaatgtaagtatttttttggcacgtatattaaaaaaatatgtgtgaatgtttttgaggaagtgtgtgattggttaagaagaaaaagtatatgaaagagaatggttgtgattggttgagaagatgagataggtggagaaataattttattttggaacaaggtattatgctacaaatagctagtacattttaagatggatgtagcggctgataagacaatccaaatcaatacacgtgatgcacaagttcgtaagtaaagtatttacctgctactgtgtacctcacgaaaaacagcgtacagtttcttttgggaaaaaaatagagcatagttgcctccccccctctctttctctctccttcagagagtacatcctttttcaaacgtggatgaaaagaaaatttttcggtgtcacatcatatgtttgatcggatgtcggaaaatttttttggacacgaataaaaaaactaatttcataactcgcatggaaaccacgagacgaatcttttgagcctaattaatacgtcattagcacgtctgtgttattgtagcacttatggctaatcatggactaattaggctcaaaagattcgtctcgagattttcgtgccaactgtgcaattagtttttttatctatatttaatgttccatttgagtgtccaaagattcgatatgatgtttttgggaaaaaattttggaaactaaaccaggctatctctcaccaaacaaccaaccttgcagaaagtgagacgacgatcgagcgaacagaatatgaattccctttccactcatcgctttctcaggggcggatccaatgtgggtgtagagcggactcaaatcccccctacacctatcggacccatggatacccccctgagtccccccttcaattttttcgtcctgattgataagataggaggtgctaaatgtattttaatagtattttagcatagtttaatactgagattatatgtttatattgatgtactcggtatgttgaggggctgtttggtttggtgccacacaatgttcatggatccgcccctgcgctttctccttataatttcttgacgacgcgttgagcttcggttgatcccgacgcctgcaacagtgccacggccgcacggcgtcgtcgtcgtcaagcgcgagtatgatcttgtccggcacagcgctacagccacgatcgaatttactttcgaatttcgaaagatctcgttgtgtatacctatggcaccatcgatcttgctcgctgccactgccacatgctgcacgcactgaaagggagacgtagagctgttcctctgaaaatgaccgataaatccacgaaacgattcggtttcacccgtaacttgacatgatatttgggcgaagcaactgttaaactgtcatttgctcattttttttcaggcagtttggtcgagcctatactcggggcctatttagttcccaaaattttttctcaaaaacatcacattgaatctttggacacatgcatgaagcattaaatatagataaaaagaaaaactaattgcacagttatgggaaaaatcgcgagacgaatcttttaagcctaattagtccgtgattagccataagtgctacagtaatccacatgtgctaatgacggcttaattagtctcaaaagattcatctcgcggtttccaagcgagttctgaaattagttttttcattcgtgtctgaaaatcccttccgacatccggtcaaacgttcgttgtgacacctaaaaattttcttttccccaactaaacacatcctcatttactctgctacagttgaagttgaaccacattgctcccctcgccacaagggtgtcaatccaaacgtcatctcggtcaattctgggatagcagcatggtcgaggacacgaggtagtataggaaatactactccactatgcactgaaaaagtcgtcctgcaatttctcgtaaaaaaaaaagttgtcatgcaattggggtagacccagccggggcaggacatggtctctttcgctaataaaaactccgccatcggctcatccatcacacagcgatggacacataaatatatactctctcggttcctaattaaatacttcatacaattttgactagttaaaaacatactctctttatattttattgtataacgccattgactttttaaccaacgtttagtcattcgtgttattcaaaatttttgtgcaaatataaaaatatttatgttatacttaaagaacatttgatgataaatcaagtcaaaataaaataaatgataattatataaattttttgaataagataaatggtcaaacgttatttaaaaagtcaacagcgtcatacattaaaataaagagggagtattaagcgagaaactaaaaaactgttatgttcttcattaatgcgaagagaaaaaagagaagagattacaattggtaaaatagtaaaaagaaaacaaaaggaagtattaaagtagtctaggggatcagtaaaactatatttatttggggataaatttttaatctaaaacatatttatttagggctaactagagggagtatatttgaagcggaaggagtgatgttgatcgcatatgcgaatttataccagaggggctgatatctttgtatgtgtttagttccttccaaagttggaaggttaggttgaaattggtacgatgtgactgaaaagttgtgtgtgtatgataggttgatgtgtatggaaaaagttggaacacagcctttggaaccatggcgttacggactcttaattcttgaacggctcggaagatccagagttgcagagacaatttgcagtctttcagctgtttatccccttcatggacaggttttaaccctgcaggcagacaacaacctcggagcagtttgtgaatgtcttcagttcttgacagtgctcacagtaatctactcctatttgctactgcccctgttccaaaaatcttgacgctttaaggtttctaagccaatttagcttcatattaaaacgatcaaatttctcttaattatcgattcaattgtcatttcattgagtacctgcactcagtatgttactacggagtagtacaaagaatcccttaatgcaattaaataataaattctcttaaagctcattgttagatgatttgatggaatagacaaatggtcccacttttcaatcaaatttactactccaatgacacttttctgggacattgacagaagcttaaaaacgacaccttttttgacggaggaagtaaacatctactctatttgtttcataaaaaactactatctccgtttcaggttataagactttctaacattgtccacattcatatagatgttaatgaatctagacacacgtatatgtctatattcattagtatatatataaatatgagcagtgctagaaagtcttataatataaaatagaggaagtaatctaacactctgtactagatgcattctagtattagatgtgagcatatatatatatatatatatatatatatatatatatatagagagagagagagagagagagaatttttatggtactatatattgatagtatatattgccattataaatgatctaatggcgtatattgatttgaccttccacttaactagcttgcagtataaaatctgaaagggtagacttgtctttctgtgtggtggtccggatccgatgccgccaagggctctcaccgcgccattagagcaggtacaatagcaggctattagccagttataaacatattttaatgagataaacgatgagagagaagagcagcaggctacagatttataaccagctagctgcaacacggactccaagacataatatatgtatgacaggtgggatcgtatattaatagtatagtaagcaactattgtatgaattggctattagattagctatagatgaattagagatagcagtgggctgtactattgaactttgctcttatagcgctatcgggcgcattgcacgcacacggcgtggatgcgcgacgttccgcggcagcgtcgaagacaacttgaatggcacctgaccggctggtgtgcgggtcagcgggtgaactaaaatgtgcttgcatgcacaacaagccatagcaccaccatatgagaatgattaattttggtattgggttgtgttagtagtccaaactataaggtctatttcttatctgggctgcaaaagtgaaatgaaactggatttgtgtttgctactgtctctcacgagcgtaagttaaggggctgtttggatgcccacctcaatttaccatagttttttattaaaggtgtgtcaagatgcaaattgtgtggctcaaatttaatggccacacttgtgacaaactttggctaagaaaagggtctatgactagtaggaccaaaagaatagaaagtgtggcatgctaaagttatagaaacaaaccaaacattagctacatttggacaaactaacatacctcaagtgtggtaaaatgtggcatcaaccaaacaggcacgcactagagcagccgagcggcgacgagtcacaccgccgttgcgcgccgctgtcggggcttgtctctccaagtcgcacgccgctgtcggggctcgtctctccaagtcgttcgcgaggtagtgactcacgacatgacatcacaaacatctagggattaaacctaaataaccaattacattttttttggcaaattcctattgtacccttgtaaatactggcagcatatactaccagtacaatgtgcggtaaaagttctcttacctcacatttgtgaggaagagaataaatcacaacacacatatagatgaggggatttgatcctacgacctccactagtcaacttcatgaaaatagtatgttattgtgagactttaaaagttacatttaaattttattatagttatatatacgttataatataacactacgatcatactatatttatatttatatttatatgaaataaatttttagaaccctgtaccaaccggtcagtggcgaaagcccgccgggggggctaacctgcagcttggctcgcgtctcctccgcctcgaagcacgtcttctcccaatcatttcaccagctgccatcaactaattggtactgctacttccatctcaaaatatagtaatttttagctatgaatttaaatatataggtgactatattaataactaaaaataattacattttaggatgaagagagtactatttagtttggtgttttaatctgtattacgggagccgcaacttgacttgcagcttcagaaatagtagatacatgtgttcaaagtgataacagcaagacccgtttcagatcctaacagaaaagtacgtacaatattcctgagaactgtatagtctgtattctagatatgcaattttctccgcacatcgacgacagcttttatgagtcgaggtcgcgctcgagcttcacgacagtcacggtgattcactatttcactacgtacaagccgcccatgctcaagatcactgttgactgttgagtacttgagtgcttaccatacgaacatagcgaattggaaaacccaaatcagtatgaacgggctataaaacgtcgggcgcgctaactggcgctctgatttgcactgattttctactctaggattggctccaaccgttttatagcccgtgcatactggttaagacc

SEQ ID NO: 62013 - DNA, 8003 bp, Oryza sativa
  unsure (1)..(8003): unsure at all n locations
aaaataagcaatattgaaagaagtttccatataagaacccaatacgagattaatcaaaattcgaaataaaaataaaataaaatccaaaattagggaaaaaaaagagagtccaagtagaaatacaatttaaaaataggtgaaattcagaattaaaaataagtaacgttgaaagaagtttccatgtaacaacccaatacgagattaatcaaaattcgaaataaaaataaaataaaatccgaaattagaaaaggaaaggggagtccaagtaggaatacaatttaaaaatagctgaaattcagaattaaaaataagtaatattgaaagaagtttccatataagaacccaatacgagattaatcaaaattcaaaataaaaataaaataaaatctaaaattagaaaaggaaatgagagtccaagtaggaatacaatttaaaaatagatgaaattaggtattaacaataaggaatattaaaagaagagttcatataagaacccaatacgagattaattaaaatttggaataaaaataaataaatccaaaattagcaaaagaaaataaaataagagttcaagtaggaatacaatttaaaattagtttaaattcgaaattaaaaataagcaatattgaacgaagaatccacgtaagaacccaatacgagattaattaaaatttagaataaaaataaaaataatatctaaaattggaaaaactaaaagagagttcaattaggaatataatttcgaaacaactgaaatttaaaataaaaaataaaaacattaaaagaacatattggtattaactatttttttaaaaagaatactgaaattagaaaaagaaaaataagatttcaattaggaatacaatttataaataactaaaatttttgataaaaataaatattattgaaagaaaagaccatctaaaacatatgacgagataaattaagtaagaggcctataaaggagtggagtggtggcggttgatacgacatataaaaattgttaataaaacatcaaatagaatcctaatgacgattaaaaaggagagacgtcaggcaggccgtgaagcaaacgagtaaggcggttgccgagacttcttagacagtaaaaaaacaaaccgcattgataattgtattcgatttttaaaatctcaatgacaataaaaaggagaagcagcgggcggggtgtataagagtatagtttcagagccaccgacggttgacgggacttctagaaaataaaaaataaattccaacgatagttatgttcgatttttagaatcacaataacaataaagaagtaggcggcgaacatgctgtagaggggcatagtggcatcgtttgataggacttctaaaaattataaaaaatgaaactataagtccaacttttaaaggttcagaacttttaaaaagtaaaaaaaaacaatgataatcatgttcgattttaaaatctcaatgacaataaagaaggtaggcagcgggcgagccgtagaggagtacaatggcaaagctactgacggtttggcaggacttctagaaagtaaaaatgaacccaaacgataattatgttcgatttttaaaatctcaataacaataaagagaagagacagtggacggcccgtagaggagtataatggcaacgtttgacgggacatctagaaattataaaaataaaacacaacgtgacaataaactctaaaaactataaaatccaatttttaaaggttccaagaagaatgaataaaaatagtggtagatcgagcaagcaaataaagaagatgacataaggggtagcaactggtgtgaattttaaaaactatataattagaaacatgaggatgataaggtttggtctctcaaagtcttaagacaatgagatagctatttaataaattttaagtaaaatcatacttaaaaaaatatatgattttgtttgggtgctagccgcgcaattgggtgggccacccagctgatgggcatcaatcccagggatttccgtgagttttttatgccaaccaaaaacactaaccattcaaaaatcagagttttttttaccgctttgttagctgatatttgctcggtgctttggaccacaagaaacaacatgatatttagatcgaaattggtttatttcccaccaatattaactttacaaatcatttttaatttggtgcactgaaaagttctttatcgcgctgaggaggtcgagatgatagacctgatgactgataagatgaaaagggtgatctcactgctttgagagatcagagaactgggattggctaaatcttctttttttttctttgtgctggcaagctagctaatattgagatgttctcttgctcaagttccttgttgcaaagtgcaaacaagtttgtatgggccaagagaggttgagagttttcttgtgtgggcaggcttgtgaagctgttgccacttggttgctaagactcctttttttgtaaaatgggtttttagacaaaaggtacatatataggccccgcttacattgaaagccatcacggcagcaaggagtacattcgttaagaactaattcaggaggttagtcatcagcactccttgtctagtcatcagaagtagtggcggcagtcggactctccccagcagcagaactatggccatcctgcagctccagcgcccgcctaaggagtccaataagcatgtcagaaaattctgagagcaacgataaacatggactacaattaaatgttatttggaacctcagaatcagtaatccacagttgtttggaaacacagtaaagtttcaaactatggatctatcaaatacacatgccattttgccaaagcacatgaaatctgttggatgacataaaatggataaaagacactagctggtcagtctgcttcatcaggatactagtttaccatgacaaaaccatccggctagaaaatcagatagcaacatttaacatgaaacaactaacatgttatttgaaacatcggaactagcaatctagctgcaatggtttgaaactggagtggattttgatccctggagtggatatcccctcgttgcttgcatatcactcaaatagttatgacnatgctctaactaaataaatagatgtattaacatgttatatataactctacaaacatgcaagttcaaattcaacttctacatctcgtaacgaagaaaaacaaatttgattgtgaatatacgttaactagctatagtttaatttgtttttttcgttacgagatatagaagttgaatttgaatttgcatgttgttgagtgatatatcacatgttaatacatcttctctaatttttttttaaatttttttcgtaaccatttgagtgacatgcaaataacgaggggacatctcctcgagatatcaaaattgtttcataacaatgtagtaaaactaaacatgcttacatggatattgaatttgaggtatttatctaacaaacaaattaactaatacattctgtaacaacctaaatggcgccaaaagaacttccacccacctacaaatcatgtcatgctacaagcataatgaaaattaggttgcattgctatatggcgtagcttcttgatgaatcatttgtaagatcaatgtgtgttttgattcttattttgtgatgaacaattggcatatgtgattattggttttgatatttggagattatcgtcgaagtggttttggagataatcaattttcagaaaatgaacaggatttactagtttgtcgggaccggtcagaccgggttgggtgtgccagtcaggccggcgtgtattggcgcggtcagaccggcgcagcccgcggtctgaccggccgacgctgtgtcggtttcggtttcgggttgtttctttggatatccgtgattgttttatggttatggcttctagatggatattatacgtatgtaatactgttgtttgctactaatgagtcaagttggagatagcttggtttcggaatatggtttctttgtttgtttcatgtgtaagtgactcgatgcctcgagagagtatttgcggtgatggactgggagttggcttggtggtaagacgatgtccgtggtggtcaaacatcatgtaggatactaaggctagagttgatgcacgtggttgatggagatttcatatggcatacgatggaggtattgtgtgcgtatgggatgcggagtcgaatttggaaggagtccaaattttgtaaggagtgatgttggtgcactttgtaaacacagagagaagcaataaagttgtcatctactttgagagttcttcgatttgtgtttcaccgggtttcggcagtctaaccggcatctcagcggcggtcagaccggcggcggcgacagcaagcgacagctgatcaggcggtcagaccagagtttcatctcggtcaaaccggtggctttcagacggtcagaccggacgactacctcggtcagaccgcgatccatcgatttcgagggtaacttttatttccgctaaaagtttttggtttttgggtatctcaaccattcaccccccctttggttggcttagttcttgtgattcaatcctacaagtggtatcaaagctttgtttgcttctttggattttaaccgatctagagtttttgccatggctgcttctaataagtttttaactaagcctcatgttttcgatggaacggatttttctcattggtgtagtaggatgcaatcttacattatggctgagaattatgatatttggagaaaagtttctcttccttgtgtgattcctgaagctattaatactgctgctgaaaaaactgcttttgaactaaattgcaaagctcgcaatattcttttgagtgggatttctcgttcggattatgatcgtgttgctcatcttcaaactgctcatgagatttgggttgctttgaataatttttatcaaggtacaaataacattaaagaacttcgtcgtgatcttttcaaaaagaagtacattaaatttgagatgaaacctggagaagctttggatgactatctttctaggtttaataaaatttagagtgatcttagatcttttgattcttcttatgatgctaattatccacaatctgagatttctcgtcactttttgattggtcttgacatgtctatttgggagatgaaagttacacctattcaggagtttgtgaacatgtctactttgactttggattcgctttacacaaaactgaaaactcatgagatgaatattcgttctcgtaaaggtgattctaagtctaggtgctttggtttcgtcttcaacttctttgaatgttggtacttcttcatcgaagtcttttgttcttgctttatttaatgccatgtccgatgatcaactcgaacagttcgaggaggacgacttggttttgctatctacacaaattttctcgagctatggaaaatgttaggaacaggaaaagaggagaaccgaatcgttgttttgtgtgtggtgcacttgatcatcttcgctcgtattgtcctaagcttgggagaggcaagaaggaagatgatggtagagttaaagaggatgacgtgaacaagaagaagaacatgaaggagaaggagaagaagaagcattgcatgcagtggttaattcaagaactcataaaagttttttatggatctaaagatgaagatgagggcaaatgtaagcaatttgttgatctagcttttattgctcgtaatgaaagttctcatgttgatgaatctgatgatgataatgaagaaaagcatagttatgatcaattagaacttgctgcttacaaatttgctaaaaaaactttaaacatgttctattgtgcttgatgagaaggatcacactattgagattttaaatgctgaaattgatagattaaaatcttcgattcctgatgatgataattgtcagtcttgtgaagttttattttctgaaattaatgctttgcgagatgtcaattctgttaattgcaaaaaattagaatttgagattgaaaaatctaaaaaattggaatcttcttttgctcttgggtttgctttacatgcttgtgttgttgatgagttgattttgacaaagaatgttttgaaaaaatacaaagttgctttttgtgcaagttctttggcgaatgcttcatgtgcaaataaggcaaaacaaaacaatggtgttttgatttctgaagattgttcaaagtgtgttttgaatgagatgaagttgaaagatgctttagggcgtgttaaacacatggaggaaattgttaaacaagatgaggtgttttcttgctcaacttgtagaaaacaaaaaggtcttttggatgcttgcaaaaattgtgctattcttactcaggaggtttcttatttgaaaagttctttgcaaagattttctgatggtaaaaagaacctcaacatgattcttgatcaatctaaggttagcacacacaatcatggtttaggttttgatccttatgctcataattctagacatcctcctactgttttgggtgttgctaggagaggtgaaattttgattgaatcagagcctaagaacactgtgtttaaatctgttggcatcatgtcttctttgaatacatcttcttcgaaatcaaatgttgtgaatgcaaaaccttctgttgttgcaaaaccatctacttcacaaacttgtcgtgagaagtacacttgttctttttgtggaaaagatggacatttggttggtttttgttttagacttgcccataaacagaaaaaggaaagagaaattgcttttgcaaaacgacattggcaaaaatcgggttttaattcgaggaccacggttagaccgacactgaccagtcggtcagaccggccagcggtcagaccgcaggtaaaccggcggtcagaccggttgctaggctcggtcagaccacaggcacagtggcggtcagaccggcctcggggcaattttgtgcgaaattcaactcagacttttgtgaagcaaaaaggtaagttttttggtaagtctgattctgattttgtaagtgtgtatgtacctactggttctagtggtcgtgtgactcagtgttggattccaaaatttcttatttctaaccccaacacggaggtctcgacatcttctcgttcgtaggtattttggcggcatactccccatgtgcatttaactttgagatgacgattgtatagcaaggtaacatcactttacttttggattgacataattttggtctattctcttgtttattagctttttcatgtgctaatgtttgaggtagtagtttttgttaatactattggatgtatgtcaattcttgagaattttggtgatatcgttggcaattggatgtctttttcaaaatctttgattttttcttgatttttgttcgggaagaattggaggttattttgagggggagttagtgctttttatgactttcttttggcatgttttgagggggagtttgtacctcatggttttatcaagcaaaaatatgacaatgaaaaaattgataaaagagagctttgtttatacatatggtattttcttgtgtatgctagtaatattttgaaggtttatttgtctctagcataacttgtatgtattctagtcttttcatgagatttagtttttgcttttaagggagatgatgcatgacacttaaattctatacttgaattaagaaaatatgtaatgttgaagctagcatctggtttgatttataaatgctctatttatatgctttattgaattgttattccttaaatagctttaattgctcattgtgaaaaagagaataaaaaatatgaaaaaaatgaataccgaattcttggaaacagtcttgacgacaaggacgtattcgatgtgagcaaaataatgggtgccgaatccctggaaacagtcttgacgacagggacgtacccggaataaaaaagaaaaatatgagcaaaaaggcttaagaaaagagaaagttcaaaaaaaaattctcttggttgttttgtgctaaaggttatttgagaaaga

SEQ ID NO: 62014 - DNA, 1834 bp, Oryza sativa
ttgatggagatttcatatggcatacgatggaggtattgtgtgcgtatgggatgcggagtcgaatttggaaggagtccaaattttgtaaggagtgatgttggtgcactttgtaaacacagagagaagcaataaagttgtcatctactttgagagttcttcgatttgtgtttcaccgggtttcggcagtctaaccggcatctcagcggcggtcagaccggcggcggcgacagcaagcgacagctgatcaggcggtcagaccagagtttcaatctcggtcaaaccggtggctttcagacggtcagaccggcatgactacctcggtcagaccgcgatccatcgatttcgagggtaacttttatttccgctaaaagtttttggtttttgggtatctcaaccattcacccccctttggttggcttagttattatgattcgatcttacatcattttataaacaaaatgtttatgctagaagcaatcgcatatctgttgtttaccttgagagcatcatctgattgcattgggcatgcacagagagctcgtagccaagcaatccagctatggacagcatcatgcaccataaaaacgtagccccaatggtttcgccagcaaagccaacgccagtcagcagcagaagaagaaagaagctaatcaccagatatgggacaatatagcacaacatgatgtggccaatctggtcaacggacaggagggcatcatgaagcacaaacctagcaacgaaagcagcccaggacaagatggcagccccctccacaaccgaaagaaaggccacgaacataggcagcagatcaggatcaggatcagcaaacggcctcaatagcagagctatgggcgtaaccatcagcagagatattataccaaacccggcagctctaacaccacgatctgtcttgaaggacgtctcctcctcctcggtcaagaaggttgggggatccacgcgcatggccgccgtctccgtgccaatgcgctgcaggtgatcggcgtaggcgtacccgagcaggccggccgtccagcctgtggcgaggtgcatgacggcgaacccgacgctggggccagcaaccgttccggctgcgtcggccagaaggacgccataggagatgtggaggaacacggtggagggacggattgtgcgcgagagggtggagatcaagaagaagaggtaggcggagatgaggaaggcgatcgtccacaggagggccagcggctcgcaggagttgcggagcagcagcggcggggagaatacgaggaacatgcatgagatcaagataacgcgaggtataatgtgatctggaccgccttcaccggaggagagaccggtgatggtggtcgacggagccttggcgtcgacaaggtggccggccaccacagcctcggcgccatctgcttcgcaagccgcggcgatggccattccagtcgtagggttgtgggggttgtgaagtcgaagcgagagcagggccggcgaaagaccaccacgacagccgcggcggcgatggaggagaaattgacttgactgctggtgtgtatcgctccagtcaattaggactgatcgatttgttgccaaaattagtgggatctctaattgtaaatagcacatttactattcttaacgttactaaggctgagttctttccaactcaaccacctctttttttttttgtgtgcatgcatttcaaactacttaacgatttgttttgcaaaaaaatgtttatacgaaagttgatttaaaaaattatattaatttatttttatttttaaaaaataattaatacttgattaattatatgttaatgagtctctctgttttacgtgcgtta

SEQ ID NO: 62015 - DNA, 7756 bp, Oryza sativa
ttttttagcaatctaaatgtgcgtctagtctaagcatctccaagagtttcttcaaatctcaaatcttgctctttatttgttcatttggcaatgaagcaaaataatttcttttcaaattttatatacattctaacagcttcttcatatcccacactctctaaattattttggttgtttagattgatgttattttaaaccataccatttttttaaataaaaagttgttaaatatgtctatatatttatatatttagttcttttaccaaaacttaataaatacataaggaatcctaccaaaacttggtaatattgtcaacttactgtaattttatcattgtcaaaatttggtaagatgtattttggctatggtctaaacaacccctttgaggaggtatcagtatttttctctttgagcgagtatgagtatctttctctttgagcgagttgcaacttgcaagcgagagagatgggaggaagagagaataggagactcacgtttggcaagtggtcatcgtttggaaccatgccactccgtcactcttttcgtcctccccgtcaatctttccgtcattcccatcctctctccggcatgttcaccacgttgacccgctcctccatcttgccggcagccatgagctcgaggagggagtcgaggaagtcgctgccgcggccgtccgggtgcacggcgtaggcagtgacgaacatggggtcgcggccggcggcgaacggcggcggcgatggcgaggggatgctctcccatgaccaccgctccacctggtgcccgacagggccgggctggggctgcagggcaagggccagctcgtcgccgtggaggccatgttcctcatgtcgctcgcgctcgccgccgcgcacatcgccatggcttaccgcgccagctgccgcgagcgacgccgcctgctcgtctacagaatcgacatcgaagctgtaagtgattgattcccttctttgctcgtatcgtatcaaaacaaaggattttgcctagtggtagcttgtagtgtggattggaaacatattaaacccaaaatatgcaagctttctagattccaatccgtgttttcgagagattctggagaacaatcgaggcatacgcttgccgaccttttactggacatgacaacggccagaagaacacgacgtcccctcacgcgaggaaagcaatggtggagcggtggccggcggatgagggcgggacaaggcactgccggttcttgccgccgctggctgcggcgcagggcgcgaagaaggcgaccgcggagtctgtgcgctcgatgcggagctcggcgacgaggcgcaggtcacggccgtatccgcggtcggcgaggtgggtgagcacggcgtcggcggcggcgtcatccggggcagtggagaggaggagaacggggagaggatggggaagacgaaaagattgatgggaggatggaaagagtgacggaagtggcatggttctaattttaaaattttacaagtgacatctagcagataacgtgaatagtaatggtatattttttatttaccacatttacagtgatatggatccaattaacccaaggctaaaaggcaaatatagtcacgggccaaaatgcagctaaagcatgaattccatatactttgatcaaggatggctaccacaaacagtactacatagtagctcagatgtctcaattcaaatatgtgccgatcgataagggttaagaattacacattcatagattcgtattatagcataatgcgctcgaggataacccctaatctttacacatgcatgtaggagtattcgttaaggactagtggactactaattcaggggaaaaaaaattctctggggcggagccccaatcctcagcgcgtgaggcaccattctagataggtgccacctgtattctcaccaatattgaagcaccggaaaaaagtaaagcaatttggattttttttttcttagcgtatacgctccgtattccagtggtgccctacgaacttgtatcgtattctctgccctaatcacgtcgttagcgttcctcgttcgtcggagccgtaatccagctattcgcccttccgttccggccatcgccgcgcgtgtagttcgccgcccttccatcgtcaccgtggccgtggccgtggccgtggccgtcgtagtcaatgtagatgaatccccgcggcggcgccttcaccggtgccgcatcctgctcatccaccggcgatgacgatcctccgaggcccctgatcaaccatggaccaatcaacaatgcatggcagcccgtttacaagacacgaagctccaaagaaaaatatactagaaagaaataacgtgtttgagtatatcgaatcactgcaaattgcttccaggaagaaataaaggttgcaatagcttacaaattagaaacaatagttaatgttattgttttctacttatatgataagtacaatgtctacttaggaatcacagcttcttcaaaatctaatctccagttcattgagcatcgacgaatgcgccatcgtcgagaatatcgatgccatatggttgtggtcaaggttgtgctggcagttgcattcatcgatatcgtggtgtttgtggtgggcggcctcggaggatcgtcaccaccggcggatgggcaggcaacagcaccgacgaaggcgccgccacggggattcatctacattgacagcaacggtgatgacgacggcgacggccacggcgacggcgacggcggaagggcggcgaactacacgcgcggtgatggccggaacggaagggcgaatagctggattacggctctgaggaacgaggaacactaatgacgtgattagggtagagaatacgatacaagttcgtagggcactactggaatacggagggtatacgctaagaaaaaaaaatccaaattgctttacttttttccggtgctttaaaattggtgagaatacaggtggcatccatctaggatggtgcctcacgcgctgaggattggggctccgcacgagagaatttttttccaattcaggggtagttggatgttgagtgttgagatcaataagctgccgcagtactatttatctagacgctggcagtcagagtcaagaccagacctgttgtaggccatcttcatctctgctctgctccaccggcagcctgaggagagtccaataaacatgtcacaaattcagatagcaacattttaaacatgcacaacaattaaacgttatttggaacctcagaatcagtaatcctgcaatcgtttggaaacgcattaaagtatcaaactaaacagaattggtatgtggcagcactacggatctatcagacaaactacaacctgttagcaacccacaatgtgccaaacaactccccgtcgcatacagatcatgccaatgctcatcaaaagtttaatgaagattaatttgcatagttatgcagcttctcaagtaaccattttacaaacatatcgcttaattatgctagaagcaaagacctgcatttagtttgttgatttaccttggcagcaccatcttgttgtattgaacacgcacagagagcatgtagccaagcaatccagcaatggccatcattacaaaccagaaaaacatagccccgatggcatcgccagccaagacaaggcagctcagcggcacacataggatggagctcagcagcagatacgggccaatatagcacaacatgtagccaagctgatgaaccgagacgaaggcttcaaacagtaagaacttagcagtgaaaatcgcccagcagtagatggcaatcccttccagaatcgagagaatggtgacgagcagggacagtgcaggaggaggcatcttcaccagaagagctccggccgttgccacggctaaagagagcaaggtaaagaaggcagcaacactacggcggtgcaccttgaaggagctctcctcctcctcggtcaagaaggttgggggagccatgttcttggccgtcgtctccttgccaatgtgctgcaggtgctcggcgtaggcgtacccgagcaagccggccgtccagcctgtggcgaggtgcatgacggcgaacccggcgtcggggccagcgaacgtgtcggcggcgacggccacaaggacgccgtaggagacgcggaagaagactgtggagggacgcattgtgcgtgagaggctggagatcaagaagaagaggtgggtgcacatgaggagggcgatcgtccacaggagggccagcgggtcaccggagtggcggcgcagcagcggcggagagcatacgaggaaaaggaacgggactgagatcaagattatgcgagctcgaatacgattggagccttcattgtagacagtggtgactctgcggcctcggcccgatcgactcgccggggagatcgtcgccgagcccgagtggtcgccgtccgagtcgcgcgacggcggccgaatgtcggagggattgtcgtcgggggaggatgagtcactcgccacatgggtggtgtcgtcgatggcgtctccccgcaagaagtcctctgtcttggcgccggtgacgatcgacggggtcttttcaccggtgatggtcgacggggtcttggcgtcgacctcggcgtctgcttcgccatccgcggcgatggccatctcagtggtagggtactagggttgtggacttatggggttgtaaccgcgagcggggtggcgggttttataatggaggaggagctgcccgtagcgggtagcggggcggaaggagaggattcggattacccaaaaaggaaaaaggaaaggcgtgcaaaggaacaggaaagaggaaaaaggaaagtaaaggaaaaaaaatacggtaacgctaattcgctgcgcgttaggattaatcgagtgtggattctaatccctcgaggggatatccccttgtatatctttttcttccaaatttgatgcaaatagttgtgaaaaattctgaaaaaaattgataatgtagagtataatgatacctactagtccaccaaaattcatgttcaaattcgatctacacatcgagaaataaaaaagacaaatttagatataaacagtacgctactattcatacgctgaatttgtattttttatatctcgacgtgtgagttgagtttggacttaagattttgtggagttgtatatatgtgttgtatgaatgttgtcaaatttgttcagaattttttataaccgtttagatggtttttaagcaaacgagggaacatcccctcaaggggtaagaatagtttcccgaattaatccccttttcccttttttccgtttcctcccttgcaggcccgctcctctctccgttccgttttttcccttcttctcagccgttcccagtacttctaaaaaaatactactatcgttcccagcccacctctcgtattgcttctcttgtaacaaaattactagtcgaataattcctattgcaaccagtttctccttcctcgtagagaggcctttcgatcttagtcttacccagcgacgtcttgcgcggccatccgatttattcgagaagcgtccttttataaacagattgtttgcaaacacatgcaattagttttgctgtttaccttgacaggaccatctggttgtactgagcacgcacggagagcatgtagccaatcaatccagccatggccatcatcaggaaccagaaaaacatagccccgacaatggcatcgccagccaaaacaagatagctcatgaggcatacaaggaagctcaccaacagatacgcgccaatgtagaacatcatgtagccaagctgatcgaccgtgacgagggcttcgaacagcgcaaactttgcaacgaaaaccgcccagcagtagatggctgtgccttccagaaccgagagattgatcacgagcagggacagatcacgaggaggcaccttcactagcagagccatggccgtagccacaagcatagagaagacggcgaagaaggtcacaacgccactacgatgtatctcgaaggaactcttctcctcctcggtcgagaaggtggggggagccatgcgcatggccgttttctccttgccaatgtgctgcaggtgctcggcgaaggcgtacccgagcaggccggccgtccagcctgtcgcgaggtgcatgacggcgaatccggcgatggggccggcgaatgtgccagcagagatggccagcaggacgccgtaggagatgtggacgaagacggtggtgggacgcattgtgcgcgagaggatggagatcaagaagaagaggtaggcggacatgaggagggcgatcgtccacaggtgggccagcggctcgccggagtggcggcgccgcagcagcggcggcgagcacgcgaggaacaggatggagataaagcacacgcgagctccaatcagatcactgccttcgtcggagagactggtggctctggggcctccggaccggatcatcgccaagcccgagcggtcgtcgtcgaccgagtcgcgctcgcgcgccggcggcgggcgaacgccggaggggctctcggggaaggatgagtcgctggccacatcggaggtgtcgtagatggcttctccccgaaccaagtcctccgtctccgcgccggtgacggtgatcttgtcgccggcgacggtcgtcgacggggtcttgtcgtcactggtgatggtcggcggggtcttggcgtcggcaaggtggacgtcgacagcctcggcatctgcttcgccatctgcggcgatggccatctcagtcgttgtagtgttgtggggttgtaaggccggagtgagcgcagggccggcgacagacctcggcggcggcggtggaggaggaggaattcgaggttttggctttggggaacaaggcattttgctctgtgtgcaacacatgatgtctgcgagcctgcggctgtgggtcttcccggtcactatgttttgactgtttgatttgttgccaaaactagcgaattttaatatgatgataattaagataggattttatcatcatgcatttataaatatacaataataatttggtagttacatatatgtcaagttatagtagattaaaattttaaataacatacaaaatatgaacaaaatgatttattaagatattaacaacataatcacggatccaaagttagaaaacaaccttgctctgtaaaatcttagatccaagagcaaatctactgtacctaaggaggtaccataaggtactaaaaatttagtgtaaaatttggtacctcataataactagataccaagagataccaaatttataatagaaaaagtggtacctcatggtacctcctcaagaaccgtaaaattgctctagatccaaagttgtgctaaagaggaccataaccttccacttacaaatcgtactataaaatttgctaagaacttaaaccaaacaataccatcgtattagtgactcctttgatatctcgagaatatcccctattttcttgaatgtcattatgaatttttttacatgcttcgtaagtgtcatgtaggatcctaaggcactgtgacgttttagaattgggtgccacattttagcaagttcgggaaattgaaatatatgttaagagttcagggatctagatgatacaaccaaacaagtttagagatgaataatacaattttgttagatatacacccctcacatagagttcactcaaccaacacttgtatttctcgtatatcccaatgagacaggagttagaactttctaacacaacatttgtacaggtacgtacgtttggcgaaggcatgttccccagttatact

SEQ ID NO: 62016 - DNA, 2783 bp, Oryza sativa
aaatagaccctgttttaaaaatatattaatttactcttaaattttatgaaatatattaatttattcttaaattttatgaaatgtatttatttaattatttgttaatgagttgtttcattttacatgcgtagggagagtctccaactcttacattctatatttgtatatatatatatatatagctatacgttcaacttcttgtatattattgctttgtgtctaactcttttggaaaaaaaaatattgtatattcttggtttgtgtctataactctctttggaacaaagaacttacgcgcgaaaaaaaaactttttcgtgtatcctaatctatatacagctccactttaaaaatttgcagatatgtaggaatatactctctccatcctaaaatgtttgacgccgttgacttttttaaatatgtttgaccgttcgtcttattcaaaaattttaagtaattattaatttctttcctatcatttgatttattattaaatatacttttatgtatacatatagttttacatatttcacaaaagtttttgaataagacaaatgatcaaacatgtttaaaaaaaatcaacggtgtcaaatatttagggaaggaggtgtcaaatatttagggaaggaggtagtataaatttggagatgatgaagccgtaataaaccgagcgacttactactctttttcttctcctccaagacgaggggagcatctcaatctgcaataagagcgaagccccggtccaaagcagattaagatatcaactcatcgcgcccaaaaacccacacccccgtagccaaaacccgccgaggaagagggagaggagcacacgcatggcgctcgcggcggcgcccgcgaatctggcgggcaagcagagcttgcgagtcgtcgtcatcggcgaccctggcaccggcaagtccagcctcgtcgtgtccgccgccaccgaggcgacgtcccccgcgtactgccccccacccgcctccccgtcgactacttcgccgaccgcatccccatcaccatcgtcgacacctcctccaggtcctccactgcccctcacgctagatttgcgggtgtatttttttttgttgggggatttgtggattttgattcgttgacaattctgaattgctgattcagcccagagcagaggtcgaagctgatcgccgagtgccagtcggcggatgtggtggtgctcacctacgcctgtgaccaacctgcgacgctggagcggctcagctcattctggttccccgaactccggcgcctccaggtgaggctctgcactcactgccggaattgattggtaattttgtggattaattttgtccgctgtggctcatgttttgttctgcttggctcagttggaggcaccggtgattgtcgtgggatgtaagctggacctgaggggtgaggagcagggaactcttgatgccgtgatggcacccatcatggttgcattccgagagatcgagacctgcattgagtgctctgcgcttcgccagatcctggttaatatgtctgcagtcataattttgtgttgataggttgctctgagatagggatgcttggcacattgctgcacataattaagttaatagctacaacactagctagatcataattttattgtattctaggcatgaacttgttgtacttttactgggcaatacttttattatgtactgtgtttattagctaaccagtagcaccaagttggacagactagagtaatattaccaataataattagagcagttttaaaaattatgaaatatacaagaaagtattacacgatattctgaatacacagggacattctctctgaatttgggtttctttctcagaaaaacccaggcaactctattattctttgtttatataaataaaagtcgtattatgttttgggccataatttattttacaatataatattgacatctagggaattaacattcatgtgaaagtactttgcaatagaaatgcaatggtatcatcttgtatggcagtaaacatagtaacatactatatttgttaagtcaatagttataaattttgaattttccaaattcatgtgtgacttgtagttatcaatggagggagtacatgataattctgtctgatgctgttaggcttgagtccatggcctttctcatccatgactggctgttgtagcgagtccagcacgctgcgcgcgctatggcgtgtttccctcacctgcctagtctcccgatacttgtttccacaaatcggttgatgaaatttggcaggtgttggactgtttgtatcagttgtacaatgaattagttaattatcgcatgaattatttgaaccatcagatgcattaaaagtccagacattgtgctagtctctagctaactataattgcgtatgtttgcaggtttatgaggtcttctattatgcacagaaagcagtgctttacccaacagctcctctatttgatcaggaggcacagatgctaaagttacgctgtatgagggctttgaagcgtatatttattctatgtgaccatgacagggatggagcttttagtgatgtggagctcaatgattttcaggtttgtagccactaaagctgccttggtttctttgattagtgtaaggcaaactaatgcttgcactatcattctattaatacttctggtgatgttaagaatctccttttggctgctttacaggtcatatgcttcaatgctcctctccaacctaatgaaatcataggcgtgaagagaaccatccaagagaaattgactgaaggtgtaaat

SEQ ID NO: 62017 - DNA, 1348 bp, Oryza sativa
ttgttgtactgagcattttttgtaataaaaactgtcattttacattgatatttgaaaatgccttttggtataatatccaggatggagctttgcaacctgctgaaatcaatgatcttttttcaaccgcacctgaaaagtaagaagctgatagaacgccctttcatgtttaataacttgatactttcattgtaacaaaaagttaggttaccaaaattgttaaatatttcttgtattaatttctctattggacttgatgtaatgaagattctttgcattagaagggtgtgaagaattactatttaataatctgtctgttgatatttcctgtatcaatactcttctattggaatttcagtccgtggtcttctcatctgtacgagaactgtgctgaaaataatgtcttgggtggtttgtcgtttgaagggttcatctccaaggtattttctcaaactttgcatgataagagttgacacaacaattgacaaccctgtatttttttgttgatggattgaccttttagcaaattattatttgttgattggtttcaaaacaagaaagagaagccctttctctattcagaactcacacgcattgtatttattggtgtggctgtcctgtagcactgtgcaagattctttcatgactctaggaaaccccatattgttgttcttttaatctctatattcattgatctgtgcattctgagcatcaaaactaggtatggaatagattgcttacagtgcatgtaaagtattaagcaaattaatctgggagcaatcatatcttgtataaggagcacgcagtgtttaatatgaactatataatttgtcttgacaaacctgtgggggtgttgttaggcagaaaattgatctttgatttctagaattttattgttgctttaatcttgcgtttggaaaatactgaatttccttattggtctgttttcttttattgactaattattctgtaattgcagtggactcttatgacacttatacacccgtcaaatagttttgccaaccttatatatgttggctatcccggcgattttgattcggcatttaccaccacgaggaaaaggcgagtagaccgtaaaaagaagcagactcagagaaatgtgttccagtgttatgtttttggtcccagacatgccggaaagactgcattgctacaatcattccttaaaagatatcactccatagtattttatatcatgaactttgtttgccatggttatttcttctgatattctcactttcactcttggtccttgcaataggcaaccttccgatgctcctcctgtcaatggtgaacaatttgcagcaaatactgttgaactgcctgatgt

SEQ ID NO: 62018 - DNA, 12624 bp, Oryza sativa
cagtacaccacttaaatagaataaccgactacacgatactgtcaattggctcgttgaagtgactgactttaatcctttatcctgtcaattggtttaaatattcgttgttctatgcgagccctcctgctgacagttcacagattcaggattgaaccaatgtagtaattcagaagttcgacacataaatattgtttattcagatgtacctctctctatattatctattcagttgtacctaattttctgcacacaaaatgtgatgctgttgaaatggcagtggtgatgaagtttcttggcaaagagcaagagaattgcttgtacaagtggccacacggggaaaaaacactggctatgaagttccttgtctgatagttgctgctaaggatgacctcgaccaatctccgttggctctgcaggactcaactagagtaagcttcaatacaatattgattcatttttaaactgttatattttatttacctctgagaatcatttgtcctttttggcacagttggttggttgaactggaattagatatttgaatgaatcagtccccccacccttttttttttcttttgcttttgctaattggagaccaccatgccagtggttgtttctgctgcctcatggaaaaactcttgatcaaactgtgtcgttccaagtcaacattcatacaaatggactgatttgtcaatattgtctactattgccaccagttttctttatgtctgatctctacagctatggattattttcagttgttttaattcaataaaatcatgtacttgtaggtgagccatgacatgggaatcgaaacaccaattcctattagtgtaaggttgagggatttgaacaatattttctgccggatagtccatgcggcgcagcagcctcatttgagcatcccagagactgaagctgggaaaacacacaggcaataccgtcaacttctgaaccgttccctcacggttgtctcaggtaagttagtgtcaagcttctgcctctaaagtgtgtttctgtatttgcctttatgctctggcacaaatcgatcatgccaattactacagaatagtaagagcacaggtttagtaagacaataaaatctaaaagtaatagttatttatgattttgagttgaaactgaatagtggttttatcttaagttggttgagttctaacacaactgatggtgtgccaataatttgcagtaggagcggctgttgcagttgtgggcgtagctgcttaccgggtttacgcagctaggaagaacgcgtcatcttgaagctctcctggacagtgatgaaatgctactctcctggacactgatgaaatgctgctattcccctcactgcccaacaacaggatagattagattatttttattgcttgttgagcttcgtaacatgctgttttctcttgcaacatcgtttatgtaaagatatatactcagttaaaatcacactggctgggaaaagggaatgtatatactcgatatgtccatgttgcgtcgcctattgaatttcagtacgtcccatgagccatttttgaactgactctaaaagatatattatagacagttctataaaagaaaaccctccaaaaagttatttaaaaaatcttccgtattgggatatcattacagaaagttcaactacacaactgtctgtggcagtctaacagatagaggaggagtgcttggtctcttggtaatttcgacgcgaatcgcaagtttgcaaccccaccagttacaaaaaatagggttgtgtttagttattgtgccaattttttttcagtatacggacacatataaagtactccctctatcctttaatataagggattttgatattttgcttacaatatttgaccgctcgtcttattcaaaaaattttggaattattatttattttatttgtgacttactttattatccaaaatactttaagctcaactttttgtttttgatatttgcacatatttttttaataagatgagtgatcaaacagtgcaagtaaaatgtcaaaatccattatattaggggacggagggagtattaaatatagactaataacaaaataaattttagattccgtccgtaaactaggagacgaatttattaagcctaattgatccgtcattagtaaacgtttaatgtagcatcacattgtcatgtcatggtgtaattaggctcaaaagatttatctcgcgatttacatgcaaactgtgcaattgatttttttccgttcacatttaatgctccatgcatatgtctaaacgtttgatgtgacggaaaagttggaagtttgaaaaaaaaatttaaatctaaacacagcctaggtaagatacacgattttgatatcattcatgtcacctcaaagtagaaaaaagaaaaacaagaaggagatatcattaatgtcatctcaaagtcaaaaaaggaaaagaaaaagaagaagaagaagaagaacgaaacaaaggctggtttagttcctaactttttcttcaaactttcaactttttcatcacatcaaaacttttttacacatacaaacttctaacttttccgttacatcattccaatttcaatcaaatttttcaattttagcgtgacctgcacacacccaaagaaggcgctcgaaacggcccgacgaggcgaaggcgccttttattccgtggaaaaagtacaccgaaggtccctcaatttgttatcgagttacaaaatcgtctctcaaccacaaaatcagatacccgatgtccctcaactaacaaaaccattcacttatcctccggtggttttgacgctggttttatctgacgtgacggctgagtcagcgtgggacccacgtgggcctcacatgtcagagtgccaggtcatctctctcctcccctcttctctcccttcctcatctctctctgacttctctccaatttgttgcgacgcgagcgacacggctgcggtgatggtggcgacgagcgacgcggcagcggtggggggaggagctgcgggcgggcagtgggggaggggcggcgggggtaggagcgccgcgcgggctcccccgccggccgccacccacgaccacgaggcggcgtgggcagcgtcaagttcggcggctccaccgcgacggccggctcgttcccggccgacgggctagtcgggctcggcggcggcgcggtctccctcgtgatgcagctcggtggcgcggcgtcgctcggccgaagattctcctactgcctcgtcccgcactccgtcaacacttcatcggcgctcaacttcggcgccctcgccaatgtcaccgagcccggcgcggcgagcacgccgctcgtcgccggggacgtggacacgtactacaccgtggtcctcgactccgtcaaggtcggcaacaagaccgtggcatcggcggcgagtttgcgcatcatcgtggactccggtacgacgctgacattcctcgacacagctctgatgggaccactcgtcgacgagctctcccgccggtgcagtcgccggatgggctgctgcatctgtgctacgaggtggccgggcgggaggtggaagccagagagagaatcacaaatcacatcgataaacatctctagaagtccatcttgttcagataatcacagtacttatgtagaaaggatagtaagatacagaaatgcaaaaataagctgtgttactcctgcaaattgcaagtgaacagaacaatctcaagctaagctgttctttaatcagaagaacaggatatgaacaagcagaatttcaagatattttgtggcgccggtttcgctttcttacctcgctatagattctgtgagagatcaaattacatgacccataaattgtagagcaatgcaggagtaacactcccagctgagaaattgattgatgtataacactccgatcttcgatcttcgttaggcgatgcaatgagagaattcagaattctcaccaacagccagcttgctagaatagagtatgagttactgatcttgaatgacctcgtgtgtacagccaacaggaagcaaaccgaacaggcgagtccggacttgacgctggagttcggcggtggcgctgaagcaggagaacgcgttcgtgacggtgcagcagcggacgctgtgcctggcgatcgtggcgacaacggagcagcagccggtgtccatcctcgggaacctttgtcgccgccgactgcgcggggagcggccggccggcggaggagacgagcggcgggcaggcgcgctgcgggagcgggacggggagagcgaggacgccgccgccgtcgtcgtccatggccgcagatctcgcgcccgcgctgtcagcggcgtcgccggcgggagtatgtgattgcggggcagcggcgggcggagcaggcgatggcgggcggagcgggcacgacgacgaagacagcttcttcccgcgtcggcgccgccggccgcctctcccttctcaagcgtcgcagccgccgccgcctcccttatcccgtatcgtcgtcgccgccgcctcccgggcttctccgatggtccgacctccgaggtcgcacgcgccgccgctggacctcctccccaacgccagccgccctgcagagaggagagaaatgagagagatcaggaagggagagaagaggggaggagagagaagacctggcactctgacatgtggggctcacgtagatcccaagctgactcgccatcacgtcagacaaaaccaacgttaaaaccaacgttaaaactaccagaggatctaaagttcgagggacgcccggtatctggttttcgcttgagggacgattttgtaactcgataacgaattgagggaccttcagtgtactttttccttattccgttgtcatgggctcattgtaactggttggcccacttgagaactggagaggcctatgttatgggccttggcttacgatagggcccacccgacggcgagccgtccgcgtacggggtcaacgcaccgagcaacggattcacaccggaccacgcgagctccttccgatgcggggcccacgtgcccaggaatccgaggcggaagggatcattccaacagctgggagatctccggcgccccgcacccggttcaggtggacccacgactccgcaactctagctcggccccgcgtcccgcggggcgcaccaacacccggaccacgcgacgaagcggagtcgtggatatgggtggcgcccgggcccaccgtattcgctgaacccatcacttcccgtacacctggcacccctacactcccgcacaccgcaaacgtaaacgcagtggaatccaaggcgacattgtcctcctttatccaaaaacaaccctgtataagacccttaacttacaaatagccccttacatcgttgtcagggaggacttatatctaaatatggataatgtttgtccttagttgaaagagtttcaaacccaaacagtggccggtggcttcccgcctctccccgcgcgttttcccgcttgaattcgttccgcaatccgagggcgggtagggctccacgtcaccgatccagctcctccttgcggtgtaaggagccgtccaattccgtcctttgcaagccaaattcctcccgccgccgccgccgccgtcttcgcctcctttataatctcccttctccgccgtctcctcccaagttccctcccaaatcccccatttcaaaaaagggaaaccaaatttctcggcgaggaggaaaagaatcctgcaatggagagcaaagcagaggcgttggctgcggcggctgcggcggcggccgcggcagcatcggcggcttctaccggaggaggacacgcgtgcggcggatgggagacgccgaagcgggaggagtgccgcatcccggcgacgctgccctgccccgcggcgccgaggaaggccgtgccggacttcgggaagaggcgcggcccgcccaagaacggctacttccagccccccgacctcgaggccctcttcgcgctcgcgccgcgccgccaggcctcctcgtgcgcttgattttgaagcttcggctgcggcggcggcggcggggagctctggtctagattaattttgggatctgtagatacttcgctatgtttctcttctgttgtactctaggtattagtagtggattagggatgggcaagaggagggtttagggagtaggaggtaggtatgtaggtgatggcggggcttgagatgaaatgagattatcagagctcataatcatactgtttttgtattccttcagatgataaaatcttttcctggcacctgcttagttgggcatttttgcactctctctctctctgctgatgttattggttcttgaggtgattgatatgaaatcatgtactcatgcagcagtagactttgattaagacctttaatggcgtcgacatcggcggcggcagcagattgttgcttgaagattgtggcctccgggacgtcgtgtggtttgctcttttctgaatatctgttacagcccacaggggaatagctgtataccggcagttcttttttttttgcttcactttcatccgcggcatctgactaggtaggaataggatagtgatcaccgatcatgttgtagtagcttgaaggtttgaaaaggtccctggttgattcattgattcataagcagtagtactgcagttcagtcttgtcttgtgtttactgcttgtaccagcaatggactcgcaaaaaccgtagttttactgctgagatagtccaggtttcgttttgccaaggaattaatacgggcgggaggaaagcagagcagtgtgtgcgttcgttcttgaatctggatgcagttaatgcggctgtgggagagagccctgcctctgcagcatggtgtgtctttgcctcctccctagctggagctaggtacggtgtaccactagtaggagaaattgcaaatgcatgtggccaatgcgtgtgactagtgtcagggcttcatgagaacaatccgtggtcctgaatcaagcaaagctatagacagaaaggagagaagggaagatcctggtgacacggacagcttcgagattctgtgaccgacgagtcgacaaggacacaacgtatgctcgccatctcgccgcggtgccgcctgttgggcgaacggcgggggcgcatgtgtggtgttgggtggacgaggacgacacgccccgtgaggccgtgacttcgtgagggcagcgagaggaggccggggagcgtacgccatacgtgcagcgtgcggggacaccgggcagaatgagccgggtgtgcaattgcaagcagcacggacatggccatgtgatgcccccacgacaagtgttgcaagtgagatcgatcgatgccagcaatttttgtttcttctctagaaaaagttttttttttgcccgtgcttgcagaatgatatccatacacctatgctcgcgataggtcgagagtagttttctcaacgactaacacttgcgacttgcgaaacgtcgatcagtcggggccttggctacaacaaggacagcaactcggcaccggccagcctcgattagtgcaggtaatttcgcccgcaatctatggctcttgacagaggcagagagttcgttgcagcaaccagtagtattatatagttaatttatacagaaagattgcacattagcacgaggaaagtgcagcaaaggaggccccctcaacaactccatgacggctgtggaaactttcgtcaggaactgttactttaccttgaagccaggcacaaattctgtcgtagaaccacatctaactggtgacacaaaagtattttgtcccatcgcaactaacacgatgagttgtgctaatctagtactcacaggaccataacgcacagtagctcgaaaaaactctttttgtcagccataaagaacacctggttcatattaaaaactagcaatgtgcagagttccatatcagggaatgcaaaggtttaggcgttgtggctaataatggcggttgcttgtgttctaatcaaacaccaacagatctccatgcaaaatgtcccctcttacctccagcctccaattacaggatgattcttctcctcgtgccctgaactcctcttgcttatgccaaacgtacttataccaaagctgacaacattcccaatatgagacaaaaataagcaattttttttcgcactgcctcatctaggtttccatattattgtccagataacccagctgaatgtttgtcacctggaagaagatgaagaaggtgccaaatttatttaatcctagttcattgagaaagcaggcctatataagcctacaccagcaaaaattaagtactgtaatacctggatagctgcttatggttggtttggtttgttaccatgccaaaatattgacactatcaaaacctgtcaagttttggctttgtcaagattttggcaacacatgtgtaattggcatatttgttgccatgacaaacaattcgtttatgctaattatatttgactgggccccaatttaacaaggcgacacaagcatgtcaagttaaatccatatcggaaaagccgcttggccaacagccttctgttcacttgatttggatgactggatgaaatgaatcatatatagaaaaaaacataaaaaaagaatgttctggctccacttcaacaacttgcacacaagctccaagcaacgtaacggcactatttagttcctttctttttccttttttctttttgttccgacaacaatctcccaaaaaacaaattcttgagaaacaaagaactagaggaaaaggttgatgaagttttatagaattgacctggagggccatgcatggttagcttcaaaggctcacaaataaaaaggcgcatgcaaggtaatgcagcggaagttgatctaagataagaaaggtgacaaataatgttgttttttacaagcaggaagcatgacctcctaaagcaagcctttcatgatccaattaggaattgatatttcaccttctatgccttctgtgaaaattaactggctctcaaagtcatatattattatgcttttttcatcaaaaagttatataggtatgcttcatagggaggacaacacactatactactagataacagcaccaatcttaacattgcagcttattacacacgcctcttggtttctttttccaaaaaaaaaacaccagaatatgttttagttaattaatatagtagtccattgtaaatcactaaattagtgtggtcatcgcatactcgcatggatgtagcaatacatctgaaaattagctgccttgccgaaaactgcaattcgatatactcaatagacagcaagcaggccctctgcactccctagccaggtgcacaaagcaggagcaaagagtggcccaatagcagtttttttctatggactcctaccaactcggccaaccactaccacgctgtgacctcccaccatgcagggcacgaacccatgatgatcccctatatagagagcccgtactcatttctcgccaagtgcaccacttcactcttgcttccaagtgcaaccacaaaaccagttcaaaagctgcgccccggcagccgcacggcttgggctgggcatccgaaatgggcactccccgtggcctacgaaatgccggctcctcctcctccgcatgccgcttcctcgccgcctttgccgtcctcctcgccttgccgacgctcaccgccggccttacccgtcactacacgttcaatgtacatctctaacgagcatgatcgatatacgtacatggccggccgtgtcgatccattcttgatgtgtggctgcattgatgtttctggccgtgttctgcaggtgcaaatgacgaacgtgacgcggctgtgcgtgaccaagagcatcccgacggtgaacgggcagttcccggggccgaagctggtggtcagggaaggcgatcgcctcgtggtcaaggtgcacaaccacatgaactacaacgtctcgttccactggtaatgccaaacaccatcgcacacattcttgcgcaatcccgcaacgtattcatgcaattcgatcgtgtgtgatcgatctcatgacgatggcaatgatatgtgcgtgcaggcacgggatcctgcagctgcggaacgggtgggcggacgggccgtcgtacatcacgcagtgcccgatccagggcgggggcagctacgtgtacgacttcaccgtcaccgggcagcgcggcacgctgtggtggcacgcccacttctcctggcttcgcgtgcacctctacggccctctcgtcatcctccccaagcgcggcgagggcttcccgttccctcgcccctacaaggagctgcctcccatcatgttcggtacgtgacgcctctcccctgtgtgatggcacttgaacttgaaattgtgacggtgtttcgtaatgcgtacacttgtgtaggtgagtggttcaatgcggatacggaggctgtcatcaaccaggccctgcagacgggagcaggccctaatatctccgacgcctacactttcaatgggcttcctggcccgacttataactgctcgtccaaaggtgagatgctctgtcctctcctgattggcccatgaattaatcacggatttgtctgtttatgtctctatgatgctcgtggcagacacgtacaaggtgaaggtgcagccagggaggacgtacctgctccggctgatcaactcggcgctcaacgacgagctcttcttcggcatcgccaaccacacgctcaccgtcgtcgaggcggacgccaactacgtcaagccgttcaccgccaagacgctcgtcatctcgccggggcagaccatgaacttgctcctcaccacggcgcccaacccgggttccccggtctacgccatggccatcgcgccatacaccaacacgcagggcacgttcgacaacaccaccgccgtggccgtcctcgagtacgccccgactcgagcgagcgccaccggaaacaacaacctccccttgccgcccctgccgcggtacaacgacaccaacgcggtggccaacttctcgagcaagttccgcagcctcgcgaccgcgcggtacccggcgcgcgtgccgcgggccgtcgaccgccacgtgctcttcaccgtcggcctcggcacggacccgtgcccgtccaaccagacgtgccagggcccgaacggcaccaagttcgccgcgtccatcaacaacaactccttcgtccgccccagggtggcgctcctggaggcgcactgccagcgccggtacgccggcgtgctgatggccaacttccccaccgcgccgccgcacccgttcaactaaaccggcacgccgcccaacaacacgttcgtgacgcacggcacgagggtggtgccgctcgcgttcaacacgtcggtggagctggtgctgcagggcacgagcatccagggcgccgagagccaccccttgcacatgcacggcttcaacttcttcgtcgtcggccaagggttcggcaactacgaccccgtgaacgacccggccaactacaacctcgtcgaccccgtcgagcgcaacaccgtcagcgtgcccaccggcggatgggtcgccgttcggttcctcgccgacaatcccggtaagaatctcggcatcacatttggcaaaatcttggtttgcatcgacttccgttgactccgaatgcagtgacgacagctagctgacatgtggtgcatgtgtgtggcaggggtgtggctcatgcactgtcacttcgacgtgcacttgagctggggcctgtccatggcgtggctggtcaacgacggccctctgccgagtcagaagatgttgccgccgccgtcggatcttcccaagtgctgatggctgatccaatggccgggccgggacagattgtttgcgaacgttttgctgtgtgcgccttcgcgttccgttgtgtttgacgtacaaaactctttgatttggaccgacttaattttaactggtgtgtgccgattttgtggcaagtgtttgggggttttgcccccgtgcttaattcctctttcaaaacagaataagatgtaagcaactcggttctgttggtattttttttcgtgggcatttgttattggtgtgtacacagtcgaatccataatgtaccagataacttctatatttaattgttttggtttttgatcatttcaatataaaaaatggcttaagcttgagagtaagaaaagcgatcacattatcttactatctgttataaaaccagccccgaaatcgacgtcggtagctaaacgcggaagaaaacgccataggagatccaaaacgacaacgtcaccgagatacgatatttggtaacggagttcagccgtagcctacatctccagggcactgattacgggcgctcctctccgatctagcatattacagcgtatcagagttacaacgactcacggtcggttgacgcaggcaaccgctccctctcgctatgctaagtcaccatgcggttacaacaagcacgcccctctatttatgagagatcttaggatagagtccgactcatactctagtcctaatacctattacaactccaagtcctaaattgtaaccaactacgtacacatattcgacacaaactctaacactatctacaattggaggaaaaaaaacgttgctatctactatacacgtaatcggagatgctataaacattactcaacatgctttttggg

SEQ ID NO: 62019 - DNA, 1389 bp, Oryza sativa
catcatacctgtaaagatcaagattgacatgcacagggaagtatccaatatttataagggatctttagagcagctgatgaagtctttgaaaagcccatagccttgagaatctgcaattacattaataatcacacaggtaaacatcagctacaagggaaaacttaattatttccttcaatgaagaattatgttacactacaaaaacatttggttcaaactttttaaaggacatgatactttatgatggtaaacaaggattatggttattcagtaaaccaacactagtgtaaacaaatatttacttatttattatgcatgacaaaataatagtagtggtatagaatatgttacgtttcctgccgttctcctttgttcatcatcacatgcatcaactgcatatgcctgaagtgactcaatttttcgcttaactttctcctccatcaaccatgaatcttttgaaggtttagcatctagaggcaatgctttggcagacttgattaactggacaaattcttccatctccttctcagctgcctctttagcaagtttccgtcgtaagagttcctccacctactaccagatgagaaatttaagtccaccagccaatacaacaacacaagttcatacagaaaattaagagataagtgcaacctgaggtaattgggcatgtgattaatacagtttttaaccaagaaaccatatgacagtagcaatgtaaagcttaatataggaaaaaatacttcccactcagacactagatactaatagaaaaatgacgagaatatgtgaagtcaagcattctttaggtgaccatcaagatatttaataaaacccctagaattgatcacatcaatttgatattattgtatatgctactcacaatacaatagacttagcagtaactgtggcaccttggagactacatcgattagcaaaacgacctatattttgtgaaagaaagagtgaaaggcaggtaatttagagtgtgtatcgtgagatgaaaatcatgggtatatttaggcaaatatacctgagcaggtgggcgaggttggtacacagaagaatcccggctttcgaccttgacaaaatagactatgtcccttgataacaagaagtgtgcacagtagctttccagagactccttgctaccataaactatctgagaaaacaaaagattagagttacatctgaatatggaaatacaagatagaaaatcagatggaataagggagcttctgacctctgcgaactcctctactgttactgatttatcattctcagaaagctccatccaagcacactccaaaacagtagggtcctaaaaaaaaaacaaattatgcacatgtatctatggtgcagatacatatcatgattcgtgcaacacatctt

SEQ ID NO: 62020 - DNA, 1865 bp, Oryza sativa
tgcatcacccatttaagagtgtgtttagttcacgttaaaattaaaaatttggttaaaattgaaacgatgtggcgaaaaaattagaagtttacgtgtgtagaaaagttttgatgtgatgaaaaagttaaaagtttaaagaaatatttcggaactaaacacggtgtaatagtggggagagtacataatgctactataaacgagctgtagactatctactcgtattgttatactgtggactgcttcaacagtatcatatctgactcaagccacctgtatggctgtatagactatctgtccatgctgaacattttgcccgaagctctgtcgcacgtacgtacggcgtgcgtccgaactttcagcgaacgtgtacgtacgtaggcgaacgttgtgtttttgccacatcggagatctatctgatcgactcgtcgacgtgaggaagaaaaataaaaattaccgtaagagatctgggcgaagcaaagaagcggatcacgcatcctaggcactgtgcgttcatagtgcgtccgtacaccagcagttgatcagactccacagaggttcagagccagcacgacgagtgccgctacgccttggtcggagacaagcgccacagatgcaccaacgcaatgccaacatggctgtaatcagttccgctcttcccttcccttccctcggttcctcgcagtgagaattgtttgcagtactgttaatatagtagtagacattgacgtgtgagtctagacccatatgtcagccacgacaactgtatcagcgctactggatttgcatccggctcctcggcgaacaaaaaaaatctcgaggagaggaggcctgttccatctttgaccggccgggctccacggtcgccgaatcggatagccatgagcccgtttgatttggcccaacctggttttaatcattggccatggcgacgcagcccggcggcgagcgagctagcagtagctgatactgacatgtcagaaagcggactgtgacacacacaggagcgcccagcgagctctctcgttgttcggtcgctggagtacttggacagttggaccaaaagttgatgagcacgcatcgtggaactgcagttggggaagccgggacaaacacaaaaggcgagcgggcagcggagacaggaggccgatcgatcggcctatggacacgggactcgtcacgggtcacaccgggaagagattcgccgagatttcttttttgagcgcgagcgaatgaatgatcgatcgatccggagaagcagagcaggcagtacgctgttcttttttttttttttttgaccgtcactacaccagatcctcacatctctgatgggatacctgtgacgggcaatcgaaatggtcactaatgaccgtcacctctgacgggttatacgggatgccgtcatcggtgaggcatccggctgcgacccgtgacaggtaactagttacctgtgacgggttaaaaatagaacccgtgtgaggttacctcacctcaaacgggtttaagtcctaacccgtcataggtgactagttacctatgacgggtcacagccggacagcccgtcagaggtgaggtttactcacctcaaacggcttttaagtcccagcccgtttgagatgacttctgccactgtatatatatgtctcctctcccagcgggacccacatgaggagataaggccggccggctccctcttctccacttctctatctcttccacttcttctctctatctctcctctctttctctgtgccgggcgaggggaggcgcggcggcgccgagccagcggggacggcggcggcggcccggccgccagattcggcaggggcgggaggggaggcgcggcggcgccgagccggcgagggcgg

SEQ ID NO: 62021 - DNA, 7891 bp, Oryza sativa
cttgtgttgttcatattgttccaattgttgctactgtgattgatgattctgagtcctatggtgattgagattcttgtgattttgttttgtgattgggacaactgcgatgaaacaaagaagaattgtgacaatttttttgatttgtgaatgccaaatgcaatcggtctaaatgaatgtgatggtaacctatgaggacggtgtttctctttttttttccctttttttcacaccagtgacggccccaattagttaggccatttgaggtgactctcacctgtgacgggttttggttgggaccagtcagaggtaactctcacctgtgacgggttttagttgggggccgtttgaggtggctcttacttctgacgggtcttcactcgtcacaggtgactcaagtcatcagtgaccactaatctctgacagggagctgaacccgtcaaagttgagggtttgagcccgtcagtgctgacctgatccagtgtagtgcgtggccatggccaacttggccatagatggtttaggcataggtaaggtggtggaaggagcatggtgcgttgccggccggaggagggcccatcacggctgcgggcttgcgctgtggccagggtggccgaccgcccgtccgtccgtcgcaaccttcccgaggcggaggacgacgagcactgccgctgcctctgcccccgccctgcctgcgctgtagccgagcgagcgcggcagccagtcccccctctcccccggtccaccaccgcgcgcgcaggccggccgggcagtctcagtctgatcctctgccctgcccggcctctcgctcgctcgctcactcggcgctcgctgctacagtttaaagctgacggccgcggctgcgtgctgacccacccacgtacaccagccacacacggggccgatcgctcgctcgctcggatgggctatggactgcagccgctgccccctcgctgcgacgcccacttgatcccctcaccgcgcgcagccgcggaaacgtgccgtgtttatccgcgggcgggggtagggtggtgtgactgtggaccaacatgagaaaccctggtgatgcgcgaggacggcgcatgccggcatccgtgcgagagtttgggggaaatctctgcgcggtggagcgcaaagcgcaacatcggatggaacgcaattcgtacggcgttggttgtgtgatctgtgaacctttgtgatttgtgaacctggcggaggtagcgaagctttaagccatttggagcaaaagttttcgggggactcgagcttttgacctcacgcacgggacggcaccgcatcggggccgctcgggccggcaactgcaaggctgccggatgcgtcgaccgtgcgtatgtatgtatgaacgtgtatgcgtgtgggggtgcgagcagcggcgcaggcttgtgtccggagtttgaacggtcgtctccaacaagagcactgctacggtgctctctacttgtagtattctattacaagtagaagcaatctgagccattaatttataagggcaaattagtattttactaatttatggttaagggtaatttttaacttttacttttttttcttaatagtaggatcagttcgtctgtgtcaccgctcctttcgttctcgcgtgcgcccgactccggcggcagtgcccactccggcatgtgcgagctcctccgttgaacagataatactacaaagaactactgaacaaagctatatagtcaaatcgaggagcaagagcaaatgtgctgttataaactcaccatgattatctttaaaacctatttattagtttctccacatgttgtgttttcagttcttaaagaattaagccattaacatcgctaaatttgtccaaggatggtaccgaagtatttaagttcagagtggtcatttgctcagttcagagcgatgctcaaaacaccgtaatattgattggcttcgatggcgttgaaatcgttgaattgatctgacttcttgtcgtggttcagggcttcaggctcgctagttatatgtctccttcttgggcctggcgtggaacgcatactgatctctagcatttgagccgctgggcaaggagtagcctcccgaggctgatcccccgccgtaatcccgcaacgatctcatggaagcacgccgccgatctgctcatcgcatctgctccgccacactcaccctaaacctagcacggcccaacgatgctcaagtgtttctaattgatatgcaaaattacgaattcaaccatccccgtccatattttttggacgattataccctctgacgtttctactattgctatttaagataggagtataaataaatctaacccattagatataaaacgatcaacggtttagattaatttatactccgagtggaaagcactggagtgggactcctccaacaatggaagtacgtagcagtaggagtagtttagatttcctgtggtactagttgcatctattgttgtggcttcgctggtcaaatttgctgttctacacttcataacagtagtttacgtaggagtactttactcgctctctctatatagtgcaacgaccgtcaagatatctatagttcgtagtagtactgggtttgccattcgtcaaacgatttgccttctcaaaaatggcagaaggcgaggaaaattagccccctcacacacctgacaaacccttgttgctgcaccagagcaaagaacaaaataaaacgcagagctttcatttcacggcagaggccagaagagcaacagatagtcgtaggaaattaaaaaatggggcgtcagccttgttccaacagcgaaaaccctgcataaacataggaaaacaccaagtgggtccttttttgggacgtcatggccctacgtgcacacatccagctccattatatagccatttttatgcctcttccacaggagcttctgacctcggtcactctcactctcatcagcttagctacactctctcacacagtctcactccccgtgattctgcccctctgctttagctatcttctccttcccatcgtctcggcgactgactgggtaacccttcttcacccctcgccacagtgcccatggagctctacgccgtggtgaagccgtgcaggctgtacaagaagaggagcagcagcggcggcggcggcaaggtggcgatgtgcgtgcgcagcggcggcgacggcggcgccggcaagagcaggccgtccttcacctgccggtgcgtgcggctcgtcaaggagcagcgcgcgaggttctacatcatgcgccgctgcgtcacgatgctcgtctgctggcacgagtaccaatgagagggtactcgatcgatcgatcgattcatggagggggcgagcaaatgcgatgaagctctctctctaggacttaaggaactttgtgtaaagagaatagtatcttttttccatttcttttcctcattttcctttccttttttttttcctctctgaggagtagagcgaatgagtggtgcagtaggccggccagtagcccagcatgcgtggtcgctgcactgcgcatttttatttctaattttttgatgtcatgtgagcgcatgagcatctaaatatagacggacgtactcgatcaaaatgggtgggtagttcttggattctgctggtgcagtggcgcttactctattccttctacttccgcttccggtgtttgactccctcgacgtgcgcgcgtgcgtgttggttcatcggagtgcgaagagatactcctctgaatctagatttggacggctcgccacctgccattttcctcaccctggcagaggattccattgcgtttcttgttctcctaccccaaaaaaaaaacacaccaagaaagctaccactaaaaccaccgtcactttccggtaaatccgttctcggcatcatgcaagttgcaactagtaaagcacaatccttgacagtttacgctggtgatttttaccatcgcgtagaggcagtaactcgcggtaaatctcgctgcatgcgactgaagggaggggggccaaattccgaaaggtaaaagaggggagccgttaccactagtagcattctgatgagccccctgacccggaatgaagctgtggagtgtggacactcccgaggaggagaggccccaagtgtgctgacgcatcgaattatttactcccaaaacgacgcctccgtatctgagcgcccctgtgagctgcgcgccatcaccagtaatcaaaaccctctctctctctctctctcacacacacacgcaaacacacagcttggaccttggaccaaatgggctcgcagtgtacttggctactttggtgaagtctcgcatgctccgatgctcctggcttggctacgagtatctaggagactaggactaccaacgggtggttcaacgatcgagtactctacctacttcacgggcatgcatccgcccagatttcggcctcactactatagtaggagtgtagtgtcgatcctgtttgagacagtcatgaggttatggctcatcctcatcatcatcatcatcacgaagagcggcagaagcttttttttttccttaggcagaagacagaggcagaggtcgtcagtcagtgtagattaggtatacttcgtactgaccaccagcttcgtgcgcatgcatgaatggcgaagtggtggtgtaactgacgatcgatttcgggaggtcgtcttctcttttactgttcccgggaagcacgttttctttcctacgtaggacgcggtaggagaggtgagtgagagtaggtagctgctgcaatggcgcatgcattgcagcagcgatatatgcgtgcgtacccagcatcttcggctgaagatgccagggacccatgcgtgctgcgatgctacgaacgttgcagaatcagcatgatcagtggccagtagcaagtttttttttctttttttctttctttcttttatttttggcgagcagtgtccagcgtgcagtagtaaagtggtcctatgatcctactgagatgagtgatgagtactcactacctaggtcctttgctctttgcaggtaaccggcgagtaagctaggagaggatgcacagccgcaggacccccccaccatccatgcacagtggccttcacaagctcgcagagctcagctccggctgcctgcactgcactggctgcaacatacggtttctgctcctgtcccccctctcccctccctctcttccaggacggctgctgcattcatgcccctatccagtatccggccttttgtgcttggatacttgcatgatcgatgaagcgtgtgtcacggagaggtagcaagggcagatcctttagagcaagtctaatagtatagcccactactagctataattcatctataaccgatttaatagccaattcatacaatagttgcttactacactattaatatatggtctcacctgtcatacacacagtatgtcttggagtccgtgctgcagctggctacaaatctgtagcccgctgctcttctctctcatcgtttatctcattaaaatatatttatagctggctaatagtctgctattgtacctgctcttatgtgtgtggttgcaatgattccgaccacagtgtgggtgactgttcctcttgatatcttgcatctggtaacagtggtgacaagtggacgctgatcagctacatgcatagttcagggctaatggtcctatgtagtagtatatttgtaaggcacgcagatgagaatagtaacaaaaagcataagaattgatgctagatagatttcattcggtgtttcagcgcataaaagtgtagctgaagttcgaaaagaaaacatgggcagaagatgtagttaagcttcagaatcttcagataagcaacaccatgtactatctcgttatctttacacctatgcgttatcaacacagacgtgggctgatctgatacgaactctgcacacgacttcttgactttggccaatataatccgtcactgcactgaatgcctttgcaggtgtaggtcgcccagatagtagcaaatattctctctactcgagtctcgtcatctcttatcttcagagttcgcactcttcaagaatacaccgggcaactcgccgaagaagaagcttcagcggcagaagaagaatcacccatcgagagttttcccctcccaaggaagatcagggtaattccgtatctccttcctcatggaaacgcactagttcatctttaggcccaaatcgaaaaagtttatatatggctagttcttgtgcatttttggtggtgtcactcatttcagtacttgatggagcatattattcaggaagaatattcagggaacatgattgtccatttttcatgttttgctcgtttgctgggataatctcttaggcattcaattttaaggaatcagatatcagcgtaccatgttttttcattagatcctaatagttttgtttttttgagaaaatgcattcttggatcaaatagaagaaataaaattttaaaaaaatgcataaaagtaggaagaaattggttgtggtttgcttcaactatatgctagtgggttctatgctgattttcaggatctcttcttgagataaaaacagtcatgtctgagaccatagatttaaccggagatagatgcattcttaagacagtgatcaggagagcaaaggatgatgctactgcaccttcagatagtcttcccattgttgatggtattgcagctatctacacatcttggtcttgcttcagtacacctattcttcagatttacaaaagcataaaagcttctgcttctaccttgtctacagttcactatgaaggaacacttgctgagaacggggaagtgtttgacactactcatgaagacaactccgtcttctcatttgaaattggagagggaactgtcatcaaggcatgggatatcgccgtgaaaacaatgaaggtaaatggatgaactgttcgctagttcattatgatcaatagcccaaacagttcttttgctgataatactgttgttaaattggacacctgaggttggagaggttgcaaagatcacatgcaagccagaatatgcttatggagctgcaggttcacctccagagataccgccagagtaagtctgaaaacttgatctgtcactagtaaagtctttggtttttttatgtacagagttcaaaggtaacagaaacagctctgtttttttttccacagtgcaactctcacttttgaggttgagttaatcgcatgcaggccgaggaaaggttctagtgtggaaagtgtatctgaagagaaagctaggcttgagtaagatatctgaacaatgttttcgtgcttcacaatttaagttcaagtaaagcattctattgacagcactacacgtgcaagactctgagtttgtgatgcatgctagttaattttgtctggatgcgactaactgttacatactagagtttccgatgacacctgccaaattgaaggattcagaattatcaaaacagacaaaaggggactgttctcatgtctagggttttacactttaacagggagttgaagaagcagagggagatcgctgctgcagccaaagaggaagagaagaggaaaagggaggaagcaaaagcagctgcagctgcgcgtgtacaagcaaaacttgaagcaaaaaagggcaagggaaagaaggccaaatagataatatcacactaagacaagttatgaggtaggagtatataaaaagtataaagttatgtatgaacctggtaactgtatgctgttgaaattccacacaaacacaaactttgtttggttgtagttaaaatgggccatgaatatgcatataaacaaaaagaagtcgtgtcactttgatcacagtgtgcaccagcccatttgtgcaagagttcaatgtctttagggcatgttcatgagatgcaattggt

SEQ ID NO: 62022 - DNA, 730 bp, Oryza sativa
tcagccttttagaaccgaaaaactccgatagccaaaatgttaatataaaaaatcacataaaccattttgtgcacataattactaatttgtcatagttagcatgagctacaaaatgacctgagcctttcttgtaagttgtagatatcagtgatatgttatagcccatcatttttcccttatagggtatttcccatgctccattaccagaaggaataagcctacttcaccccctaaagtacgaaaccggatattctaccccttaaagtatgaaaaagggttcaaataaccccccagagtagttttttaggtggttttgccatgaaaatgattacgtggcagcggtattggcttgcatgacacaaagattagtctagtaaacccaagttgatctaactattgcttttcactcattgatcggcaagcctaatcccttcatcctaatataaggcatggtcaaacttggtacggttggcttataatttatcatgtactataatataaggtttatagcaagaaaattataatcatatgaaagtaaattcaaatgtcaatccaatgataattttctcaacaaataaaatttaattcatattatactaattattggtcaaatattttagaagttgagtcttgaaatgcttgcgcgccttatattatgggatggagggagtatatattaacactaatttacatcattctcagcccgtttcacttgtgaataaaatgctta

SEQ ID NO: 62023 - DNA, 1454 bp, Oryza sativa
cttcgcgcattgcaagttctgtatagcaattctctgacagggcggtaggggacacacaaagcgtcttcgtccttgcaatgacagtacgtagctgtcgtagcacatgtttatcttctagaaggtctacgtgttgtccagatcccgtggatgcaaattaattgctaataacggccatggatcccagattgattcggtgctctggctgccacccaaaagaagcctcatcgtttaccaaataaataaattcagctacagttaaaacttaaaatttaaaattgattttatggtatttttaatataatatctcttttaacatttatttttaagtcgttaaaaacacatatatataaaatttttaaattatttttcaatcactaataaagctgtgtgccatataatcagctcttgattatattaaccgaataaccgatgaggctattggggacatgtgccattagaaggaacccaaggagctcgagagctgaaacatgaaagttaatcctgacattggaaaacataaacttaattaatgaacaaatttacagcattgaccacagttcaggttcaggaccgatggagccctgaggatccaatggtttgcatttgtctctgtactgtggtataaaactcaattcggaccttctcaatcacattacatcaagattagtgaattttcgtttgaactttacagccattttgtagagcacttcaatttctacgaaaatctgggcagtagatcgtataacaaacgagtcacaccctcgatacacaagctcgaattcccgcagcaaattcaaatgttaccagtgacggcccacatatggcccaatcagcccgtccttcccgttgaggcccaatcacgaatcttccagaagctaacggaataagttcaccgcaggtctctcaacttgacaacgagattttttgaggtccattaaccacaaaaccagaaatgtgtacacctaaactcactcaaatagttcaaaagaggtcccatgacagtatatataggtggtttcgctgacgtggcatcctagtcagtaaaaaaaataaaaaatatgtgggacccacatgtcagccgtcctctcctcttttctcctcttctcttttctcacttctctgctcttctttggtgagggaggccggcaatgggtagcgcgcgtggcggccggggcggagcgggcgcggcgacacgcggggaagaagcgggagagggggaaaggaggcagacgcagcggcgggcggcgcggagagggggagagaggcggccgagacggcgggagcagcgggcagggcagagggtggcgcggagagggggagaggaggcaagcgcgccggcggacggcatgcggggacgacgacgaggaaagggggagaaataagtcgatggccgacgacagtgaggcgggtgagcatggcgccgggctgctcacccttgctgaccaggccccccg

SEQ ID NO: 62024 - DNA, 1922 bp, Oryza sativa
ccgccccggcaaccgcgcgcactgcccgccgccggcctccctcaccgaagaaaagcagagagaagtgagaaaagagtagaggagaagaagagaggagagggtggctgacatgtgggcccccgtattttttttaatatttttggatgactaggagtgtgttcggcaacctaggttcccaacctctctccctcatattttgtacgcacgcttttcaaactactaaacggtgtgttttttgcaaaaagtttctatacgaaagttgcttaaaaaatcacattgatccatttttgaaaaaaataatttgctaatacttaattaatcacgtgttaatgtaccgccccgttttctatgtgggagggatttgctcccatccagaagtaacgaacacagcctaggatgccacgtcagtgaaaccacccatatatacttccatgggacctcctttaaacagtttgagtgaatttaggggtacatatttctggtgttgtggttaagggatctcaaaataattttgctgttaagttgaggtaccctctggtgaacttattccataatgggaccagcacacgaaaccggcggctcatattgcggtcgtgggatttttgtccctcttgctaacctctcgatgcaccgttgaatcctcgccttccactcgcgggaggctcttatcgccaaaaaccctctcctccccggcggcagcttcgtggcggcgggttcgatgaggccgtcgcccatggcggtgcgggcggcgggtggctgctccacggcggcggcggcgacgctcgccttcttccgcctccgtcccctcggccgcgccgtccgcccggactccgctcgcgccggctggcacttctccctgtacggcggatgccggggacgccaggtccatggcctcgtcgactccgtcctggaggagctccgatcacagaggcgtggtcgggtttcggcaaagtaacgcgcccttgtcattctctagactgaattgcctatgcattttgaacccataatttgcatgcttgagttgtaatggttggtgtatgcgtgtgcacttggagctgattggcagtagctaccaagttatacattacactgagttactaatccgcatgtatttcctcattaaattgtgcacaagggagttttgattccttagtaaaacttcatcggttggtgcctagtgagtaagccccagaggtgtttggtttggtagtttgtgccaaattttccatagcactccttgccaaagtttggtaaggaatgaactagggagctaatggaaggaatcctccgaacacttttagcaaaccaaatgctggccaaatccagtcaatggtaccaaaagttggtaagacaaacaatggcaatcatcagtatcaaaccaaacagactatagggttatgataaacttcttaggaattgacatttctaccgttgagcggtgaccagtggccatagtatattctttattgatgcaagtaggtgagcatagttttcttatgagctgttgctgtgaactatttatgtaccaacaaaagtaatcaaataatttactcaaggagctgtttctatataatgtgcttctgggaaggtgaaataatgtttgcacgattttttattggtaaatgtgttgagtgaaatttatactgtaatgcggaaaatccgttaacatatatacttgtagatattcagccatttattgtccaaatttacaaccatttagtatattgtgattgtgatgtctatattagtgtgacactgctgcactggccttttctgataaatgagtgtttcctttttttctttcttcctttcttttagcttatcacaaggtgttaatggctagttctgaaaattttgcatacagatgtttagttttaataattaattgtttgatttaaccatttgacaatatactaaagatt

SEQ ID NO: 62025 - DNA, 5743 bp, Oryza sativa
tgcagtaatctgcacgcagcagtattagctgacctctggcgacgctgctcttgcgctcctggctccggtactgcaccaccacgtacgggtctatcttgcctgcacaggacaagaacgcggatgagatcgagctcgatcggcctcgtcttcttctaacggcgctcggccgcggatcgaggtaggacgcacctatctcacctaggaagtcgttgccggtgaggcccttggcgtcgacgagatgcacctccaggacaccgctccccgccatctttctcttctcttctccgctcgatcgatcaaggccggccaaattaccaaccacgcaaacaatctcgccttctcggtgtagttctctgaatctctctggccttcttggtgtgttgctccaactcaagcagatgccgtggtagctggctcgagcgtgcgcgcgtttataggcgagctggctggggaccagtcaaagctcccgcacatttgaagcggtcgccaccgtgtaaacccgcacgtttctacgtggttgagttggactgaaccgagccggttcgaggcttcactactgttctcccatattgcttcctctctccttcctctctatactctctacttgcccatctcttactcctagctgtcagctacaactggccatatttttagcttagggattactactacgtactaatttaattacttggacgtgcttaacgacggctcttttgtttgtttcgactcccagctggaagagccgaagaggcactagcaactggcagttagcagttatgctatatatcaatatatgaccctacttaaatcagtggtattattccgctagtcaacagcatgcccacggtgtgattccttccccagtgaatcgtcctggcattaacacatgcttattgcatgattagcagtacaagtttcgtacgatctttctctctgaccctctgcagtttagaattagtagtttaaacaaccaggtctgttcgacgacgacttgtacgtgatttggtcacgtctcgccgcctggatcgaattcgaggtgattttttttcatcgcttcaacgtgaggatcggagctgatcgagtcttgctgctaagcgtgtttcctcggctaaatgcgcgagtcccaatctacgcgataagttcgaagaatcatcaaagaggaaacttggactgagactgcagtagggagacgaatttgcgtacaaccattagttcgcaagaacaatcctggacgagatcgagatagagatagtcaggcagatagatatcggtagaatttccagatttctgaagaatgggtctcagaatcagaaactgcttggttctgattgttaacctatcaggtggttttcatgacagtgatgtgtcataataacaaagaacgggtgtactgacatcagttgttgacatactgtgagtctgtgatgactcggccaaaaaattaaaaacgattatcattggccgtttgttttaatttacgctggaaacagattaacagagcagtatttttcgggaacgcaggaaacagagcagtagagcaccatcaggcatcaacatcacaacgtcagctgcaaaattgaatagtggtttcgtctcacattacgtacaggtatatggcgatcagtcgatcacaaaaaaaaagcatattattttgaagtcgatagctcgcgcaacacataactaattaaagaacaaagcatggatcagtgtcgcagtaatccaaaagttgaaatcctcagacagagaaaaatgaaagcagacagagaattcacatgtcaagatcctgaggaactgagctcgacaaatctagcatagattccgaaattctaattgccgaaaacatagagcaactgaattaattggacagcaatacctagtgagtttgtgagcagaagatctagtgagtttgtgaccatcaacttttcaaggtgaattagttgaactctgtagcgtgacgagaagattggttcctaatttggcttaatcgaggacaactagaaagaaaattcttattggttttgctcgccctgcacctgcggattagtccacgatgcttctcacgctcagcgacgggaaatcctagcgaggattatctcgcgcacgacctcgttgctgatgagctcccggcaccgacatccatgcgatcaccgtcgtcggtcgtcccctgcaacggcgaggacgaagggtgagccggcgttgacagggatccaacggccagggaccacccacgtttgacgcatccgtgcccaacacattttcgaataggccctgacattttgtaaaaaggaccctgcttggatcgctgccaatgatggccgccctgagcccctgacctcaccgacgagcatccccggacggcgtgctcttctgcgcctctgcctcagcgatgtcctccgcgccgccctcgattgccttcctgccttcttgacatgttgccttctactccctccgtttcacaatataagtcattctagcattatgatgttaatgaatctatatatatattaacatcaatatatatgtgagaaatgctagaatgacttacattgtgaaacggaggaagtaggaacgagccggcgttacaccctacgccgctgccggcctgccggctgccgccggcaactcgcccgtcctccaaggccggacccaggggtggtgccgggagggcaccggcataccccaagaaatgtgaaatttcctgggatcagcgactcatcagtgtagtcatatttatcagcattaagctagctgcagactgcagtccgtgccctgcacaaacgaaacaccccattatttgatgtttgaggcgctaagcagcggcggtgtttttggatattacaatgtcagctagtccgttgccaaattaattcattagcccttcatattacgcccaacataaatttttctgggttcgccgcttaggcgtcctcaggggaccactcaccagtgaagttaaactcgtcgtcgagtggccggccgggggccattgccgcagcttgtacggcttctgtgattgacaaacgccgtagcacaaaggtgttcaacttatgccggatcatgctcgattttctcttaaagaattggaacaatgcaagggggcactggcagtaaaggatctattcagaatacacatcctctgatctgcaggaatcagtatggatgttcgcatattacattttattgtaactttgaaatgatattttataagtactagtataccgtttattttatctggtgagtacaaaatctgtaatgtacacttcgtctggctatggttgttgacaattatatagagaaaaaaaatctgttataactgcaactgttgcaatatgtaattatatgtttaaaattggtcttctggatgataatgtgcactagataactacttcccagaaaacgcttttaagggagtgtacattcaagaaaggaagagggaggacagtacgtcacagatggattcagtcactaactagtttacatgacaatgtaatagagtaacaagcgaatgacccggttattattctgcattaatcaacaattgcttaaatcacgaagtaacaaacttaacaaacatgtagtatatccttcatgatagcccgtttgactacgaaaacaagtaatcatcaatcaaacatgcaaaggacagtacttcactcaggaagtatcaggttcaactattatagcatcaagccatcaacaaacttctgataatacagacattaacggcactttcagttcatctgatcctctcgggagaaaaagtcaaaaagaaaaaaagcaaccacaggtggctgcatgctctatggaacgatatggagttcactgacttcgagatataacaaagcaagctggtcaaacatgtcataacttaaaattggcagcattaactcctacgatcatctggttgcaacccagaacactaagcagaagacttgacggtagcagacttgatgatgtccacaaattcaggctgcagaaaaaaaaagtaatcatcagtaatatacacaacggtaaagcctgaaatgttatgtgagaatgtatagagttaaattcaaatatttggcatgctactaggcacaaccgcacaaggattgtactggtcaaatggtgttttgtttaactaggcttatgttctacatgctactatcaatatcatggagaggataataaaggaataggaatatgaccttcaatgaagctcctccaacaaggaatccatcaacatcaggtttagcagcaagttctttgcagtttgctccatttacggagcctgtagaagacaaatatgcgaagacaagggatcaggttaatcgtagggaagtggggagagttttgtacattagcaattggcatcactactaaacaaaatcttggttacatttcaattcatagtcctatagttataaaggtatacctctgtaaataatcctggttgattcagcaactgcaggactaacattagtcacaagccactttctcagaccatcatgaacctaatgtcatgcatatttcaaataattcgaatgaacagaattgcagaatcaggtaccaggcatcggtcaagaaagacattagatataggaaaaaacccatattggtttatgaggcagataaatgtgaagggaacatgctaatcgtgatgtaattgctctatgttagaaggaatacctcctgagcctgagcaggggttgcaaccttgccggttccaatggcccaaactggttcatatgccaaaacaacattggtccaatcggatatcttctctgaaaaatatgacgagtaaaaaagacaaaaagttaggggtggagaaatgagaagacttctatgtcagcacagtacaatggaccacaaaagccataaagaacaaatgaaacgaaaatggatgtgactaatcaaaacaggatgtgttttcttcaataactaaaaggctcatagtagtaaagtatgtgtttcttgtatgacataattcctagttcaaatgatagatcatttaataatttgaccacaccgttatcatcataaacctgtacacaagctacagataccttttggatatttagcagggtaaaagcaatcacagtattctattctgcaaatataaactagcattcctgtttaacagctttcaaggtggaagaactggatttatcaacagcacaaggtacttcataaggaaggaaggaagcacttattcagttgttccaacattaggggtgaagttccaactttataagaaattaacttgaagaatagcaagtgaaattacctgcaatagctttagtttgcgctgcaacaacttccatcgttgttcctgcttctctctgttcaagggtctcaccaatgcaagcaattaccttgataccttgggaaagtgcgtacgcaattttgtcagcaacaaactgtcatgaatggtgaaaagaactgttagtaacaacatagtaaatcaaaatcccatgagcttcaaacagaatttccagcagcttgatgaaataacccaatttataggtctaacttggctaaaactcaacagagtaactcaacagtcttttatgctagcttagggacggtgcagattgaccttaaaataggaccattgtctagatattcttggcaagttcctggccttgctaaaccagtagctgcccgcattctagttgctataaagctgacatgaaaaaaaatcctatgtttctagacaatgtagaaagaactcacatcacttgattcgcccatcagcgctctc

SEQ ID NO: 62026 - DNA, 2428 bp, Oryza sativa
acaaatccattcaatgcctataatcaagtcagatttcgtggaactagagctgcttataatcggctaacaatactcgcggttcgaacaatccgtactaaaatcgacgctctcgtgataaacactcagattgcgctgtaaggccgagttgttcacccaatgccaaataaatcactaatcatctctctcaaaacaaaaggggaagggaaacagagcaggggagtgggggaggacgctcacctgatctcgccagtgaaggcgccgcccttgcgcacccagcaattctgcgcggcgacggagaagtccggccggagcaaacccttcacctgcggcaggaacacgaacggcgggctcaccaccacctctgcacccaaaaaaaattaaaataaataaacaaacccacagatcagcaccagatcgattcatgaatcgatccaactccaaacaacgccctcgggaggggacgacggctcaccgacgacgtcctcggagggcacctcggcctcgttgaggacggtgacgatcttcttcacgtcctcccctgtcccattctgcacgcagcaacagcgcagcgcatcgataaaacccaagcctcatcactcatcagcagcgtctccggctcatccggaatctggattgtgagacgactagtgctggggggaatacttacgcatttccagttgccgccgacgaagaacttcctggcagccatggatggatcgccgagacgagggtgcagcgagcgaaggaggcagagggttttcgtggagtggaagctgtgatggggggactcgagatggggcggttaaatcgaggaggggaaggaggaaacacgtggcacagcttcttggggcggaagaaagaaaaggcttcggtttcggctgtgtgctttgttgatgccgcaggcgcctacccgaaggcggaaaccgcggaggccgccggcgccgattgattcgggccaacctggtttctcgtcgatccgcgatgaaccgaatgaccaaaaggtgatagagaggcatagaaaggcgccgataggggtttagcttttcctaagggcatccacaatataaaagtagtctataaacaatagaatattccattcagccacctattatcattgtgcaactagtccatataaaaaaaatagcaaaaaatacccatatacatatggactacccatatgaaataaattatattatctatctctactcctctctcttctccttctcctaatgataccttgtatctatacattgtggacattatcatagggataaactatttatgtgggtcccatctatatagatcactttgccatatacattggtgatgctctaaacaaaaaacttcggccgagtttagttccaaaatttttcttcaaactttcaactttttcatcacatcaaaactcttacacacacaaacttccaatttttccatcacatcgttccaattttaaccaaacttccaattttagtgtgaacacacccttcttacatagtctaatttttcatacatattctgatatgtatagttactatagatatagaattagaatctagaaacatattccagtttctctaaattaagctcacccaaacagggccagtaatacagctgaatcatatcatacaactagcatcaagtaagaacgaacacaagcatatgattagcctctgcaacgttgttctaacagagcttcagcgagtacagaagatgctaaagaatttaaggaattgtcaacaaccaacaaacgaaacctgagctgctgtcaaaatggtttcttgactatctctggcaatgattttgcaaaaacgggttttattattgttacacagagcagaccctggctgtttcgcgacaaagggaaagcacaagacaaaataaatctgacaatccaatgaggaatactcttattcagctataatgacgttctaacactataattttttttcgttgttgttttgtacacacctgtggcttctacaatctgaattttctaactgtaaattcacaaagtgcagcgagcaatgtattcttctacagagtgtcgctcatcttttgtacaccttggttagaagagatgggagaatgattggtggaccttctgtactcagtacaaagcttcaattctggaattcttctccaccggttttgtttgatcttgttgtggtttaatcgtgatactttgagaaaaagctcatcagctcagaaagacacttcagctcatctgtcctacttcatcagattgatgtcagttcctacaaggcaatggtaaaacaattatgcacacttcttccatgttcaaatcaattaataaaaggacccaactaccaacatggatcagataaaccaggtagaatttgtagactggctatgaaaagtataatgcatctcaattgtaaagcaggggttttcaagatttttgtaa

SEQ ID NO: 62027 - DNA, 1404 bp, Oryza sativa
gatattatatgtctgacaaaaaatcagggtggacttggagtttataattgaaaattcaaaacccaatgtttattgaacaaatggttgtttaagctaataaattagcaatgtgtttggcaagatttattgaaaaaaatatacttcgataatctatcaacaaatcaagttgagaggaaagaaggggtttcctattttttgtcgggacttatgaaagttaagagtacattcttaaatatgggttcctagataattaataatagtgaacaagtcagattctgcaagaataagtggataggaaatacctcctttaaagataggtacctgcctttgtattctatagtttgaaggagatactcttcgattgcaaatgttatgagttctgttccgctgaatgttttttaaagagctttagtaggctataacctggtcaattggcataacttgtgtgcttcgatcatggttgtcaagtcgtaaagtcgagtcgaggtacccctgaaccaacttgtcgacttggtcgactagtccacgactagcccacgacttggtcatgcaaaaacagtggatgcaatatataatctttactagtattatactgtgctaaggaatgtatataatataaactatggactatagagttgcaaagcaaaacaataagtcgacaagaaataaaactaaagtactaaacacaataagccaattagcatggtgaattggtgatttgctatgactaatcacaactaatttacggctgaatttacgactaatctacgactaaccacgagtaaccacgactaatcgcacgacttgctatttggtcaagtcatggctctttagtcgactagcttgaccgactttacgactaatcacgactagtcgggcgacttgataacaatggcttcaattgtgcatatccatttgacagaagaaagtgaaatatttaaatgaaattttcatcaaaatagttactcggttcgttctatatacttagctttaattaataatacttatattgggaggaacaaaattaactggatacttaagatgcctcttaagattaagatttttatgtggtatttgcttaaagggatagtgttaacaaaggacaatttggttaggagaaattgaaatattagtgtgagatgttgttttttcaataaaaatgaggggatccatcatttattcatggagtgccattttgctctggagagcattacaggtttcttatggtttatatcctccacatagttcatctcatatctttggggattggcttgtgggtattgataaagaaaacatgaaacttattattttaggagcatatgctatatgttggattctatggtttaggagaaatgatttgttttttttttgacaaatcaccgctcaaatattatatgtaggttt

SEQ ID NO: 62028 - DNA, 816 bp, Oryza sativa
cgttagtgccgtcatttcatgtcggccaccattactcagctcgtaataaccactctcttcatacaaatccaatgttgccgttttataaaaggaaaggagaggagatggtcctcactaacaatactgagtagtagagaaagagaaagaacggagtgcattgaggaggagaggaagccgcataagagaggaggcagtggagagaagaaaataattgcacgtaagcagtcagacgcgccgaaagtgtcctcgtctctttctaaatatgcatattttctctgaacaacccattaataattgagatggtgcgcacttctctctctctatatatatatatccactagagttcaaatcatagtgtccatagatatggttaccactgcatgtggttccccctatgtgatatggatctgtgctgaacatccaaatttctcaccaatttttgtaagagttctaaaattttaatcccttctcaaattccaaggtagtacaccaagcactataagcttgctacttgctacaatgtatacacacacaaacacaaccctagctagctacccagtatatacatactgtacttgtacacagcttaattaatttaattgaattgattaattagacgttgacgaagggcgagccggtgaggaactcggtgaaggcgagggcgacgaggccgagcatggcgaagcggccgttccagagctcggcgtcggcgctcatcacgccgccgctcctcgcctccgcgctctcgccgcggagcagcggcaccagcgacgccgcggagagcacggtggcggtggcggcgaaccacgcgagccc

SEQ ID NO: 62029 - DNA, 7020 bp, Oryza sativa
  unsure (1)..(7020): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcaatccgtcattagcaaatatttattgtagcaccacattatcaaatcatagagcaattaggcttaataaatccatctcgcaatttacacgcaatctgtgtaattagttttttttgtctatatttaatacttcatgcatgtgtccaaacattcgatgtgacagggtgaaaaaacttgccaggggaactaaacaggccctaagattttttttgtctttccctattgtcccaaaataagttatttttgagcaaccattgtaccgaagtttgtgaaaataggggataaatgtattgggaatagatagagagcaataattgcattggggtttgataaaatgaggatattgtagtcttttttttatattggtatatgtgggatatgtgaaaaataaacttatttgagacataactactaccttcgtccaaaatatagtaatttttagctatatatctgaatatgctcttatccagataaagatatatagctagaaagttgttatatttggggagtagtacaattttcgaccaacagagacattggtgcattgcttggacccatataattaggatgagtcagagacattggtgcattgcttggacccatataattaggatgagtcacattgtttacgatcgatgggtagcagatagggatggaaggagaatcaagatctaacaagtcaatggggtaggagataggtatggaaggagaattgagatctaacagcttacagctagtgggagaggaatggagacaactccgctgttaagagacgagaactagcgacacatccctaatcttactaaaaacatgttaaaagtctacttacatgtgcataatattcgtatgcatgaagatttgaaccttggtgggtgaagtcatgcacccacgactctacccgccggtgcttccacttggtgggatagtttttgctattctaagatcctcaatacaatgtttttaaaaaaatcctgagtaccatgaactttagaaagcaaatccttcatatttgccttaaaaaatatgatcccttattcactgcctcagatttcaaggaaggagacattgaggtaaataattagataaaatttcaggatatttttccttaaaatttgtgccagtgaatagacaatatcccctacggtaatttgagactaatgaagaggagtaatttcctcttaccaaaactgaagctccaaagatgtgggagatgataatacatggaaaatatatcgaagtcacatgaggttctggaggtaggattgactttgcttaatcatgcttaactttaaaaagagctgtttgatgctctcatatcccaagatcaatttacaccttcacctctcgtgggcatgccaattagcatagacttaaccattgtttaggatgaatagaaaaatactacctctatttttataaagatgatgccattgactttcagtgtaacgtttaaccattcgttttatttcaaattctagtgtaaatatgaaaaaaaagttattttaaagttatgttaatgataaaagaagccacaaaaaaataaatgatacttatatagtttttagtaagaaaatggtcaaacgccatgccaaaagttaatggcgttatctattgaacaacagagttaatataaagctaaaactcgttgagtcaaagataatgtttaagaaaggaactcttagtattcacaaattcaacagagacagtttatattgccgcagctttgctatctgcaaatttcagatccagaaatatgtaactcaacagagcaatatgtgtttcgatcagagatctgtttgacttacgaaaaaagaaactattcctagcatttaagacgatggggagacgttgataatggataccaggttccagtttaagctgacatgtcagttcttcagcagttacttcggaaataacagaaaacaataaacatgcagttcaatagtgtcagtggcacaaaacagggcatcattcctccatagtccttaatatatgagttgaattgatctttggagattttaaggacaaaaatattcactaaagaagcattttacttggtgtcctaagaagactccaaccaatattgtaagccatggacagctatgatcagaccatgctttgccattcttaattctaattgtatacttttagatcaatctaatgagctgtaatgaaggacagctaagaaactttacattgatactaagtttcacatgttgttctgaaacgaactgcttgatatccatgtccgttgctctcacattagcataatgtacatcagaagtagaatcctaccagattttttttttttgtaattcttatcaaaataaattcatacttaagagagggagatcatggaaaacaacgattgctgaatatcatttaatcatgtatgaattatttcaactagttattttttcaagattattagtaagtactaacaaggagaaaaagacataatttgctagacatgattgattagttttggaaatagtatcatttacgacatcaaaatgtggagattattctagttccacaaactaataactagattgtagatgtaaaacatgccaaaccttcagttactaaatgaaataaactgcatgggccagatatgtaacaagaagcagtccatgtgatgtaataattttagtaactaaattggcagaaaacattatggaactactacatgcaacaggtttgcaagtcccagctcccaaaggtcaaccaaatttactgaaaatgaaagcatcacaagagaatgataggggttgaaatcatcagtggggtcaataagtcaagagggttggtgtaacttgtaaggctatgtatttagtgctctagattaggttagtgaaaatacaattctaagctactagagaagagacagagaagaccagtatttcttccagagcttaccatgaaatcacactccagtctctctccaagcttcagaaccagacatctctcctcttctgtgcaatgaggtcttctaactttagtggttgaattttggcagtctccatgccttcttcacaagattatatatacatcagtttcaccggtcaaagtaagcacagccttccttgattctcttttgtgcgactttgtgatgccttcttgcattatatacactacatattaaagtcacacattcttggagcagagctatgtacctaaatcattcttagaagtaactaaccttcttcaacccttactttgtaaccatggctttctctactactgaaatctctctatgtagctccattggacttctaggaaaggaggtggtctttacatcttgagcgtccagaactgagctatttgaacagccttcacttgtttgtttttcttctggtgaaatattggcatcacctttctttgacaaagttgaacattcatgaattcttcttaacttttttttttatcctctcattttcctgagatcctacttccagctcttcagttggtcttgcaagttcatatgttccactgctttcttgcaaagaatccttgccttgtttacatgcctaagtttgttgctagcatcattctgcctatactttgattttctcttgttttctcttccttcttgcaatcgtgacaagatttacaattgtaatgctccactctgttctgaaaaaactaccatacttatccaaatcattctagcacaatcacaatgggctgcttcttctactcaagagagaagaacaagaataagaacaagaagcaatcaaggtcatcccctacactaaccgtagacaaagatgacttcagagatgaaatgtccaagaaggccaacagatcatgcagcctggttgttgcttcatcaccacggagcatactggagctatacgaggagcgtgcgcatgagctccgtgattttcgccttgccgagctgagaagtgctaccggtaacttcagtagagagctcaagataggggaaggagggtttgggagtgtgtacaagggcttcctaaaaacttcttgcggtcatttggggctcaggaatgacagtggcaatgtggtggtggctgtcaagaagctcaatcctaatggaatgcaggtattgattgtcttcgatagaccttatgaatgttagatgctataatcatgtttctatgtacactgcaattgttaaatggagttgaagcataccttttattatgaaacaaagggatgcagggagcctgggatcaaattgcataagtaaatatactgattctgcacatattggttactttcgaatcgtgccgagtatattatttaatgtaggattccaggctgtgtaacaatttttatacaaatcgcatttagtactctaaaaagttgggcaggatggtttggtcaaaattattatcacttatggaatggaatgtgaatgttagcctcaggatgactgatgacaaggattttagcaaaattattctcaaatgtagactactggtaaaatacatttttagttcatattttgcatttcccatgcataatactcagcaaatatataactgtcaaattatagctgcatgttatagaaaattatgcctcacgaatttcttgtgtcttatatgcaaaaaaggaaaatgaaccccccatggcttgtaagttttaacatctagaatgcagtaattacaacattttgaggaatcatgcacttggagtagcaatctgaaaaaacaaattcttccattaaatttgtttaaatgttatttatacttctacaattcttccagtatgaccatcaattcaaaaagttgatttattcctcaattacatcactttcagggtcataagcagtggctggctgaagttcagttccttgctgttgtggatcacccaaatcttgtcaaactcattggctactgcgggactgacgacggcgaacaaggtcctcagagacttcttgtgtatgagtttatgcctaacaagaccctagaatatcacttgttcaataaagcatacccaacacttccatggaaaacaaggcttagcatagccttgggcgttgctaaggggctgcagtacttgcatgaagggttggaaattcaggtattggtctaacaacttcgataatcgatatattgagtattgtcagttacaagttcagagaacaatgtaaatagcagtgctctttttttcctcctcttttcttctgctttttctgctgttttctttaatccttactattagttgttattagaagcttagggctctagagctatgttacattagtaaacaaataatacagctgtttcccattaatgctatctcaaaacccaagtgctcagagttaagtgacaactcccagttgttccagttttgcaatgatagtctcatagggatatgtatcaggagctatgattcagaaggctttctgatctataattctatacttgttagcgcaaattaacagagttttccagtgtttatattctgaactattgatgcttgtgttcacatgttgtagagttgtagacttgtagttatgacactctttatgttacaggtcatatatcgcgacttaaaatcatcaaacgtgctgttagatgaggaattcagaccaaaactttcagattttggattagcaagggagggcccagtggatggacaaactcacgtgtccacagcggtaagtcatttgtcatcagtactagcaagatggttaccatttaccttaagaactacttgcattcaatctgcacaaaaaaaaaagtagaattacagtattttcttgaataatttcatggttggttcgaatcgggcatcaaaacggtctagaaagtttggtaggcggccaaaccatcgtttcaggcatttgtcctgacatataatctgttttcacctggagagatgtgttttcacaaaaagattcatgcagttcaacgaatgcgaaacttccaccctttcaacaaaaataagctaaccaatgcaacccctagaaatttaagatctgagagttggcggtccaatttagttcaaagttcaaactaatggctaaacttttgcaaaaaaaataaaataaaattcgatcggagactaatggctactccctccgtttcataatgtaagtcattctagcatttctcatattcatagtgatgttaatgaatctagacatatacatctatctagattcatcaacatcaatataaatgtgggaaatgctagaatgacttacattgtgaaacggaggaagtacaattttaacattgggtgttatggttatcaaaagattggtacattagaaatcaattttagtgcgaagtaggacaggaataataggattattatgtattaatctgagcaatgcaagcatgaacaatcaacaacaacgtgtgatgtgtatgaaacgggcataaaatcaaacaggtgatgggcacgtacgggtacgcggcgccggactacgtggagacgggccgcctcacggcgaggagcgacgtctggagcttcggcgtcgtgctgctcgagctcctcaccggccaccgcgccttcgaccggagccggccacgccccgaccagaagctcgtcgactgggcgcgccgccaccccgcgggcacccggtggttctcgaggctccccgacccgcgactcgcggggaggtactcgcaccgcgccgcgcaggacgtcgcggcgctcgcgtggaggtgcctcgccgaccgcgccggggagcgcccgtccatgg

SEQ ID NO: 62030 - DNA, 8836 bp, Oryza sativa
attcctgcagccccggttcctcctccccggaggcgaagaaggcagcgacggcgaagcggcggcgaatggcgcacctgggcaagctggcggctggcgcgagcgcggcgccggcggcgcggaggctggtgcacatgaagatgacgaaggcagcagctacatgcaacgcaggcacgcagcatggtgagacttgagacctccctgtgttcaaagttcaaacgcactactattctatcatgtaatctactcctcctattctatattacttcctccgtttcacaatgtaaatcattctaacatttttcacattcatattgatgtgctagaatttctcacgttcatattgatgtgaaacggagggaggataagttatttgattttcttttgttaaatttctttaaatttgatcaatttataaaaaaaatatagtagtatttacaaaacaaacatattatcaaaatatattcaatattagatttaatgaaactaatttgatatattagataaaaaaatatttttataacttggtcaaactaaataaagtttaactagaaaaaaaatcaaacaatttataatacgaaatgaaatggaaagagtactaatttttgggataattacgacctgattttgtttcgatgacttgctctcgcctgttctactaccattgcaagcctgtgctgtgcatatcatttttttttcaaaaaataagtgttttggtttctcttaagtacggcattgggatattcttcatttgaaaaacagcagcaatttctgatttcttaacatcaccacatagtttgaacacaggatgtgtaccgtaccaaaagtggattttaatcttgacgactacactctccacataagagaattcatcagaagctagaaacagaacggcttttgtgttttgtcatttgatccaagcgtaaactcaggatggaaaactggaaccagaaaacttcgactttgtaggctcggagaaaaatattcactattacaaaaatccatgcaggagtcaagttaaaagaagaaacagggttctgtctttgagatggagtataatttatttaagatcattccctccatcccatcatccatgagtttgcaaacttcagctcacattctaaaaatgaagatgcaaaagagagagagggacagcaacttaaaaacgtattgatcaaccagccaaagcggcattgagcgcactgtgaacatccactccaatctgagcttcggccttctccagttcagttgaggccgatccaagcttggcgttgaattccgcgagaccctgctggaccgcggctgggtcgatctggtccagggggacagcctcaacagccacgatatcagcgatggagtttgcatggacaaatgcaaagccactgctcacaaagtacttggtgatatcgtttccctcgtgtaccgagagaacaccaggcttgagctctgcgattgtggaaacgtggcctggcaaaacacccatctgaccagttgttgctggtacaattaccatgtcaacctgagtatagacaagcaaagacataagcaagggaaagaagcaacagaagacaatattgatgatgggggaagaattaattggtacattaacagtagtattgttgaatcaagcattgacatacaaaatctatgtgaatcaactgatagataatttgcctatcatctgttgaaatgcaacaacacaaacatagacaaccttcgaacaccatcaaccaattatatttcatacacaatagcaacaaaagaacatgacgctcagcaacatacttaaggaaaaattgatgatctgaaacttcttaatagtgccattaaccattaagtaaacagtaccaaaccatcaaggccaacaagcaagctaaaggaaacaacatgaaacaaagaaaatcaccacaaaactaaacaagtagtattagacttggttatcacagggcaaataacatatatcaaggacaaaagctataattggcgcacagtcaaaaaagaagctgcctatgcagcatagtaaaatataagtgaatagtaggctatattaatatgcagttttatttatagaacttcagaaggaaagattttctcaaccaaagaaatttacatcaggaacattgacagtgaatgttcagacacaaactctagttaatgtaaacaagagaaactgcaactataccgataaatccagacaatgcataaagccgcatagcactacaaacactagagataaacaggtctgaatacactgttgtagtcagaattaaaacttggcctggcacacagcaatcctagcaagagaaacttgaaatctataaataagaaacacccaaggagcgacctggaatcctcaatctgattaacaaaatgtaacggggtttccaaaagatacttcactagactactactacctctgtccccaaggagcggaccgtgtttattgaagattttgtttggttggttgtatgaatcacgaatttagccaggttcatagctaactaaaaacacagtcttttaaggcgaggaaatatcaatttatgaattctctatgctccttgcaattaaggcacacaagcaccccaaacaagaaaaaagaaatgcaatttgctaccaacactcaacagcaatcaaatgttgagcagaaattctatagtcatatgacatctagccacctggagaatcacgctacgttatgtttgtcccatgaaagaacatctccaactcatagcaacaaaacaaggaaatacctggtatgattcaacagccatgtacaaccgtaaaccgccacacattcgtgttaataggattgcaaatacgcacgcccaacaaatggccacatcacaaacattctgggcaaacgataaacggaggatagaagcattgaccatgatatattcctacggatgaagagtctggatgcgagacctctaccacaccagctcgacgaatcggatcgcgctgccttgacccacccaacccctatccctaatcgcacgacgcaaaccccagatcgcgcacatacccgaaaccctagcgacgccacacgcacagatctggggaccgaggaggacagaggagagggggaggggggggggggcaaacacggtccgcgcgtacctccttgttggcgatctcggacttgtaggggaggacgaagttgacggtgagcttggaggggatggccgccggcgtgggggggcggggctgcatgagcgacatgggcgtggcgggggcctcgatgttgggggccaccttcttccacgcctccgcgaaggcggagtcggtggccgcctcggccggcacctccgccgtcgagagcgccctgctgctgcggccggcggcggcggcggcgcgggtggtggccaggcggcgggcggcgtggcgcagcatttttctctttcttctttttctctctctcgtttctcctctcgtcgctgcggctgcgcgtgggtgggtggaatggggttccaggggtgtgggcgatttggagggcgaggtgaggtgaggagtgtgggtcagtgggagtggaggcgagtttgggctgggccgtttctatatttaggctaggtcgcctgccttcttttcatatcatttaggaataagttcacttgaggtcccttaactgatcaacgaatccgattttggtccttcaaccaaaaaaatagatataacggatcccacaactgtcaaaaccggcgcaatataggtcccatggcggtttggacggtggttttcgctgccatgtcgcttacatggctagtttgactcggtctttattctacgtggcattgccatgacaatttgatctgggaaataataaaaaccgtggacccatatgtcagctataataaaaataataattaaaaatggtgaggcccacgtgtcattctcactccctcctcttctctctcccggtcgttcttcttcctcctctgtcatctcttcatcatgtggaaagagagagagaaaggagcgaatgagaacacatttccatatcaaattgccactttaaacgtcacgtggatgctatatgggataaagatcaagtcaaactagccatgccagctaaaaccaccgttcaaaccattatgggacctatgttgcaccgggtatatggtttccggttgaaaggtgaaaatcagattcgttaacaagttaagggtctcaagtgaacttattcatattgtttattggattttttaaaatggattatttactccgcgtttctaagaatatgctttctaaaaaaagaatttttattggattgcttagaacaccttgttaaagttatttattaaaatgtttaatttatccatataatcaagtagataatccacagcacacatagttcttatatgttaaatggctactttttttcatgcttaatggacgaagcgttttgacaattattagaggatacaaacaaatgaattatctattatcaactcgaaaaatggatttaaaatggtattctaggaagttcatatataaaaatattttacaaaaattacatcggaaaacatgccaccgttccattcttctcctcttctaaattaaaaaaaaaaactcatttcttccttaaacattttctcattttttccggtaaagaaatatatttttttaatttatttatgggttataatacaaagcagaggtttgcaatgaggatgatcgcattctttctgaaccagactacacaaatagccacgttttggatgggaacaatcacaagttcatggcaaaatgatagtgcacccagaaagcatagacacatcataattgattatatttagcatagagcaaccaagctaggtatttcggaaagacacgatttacagaatgcacctgcttacatcaacctggtactagataaatactgtgacatagccatagtcctgcatttaactaaaattacaaagaaccaactgatcaatccaactatcctttgggttttataaacacagcacctgcagaaatccccaacaatgatgtcagccctaaagttaagaaagaagccaaaccaattacccgtgcttccaaagaggcaccgaatcaaataatgaacacaccaacagtaaagaaattgatatgtggaaacttagcatcagtttttaacgtgcaaagtcaaatgcaatatatgcttaaagcctaaaaactattagaagtaaaatatttcttgtaattgagcagctgatggacagctatgctcaactaaaaggaaaaacttcctaaaattagtattcatagcaatatggcatccttcaacatgtgagcgtttttaggtaaaagttggaatcattaagcacgaacatcaactgtgttattgaaacatttttcctgtttttgctctattatctgcacatatttaggaaatagagagtttccaggacttatgtcatatgactatattaaaaagaatatcacaattagaatatctgcctcaacttcataactgtgtcctctagaaccacagcaactagttaagcatgccaagttactgttcaagttcctctaaaaaaagttactgttcaagttgtgtaccccacatggtagtactggacaattctggtattagtgatggcaaaccttagtagccagtaaggtctggactgcaagtgctctatcaaactcccatcaggcctacaagttcatcagtttcattaaaaacttgaaatcggtaataaatgattgtcagagatgtcaaagtgtacaactgtttcaaaataataaataccatttgtggtctatgcaattgatcttgcttgtgacgtaaggtcaaggagtcggtttcccacaaaaataattacttgacaacttgaagcaacagcatgatcttctgtatcagcatagcctctttgtagaatatcacaagaaagaaacattactgttggtaagacagtagtctaagattgccacaaggccagtactacaataagattatcaataagattatcaatggtcaacatatttaaatgtaagaattagcaaccacctggaacctgaagaggaaatatgtgctgctatgagattcatgatccatgccaaaacagatgaaagaaaagacgggcaatttatataaaaaaaaaatcgatagttgaagccttgaaagttgatttagaagccttgaaagtggatttagaggtcaaagaagagaaaatccatgcatgtaagatgttacagtgagtactaaggaattggaactaaccatcaagaataaatggaaagacttgaaaggacaatacagaattatacaacagatgcggatgatgttacatcggaagaattctgtacagatgtgcatgcacaagaagagtgttctctaaatgcaaaaggattacagtgctgcagtcattttacctatttgacgcctgcccaggatctgaaagctctgacatcttctattcttttactctgttgttctgttttttcatgcagcaaattcaaatttctatacagattcttgtgtagctttagaaaaacttgcttgtatttccacttgtcacagtacattttacggtttgccatgtaacttaaaacctccatgactcttgcaaaatagccagcgtttaggaaattcaaaatcaagcagtcaagcaagtctctatccacagttagctctccatattcgagtctgcgctttatttctccccacagcatggcaatctccctatgcatgcctagtgaagaatatccacacagtatgtggcaaaaggtatgcagactgggtcttacattctgctctctcatccgcttatatgtgctcaaagcatcgtccatcatatttgccttgcagaagaaaagaattgaattattgaactcaaaagttaagtgctctcgagagctataatgttctatttcttgaaccaaactggaaagcaaagacgaatttctgaggggcatctcatccttgactattttggcaacatcctttatggtaaaggatggattggtatgaaaatcagccattgtatatgctttcttttgtatctgttggagaaacctattaacttcttccggtttattctccttctcatatgctctcaaaagagacatgtaagtacagattagaacaggaatctcagctgactctaaatcatccaggatatcatgagcagcatgcaaccatcccatcagaatgcatgcactaattacatctgaatgagatggcccctttagatcttccttgtgtaatgtaataagaaagctagacaatgcacgcactttacttgctttcaaacagccaacaatgaatttagcaagagccttctcactaggacgaatatttccatcaataacagcaagaaggccaaattgactttctgtatctaaaacgaaacctttgtccacttttatggggtcaaacattattctgaatccagttttcaggttgccagagcctatctgtattacaccttgtttatggacactatcaccaacaaaagcacgaggcttttgttgtcgatacagatcaaccaaaagctgagcagcggcatccatgtcattatatttgaaatgcaggttcagcagacttccataaaaatatagatagtgctgaatgaacggcaaagatgcaaaagaatcgatacttcttttcatgttcaccaattcaacttgctgcccaaccatctcaaagacaaggctagcgatagccactgtatttacatcggccacaaccccaaccagcgacataagctccattattctttgggccttgatcatgcatttgaaatcgacacatgacttcaaaaccatattaaacaaggtaacattactctttattggatccagttttttcagctgccttctatctccaatctgctccaagaaacactcgcaggtctcacacaaaacatcagcagcaagataggatcctacttgtgacttcaccatatgcaagtacaccatggtcagcatatcaacatcaggaagcttgccgctctccaatatgatcctcaccactgtggaggctggaatcggcatctgatctctggcaagcgccagagctagcttcatcagcgagccacaattaagaaggttgccattgcattggtaaactgacaagaccatgtcgaatgccctctgaagccatctcctgctagacgcataggacagcgacacgatcatcctgtccaacacccgcggctcaggaaggccatgcagggtcttgtaattggcaaatgcttgcagcacgtcgtcgacattgccgtcatcgagagcagcattgattgtcctcagtagggtctcacgagatggcgcttcccacggcagaatcttggctgcaatcgtgcccatgggaaggtgatgtatggccagagcggattgcctcctccatgacccgtagcaatcagcctaataacaagaaactatatgaactaaaggagaactattttcatttttttttacagattttagtaaaggaaaatatatccatttatcttatactccctctgtttcatattataagttgatttgtttttttcttagtcaaacttctataggtttgactaagtttataaaaaaattagcaacatctacaaaaccaaattagtttcattaaatataacacggaatatatttttataatatatttgttttatattggaaatgttgttatatttttctacaaacttgatcaaacttaaaaggaaaagttgaactaaaagaaacggagagagtagattttaggaaagcagcaagaaggctgcgccatacctgcttggagttggaggggaggatgaagaagtcaacggtgagcttggaatcggaggtggtggtggccggcgtgggcgagatggccattgtcgcaggggcttatgcccatcttcgaccccccccc

SEQ ID NO: 62031 - DNA, 4761 bp, Oryza sativa
ccccccccccccccccgtgcgcctcttccaactccacgctcccaagcaggtatggtgctgccttcctaaaatctactctctccgtttcatgttaataagtcacaagccactttgatttttctttagttacacttagtttttaaagtttgaccaagtttttagaaaaatataacaacatttccaatataaaacgaatatattatcaaaatatattccgtgttatatttaatgaaactaatttggttgtgtagatgttactaatttttttataaacttgtggattcattgcactaagatgtatctcatccagtcctaggttacaagattttggaccggagggagtataactggtgcacggtaaaaaaaaaaaagcttcttatgcagcatagtaaaatataagtgaatagtaggctatactaatatgcagttttattcatagaacttgagaaggaaagattttctcaaccaaagaaatttacatcaggaacattgacactgaatgttcagacacaaactctagctaatgtagggcaaaggagaggggggcacacggtccgcgcatacctccttgttggcgatctcggacttgtaggggaggacgaagttgacggtgagcttggaggggatggccgccggcgtgggggggcggggctgcatgagcgacatgggcgtggcgggggcctcgatgttgggggccaccttcttccacgcctccgcgaaggcggagtcggtggccgcctcggccggcacctccgccgtcgagagcaccctgctgctgcggccggcggcggcggcggcggcggcgcgggtggtggccaggcggcgggcggcgtggcgcagcatttttctttttcttctttttctctctctctcgtttctcctctcctcgctgcggctgcgggtgggtggaatggggttccagaggtgtgggcgatttggagggcgaggtgatgagtgtggttcagggtttacgaccgatatgcccttccgttccgtttcgagcaccggtgaaattcgaaatttcacgaaatcaagtggaaaaccggtaacttctgaagaaatttcataaaccaaaatttgaatacaaattccctgagtttaccgataatttctcaaaaaccggtcggttttggtgaaatttcgatcgaaatcatcgaaatttcgatcagtaattgggcctatttcatgcaatctggcccatgtaagtgtttttttaattttttattctattctttcatgatgtataaatacacacaatacttcattttttaaaaaaatttatatcccaataggttacatgaatatcatagtatttataagattttatttgattttttttcttttttatcaattcaaatttgaatttggatgaaactcctcgaaatctcagatggtttctactttcgagccttgtcgaaacgtcgaaatttcgcgaaatccgaccggaatcgtaaaccctggtgtggtcagtgggagtggaggcgactttgggctgggccgtttctatatttgggctaggtcgcctgccttcttttcgtattatttaggaataagttcagcagaggtccctcaacttaacagcgagattttttgaggtccctcaacctaaaaccagaaatgttcgctcctaaattcattcaaaccattcatcggagatcctttggcagtatatgtgggtggtttcactaacgtggcatcctagtcagaaaaaaaaattaaaaaaaaatcatggggcccacatgttagctgcatttttttcttctcttttctctcctcctcctctctttcctcttctctctctttgccaacggcgggcggcgatgggtgagcgcgcggccggagtaggcggaggggcagtgtcagcgtgcggccagagcaggcagagcggcggtgtctccgggagagcgtggcagcggcagcggcaagcggttggcgagcacggcggcgggcaagtggcggctctgggcgtgggcggtgcgcggctagagcaggcggagcggcggcgtctccgggcgcgggcggagcagaggggcaggggacgcgggaggcgtggcgggcgagcggcggtgaggaaaaaccatagaaattgtgttgtttgctgcttggaacaacacccctttgagactttgctgcaaagcaaagtgcttttttcccatgagattacaaagtagaataccaagctggagaattcaacaaggttctgttgaatatcaatatcaataagtaaacatttatcttaatcaagtatacaatactaaggcttgtggttttcgttactggtgatgcgacgggaggtatttattggtgatcatttaaatgatatttttattgcagattgtttgggggccatttgacattctattactgagataggggaggcctttttcacgattagatgttgtagatagagttgagtttagtgtatatcaaagctatggcagcattgtacatttcgtatcattctctgctttgcatttttttttatagaaagtgtctacggaagagttattaagatattgcaatttacactacaataattcttgaactttggttgtttgcatgttgagtgtgatatatattgtggaaaatttagaataatctttaggtgattttacatgattagtgtaatataatgtgggaaacgtgccttgcacgtgtaagattactagtccgcagaataaccagtagtcacccacaaacttctgacaaggcattgttccaaaatattttgagggtctgtttggttgttgccgtgtgcaacatgcctccctgagattttgatggaatatgcctggttgagctgtttggttggtgatgtgcctcagaacggataaacttggattatgtcttataagtattaattgtaggtattgaccaaaatttgctaattttatcaatcataacagtaaccactaccgtcacttggctacctgtgattaatatagtttcacctccaacaaacgaacggttcgtcatttcgacttcccaataaggagtaatggataaatcattgaggactgctcagaagccaaacagatgtgcgattcctctcgggaattcacttagtatgatatttgagttagcctatgtccagtaaactcctaagacctttcattcccatccaggagggttgttcctagtataaatgtcccacatgttttatcatttagaagacttttgacaatgagaatatgaaccccttttgtttagctgcgtgctaacaaatttagagagagatctctacccctttgttcttgtggtttccttgtgggattatagaagcggcgttcgacgcctcccaattggtgctcctagtccctttgaggatttttcctcgattgattctaggttgtgttggttggtaacttagtgtggttgggcgaatcctcgatttaggttgccgtgtagagatggtggttagcttcgagttcgatcgtcagattgcactgttatcttggctacttgcagctagttatcttcgtctctttgaggctagttattggttcttgatcctacgccgtgaagatcgggacatcacccctatttgggtcgtatcactcttcctctctctcttacgggtcggcgacagatgatgggtggcgccgcgggacgcgggacgcgcaggtggtggcggcggcgggggacacgaaggtggtggtggcgcgggacacagaggagggagcggcgaacttcgggagggagcgggagggaactctggcgaactccctccggcgcaggagggtctccaccgcgccgtgcatgccgcctacgtgtccgctgtccacgcccgcccactgcttgcccccacctctatccgtccatcccgcgccgccgccgccgcctcgttcatagtgagagagagagatagagagagaagggagagtggaagaggagtatgataggtgggccccatattttttatcaataaaatgtagattggactatcacgcgtacgctatgtaggtcaaaactgctctggattgggtcgaggggggtaaattgtctggtattgaaagttcagggtgaacgatgtctagttttcgggtttaggggggtaattcggtcggccacgatagttggggggggtaattcgtactttttcttattttatattgtctatatttgataagcgtcttctattcttgtatgtaagataagatctcaaagtttcatatctatctatacatagtcttgcttcatataaatattccgtatgcatacatttaggggagcaaatcctatatgttatacaagtatttgatccaaattattcactttcatttaattgggatctttacatttgagcatacatttgagtatatgacacttatggtgttgattaatactcatcatttattcatattcttttatacatgtgatctgttggtcaacaagtgaaggttgacaaccgaatcattcggactaataaatacattgagttgaacaagaaaaataggtcccatgaattggaaaatgtgctgatactcgatagagatcatgacacctaatgatatcaagaataacaaagtgaagttattggaaagtggggtacgaagtggcaagacggtgaaggccaagtgatgctcgccgcgatgaaccatgcggtggtgaaggcaagcaaggagcttggcaccgaaggaccaaatccagtggtgaagggcgagtgacgactatgtctgatggaccgtgcaaggccatttgaagctacaaggagcacgcatcaatctttaaagaatactagaatataccctgcgtgatgtt

SEQ ID NO: 62032 - DNA, 6013 bp, Oryza sativa
tggaatattaagtttcaaaagtataagaagtgcctagcttccacctaaagttgaagcatgattggaatagttcgtgccatgtatatagtgcccaagaattaaatttgtttacttaaatattggtttgtaagattagaaactgtacgcgtcttgttagattttgcttttaacaaatgcacatcatgaccattctctgttctatacaatgattttgtttgagtacagttttttttgccagaacaaacgtgaagaacataataaaatttcaagcaggggaaggccatttttaagaaacgtgaagaacattctctatgaagggcatttgaacgaacaaagatgaatactgcaacaatcacttcaagcagggaaaagaatataataaaatttcaattatttcaagctgttaaatgtattttccccagtcttcttgtgtcttcactgcaaacctgtaacatgacaaaatttactgaaagtgctgagggaaaaactttcgtcagtttgattctaagatggaacatacctgtaagatgtttaattcttccatgttggatttgcaagaccataaggataaactgtggatgaataaccaattaaatctgcaagaacaaagctgattgaatctgagcaaatttgattagaacaaagctgattgaatctgagcaaatctgattacctggaatcctcgatacgggcaggaacacaacggagttgaatactctggatcctcgaataaacgtacaggaatacaatggaacttatacaatcagttgtgaggtccgtcatgaaaaatcaacaaattcccttatcttcagatagaagatacggatatgatacctaacaaaaccaagagatgagagtctaaggcaaaataaaatgtcatacttactgagcgaggaggagaatagggtgtgtttagtacagatgggagatccaccgaaaagaagctgtcgtaagacgacagaccttgttaagattgaatccaattgcacccaataatcctcgagtacagtgaaggctacttattcatgaatttgccaaagagatgataggtcaaattgaaaaggaagcacatacggattgatctttcctgaatgaaaatccacaggaggcacataacaaattcagaaggaaggagtaggtaccacaccatcaaataccttcggtagatatgaaagattcaaaggcatgaaaataaagctacaaaacgatcactgtagtttaaaccaatccaataatatgtacctatgcaatgaagattcatatgaaaccaagcagttcgtggagaacaaccaagaacctacttctgcttctgcttctgtatggactggagaacttcgtcggtaataagcaaaggcccgcaatgatatcgccatggctttaattagaggcgaatgaaattaacgcgttaatggcaatcataagtctgctcttagtgggcggcgaaggtttctcttaggatggggcgaggaaggcgatgcggctagcactgggaggagggaggcgaaacagacctagggagggccgtgcggcgccgatgcgacgggattggcaaagcgcgatgcgagataggaaggggatggggtggggtgcgagaaatgcggcggggaaggtggagaagtgcgatgcggggagggagggcatgcgatacggcgagagacatgcggtgggggtggcagtagcgtgatgcgggagagggagccaatccggtgcgggagcggcaggcatgtgggctgggctgggccgagtatttgggagccatccatgaataaagaactgaggcaggctaaaagcaacctgatcggttgaagtggagtgatccaacggatggaaatcgatagtgatgtggcaaagcgagagagcaggaaaatagaattagtggggatgacttgtataggtatataggatacggtgaaacggttttagcgttggtatcccttaagacaaagaaaggaagatggtataaaggcattcctattggtataattattttcctatttatatttgagtataagaatatcgtactattaatagggacgcaatgttgttgtgcttgtgtatatctcagtgttcaaaataacctatcctagtgctaccttgagagaaagccaaactttaacctatcctttgagtggttttaaaccttgcttctggttgagttggtagtcttctaagtgagctttccatagagtccaagatcataaaaaagggactcccgagaaaaaagttatggttgttttactctttggtgttttcggaaattccaaaaatgatagaaattctagttttgctctctcgtgttttttggattttgaaaaattccgaaaaagacagaaatctcaggtttgctctctagtgtttttcggatatttttgaaaatgcatttcgaaagttccgaaaaatggaatatttgcctcaaacggctagttttgataggctcgggtatataaacgcctccatcccctccttgagtggctgttgttcttaggcatgaaatagatatatccaaagccaaatatcccatctccaatctccagcctaagtggtagatctttgtgagtaagatttgagaagagaagagagttgggaagagagtttgagagctagtgagcttcactctatactttgagcattggagtacatagcaagtaaattttcgattgtgtttgttactcttggggactaaggtcgccaatgagcaccgaaggttgtggtgtgccacaaaaagtttgtgaaggcttcaatttcgtctctgcaagggaagaaattaagagtgaaatcgaggagtgcatttgtgcaacctcatgtagaaaagggatgaaagagacccggcctttgtggcccctcaacgaagacgtaatccgtggatccaaacttgggaaacaagtcacgcgtctcctctcttggttcgctcgttcttgccttctctcgtgttatgtttgagcttggttttacctgatctatttgtatgcttaattgatatagttggtgaccttatatcttgcttggataccttgtttgtcaccttttgatccatatatattttgtttgttcgagctataagttcatagctagtgttttattctgttattctccaaactttttgattgagaccggaacttacaatcccgtaccggaagtttcaatttgaattgaaagttcccatcattctaatatgctatgaagatatgataatttttaggaatgcctatttacccccccactctaggcgacatcaaagtcctttcacttcagggcaccaaccaaacaccactcagaccaacatcagggattgaggcctttgtgcctagtgtagtcaccttgagagttgagacctgtgggaacgtgccaaagagaagatgatgtcatgcatcatccatggttctttgcttggtttaactttgtggccatgttgtcctatttttgtttactcaacttttactttttgatggcttttgtttcgatttatatagctttaatatgatagtctagtattagttggtctggtttaacctaacatgaattgtaggaaaacattctttaatttcaatattagtattttgggtaaagcaagaaataaaaaggtagtttcgagcgaaatgtagggcatctcaaatgtcgattcacttcaaagtgaggaggggatctaccaaaggtaagattcgattgatttttttttatgtcttcttttgcctctatattgctttttcttgtaaaggactcatcttcctcagttctcctcctcaactcaacctatggtattatgattctcattgctatcttatttctgagatctccctcacattcgattgtgttgttgtggaggcaataaaagatcttcttcaagacttgaatatagtggcagggagctcagtctcaaggctcaaggcacaaaggagctaaattccattagctttggactttgatgaagttttccatagaaaccttgattttctttcactttgaaaaaaatactctatgttagatttgtttccctggacctactaattacttagtgtggagttcagacagtatgtttgatatggtttggaaagttataaagtgttcccaaacagagcatgggtattaccaatgattttgttctaatccaaaccaatcacactaacatttagctctcttctgaaatgcagaattgggaaagtagatggatataaaaaaatacatgattttgacacgaataagaagtacaacaagcgattgcaaaagacagggataaaaaggaaaaagaaaaagagaggaaatgactgtttgattagatcaaatgaatttgaagatagataaatataaagaaaactttacatagggttagacctcatgttgaattttctccaaaacaaacatagaatgaggcattatatatgaattccataagattcaacaatgtctagtcctttgaaatatcaaagggccatttgaaaaaaaaatctatataaatgaaatactacaaaattcctatgcttttcatttaaataaaatgggtgttaattttcaaaataataaataacattttttttggtatcaattgatccaaaatggctctttctaggctttctaaaatgctaaacggtgtttttaaaaaacattatatatagaagtctcttaagaaaatatcaaataaatatatttatcaatttttaatagctaatatttaattaatcatgtgctattgaggagtttcaaatgggtccttaggctgtgtttgagacaagcacaaggaagataaaagtttctcatttttcgcccacacgcttcccgaaccgttaaacggtgcattttcaagtttctatagaaatgttgctttaaaaaaatcctattaatacactttttaagtttgaaatagttagtaagggggtgtttggatgtgactaaaactttttagtccctgtcacatcggatgtttggacactaattagaagtattaaacgtaaactaatgacaaaacccattccataactctggactaattcgcgagaagaatctattgagcctaattaatacatgattagcctatgtgatgctacagtaaatattatctaattatggattaattaggcttaaaatttgtctcgcgaattagctctcatttatgtaattagttttgtaagtagtctatgtttaatactccaaattagtgtccaaacattcgatgtgatagggactaaagtttagtctctggatccaagcaccacctaaatcatgactcatctcgttctttgtaccttcttaatcttcttctttttcaatctccaaaacacattcttataattgagaggataatgataattactactgtttatttcagttctccctctaagtggccaacgagcgggccctataaaagcgactatcagcacgaaccctacaatcattcacctgtttaggggagtttaaaattatgagaagcaactaggtgatagctagcttgtgaggatctagaaaacttagattttttagcttctaatttttagttttgtagattcacagaatctaaataaaaatctgaattgattgggaagtagtagagacgaaagaagctactactactaatttttcaactccagttaaaatgggagcggagctaggtggagcgctctctcaaaagaactagcaaggtagagctaggtttaggcagtgctccacaggtccactccagatccaacttctagagctaaatttagtgtctgtttggtagagctcaaactcctaagtttagctctaggagctgagtttagaatagagttgcagagcagcctaaactccgctccacctctctagttaattttgtgagaatgtttcacccaactgcactctcattttagatgaaactgaatctgtttcgttgagctccagcttcaaaaaggatgaagttggaactagagctatgccacatctctactctctactacttaaaaaaattgaaaacgtttccgttgtccgtaataacagaggtgaaaaaaacattaaaacaaaaaaggaaagtccgattcaatttgac

SEQ ID NO: 62033 - DNA, 6612 bp, Oryza sativa
gcgccccagataggagacgatccaattagagagaagaggtggaaatcataaaataaatcacatcacagaggagtagagagggaggggtgagcggacgcttttgctgctcctcgcccaacctcctcctcgccacctcgccgtcatggaggccccgagccgccgcgccgccggggagccaccgagccgggagctgtcgacctgtgcccctgtgccgctgctaaactagggagatgccgagagggagggaggaagaaggcgacgtcgaggaggctgaggaggcgcggccacgcgttgaggtccggtggcgggaggcagatgtggcaggggtaggggtggtggtgaggaggtgggcagcgctgggggtcgggcgggagtcgtgcgacggtgtggggtggaggtaccgagggaggaagaggagcgggtggtaggtcggttgggattgtggcaataaggatggatggctaggattgtgaggataaggttggttgattggtaggttggctctgactagtttattctaataggggtcggtatccggttttttaaataggtgtcagtttcttcaaagaacattcatctataagactaatatagatgatcaatatatgtgttggttgtgaaaaaccgggacctataaatatattatagatgtttgttcttttttttaaaaaaactagcttttctctactacttaaaattttgaaaacgtttccgttatccgtcttaaaataaaaaaagagcgaacaaaaaatattcgctctgtccgattccgccaccacacgaaaattgaatacagactcgatttggactcaaaatcgaatgaaattaaccccgtaaatacaaagggttccatgacaatccaatcgggctagactactacttaaaaaattgtgaacgtttccgtcttaaaattaaaaaagagcgaaaataatcttcgccctgtccgattccgccaccacacgaaaattggatacaaacttgatttgtactcaaaatcggatgaaattaaccctataaatacaaaggattccacatgacaatctaatcggacaatccagtgattgagaaaaagaacgggaagaaaaatagaaacatcaccgtgaagccgccaacgccgtcgtcgccaccggatctgtccatgggaagctgtcggcgtcgtctgtgaagccggatcgacacgtcgccgttgtatccgctgcaggaagccgccggcactgaatccgctcgcaggaagccaccgacgtcgccgtcgctgtcgacaccgacgttgggagggtaccgccggatcttgagggtggagagggcgtcatcaccgacagaaataaagaggcctagagggagggacggccattgaggccgacggggagagggagagggggagggacaaccgtcgtcgctgtaccctgccgtcgccgtgccgtgccggcgagatgggagggagagggacaggaggagtggcgccgccggagggagaggggaggagaaacggcgccagagggaaggggagggggagaggcggcgccggtgggggaggaggggagcggtgtcgggcgggaggaggcagctggcgattggggggtgggggaggcggaggtggcgttgggcagggggaggcagggagagggagggggagaatgaatctagggttagggttgcaccagggttttgattgatttggaactgatttgagccgtccatcgaaacaaacggctaacatcgatcgagcgtcgggctggcctccgtcaccggaccgtggcacttggccgtacacgggccggcggtccaacacaaacgtggaagtgagacgaggagtatggggatgttagttagactttagtcgcttgcggcctaagaaaagtgggtcggctcggttgcgggctgaagaagaaaatgggctgaaaatggcccatagagaaagaatgatttttatttaaattaatgctgaaatgatgtttgtattattaaaattagcaattaagcacaacaaatttcaagaaaattttaaagtgtagttaatatggagaatttaataaaaattaaatccaaccatatcattttacctacctacttaaaaaaatatctaaatataaaaaaatgtatttcaattaattagaatttaatatgttttagggctagtatatcataaggcaaaatctaaaccgagaagcctctcggtttagtgttaaccaacgaccaatcaattgtgagaagaagtactgctatacatgcatgctttatttctcttagacatgcatgtctttttcttcattcttataaagttttttctcaaattacttattcgatctacaatccgattacaccattgtatttgttacaattaaatcttcacaacaagatcttacatgattatactacgatgaaaaaatatttatatttgtaaattacttttattatatacgtaagttacttttatcatatatataagttacttttagatttgactaaattatttcttagacatataaaagtaaattcaatacaatctaaaagtaatttacatattataaaagtaacttaaaacaaaacggaagtaattttgtcacgacattagaagtaaattcgttgttgggttaaaaacatgactagttgtgtagtcacgtccaatgaaaaaagtcaagcattaaagttacgtttcttttgttataagttacttctataatatatgtaaattacttttagactttattgaatttacttttatatgtctatgaggtaatttagtgaaatctaaaagtaatttagatatttgtaaaagtaatttatatttttttcatcaaaatatatttatgtgagatcttgttataaagatttaattgttacgaacacaatggtgtaatcgaatcgtagatcggataaatagtttaagagaaaattttatttaaagtataggtagatagagtctctcatatatgaagtgatcgctggtttatctagctgtgactagtcacgtccatatcataaattagagttgtaccaaaggtacgtacgtaaaagctctccaaacctctccaaaccggtctccacggctccaccctccaaagtccaaactcctcctgcacgagacggctggacgcgaagagtccaaatccgaaatcccacagaggggagacggttttaatcaaatcaacttctcctccaccacctcacctcttcctcttctctctcccgtctctccccctcccccgattcgcctcgtctctccccactccccgaaccacaaaaccctaaccctagggaggagggggagcccttcccctcgcccccatccccgccccgcccgctccgatggcgacgcaaccgccctcctcctccgccgccgccgacctctacgagacggcctcgcagcccgacccgcccgcctcggccgccggcgacgcctacaccttcctcgagttcaacacccagggcgacgacttcgactacccggacttcccggagctctcccagccggcccgatccgcgccccccacgtcggctccgggggtgcctggctccgcgggctcgccgtcgccgtcgtcctcgtcgtggccgcccccgcctcccccgccgccggacgcctcgcaggaccccgatctcgcgccgcgggaggccaccaccccgccggcctcctcgtcctcgccgtcgccgcgcgcgtcggccaaggcgagggcgtccgccgcggcggcggacgggctcgcctccggggtcgcggcgctcagcttcgaggagccgctcggcgccggcgccggggaggacgggtacgactacggcaagggcgacttcgtcgagcacgcgtgccggtactgcgggatccacaaccccgcgtgcgtcgcgcgctgcaacgtgccgtcctgccgcaagtggttctgcaactcgcgggggaacacgtccggctcccacatcgttaaccacctggtgcgtgtccctgtctttttctcgtgctaattacggtcataacagcttagggtcataacagcttagtttctttcagttttaagatcaatccatcgatcatatgtgaattcggtaggagtttgccgccaacctaagtaggtgacaagtttgtctcgcagatgatgatctcttgtagcttgataacattttttggtggcctatggtgccaaaaaagtgcatttagttcaggatgcggcaatcaactatattgaagagatgaattattgtgattgttgaattgctttcatctgcttaggttaatcaaatttgattgttttgataaattgctcaaccagtcagttctcccctcatttttggtaaaatttatgagcatgctggatggaaattctgaggattagcttgccagctcatacaatgaaaattttcagtagcgaaacgattttttttatttattggcattttagtgtagaatactcatgtttaaaacttgatagcatgctttgtcccataagggcatttatgtcatcaggatgccttgtccactaaaattatttgttcctaattttgttatctgtggtgcaatacaaaaatttatgataaattgcaatcctacatcttttcttttgaaatcaattgtgctacatggcaatttgctatcatgtctgcgggtggttagtagaattcaactttggttcaaaaaatccagggtcttctataggggatttctcaggcgttcctgaattacctatgctattttttgcagaccagcttaggctttacagactacatagaaatttaatggtagaaattattggtgtcacttatttttagcctgttactgctttcgttcagtttatttcatattttatgacttaatttttacaccgctgtgtattttacacaggttagagcaaaacataaggaagtttgcctacacaaggatagtccgttgggtgaaacaattcttgagtgctacaattgtggttgtcggaatgtattccttcttggttttatctcagcaaaggcagagaatgtcgttgttcttctgtgcagagagccctgtttgagtgttaatgcattgaaggatatgaattgggacctcagtcagtggtgtcctcttattgatgacaggtgtttcttatcatggcttgtcaaggttaatgcttcctccatttattattttgggttgtgtgtgcaattgtgcattgagtgttgtcctgttatttgtcttttcacaaatttgcaatcttttgttctaccaggttccctcagaacaggagcagctgagggctcgtcaaattagtgcgcaacaaattaacaaagtggaagagctctggaaaacaaaccctgatgcctctcttgaagatcttgaaaaaccaggtgtcgatgatgagccccaacaagtggctctgaagtatgaagatgcttaccaggtttggaatgttcattggttcatttgggcatttatttcctgagcctgtttttgatatcttgcaccttgattctatactaacacttttaaaacactcaaatcttccatgtttttctatattgtaactaacacaggttttcattttttttttgccagtatcaaaatgtgtttgctccactgataaagcttgaggctgattatgacaaggtactatgttctgataatatttcctgaatgtgctgatagttcttaaaacattttgttccttggaaccagactatgatatatgtatatgtactgaagtttcttgcctcctgttatttttctgtagatgatgaaagagtcacagagcaaggacagcttgaccgtgcggtgggatattggactgaacaagaagcgcatagcctatttcgtgtttccaaaggttagattaagaacttggaagcacaagatctgataacatagggcctggaatcttgtcaaaaccatttttcccttgctccttgtaattatcatggactttttatatcatttaatacacctacactttttatttttctaacatgtggaatcaattttatattttaggaagacaatgaattgagacttgtcccaggagatgagctgcggcttcgatattctggtgattcttcacaccctgcatggcagtctgtgggtcatgtggtatgtgccctagaaacatgttaattgatagctctacaataacaccaacagggtcacttctactttagtgctaatggtaagggcattattccttcagattaaacttacggcacaagaggaggtagcacttgaacttcgtgctagtcaggtatgaggagtatagctctcacttgtttttcttagtaaccttttactgctcccattttccatcataaactttcctgatttcagggagttcctgttgatttgaaccatggattcagtgtggattttgtctggaagagtactagctttgataggatgcagggggcaatgaaaacttttgctgtggatgagacaagtgtcagtgggtgagttagatgcatctatatcgtgtatacttagaatttctggtcctctagtcatatttatattgcttttactatgattactgcttaaggatgaacacacatttctttgcgattgaacaaagtgtttaagtaaaaaatgtatatttttagctattttttaagtttatggttgttggtaccttttttggggatatggttaaaggttgataggaccctgatgaattgggaaga

SEQ ID NO: 62034 - DNA, 11563 bp, Oryza sativa
tgtcattatatgatatagcaagcaaatgtataaatatcatagtagaagagtaatataatgagaaacctgcaacttttcaaaaacaaaatacctgaacgtcatcattaaacatccgataagtcttcctgtaacgctgcaacaacctgaaggcccacttgctctggaaatcttcaaactatgaaaaaaaagagagagaaaagcatcagaaaaaaatattctagctaaagccacatgtaacaacaaaggcaagtccaaagtaacactaaaatcagaagagaacctgtacaataacattcggccagcgagcgaaaaccgcttccataaattcatcgataatcgctacatattcttccccctccagacgatgttcttgtaacccaagatctgtatggtttataaaagattaacataaaaaactgtctagaataattcttaggggcgaaaaagctatccattctcacgggctgttaaatattacaagtaaacacatgtttacaaattacaagtgtcttcatttgctttagagaatagaggctaactgtgtgtttgatatgaaaaatatgtgataattagaagcttaattacaaattaaactacttcaaattatacaacacagaaatattttaagaacaacttacacagaggatccttgaggagcttctcattgtttgttcccacatcaatcatgaccggaagaacctagaaaaaaagtgaagacagttttaaatcaatggtaaatataaattctgctagccacatgagcagtaggcaaacaacaagaaatgaatagcagtagagtacttatagaatccataacatttaagcactaggcattggtaccacttttgctaaggtacagtaatttaagtcaatgtatcttaatttgaagctttgttatttttccgaccctatgaattcacactttagtaacatatttcattttagctgtgtccagaaatgagtcgagatagtaaaactctagcaggtattttatctccccaatctataataaaatgggcctaactgacacattatcacataagtagcaggaccatcattactgatcaaacgaaatccctatagatgatacatatgaaactgtatttttagcatccactaatagtttttttaacctcttcagcaaacaagcttcactatactttcttagtttagctgattaactcctgcaacaaaagtcattacaaaaaagcacgggagatgtaaaattagaagagggagaaagggaagagtctaacaatcttctaaggtaccataaaccaaaagtttttaccctctggggatttattccagcagcagcaacatatagatccaactttccaatggcaataccaataccatgcaccccgagatcacccaggcccaatatcctgcttccatcagtcactactatcatgtcaacctgcaaaggaacggacatattttatttactttgagattatatgacattttttttcttgagagatgttcaaaaatcaaaagcaaaaggtagactgtcttatgctctgagatagcgttactgaattataccactaaagattaaaccaatgaaagagctcagctgctaaatgtaaaatcagtaactggatgaacacaaatgagtacctggtcagctggccagttgtacaccatggacatcatttccccacgatcttctgcactaaaatacattccccgaggccgtctaaataaaccactatagttttgacaaacaagtccaacagtcggcgtgtaaacaataggtgcatgttcctcaatattatctattaagacctattaaaaagatgaaaaaaatatggaaatcaggtaaccactttgaaaaggcacacctcagcctgctaaagttaacaacaattgagattatagtagaaacgaagttagcaacgaacatgtgtaatcatacagtgtcccgtaaacagtccaaattgtgcgtattaaatggtgagagcatacatgatcaatagaaataaggttgcacacaaatgtatgagttgtaaagttacaaaccttgtaatacattgtttcatttctgtcatgcagcctgttaaggatacgccattttgctaacgggtaagtatccgatgggccatctctcgcatatttctgcagccgttgcatgtcaagcactgttataaaagtgaaacaaaaaaagaagtaaatgaaccgctcacatcagcattcacgcagtattgtgatgattcacagatagctggtgaaatgttcaggtaatttagtgctaaaccctttgcatctatatgctgtatctctgagtggaacttgtactgatacttcagagttggtgctgtgcaagtgtgtggatgtttgggcagtctttttccgattgaagtttgtgagcataattctaaatgtgcagttgtctactcaagttggttggcccagaaaggacgatccaccttttgtgaagggactttttttagtccagatcaaacgtgactaaataaatgacgattgaaactttctcctagaagctggattataccatgtccaatcgcacagatcaaacagaaattctatctgacggttctacaattgatgcatgcgcacatacagacagtcagacacacagtcattcactcactcacttactccagtgcctgctgtcaattataggtaggtaagctaactcattctaaagctcaattaggcacctagtcaatttacagtttggacgtggccaatcaggcacaattcctagctgaaaaaagaaaaaaaaaaacaatcccaattcgattcgacccatgacgattcaagcagcaacgaaaaatccaaaacaaatttaaggatggaagagagagagagagggggggggggcgcgggtgccgcgtactgaatcggtcgatctgctgctgggaggagacgacgttgggcgggagcaggccgcggaggccgaggcggtccctctccgtcatcgagaaccccgtgccctgcaggaaagccacacagccaaaaccacccacacgcatcagaacgctctcgcgccgccgcgagggaagaacacgagggcggaacgcgagcgagacgagagcgtgcgtacccggttgaaccatgggtcgtggaggatgtcggagccgcgcttgtggagcacgacggggcggtggcactccgccgtgacgaagccgcgcgccagcaggaggaggtggtgctccccgccgccgcagcgggatcggcggaggaggctccgcgagatggacgccgccgccatcgatctcactctcacactcaccagcgcgatgccgcgttcgaattattctctctctctctctctctctctctctctcttccggctttttgggggaggagatgagagcgagacgacgcggcgcggcggggggatctgctctagctgcgcggttgcggtctgcgcgacgaggcgccgacaccgcgacgcgagaggccgggccgtgcgtgcgactctccccgcggggacggacgactattccggtgccggttcggttgatctgagcttttgcgttggtacggcgcgtgggtggcaggtccaggtcagtcagtcgcggccgggaccaggcgtggcctgagatggggcggagatctgccgggattactcgttcaaatgtggacttcttttttctcacttcagatggcgcattcattagccggcaattcgctagcccataagacgggggtggtgcatacgcaggagaggaggaggcagcacatacgtgagggcgacacgaaccgtacgatgcattgccattatatgcgacacggtctgagactagtcattcctcgtaaacaagcgatttattaatatttatatttttcgatgtccatatagccaatcttatgtggaagaatagagaatcacacattaaattcgagaaagtcagtaagaggataagttgttggattgaaatatgcctatcaaaaataaaaattttagatttggaaatatgactatcaaaagtagatggagggagtatatttttttaaaaaaaattctataaaaaattgtttaaaaaacatattaatctatttttcaaaaagaactagttaatactaaattaatcatacaataatacgtgtttcgttttgctctcgtctcttgtgaggtcggctgctgcgagctcaagctcgtcgacaaggaagggggtagagagagaggaggtggtaggggaaggggataaggagaccaccaccggctacaaggaaaggcggcggagctcgaggggcctaatgccacgcctcgttgctcgcatcccctagcgaggccggctgctgtgagcttgagctcatcggcgagggaggagaatggagcaacgaggaagacagcggttgagggatagggatgaggacgggaacggagacggtgatgcgacggagatgacatagatcgtgacggagtggcatggttctaatttatttaaattctagtggcatgtactccaatatgatgaatagtagttgtatttttttaatttgccacatttgcagtggcatggatccaattaacccataaaattatcactggtgagagataatttcttataactatttaccactgtgtcttaccagcatagaaagcagcgtgggtcccatgagtcagcctcttcatttttattcttctccaccatccaatgatggagcacgagttgcttctccctccatcgtcgttgtgtccccatggcgactctactgatggcacacctagcaaggataaaggattctgacaagctattcttatgtaaaaacaacccgtctcattcgattatgaggttcagctctaagtcaaccttgtctgcatcgtcgatggacagattgatcgtagatggcggtgcgggatcggaggacgaatgatggctcaggcagtcaggctccttcaccggccggggagaagaaggagaaggaagggggtgactcgtgggatccatgctggcaagtcatagtggcacaccacgtaggtaaaagtggtaaataattaagaaaccatctttctccagtggaaattttgcaagtgcaaacctaataaggatatttgccaaacctcatagtcgcaaatagttaaattccccctaaacaacattgttttttttcttttcctttttttttggaaaacaacaattaagaacctaattacatatttgctaaatttggctatcatcaagatattccatcgaaggtgagtttacttttacaacaaaatatatcacgaaaacaagctacttttgttacaatattttatggacaagataaaagtcgatctttagaaaagacactttcaaaatatgaatatttgttccacacaacatgtattaaaatattcattttcaatataatagcatagagaaaaaaaggcaaaagacagaaatgcacagggcccaaactcatgcccttagcattttggttgcctcctcctcggtacaaacatactacggagattttcatccacttcaaaatgcagtgaatggtgatgcgcagataaagtaaagcatcgaggcaagtggctgcaactcttcttcatggagtaaaatcaacaaacacatagctatagctagcggcaacaaagaaagcaaaaggtgacaacagcgaggaatcctctgcatgtcttggcttgttcggtcattgtgttcctgctccacaccacacgtatcggtactacctcgccgccttctctggtcgtgcgctatcgtaccatgccagtattgaggccgacacgacacacaccatggggcgcacgcgttccagcactccttgacgtcgtcgtacttctcctcgacgacacaaacgcccctttgctttattgttgtcatcgtcatggccatacattcctaagaggctcacgtatgctgcaaatgaacagcaagctgcaagcggttgaggaggttagtgtagaccgtgcgtccatgccgagcgcgacaccacgtatgccgaggccaagcttgttgactaggacgaagttgatgggcatgaggaggtgctcgtagcttggtgtagcaggtggaaatcgagccctcgcccatcccaagtcaagtattgttcacactaggagaaaaggaaaaatagagagcaagaggaagaatatgcgtgggtctacggtggttttgacttttcgtgttatttctctctcttagtcaaccaaaattaaatatttgcaaatatcggtagcaaattatcatattttgaaagtgtcttccctcaaagatctaactattattacgtctaggagtgtctttacccttatgtctgtagagtatctttcttcctttacttaacatttacgaaagatggatctagttggataggggctgtcaacataggccggagttgtcttggtcttttcaaagggttatcatggtgagaggcacgtttgagtcacacctaaagggaaaaggtatataaattattagggcaaccatgctcgagaatacaataagtaaagcttatgtatgaatatatcaataaaataagggtaatgcattttttacgactaacatggttgttggtggcgagaaatgagttcaccacaatctggctaatggtgccgtggtggaaggactcgtgatcgtgtgtgactggtgttgtcgagctgcaaagcatggccaatagacaacacttacgtgcataacaaaaccaagtgtcaggttatcagcaaaggaagaaagaagaaataagagatcaacacgttcatgggtatagccaaacaaagaaagacaacacacaagaggtgggtggcatatatccttgagaagccattcagcgagcaagaatagaaatagctgatgatgcattcaaatctatcactttgttaggcaccataagagaaccatgttagcgacaataggttttaacgaatctatcggcagctgcatgcaatgaaaaagcattagaatcaaaaggaaaataattacataacttaagcagtcaacaatcgagcgaagtggtgaaagatgcattaaggtgcaacacaagaaaaagaaaaaaggaacacgtgccacacaacgacaatgaccaaaactagtaggaagcaggaatcctaccaagaccaatatctatctattctaccattcaacttggaaacctatacatattcctaattattatcattatattatgtgaaacccatataattaagttgtgtgtattatctcatactatttacttcacatgctcatggcaacagttacagaaaaagtatacattgcactataaaacattgtagtttggataatggcggtgtgatgtttatgcttctaagtgtgccattaaaaaaccaaaatataccaacatgccattgtcttctcagcattctcccttctttcctggggatcctctgttgatttttatgatagccatcgtcttcctaacatcccttcaacaacgctccatctctcacttccaacaacgctccatctctcacttgcctcaaatgcaactaaagaaagacgtgcagtgacaatgatgtcatcatataggatgtttgattggagcaatgtctcaatgggtgagaagatgaggcatactcgatgctgtcaatgcaactctaatacccataagtggtataccaagttgccttcactgttacaaatccaaatcagttttgattgaagacacacctattgtcgcgaatactgctaaccctcactcccgagatatgctttttctacctctagttgtatctaaaagagtgcctagagagctgcattgctagctttggtggtaggaagtgctaagtccgaaaaaatgatttatgatgaaatgtttaactacatcttcgtaggaagcgatccaatatagttactgtggctacgactgttatggctggcataacaaacacaaccgtggctgcgagcctatgactttatttataaaggttatgtaagatgaaatatatttttattttttctgaaaatgaaagcgaaacagctggaacattttgcgctccctccagcccacccacgtccaaactccaaacgccaaacgaagcaggcttcgctccgattaaaaaaaaaaggggcctccttctctgcttggcggggcgggcggtggtaataaccggcaggcagtcaggcaccaatctcggagccaaacaacgcccatacgacgagacgagaagaggagaagcggagcgcatcgctcggtcttccttccttccgtccgtccgcggggcacaaacgcacccaccacccccccataacgcgcgagatcccctctccgccccccctctcccgatccgccccgccggatcccgccccgccccgatccgatccgacctagcccgcctcgccgccgccgccgtcgccggccggagaagggaggaaggagaaggagaaggagaagaagaggaggcacgagatggcccccgtgtcggcgctcgccaagtacaagctggtgttcctcggcgaccagtccgtcggcaagaccagcatcatcacccgcttcatgtacgacaagttcgacaacacctaccaggtgcgttcttcttctctatcggtttcgccgtctgctcgcctctcttcggggggttggggttggatctgatcgggggccagatccggcggtggcgccctggccggccggccggccgatctggaggagaggcggttgggattggatctgtgtcgtgggttggccgctgactcggtcccgtggcggtggtggttttggtcttgttgattatttggacgtgatcctctctgctagtgaagttgaatcagcagtatctcgtgtgcgcgggtgatgtgatggtgtcaagcaaggcgtgatctcggcggccttgaggagagcgagcaattaagcctcgatcgatggcatggcgggatccaagtgcagccccatgatacaaatttacagatttacagggagcttaacagtaggcaatttcaacgagaatgggctgctgcattcagaatgtggtctttggatattgaacttgggattggaaagcagggaacatgagccttgtgaatgtggtttttcttcagctacagggcattgtggaattcgtttgggatctgggattgcaatttttctctgctagattgcacatgccttgtgaccggcgcacttatgccatgctgtagacaagattggggatcatctgttttcacattattgtaccacattgagacatccgtattcggaatggtgtctggacgccttttgatacatcgaaaagatgtccttcctcacgagggctatttctattctgtatgatggtgggaatgatgatgctgtcattatactattgcacgcttattttgagcattatatgtcactgcaatgtttcagttttaatacttatcttaaaatgtttcagttttaatacttatcttatctggtcgttatgttctcatgatttattctattttgcgaacaggctacaatcggtattgacttcctgtcaaagacaatgtaccttgaagataggactgtcagactgcaactttggtatgatggcatcttttgctgcatttccagttagttgttctactccttgggaatcggcaggcattatcttatgcattttgtatttttttttctgcagggatacagctggtcaggaacgattcaggagtttgattccaagctatatcagagactcttccgttgcggtcatcgtatttgatgttgcaagtatgttctctcatctccatgtgcgcacatgggtggcatgtgtgttctcactaactgcttttatactagcaacaatgcagcagaccaacagagaattgccaagcaaatttgatggcacatgtcaacaaattatgatttttaatagcaatgtcatttttaattcgttttgcattataaaagctctttcctatcctgcctcctttttccttaaatttgttttacatgctgtaggcagacagtctttcctaaacacttcaaaatggatagaggaagttagaactgagaggggcagtgatgttatcattgtgctggttgggaacaaaactgatcttgttgacaagaggtgagtggagttcaaaaaaattcttgttttctttagccctttcctgttatcttgcttatctgatgattttgctgttaataatgatcctctttaccttctggattttacttggtgaattttattttgcagcagtttcatttgaatgcccttgtttctgtatgatgtcagattttgttcaccatatgctttatgtgttactgttagtggtgtactggtgtttaccaaacatttcatttatttgtctcatgtaagacattactgaattatgatttctagaaatgcattctaccagggttagtagagtaaaattaagtgcaatacctgctgccttaatttttttagttgggttcccaaccaatatttctatatgatgtcaaatttatttctctagatgtctttgattttatggtgtttaccaaacaatgcaatcttattatgtaagatagaactgtatatttacttttgatatgcagttattacgcgatgattgaacagtacgataatttagcacaaaactcactaccttataattttagttggatcaagctcaaggtttgtgattcaaaacaatgccatgtaatgtgagtgtatgataaaatgttgacctatgcccacttgttattggcattgttatgaactacaaactgtaggctcacatgtgtctaaaagtctgtttaattctagatatttccttgtttcatttatcgctaaacagataaccacaacatgtgtgattcaggaaaatttctgtcaggtccctaaaaaagtcagaccttgctataattccaaattatcgtggcaatttccattttttaggcaccacttgttgtggcattggcgattaagatacatcaatttgtggcatcagtgccagttcttaaagccaatcttgttttggtgtgaatttttggaataaaatgtgtatggccagagcttcatatttcatgactgcagcttctgtgctctttaatattattttccatgatagtttaagctgacattcattttgaatctctcagtttaattttaaatattatgtgataacttatttcttgctgttgcttttgtgctggtggactcatttcctgctttagcttcattagattaaatatcatcgatctccataaatttttatgtaaaatgtatatattgttgagtgttgctgtcaattttaagtcatgtactttctcatgcaacaggcaagtctccatagaggaaggagagggcaaagcgaaagatctcggtgtgatgttcattgaaaccagtgctaaagctggttttaacattaaggtgtgcttaggaaaatataaatttcttgcatatcctttgtattacatcaggagattagcacgcgtgtagatctggcacattttcagaaagttcaaaatcgtgttcttttatttgggagatgctgaaatctgaattatttatgggttacatggggataatttgttctgacattttttctcatgctgatcaggcgttgttccgtaagattgcggctgcacttcctggaatggagaccctctcatcagcaaagcaggaagacatggttgatgtgaacttgaagtccagcaacgccaactcatc

SEQ ID NO: 62035 - DNA, 7345 bp, Oryza sativa
acatggcagtagccatatgttatcccggttgttttgaccattcaaatgtttgctttctaggcctcctttggaggacttcttgtgggatctgtgcaaatttcatatttgctacagcaatcatgtattccaaaaggaagctcaatccatacagtagacatcagaactagaaattttacaggagttccacgtgaagtctaagggcttgtttggcacagctccagctccacccctcctggagctggagctcggtcaaatagtttcagctccaccaaaactaggagtggagtaaactaggagtggagttgggtggagctctctcacaaaataaactagagtcatttccacaactccactccagacccaatttctggaactaaatttaggagttggagctataccaaacagaccctaaattctcacaaaattgcactcgctcctgctccggctctggctccggatctcctccccctcgccgccttcctccaatcgagggcgcttgctgcgcgcgccgtcgtgaccaccagaggagctgcgccatctgctcgtgcggcccttgcccgggatctcaatccctcagatgggccaaccctaaggccctgtttgtttaggcttatgtttagctgggcttttctagttaggacttattttcttcctggctttaaaagtagctgtttggtggatggcttactattgaatggtaaaaaacacccatcaggtttgggtttcttgtttacaagccgaggacattgtaggagtaattttctcacgtaataatattacttttttttcttgatgtatcgcttttaacactttaattgtttccttatttttaatatatacgaattagagatacaaataaatatccgttcctaaatccgattgaggaataatatgggatagatacgagatgagtgacatgttacctggcaccgtccgtaccaggttccaaatttgaagaaaaatatgttaggatatgggaatatcgtgatccgaccgaacccgcccgttttcacccataccattaccttggcagtagtatattagtgaaataatacaatcacaaatatttcatgataatatacaagtaaaataatataagcacatatccttcttctgtaaaaaaaaactggatgtttttaaggtttctcaccaaaattagtaactactaaaaatgatttaccccatgattcaggtgtcattttaataagtgtatatatacactcaggtactggagaatatttactgattgcaaaaggtaatgaatgctttcacagcttgttgccacatggtacatgacttacacattgcgccatggccataaaaattagggataagtccatttttcacccttcaactcttcgctttatcttaaaagggttaattggaatcattccattgcaacttcggctatttggaaatatgccattataattagcgaaaccggctaggtgccatcgcaatttcttccaaattggaaccatgccattatgtacgtctgaatcgccatccatgccgtttgtcctcgtacgtatttccgtatggacgcttgtgcccctggctgagacgatacaagccagccagccatcccggtccggcttaaccatctctgttccccattccccattgtctgcaaaccctagctcgccgacggcgatctcgacggcgacgacgacccacgatgtagaagttcccctgaagatcgcaagctcccctacgacatcatcgtgcgcagcgaaattgccgatggaggggatggatctgggaggctcgattcctcctatttcgtcgataccatgagtaacttgaactcgaatatactccttggatatctaaagtagaagtgcattgggtatttcatcgtatttacatgtagattttcagttgatgttctctcctttcatggtaggcactggttttcagtagaggttagggttggtgcttatgtcacgatagaaacagagcgaccaccgccactggtatagctcgcctccatcgccgcctccaacctcgttgccacgttgatccatctgcgccgggagaagctatcggtacagctgccgccgtatccctagcccccgtcgtcgtcgccggcgccgtatccctagcccccgtcgttgtcaccggcgctgcaccaaacgccgccgagatctctatcggcgagctagggtttgcagacaatggggaatagggaatggggaatggggaacagagatggttaagccggaccgggatggctggcttgtatcgtctcagccaggggcacaagcgtccatatagaaatacgtacaaggacaaatggcatggatggtgattcagacgtacataatggcatggttccaatttggaagaaattgcgatggcacctagccgatttcactaattgtaatggcatatttccaaatagctgaagttgcaatgacatggttccaattaaccctatttaaaatacaccagagcatttctagcagggaccctaaatatagcccctaaacagattttgggtgttgaggcttaaaaaactcaatccagcagagcccctatcaaggatcctaaattaggcaggcacccaaataacctttccaagcccccaggggctctactgcacagcccccatccacggttggaaaagcgcgggagctgcccgacgtggtcttggtccgtcggcacctcccctgcccagtgcggcagtgcttatccccggccggtgcggctcctccctgcctaccgtgtcctccttcaggtgccctcctctacccgacgctcctccccggccgacgcgtttgccgtgcctggagtctcctccagcctgcactctccacctgaactcgatgaaaaacatggcccagtgaccgagtcatgcgatggcgtcaaggcactggatggtccaagtgctgctgcgggctgcgaaattgagacagtagtagcagggtagcactagcaactgcgattgtgggacgaaagaagaatggggaaagtgatacatgcgatgtgctatgcagcttttttgttgctttgcttggttgttgcttcgtgagagaagtagcaggtctattggtggatgagaggacaggaaaaatcagcacatgtgagaaactgcatggaagcgcgacagcagcagaagctcgtttcacccgagctatgaatacaggctactaggatttgtatttccattttaatttttttttaaaaaatcgaatttgaattgtgatgttttgaattgtgaatttaaatatggttggattattatggttttatactaggagtagcgtagagtatataactatagattagtactttaaagtatatgttaaaatagaagatgaaatgaaataaggggtgagaaaagggactgttgttggagttaaaaggtattttttaggtactcagaaaatggggaagcccccattatacttttaggggttgtaaaataggagctattgctggagatgatattttacactctcaaactttctatactgtgtagattatcccctttgacggtttctagcatggtttttgcaattaattatggggatatgcaatacagggaagaaatcgtacgaattcatcagttatttaatttattgatgtgtttcgctgtgcaattgcacgccgctggaacagctagatgacggagcgcgctgcgagcaggtcggcgacgatacgtgcgcgtgacgagccgtgatcagcggtcggcaagcggtttcgccatagatggtccgtgcgtggatgatggatcggtggtgctctagaggcggccgagaagtgcctcgtgtgctagcttctgatcatcgatcctggcgtcctgcggcggccatggctgttcaacgttcgccggcggcgcgcggggcggcatcgacggcgaccagtcgaccaccatggcagcggcaccgacgtccgcattccgcccagcgcgcgtgctcctcctatgtggcgcgcgcgcaccacaccgtcctgagagtgaaaacggtcggaaataattaatcatatttatcatttaaactgtacggggccaccattaatacgatgcagaaagaaattaaaaaatcagaatatataaatagccaataatgttgcggtcggaaacgataacctttatatggaaatggggtgctcgatcgattgggaattttcttgacctttttcaccccactgcagatcgattcgagggaggttggggaggctacctacctccgctagttgccagtggaaggaaatcccaggctcgaggtggaaatggagcttgtggaagggtcgacggcagcaatgtaggaatcgtagttagccagcagtttttcccgccggcgagcccctgcaaagttgcgcatttaccgtataaaggtcggtgtcagatgacaccgatgactttcggtaaaacctatgagaatttttacggtacaatatactatcattatatactaccaatatataaaagggtatattcggaacttaaaaaaaattgaataagggatttttagtaattcgtcagatctgatggggagcaggggcggatccaacgtgagtgcaggggggttcgagtccccctgcacccacaagatctatggatacccctggagcacccccttcaattttttcaccatgaatgataaattaaaggtccttatatggctggagattgaagaaactgtgtaattgagcactctcaattttttgtttctatatctgccccctgatggggagtaatcggtcttggatctcatcatgcatcgcgagcgcgattagattatggcgcgtgtggcggctgcatggtttgatgagcaacgagaagccgaggagacgctggacgcaggccccaagcattcgcggtggcctgtggcctgccttccggctgagcctcaccggccacggcaagaaactgcgacgagctgattcatagtgtacattgagcgatcttgttagttcaatgtagattctactcaaaattgttggctagtacggacaacgtgaggcaaataaatcaggtactgatttagtgctcttgggcttgtcttgcgttcagtaccagatcggcagatgaacatggaagttcataaaaccgactgtgtacattgcccttacaattttatactggaatctcattaagtggggaggagaatgaatctacaccattggatcatttatgctagcagtgtatactggcagtatagtgtaccgtctaaacataattagcatactatgacatcgataaatacgttatgacaccaacgaatcgattttctatatccgccaccactgcaaacctcacacaaacgctacagcgtaacaacttgcttttctgatgcattatatatatcccctctacttaaaggaaattacatgcaatgcgcgcgagccgcgcacgactgaactcctgctgtcctgcacttgccgcgcagacccacgactcaaaaaagaaaagatgccaccgcatgaactcggatacttaggcctatagctgtgcacatgaacgtgttcgtgcagatcctaagaaggatactgtggtacatagcgtgactcgcctgaaatatgtcaacaattctcagtacgggcccacctctgacggtccacaaactatgagccaaagtgctcaaggatgttcacagctttgatgaatccattgagagatcgtaacaggtgaagccaccggccgaggctcgtcccaggtatctagacacatgtgacgggccggcacccacacctaccagaaggatacctctgtcaggtgccagtgcaagcccatcacaggtgaccaaatacctgtgacgagcctcgcaattacgtctcgtttgaggtgagtataactcatatctaacgggcttaaaccctaacccgttggagttgtcttgtcgtctataaatacccccaaccactatatgtttttcatcccaatcctacgcactgttcacattttgggcgggagaataaggggggtgaatttttgttgcaagaaaacgtgtgataattatttgatgacgaatattatgtattttgtctgatacttgtcatcttattgtttgcagatggaccaaagttggatgtacggtattgatagttggtcccaagagtatagggatggggtcgctgaattcctaagaattgtagataatgataggataattaggatgagcgaatattagaggatgttctctgatagttcatgggtgcattctgtaacatcctgaaaattcctgacattaaaaatcactaaaatttcaaactttttaaaactttttgcatcatgctggaagttatggttgttattgcttgccaaaccataaatcgacgcaatggaaaaaaaatcaatctaaagatttacacccgagcaatagttacgatttacaacgatacgatatttattatcaatcccataaatatttatgcacatggaagccaggccaaataaagtacaagtcaattattaaaccctgtggtataaatcacaaatcaaatattaaataatcaaaccatgttgatagcctgatttcatatttaacaaaaggaaacaacatagttgaatataattcacttgaatccaatctcacatgaaatataagtacacatgaaatgatgatcacatcaatggccccatctataatagagtatctcactagaatatataattaatatttgaaacaccttatcaagctcctcatagcatgaaaatcactcatataaaataatggtcatataaataaattaggctttatacataaataagaatatgtgagtgtttaattaaacaattagattaatgttgtactaagtctcaatttatatttatagaatgagtagacccacgtaaaatgcattgttatacaaataagttcattcaatgtgctattgtaataataatggccacattaggatattttaaattaattttagaaccctcaaagcctccaaaattatctaggttaatttttgatttaaacctcatttaaataatacaataggaaaatatataaaatatgggtaatattaaattttggtcaactttcatctaaaataaaacatatattgggtaaaactctaattgtgtgaaatctagaaattatgggacaagttttaataggaaataggcctcaaaagtggataattaggaaaaagtcactgttcattatggcctaggtgtttgatgtggttccctagcccttcccccctccactgccgcgctccccctcgcgccccgtgcccctgcacgcgccgcgccgcgccgttgccgcccactgctgcgcgccgcctcgcgccccgcgccgctctcgcctccgcgcgccgtcacgccgcctcgcgccccgcgcgccgtcaccgtcgccgtcacattgccatcaacaccgcgcctcgcgcc

SEQ ID NO: 62036 - DNA, 8251 bp, Oryza sativa
tcaccgctgttgccatcagcgccttgagccccgcccgcgccgcgcactgtcgccgttgcgccgcgttgtcccgccgccgcacgtcgccgtcgccccgagccccacgccgccgcgccgtcccgtcgtcgtttaaagccggccacccctccccgcgcctatataagcccctccccggctacccattgctccccacactacccccaccacctcccctcccttttccctctctttcccatccccggcggacgcctcgttggaagcagccgccgccgccgctgagccgacgcgccccgccgccgcgatgtacctcgtcgccgcgccgtgctccgccgtcgacctcgccgccgcgtctccgtcgaccccgccgccgaaccggtgagcctccccctcccccactgcttgccgtcgcgccgtgccgcccgccggttctagccgaggccgagagagagaggagaaagcagagagaagagagagaaaagagaatggaggagagaggttagagtgggccccacctgtcattaattccatccaatttcccttagaaaaataattctgtagaaaagaaaatcaagaccttgaccccacctgtcagtcactatagcttgtggataaggttgtattataaataaatgaattaggaacagtgccttttttacaatttctcggatttattcaaatttgaatctttacactagcataacttattcattttagttccgatttgagtgaaacttgaacctaaattcatctaaattcataagctttccaatgatatataattcactatttgataaaatatatttataaatattaaataattaatatcaagatgatgcataatagtcaacttaaaaatatgttaataaataaaattagtattgtacagtagagtagatgtaataatatttgtctctaacatgtcttccactgtaacaaccacacaaactaattttatgtgatgtctcaaatgaatggatgtataggaaaatactagtacttatttaatattcgatggccatataattaaatccatggcttataggttatttaaatcaagtgtagccttatgattatgtaactaaaatataaacacacatagatgaatctttaacctgtttaggagaataataatagagctagatgtggaggaatcactaagtaaattaatcgatgcaataccatatagaatagcatatatatgcctaaattgattaccacttattagtaacccaatagaaccagtgcttaaacttgtcgcatcacatatacaatatcactcatagaaactagctaatgtataattaaactacaatatattcaggaatcacttggagcattgggtagtacactttctaaataagctcatatacagtaggcgaccaaaaccttatacgttgttgcacacatatattgtacatcccattatagttatacaattaatttatctttttcatatattaaactagggagtatataacaaacatgaatagtagataagtactaattataaatcttgacctcatatgttcatagtttaattgtaactccggattgttcattaagagataatctgtaactataatattataaacttcccgaatttaacatatagagcatggacaattattagccctcttataatttataatggcaagtaaaatatgttcataattaaagtaaagcttccatcaataaaataataatacaaataattcgctgtaattgtttgattgatcctaaatccatctaacaacagaacctctagtatataaccgtcctatttagatagatgcatacatagccataatccttccatagccatttgatagactaaaccaccgattagccaaatatatatgtatcccataaatgctatgtttgttaactcctaaataggccacgatgacaatagaaagattaagaaactttagccttagcatgattgggatccattagcaaacacgaatagtacaatttgttgcgcatatttgattgttgtttgaatattggtttttctcgcgtattatagaccatgtgtatcggctagtcgtgaggcaacgtctgcaacttccaggaggtgaaggttgatcaagattatatcaataataaggattatcctaagcaaggcaagtcatcactattccttgaacatgttaatcccaattgcgaaattattttgtttataaataaaattgcatgcaatgatgaacatcctacttgtgattatgccatgccttgattattgtttgcccttattccttcgtaaccaggtttacgtatgagtccctagtcaattatgacaaatgcttagaaatgctattctagaatcatgcatactcatatttatcaaatgctatacgcttgggcaattacctttgggaaggtaattgagatgcggcatgtggagacatgagcgccacattgccatgatgttgatgacatgatttgtgaaaggagaaataaaattaaacaatttttttcgactggggcggacggaggatttgggtggtatctggaaaaggctagtaccatccccggtcaattaaggaccgagccatgaagttaagcatgaaacgacccccgtacaaccgcacttctcgtatgggtatagacctagcggagtagatagctgagcggaggcagtatccatgcgtagtggtcttcttttaggtgtgtgatacggcaagcagtctgctggcggatgcccggttcggatggcctggtggatggcggatgcccattccggatggtcagaggctggcttggcaatactacaagaggatacccataagagaacaatcatgatggactgggttcaacgacaagaaacaacgtaggaatgtgtgtgtttttcccttcccgggagcgccagaactcctctcactgctagaaacgtatgacgcctagagtgcatgagggctaaagttcatggagcgggtactgccaatgcgaggttatcgaaaagctttgccgtgacgtgtctcatgtgttgggacgaggcttatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgtgggatgggatattgcatgatgaattttatgctgatggagccacttcctgagaggagggaaggtggacgtcctcagaaaccatgacgactcaatggcgggaagctatccttgggattacaatggatggtggatagaaccgtcgttgtttaatgtgaacactggtattaaaacttgatcagtctatgctaggtcttaggcttgtgaaaagatttgcaaaacttgttttgcgcaaaggaacctgaagccattccttgaaataccctctatcatatgcatcgttgctgtggtggcttgctgagtacggttggtactcacccttgctattcatatatcttttaggagagtgttgaagagaagcccttgtcggtatgcttgcgtatccaacaagatgatcggaatgcggtgttgttctaggtctcgttccccagtcgactgcctgtggcatgttaaccgggcccttatattattttgtcttccgctgttgttctctgatagttgttggcctacctagccctaatgtaagtatttaactcttttagcatgaattcattcgtgatatgctgtgatccaactatgtatgtgtataccaactactgatccagggattggtacggataaacacagaagatttccgatttccaaaatcgggggtctacacattctcatctaattcatagagggttcatgaagcattacagttgttggagcaagcatgaagaacaagagccacatgatgttgtagctgatgaagtagatgtagggaataggctagatcgagatgacatgtttgtccattcttcatttggtatagataccataaattttgaccttaaaactctgtccgaaatgtttcgtgatattgaagacccatatcacgataagagagattttgaaaaattcagtaggttggtggcagattctgatgcacctttgtatcttgggtgcaaaccaaagcaaaccaacttatcatttgtgttggaactctgaagcttaaggaaagtaatggttggccaaacaagaatttcacaaaatcctctcgagttgttgaaggacttgttgctagaggagaacgaaaatcccacaaattgacacatgaagcaaagcgaatcttatgcccattgggtctagaggtcagaagaattcatacttgttagaacgattacatatgtattacaaatagtattacggcttctagatacgagcaagacataagtgaagatgaaggtcatcagttaaagaggagggctccgtaaagatagtgtgatatcttccaattgctaaccgcatgaaaaaaactgtttgtgaatcctaagcaagctaagttagtacattggcatgctgaggacagtaaaccgaggcattccagccaacttagtgtagtgaaggacaatcgataggttttaccccaaatttgcaaatgacccaagaaacattttattttagccaaagtaagaaagttgaggcgtcaatacattggtactttagagtgacttcagtgcttcaaagacgacctattcacagggagcaaacatttagaaaggacacaactacaccgagagtgctagctggatagtgctgaagagagacaccattctttccaaaaaaaaaaaagctactagtacactcaatatctatatatttttttcttcttagagaagtttctcttaaattactcatccgatttataatccgattacaccgttgtgttcgtaacaattaaatatttacaacaagaactcacatgattatattttgatgaaaaagcacaaattactttcatgatatgtctaaattacttctagatttcactaagttacttattaaacatataaaagtaaattcagtaaagcttaaaagtaatttacatatattataaaagtaacttataacaaaaagaaagtgactttaatttagaactatatctagattcattaacattaatataggcaatactaaaatgacttgcattatgaaacggggggagtaactctctatagtagaaataattatattgtgagtgagctgaaataagaaactatgtagagtgaattcgcaagtaaagtgtagagaagatttataaagtccacaaattatagaattaactaaaaacaataataaaaataatcaacttagagcattatgaatgtatagaagtaatttagtcaaatctgaaagtaacttatatatattataaaagtaacttagtatataataaaagtaatttacaaatataaatatttttttatcgtaatataatcatgtaagatcttgttgtgaagatttaattgtaacgaacataatagtgtaattgaattgtaaatcggataagtaatttgagagaaaactttataagaagaaagaaaaagacacacatgtctaagaggaaaaacagcacgcacatcagcatgtgtagcagtaattcttctcacaattgaatcgtcgctggttaaaactaaaccgagaggcttctcggtttagattttaccatttagaaagcttactagcacaccacaatcaaggttcacaaaaccgttttagatggagtttccaccacccccaccataaagcgtaataaaccatgtgggtaaccacacgactaccgtgaaaaccataaggttaccacaatttaaggttaccacatgtttaaggttaccacaaaattaaacatggattcaaaaactaaggttaccacatgtgatgatcgcgtggttttgtaaacgctggtgactcacaggatttccaaacgtaaccaatacggctcccaccgttcagtcaagagcctgcacctcaacaaaatgtcaccattcatgagcacgattacatgactacccaaatacccaacaaaacttaagccttcaatccagagaacaaataaaataggcacttgcaatctggtactaaacacatgaaaaacaatcgcagcagaacacaggccaaatatagtattatcaaaacatgtgacagaacatttgctctcacggttgtggaatcaaccacgcagaaaacccatcacgggtttaccagcatccagccagctccataaaatgacagctgatccaaaaaagaaaatcacgcgatctccatcaatgactacaagctctagcattcgttctttcaggcaagatcaccaaacatcatttctgtgaacctaaatatcaaaaactataaagaaagcatacataatgttcagataaatataatggccatgtgcgagagttctgaaagggctggccaccccccatctatacccctatacaaagccaatctgcaagcgttttcgtggtaccatggaggcaggcgatagcggctgcaccttagacttcacggcgccagccaatcctgaagtattgacatcgtaccactataagctccattttgtcttctatacaggtgaagcgatgtgggtagcgtcgtcagcatctctcagtgcacaagttgccacctcttgttgtcaagccccactgtgaactaccatgacaagaaagagatgtgttgcaatccttgtgctcctcagcaatggtcaatggtcgacagccatagccatcttgtacaaagcttgcctcaataaatatccatgtagtgctccaacatatgcttgtgcccaatacttgcaactgatgtctatgcaccatcgtttctgcattacagtgcagaaaggcacaaccaagctgctgtgggccaaggatacaacccatcaaacttccaaaacttaatgcggcttcagcaattatatcacaagctttcctgatcactggggaggaggttggagagactgcggttgggtgttgtaatgagcatatgactgagagtagagcgggttcatcatgggctgcaaaatatcatgttacctacacactccctgagaaagataaagttacaattaaacagataatgaaaaaggataaaccacctgagactgaagaccaggaccagccattccaaaatgcatctgtgatgactcatcttgtgaagagtcattgtatcccgcttgtgtaaacattccatgtgaaccatgggccatgtgatcctggataacactaaaaggttactcacagaacatacacataaagaaggcttgaaaaggcagttacttttcgtaatagttatgaccgagatagaacagacctgagagacaatgtcatttgctgcacccatatgggaataccctgggtgtgcattttggttcaaataattcccaggatatccagattggggtccttgagagtagtcaacaccatagcctccttgagaagcctatatatgaacaacttatattagaaaactcttccccagagtaaacgcaaactttaaactttacggcattgccataatttactttccaattggttgacaaatcagatttaactgaataaatgaattggcacagaaatacaagagacatttgaaacaatgggtacctgagtggaaaaatcagcaatgttgtatgccacatgagatccttggctcttgaaatcatctccaaagaagtcctagaaaacaacaaaaccaaattttgtcatcaaggatagaacaagatagtaaatggcatgcatgcatcattaattgctagtacctgagacatcccaccaatggaaaacccatcgcggaatgtttgactgagaccttggacaggcatctaattgcaaaaggcaaatattactagacaggtacttttttttgtatgacatatattaatagaaataaacaaacctgtgtcatcaatccagtctgggacattggacctccaccagaaggctgactgctcggattctccaggccaggaaagttaaaagctgaccccatgcctcccatagcttgctgagaactctgttggtgagcaaggtgcccaccaatagggccaccagtatttccacgaggtccaaagtttctgtttccaggttgaggcacaggtggaacagctccaatcggtccgtgcaatgatccccgggttggaatagcatagggttgagaatgagccccagcaaatggagggaaaggcatacgaggtaaaggatagccagatgggtgcacaccaggtttatgagccccatttggtgggccaaatggaacaaaggaatgccctgcatttcagaaaagaagag

SEQ ID NO: 62037 - DNA, 2729 bp, Oryza sativa
aacacatggagattatcgagtgaaaattcaaaaactcagaagagctccttactttcaatatctactattagatatgcttatccaatgaacaggaatatctctcaaatagtaccaagcatcacgtgcttatagatttacaaaatttaggctgagtttggtgcaaaaattgtataagtttcttaaaaaaaatcaataaaatcattcgcaaatgctccgtctcgttttgcatgaaacaaattagcccagccaaacgtccagctcaaacacacctttagttatataaagaagcaagaaataatactgaaacaggacaattggaatggaaccacttatccgtttgtcaaatactcaaatgtaaaagaccttgaacacatgcaggtagaaaatacacatgttccatcaacactacaagcattcaattctactgtcaggaaagataacctgttcaaaaaacacctaacaatctgggcataaaccccaaaaataagcaacctgaacagggtatgcaaagcattgttatgtactgaaggaaagcttataccttataatgtgtcaataaactattccagagtggctgcttgcttagaactttagggttcccaagaataactataccgtaccgagcacgagttaatgcgacatttaacctgcgtggatcattaagaaacccaataccctgaaaggtgaaaaaaaaaatatcatgtcagttaacacaaatttgcgaaacaaaaaggttgttcttcaagcaggaaaagctagaatatgcacagacaacacagttcaatccttgcacaaaatatacaacagtctgcaagttaaactactgcctagatgcttaacataagaatttacaaagacaggcttaccaccctcaactgtcattgccaatgagtttgaaaacataaatagaattttcactaaatagaaaaggccaggtcagagtacatctataacgccctctagaagtcaatgtgaaatactgtcaagaatattatgctgcaaaccaagtaaaacagcaaagattacctggtgctcattgcttctaacacaagacaggattatgtaatctttttctcttccctggaaggaatcaacacttgctacctgaaataagtataaatcttatatgacaaggcagctttcaccttggtaggtttaacggaacagtatacatgattggtggttaacctcaatttctttgtatagttgttggcgaagagagccattccttgacatataattcacaatatatgccctttgtccttcataaggtgtgataactccaatctacaatacattccacaaaatgtgatttctttttttataaaagaatcaagtgctgcaaaatgttactagtagatgaaaaagggatcatcactgcatacctggcttggtacaacaccactccttaaaaatgtagttacaatcttttcaacatttgcagcttcagttctattgaggtatgatgtcccactggcactgatctcttcttgtcccatctacagaaaatcagtacgagtctcttgtgtaaataagcaagaagagcttttgcagttaggaagtacagaagaacaaagatcaattggtggtggtccaagaaggtacctgcacgtagaagaacataggccgatttggaacaggccaaggaaaatcaatcccaggtgtctgtctctcgtttacagttactccattttgcagtgtgccttcatagaagcagttggacgggaagtctgaaagacaagggtgcatcctatattgtacctgtaataacagatgattatgttagaactattagctttgttcccaaggaatgttaattttcgaacgcaaaatacttggatataactcgtttcaatggttacttgggtataatttggtgaattgattgtgtaaaaacaacgacaatatcgggatgaacaacagagatttgatgattcatccccaaaaaaggcttaaagaaaaaccagaaaatgcaaagtgataagtaatgttggaacatgtactattcttaataattcaaagttttgtccaatgatatgacaacgaatattaagcaagacagtttgttcaaattagaatgcctgcactaaattgtacctgacatacacatacggggggaaaccatttttcaaagaatcctcacaaaagtaacatgatttatgagcaatctcaggataacttaaaaagaatgtatcagttaggctttaaatccaccgcttccaaagttttgacatcaatgtcacaggacaaggcatggtaagcatactcacaccatggtaataatgtggagaaacagaacaccagattcaacaattacctgtagcctgaaaggcttgactccaaggataacaagccgttcaaagagcgattgtgctaatcctgcacgagctgcctttttgcacatgatgactgggcccagttgacaatgatctccaacaagaacaacctaaagaaagagtataaatatagcataatggaaagaacaaaaaaccaccaattaattacttgttacctgctttacaccaagcaccaatggaatgagacattcaggctctgttgcctgtgtagattcatcaataagaacctgacataaaaaaaaaaagaagaaagaaactccatcacctcaataaagagcagacatcaaaattaaactgctattagaaagaaagtattacttgacggaatcggaagtttgctaaacgagggtatccagcagggctgcaggaatt

SEQ ID NO: 62038 - DNA, 2375 bp, Oryza sativa
  unsure (1)..(2375): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactggcaatgctgcttcatcaaaacatcacccaaaggcagcagatatctccaattcaggaactccacatcaccttttacctgttcttggcctttgtgctccaaatgctgatcagatgaactcatataaagggtcagtttgtgggccaagcacaaaggagcaaaaaagagctagtggtgaactagccaacaaaccgctgttgactcctgctgttgatcattctagcgaacaaaaacatgatggccaaccaactccttgtaagcctatgtttcctggttcctccgaggagactttgcgaaggctgaataatatcattccagacagttacttccccttccaacctgtatgtcctcttctttctttggtagcatattatttcatctagttgctttatcgttgttcatgctttttcttcaaaagtgaaaaatataagatagttgtccactttatacttattaggaggaaatggtgcaacctaccctgatattagtttttaaaatattttttatggatgcaaaattgggaaaaaaagaatccattcttgagtacagcatatatgatgttttatctagttaagagcatcattaaagaaaaagaatgacaaggtttttgtgtgcagattcctcctatatccgggaaggggattggtgatcatgtagaaaatcctgtatcgtccattccttcatttcaagggaaactgggtcttcctaattttagtctggaagacagtattccacttaagcatttgaagtcagtaccggatctatttcccaacttgtctttgggcactagcaatgaatatcttcgtaattgtgtcccagaattgccaaatagttcatttctaccaagctttatggcagatattgctggaacttcaaagcagaagaacaagttcatggcagatatgtctggccttcttccaggtttggcaatcaacccagttcaacaaatccattcgtccatgcctgaaaatcataagaaggtcttggacaaattaatgatgcgtgctcagtactcctcaagcaagttcttgaagaatgcctcaaataaattcctgaagaagagtttaaaaccagactattggtcagaagatgaactcgatgctttgtggattggggttcgcaggcatggaagaggaaattgggaggccatgcttagagatccaaagctgaagtttttgagccaccgatctcatgaagagctggcctcaagatggattttggaggagcagaaaattatagaggaaccaatgcctacagccaccagaagctccaactctacatcatttcctggcatatcggatgcaatgatgtctcgggcacttaatggaagtagcttttccaaactgaggatggagccgccaaagttgcagtcccacctaactgacattcagttaggttgcaatgatataccaaccagattttctcatgttgagcccactaattacatgaatttaagtgagggtggtccatcactgacaccgtggcaggatttcaaaaatagatcaggacacagtggagattttcctggcccacttgacaagtgggagaaacctgatatggggttgatcccaccatttatgccgaatccttttatgaaggaaagcattgggtcactgcccataaacagacacagcagtaattccattcagcagaatgaagttggatcaagttctcatgagagcatacttcatggtttttcggacggacaggccaaattattccatgagatgcaacggcgtgtgaagttagggaaattacccattgagatgaatctgaatcacacaaagctgtcagatcctctagctgagaactctggtgattttgaaagttcaaaaccgaacaagctaccgcactggcttcaggaggctgtgcgtgcacctccatccaagccacctgaatgtgagctaccagcaactgtttcagctattgctcagtctgtgtgcctactacttggagagcaaaaaccagcaatacctccattcccgattccaggacctcgtctctctctccccaaggacccaaggagtgctccaaagaagaggagagttcacaaagttcagcaagcttcctccctggtagatcattccaaaactacagttgggcaaggtgaccacaactctactccgtcagcaccactatccat

SEQ ID NO: 62039 - DNA, 4810 bp, Oryza sativa
tgatcacaaatgagcattagaacttttgagcaatgagctcaaatgcttatttttcttccatttagcgctgagattttccctttcccaatggtttccagtgtgtggaggtatcaggtacctgccttttgtgtttgtatgcttagcccagaatccagatagagtaaaaatccagggactagtagtttagccctctagtccagcgggagcaaactctcgaaagcctctatatacatgaagtgtatattttcagacatggtaccttggacatggacaagtattcatttatttatgcgtgtatgatttagatagtccgtttaccaccccactcccagggttacaatttagaaatactacatgtttgtctatggaaaaaaaaatcctggttacctttttaatccttgtgttcttcagtttttgttgttcgaattatccatttccttgatacatagtgccttgctgccattacttgattaaaaatggatgaaaatgcttcatattcagtgggctaatcgagtatgctccaaatgatggaagctatcacggtactccctaaaagccatgaacaaaacaagaaagcctggtcccgaaacggacctgcaaatttattttcggccttcatcagtctatgttacaggttaaggggttaagggcctttgaatcaaaggatttatgtaggaatttcataggattcaaatcctataggaaatttttctatttgaccctttgattcaaaggattgaagctttccaaatcctatgaaattcctatggaatggcacattgcaggtggattttggaggaaatttagcaagagctccaacctcttaaaaaatttcctttgaatctatctctctcatccgattcctgtgttttttatacgctccaatctaacgactatttatatgtttttcctgtgttttgtaatcctctgttttacacttcaattcctgtcagaatcctgtgttttttctattcctccgttttttctaccctgcgattcaaagggtccctaagttatcaatgtgtgcaaaaataattcttgcaggttggaagttgattcatacagcaacatgcaccattgaccgttcatttaaaaagaacacaaagtacagtgcctagatcacagcggatgaggatactaactttacttctctctaacttcgagtcattgacaaatgactccgttgagtagaggatccacatctcagtgacccatattagagaggatccacatctcagtgacccatattagagggaagtaagtcaaaggatctcgatccgatcacagcacatctgaatataacacaatcgcagcagtaagtaggttacatttacagatgctcaagctcaatgttctcaacggcgtttggtgtcagactgtcagtaatcttggtatgcatttctacatccatttggcgtcagcaatacatttctagctcctcactcctcagcatgtaggtgagatcattaaactactgatccaaccctgcaattcaaaacatatccaaggttggtaatgcatctaaatttacagagacctgctcctgcagaagagaattcagatgtgcgcgtgttagtaacatgtaaaagtgccgtaatttttaaagctttttgtagaacataatgtaacatgacaacaaaacaaacaaggctgttctcaggctaggctagattgtaactaaagcttgagttggcagatcctagccttgcatgagaaccacaaaccagtccttagaccctactttaccttgaaaaaactgaaaatactccttagtgcttcaacttaaaggcattattatgtcttttaacagtacatcgtgtggaaagttaaatgagataacagttatcatggttcagtaaaacttaactctaaatcttgctgggaggcagtccatccgggttcataggcttccagaaacatgagctttgctttgtttggaaggtcatgtggatggacaaatggaacccctggcggccatccgatttcagttctgatgttctcacatggacggtctaacgattttatgtggctttcacagtccctgagactgcaaaatctcagcttgatgcctttcttatccgcaatatcctggacacgctccttgagcaccctctgcgcctctaggcgaagtcttttggaaggagggagtgcctttgtttttctaccttccttctttctcttcatcacaaagttatacgatgctacaccagacaattgaagaagccatcaattcacagtattccaatgaagtcataagctcaaatcacttaggatgggtagaatgaggcatgcatcagcatgtacatgtagaaataacactctaggagacttcaaaaagaggtcaacgacaacgcgtccgtcatagagcatagtaccccattagaatgttccaagagaaatatcaactaatcttgtttcaacatgtcacagtatattattaactagaggcagagaaagacttggcctgaccctcatgttgtgctttcttgtattagaggtgtaagcctgatccgtgcacggatattgcagctaatgaaaatgcacaaaatgatatcaatgacaaataatattatcctataaagaacacacaattattatttcttgttggtcttctttttctctaaactagtttatcttcaccctaagtcagtggggacaaaaaaaaggacttcacaactgtggacatcacattccaccaccccgaacttatttgatgaatcgttatggcaaaaccacatcttgttataatataatgtagatcacgaagaacatattaaaggcaagatgtaccagatatagcaagtactggatgtagataaggaattttacgatggctaacatgaggatgtagcaattggtgccacactgccacttagcagttatttcttctgaatgaaaaaaatgtatcataaatcataaagtattataatgcaccaatgtagagttggcctgaaggtatagcaacttggtatgggactatggggtacataaacagttaccttcctgttcaacatgtggtgatggttcattgttcttgggaaaaagttgatttgctgaatgttctgtctgcatgaaatcattaactagtatggggacctgaaactgagcatcaacaccatggccagcagccctcatctcttcaccactcagccttgcaactgacctaggcatgagcttgaacaccaacgaacaccgcccaaacatacattcctgcaagttgccgacctccgtcttgtgcacagctgggtttacatagccagctgtttcccgataaagcgcaaggccaggatagacaacaatatcaagcggaccaagatccccatcgacaagaatccagcgcccttgcaaatctttgatatacaggcccgacctatccgacttaaccagcgtaagcaaagtcttgtcaatctggttctcctgatccgaaaacatgagcaattgttcatcatcctgagaagcgacgctatgctgctgtgctccttccatcgacggcctcgaatgacaacatgccgaaagaacagaagatgatacctcctggcttctcaagggtatgttgtcaagcaactccgtaaatgtggagctacgcagattcagcgagaagctaatcgcgtccaagacctcccgggaaaccttcccaagcaccgaaaacatatcaggcaacccggacggcggcaattccgccacaccgttcggctctaccggcgtgatgccgggcctgaaatcatacatttccagccacatctgaggatcagcatagtagccagacgtcttgcaccactcccgggcatcacccgagccgccgccaccgccgccgccgccggcctcgccggatccgtaccctcgctggtggaagaagaggcgtgcggagtccagccccgacctcagcagggcgccgtcggccggaggcagctcgacgacggccgccgagtactgcgccagcgactgcatcagggccgacacgcacatcttgtagccgtcggacgggaggccgtcggcggcggcgaggtcgcagaggcgcacgcggccgagggacgcgaggatgttcgcctccgcgtcatccatccggggaggggatggttcttggatcttcttggaattcacctcagggtcaggggcaccatccaatcgccgccgggaaggccaagattcgtagctacgcgagtggaagcgcccctaccaactcgctcgccgggaagatgcctgcggcggcggcttcacggcatgatcaccggcgaaccagctaagatttcaaggcggtacacgacacaccgtacctttcacgggtggtagtagcattcgattctctgcctctggagctgcggattcgtctcccgaggcgagctcgccggagaagaagtggtggtcggggatggagatgggcgtggcggcgccggcgccggcgagggcctcggtcgaactgtagaaggggattctcgtcaatgtaatgtacgaaaccaccgtcgccatcgtccgtccgataggaaaccgacggaccacaacacttcctgtaattcacaccgtgtatagtgtgtattggggctgctttagcagagaaaacagacgatatgcctctctatatattgggttcggataaaataccacttaatacaacacaccggataaaatgctactcaatacgttgcctaccggatgaaatgccactttacctgcccccgccgttgccgcctccggcgaacacgcgggtaggcgtccttgccgtcccgtcgcctcctcctccctctacctcgtcgtcctcgccaccgctcaccctccgccctatccttctcccccgtcatccctgtcggtcggc

SEQ ID NO: 62040 - DNA, 4001 bp, Oryza sativa
tagacaacgtattgagtggtattttatccggtgcattgtattaagtagcatttcatccgaacccaatctatagggtggcatactgtccattttctcgctttaccatgggatctcgtttggacaatacgataccaaggaggtatatcagaattagatcggatactcatcaggtatcatctcatatctcgtagttactagctaatacttatcggtaccaagtcgatacccaacggccaatggtacagctcgatatccatcgggtattagatctgagctaaaaggagctaaaaggagggagagaataagggaaggagttggttacttgtatcggtttgctcatctagaaacgatgacgacgacgaggtcgggcaacgtcaaatctgatcggtaggatttcagagtttcaaatccgcctcggacaagcaacggggagggcatagatatttgctttaaccattcccattccctgttgtgtgaacatgagatcctaatttcgacagcaacaattgctttctccctcaacgtgacgatttcggctacaacgatcacgactatcgcatggctacctcgataaccatacaagggctatcatcattaagttttcttgttggtttgtactcagttctaagcggcatgggttatgcctgaactgcatgggattttggagtatatgattaagatcgatacaatatatagttgttatggttgatactgttatgctagatattacatctttagaattggttaacatccaaatcaattgtattcttttctgcaaagaatggttcattacaatcgaaccattgtatgcggtacatctccccttacacaagctttcagaatttcagttttctgatgggccaatttgtacttgggtggagacatccttacacgtctgaccaacctaccaaaggcttctgccgtcacttgtgttctttctatttatctaaaaactcgtgttgtttctgcagagcaaagcatctctttagcatcatcactcaagttctcatcaatattcaagatcatcctgaatgtcaattgtgatacagaagcaacaggaaaaaaaaagaaagaaaaatgtctgcaaaagaaacaaaagccattcaaccaaactgctatcagaaagcttaccagcgtcacagagtgagagacaaggagaccaaactgcagagattaccatgatgaaaaagcagagtcaaaagagaggagtgaaaaaaaaaaagcagcaactgtgcttgagcaagcaagaggaagcttgaaacaagctggaattctactaatgcaattctattcccctaaatcgatcataatttatgctgcaaataaaataaattgaaatgaaaaaaattgcatgcttctcactcctacagatcgatcagaattcagaacccaaagaatttctcccgatctgaacaaaacccaccccgaatctctgatcaagaaagggatcagatcaaattggtgcgacgttttcaggtgtcgagctctgaatctgcccatggagtcttccgtttctactagccattgagcgcaatggcatcgagtgatccatcctcgcaagaatcccggcggccatggcggcggcggtcagctgctggagttggggccgtagcacgcgccgcggacggggttccagagccactgcaccatgaaccgccggccgttgacgccgttgacgttgtaggaggcgccgtcggcggcgcgcgacacgttcccgacgagcccgcccgcgccgccgccgtcgccgtacacgccgaggcagaggtcggcgatctccgtcggcgccgtgggcgtgtctccggcgtaccacgcgttcaccagcgggttcgtcgccagctccgccagctcgtgcccgagcacgatcaccatcccgtccaccccgacgtcgccgttcggcggccgcagcacctgctgcccaccggcgccgccgccgtagtccggcgcggcgaacgggtacgcgcacttgcccgggcactgcgtggcgctgttcccgacccacgcgtacggcacggtgacgccgacgacggaggcgaaggtgaagtagtggaagccgcagacggcgcggcagaactcctccacctggacgtccggcgaggtgagcaccaggtagacgccgctgtaggggtcgagcgggagcgggtccgggtaggcgtacacggcggagcggatgacggactgcatgtcgatccgccgcagcgacgcgccgtgcgagtacccggcgtcggagcgctcgccggcgacggcgaacgcgccagtcacgtgggcgcccgtctggtccgcgtacagccgcggcgcgcgcgcccaccagtcggacaccgccggggacggcgccgccggggccgagagcgaggcgaggaagtctcggagcaccgcctgcgccgcggcctcccaccggccgtaccagatgaggtagaggttcgtcggcgaccccgacacgacggggcccatgtggtactgcatgtccaccagctggttgccgtccaccaggtagtcagcccggtacaccggcgcgccgccggcggtggagacggcggcggcggcgaggaggaggaggagtggaagcctccccatttttctcgacgagtggagtggaggagtgagagcgtgggggaagtgaagtggagtttttggtggtttttgagtttgaattccgactctttttaacttcaaagtttggttgtactaccaatgtggtgataaaaattgtgacttccaaaaaagaaatttgatggacttgcattgggagggaggccgacaggtgggccccatgatgtttgtgcgtaaatatccaccatctgatttgaagatttaaacccgggtttataaaaacgtgcaattcgaatgcttcaattcgaaacggacatttttttatatatacttctaaatataaaaattacataaaaagatatattgcaattttttcataatataaatatactagtataattttaaacatttaattatgatatactgagtacatctttattttatcaattatttaagattttaaggtttgactgtatacattatctgtttggaaatgaatggaatacatcagctgatctttaacggtataatccacggaatgaattatatacacactcttctatttataaaatcagacttgtgagtggatttcagatcaaatttgcccaagttgatttaaactaggtggcatatgtggccagaccaggggaggcttcctgctagatctttttaatcagactggacccacctacttgatgtgcatttgcgaatagcatggaccacatgtcaacggctgcacgaagctcgaacatggcccttggttctagaagcagtgcggatgacgtgtgggccccacccagcggtaaggaatcatcatggcagtcacttgttgctggcttgcttccagtggaaagcctgaagacttgtggtacaactgttaactaaggccctgtttagataggactaaaacttttaaaagtccctatcacatcggatgtttgaaaattaattataaatattaaacgtagactattaataaaacccatccataatcttggactaattcgcgagacgaatctattgagcctaattaatctatgattagactatgtgatgctacagtaaacattctctaattatggattaattaggcttaaaaaatttgtcttgcaaattagctttcatttatgtaattagttttgtaagtagtctatatttaatactctaaattaatgtctaaatatagagactaaaattaagtccctggatctaaacaccacctaaacccaattcagcaatattgaatgattcggcagacgatgtaactaagagtacaatataaatactccttccgtcaagaattagatttaacataatctaatacaataaatctggacaggctctatgcttagttattttagatgaaaaaaggagtataatctaatacatatatgacatatcgtaacactacaattctaaacactgtctaaaatatgaattcctctttcacgtag

SEQ ID NO: 62041 - DNA, 6625 bp, Oryza sativa
aattcctgcagcccattcctctttcacgtagaggggccggcatttgattgtactaacaatcataaggaatcatcatatgtacaccctcagtcctagaataagttaatctagtactcgctccatctctaaatataagagattttggttggatgtgacttatcgatttattgtagtaggatgtgtcatatccaaccaaaattccttatatttagggagagagagtacttgatataacacattttagtgtccaaattatagtattaggatgtgtcatgtgcagtagcactagagggtgtatagtaattttcggtaggtacgtggatgttaattgtggtgacagggaaagtagactgctgctagagagaggaacatttggtttgaagcacaggtgttttttctgtgtgattctcaaggagcagggcatgtgagagcctgcagtttaaaagcctttgcatcattctatacacctctgcaacaccatccatctttaaattctctaaacttcattagtagtactattttttaatctgtctcagtttccaatggctgcatatcacccatagctccatcatcagtcatcagagcaagtttaacagtatagtcaactattagctccaattcatttatagccaatctaatagctcatttatacaatagttacatactacactattaatacctggtctcacttatcatacacacactgcatcttggagtctgtgctacagctggctataaatttgtagcccgttgctattctctctccttatttatttacttaaaatatgtttgcagttggcttatagcctgctattgtacctgctctcacaatgcgtggcttgagtggcttcctcgtttttttcttttctgaaacaatagactgcattgctttctgaacccgaagagtgaaacggaagtgattgcaagtttgcaacagagaatgtggagaaagataaaataattagactgctggacgaaccgcaaaggcacccatctgatatagctgaagcgctgatgatgttgatggtgctgatactcatgggataggattcttctgtctatcttttttcagttacacaaaacacacatagaagtaatttatagagccgccaaccatgtgaaaaatgaatagggatatgttggtgatttccctagataatgtctaagggtggtttctcaactacactttcccaacttacactctatcgtttttcacatatacgcttcctaaactaataaacgatacgttataaaaacagtacatattgatattaatagattttttaaaaaaaaatctatagaaaagatatatttttttaagtttttagctaatactgtgctaatccatcattccgttttacgtgttggataagaagggtacctaattccttcaaacgaacacagcctttaggccccctttgaatcaaaggaaaaaccataggaattctagagtattttatcctatgggaaataatcttatagagtcctttgaaacaaaggattgtttcctatcaattactttgaaattcctatggaatgaatcttactagagcaattttggaggaaaataagcatgaggtctcacctcatgttttcctcttcatgtgtctaagattcctgcgtttttcctatgtgctaatcaaacgacagtttgaagactttcttgtgcttcaaaatcccataggaatccaataagtatggcattcaattcctacatttttcctattcctatgttttttcaatcctgcgattcaaagggtccctaaatctctccaccctcggaccgggatccatctgtccgtggaggatccaaaggccagaacggcggcatcaacggctagcacgaagacattgacatgagcaccacaaactctaactccttgaaacggcttaggtcaacggtagaggggagcaaacatcgccagctgttccttgaaacggcggcccaataggttaatcgtgatagcgtttacctcttgttccattccctatacatgttttttgaccagactcaggtaactcatggtagtactcatctcgtcattaacttgccgcacagcaatctaccagggcaggctgcaaaattatgctggtgattttagatgtatactacttccaccccaaaaatataccaaatacatagccaggatccctacattttcggacgaaggtagcatgtattaacactaggtggtctataaaggaaactgacagaaaatagaagaaatatataataccattacaaatcgacaatcgcatacatatattgcagtacatggttagctggggaagcttgtgaaatagaactggttaaatggacttacattacatgtcactggaagaaacaaaaagattaagatttaaaaaaaaaaacagtttctgccagatccaaagacttcagttttgcagcaaattaacaagtcagcatctttggtggagttgccagaaaaaactcaagtctgcagaagggcatagttctgagcaatgtacattccatgactatggggtttacaggagtaacattcagtctaattatttaagacgtgaccacgtgaatgatcaggattaacattacacattacctagtggaagctacaatttatctgaggatgagaaaaaggggaaatgattatgtacatctcagccattacatatatctaaaatatcaggggacaaccaatatagaccgaatccgttaaaagccggttgttattactggttttcgccaggttgagccttttctcacattcctcagatggtcaggattcaggaaccctccagcatgaaacaaggtaattaataactttgcccatcttgcaagtctgtcaaacttagaatattctcaacgcatggaccattgcatttttcacctcatctcactgaagctgagacctgctactgctttcaggccagtggaagctaggtgcactgttgtattgagacaaatcgaatgaaatagtctccacctagaaagcaaacacaattttgaaaaaaaaaagtgagaagggttttatctacatcagatccaccaatacagaaagaacagataaggagaaaaacatgggatgtgtatatttgatcttactccataagggaaggtttcgtgtgcaccagtagatgtcaatggccatccctcattaacttgattatgctgcacctaatgagaaaaacttcaatattagacgaccacaaggaaaaaatttcaactaactcagcggatcttattacaatacatacatttgtggcgtcagttatgctttcggttgtggtgactgccgtgtttaaggtatttgccatggcattccttctcttgttatatgctcttttagttttcttcttcaaggtgtcaagaacattcggggttgccagtttcttcttgcgggaacgttttgactgaccttgtacaacatcccatccttttgtactaagagaaatgggcaaagtgtcatcattaaaatcctcattcactggattgtatgcaaaatttgcggttgaaacatgactatcaaccctctgatctcttagtgacttctcataagaaatcactttatcccttatctccctcatgattgataaagcatagccctttgattctgagttcacagaaccaaattccactacttctgtgaaatattggtgagtgagtttgtagagatcatcatagcctcctgtttcctgattacttaatgatacaggctgtgacatggaagaacaagtttgtttacaatccttgcaccagcgatggatgatgtattttggtggaatcattggtacaaactcctgcctcagtacagtaagagcatgcctgcataatatacctttgaattggaacaatcggcagagacacaatatgtcatcttcgacattatcataagcaactttgtagtccaccttctttgtttcatcaatgtgatctgaaactatgtatgtaaccactgattcattccggtcaagtatactataattgcaatgaaaagaatgcccgatttcatctaagaacttctgaaatatctccaatgtgtacatctttgctgcttgctcctccacagatacaccagtcatcaccggtggcctcatctgagatgaccgtaaatcctcatagttttccttttctaacttaactttcacagcagactcatactgctcaacaaacatttttacagaggtatctggcatcaaccagccatcaaaatagtcagatgcactatcacttctttctgtaatagacattcctgcccaaaaggaatccttcacataaacaggagcccactgtgtcctgacctcaaatagtttggacaaccattcgtttccctctagatgaaattgttcgaccatttcttgccaatctttgtcaaaatcaggcatggtaatggaatcaaaggctagtgagctaaatgcagaaactatttcatccttcttttctgtttcctccaacttttcaggaagctcatttaagatgtcgagaaggcaaaagcggtaacgtgcattagggaaaacctttttaacagctattgcaacatcatgacagtagtttgtaattactgaaggtggtggcgtgctgttcatacatcttacccatgtatcaaaaagccagacgtaagctccaagagatctaccagcaagaagaccacaccctagtaatacttgctgagcatggtggttagtgcccacaaatgacacaaactgtatttcatattggtcgctaaagtttctgacattaatagcaacaacatcaccaaagtaattgtaagaagaacgtgatttggcatcagcccaaaatacattccttagttgtccttgctcattcatatccaaactgtaaaagaagtacggattttggtcttgcattttgttgagaaaactcaataaggcatctagatcaccttcagcaagcttcagtttcctatttctatctatcttggtcctgaattcaatctgggtagacaaaggtatgccgctatcaccgcctctgctagaaagcgcagcagctgagctactgtctggtgcttcaagcataagaggtggattctgaaggaaaggagagttctttagctgcttcttaaatttaagtaagctaggatccaacggatggttatgttccaactctagaacaataacttcccagcggttttgaaaatgagcatccttaacaatcatcttagccttgcatccagtctttgtgcctcgttttcttgcggatctcgtcgcgccagacctcagtctagactgccctcctttagagcatatgaatgtagagcgatagcggaaaccatcgaaggtattgttcgatcttcttgtgataccaaaaccagagcggcagccgtaagacacatagaactgaaaggcgtcttcctccgactcaaacaccatccctacttttggtacaaacgcgggatctatatcaaccggcttgaagatatcaccctcggcaacatttccttgtttctcaccatcatcttcttgcatgtcttcctcattagacgattccgtattgtactcctcctcttccattggccccaaataatctagtcaggcagaaaatagaggaaataaatcatgccctgtgtacatacatatccttgacaaaagaatggtggccactaacagaacactctgcgcgtcatcatcacatacgaaggtaaataaactgataagcggaaacagtttataaaacaaagcttcctaggctttgcaacacccagtgcaaatttccaactctactgacagtggcggatctaacatgggacattgggggttcagttgaaccccccaaaccttcttaggaaccatcaaacagttactagtattaaggttaaggcaaatttctagagcagaagctagggttaacgcaaattcgagaaaaaaagtgcgtgggtagagagagagagatgggaaagaggatgtgcgtaacggatgcggcggaagcagcaggacgagcgacggcgacccagctcgctcgctcgctcgcacgcgcgattggatggggatcggcggtggcggaggatgtgctcaccaggatgcagcaggatgaatgacggcgccctgctcgctcgcgggatggatggggatcgccggagccggagccggaggcggcagcggtgggcaagagcaaactaaagaggaggggtcgtcaggataagggttaaggcagtgttcttccccataaattgcacccacggtgcaacaacttgtcaggtgggtacaaataatttttaaaagttactttaaaaatcatatcaatctatgttttaatttttttaattaatacttaattaatcacgtgttaataggcaacaccgattttcgtgtgtggaggtggagtcgaactcagcctaattagatccatgtcattataaatttgctgttttagaaaaatagcattactatttacgaaattagaaacatgccattacaatttaataggtcttcgagatatactactgcttaccccttcaccatgctttctaattttttcggaccaaattatcctcgcgttcttcctcttctcatttctctctctcatctcacccctcttctctcttccattggtcaacgccatttctccgtcgatgagctccattgggagatggatatggagggtggcggaaggcggggctgcaggaat

SEQ ID NO: 62042 - DNA, 3300 bp, Oryza sativa
ctcgcgcacgatggttgtcttttgctgaggttgggctattttggatctggtagtcaaagagctcgactgtgcttcctcgccgagctccaccgtccccgacatccgcagccagcccgcttggcggagccgacgacctctggaaaaaatttcagttgctacagtttggttaccggccacactttatcatagtttgtcatagacaagtttgatcaacttaacaattgtttggttgaagccacactttgtggcagggttccaaaaaaaaaactaagtctcataaatcaatgattttagaaaagtatggcaaaatcccccttagctaaggtgtagcggtgaaatttgatcaattttttgttatacattgtggctaagtgtggcaggcaacacacaccacctcaagtgccaaaaacgccaaactaaattgtgtgtccatgctaaagaagtggaagactttcgtgctagtttctcatattttcattcggttacattgtacatctaagagacaatgctcccattatttttagatcatttataggattattgccactaattatttactccacctatttaaaaatatgtttcttaaaatactcttttctattagattactagaccacctgttctaagccaatttttaagttactttaaaaaaataatttgtagctgtaattaagtagataatccgtagcaataatttgttaaataatatgtttaaatgggccaattctaaataccctcatcatagtgcacttgaaaggtatccaaaactgacgctggaatggctctttgacaaagtttttttaattgttggctcaagaggtgagttatctagaggaataaataagatattgtttcatacgccactaatgttcttatctcaatactgggcaatgatggaaataacttggaatacttctatgtgaatataaatgatgatgatcgaggcccataaccagcaccaaggaggatgctttatggaaaaattattatcggtaacttggaacttctagaagcagagaaatgagttgatttttatcaaaagataccttattctccttcttgaatcattgtactgttattgttttaagtttctaataaaatactccctccatcccaaaaataaccaattagccaggaattggttctttttgggacggagggagtatatcctaacagtcaatggcggagacaagcctgagatagttagagcttgagccctaggtttgtatcctagactcctgtttaaatctttaaagcattggtgagaattttgaaaatataaggtgtatatataagtcgaaccctactcctacagagtttctggctccgcccatgctgacaacggggcttcctttgctcggttctcaaagaaaatattcttagctcaataaaatgttataaacatataattaaatgccaacgcagatctccttaaaagcttattgtgaagctattgcccaaatgttaaaaaagatagtttgcttttgaaagatcaattagatgccatgtcaattgaaagtgcacttataaccttgacatcttgatcattataaccttgacatcttgatcactccaagcagctatgcctatgcagaggttatcctctgattttgtggccatatgccccctttacctttttgtttttcgctgttgcagttttgtttcacactgccagcctgggcccaccccgatccctctcgtctacctcgagctgaccctgttggtactcgtatcgtcgggtttctgaattctgatggttgaggtcaatttccctgaaaccaaatttgttggcacaacaaaaccgacgacagcatttggtcatgagataacatcatagtcattcaaaacgcaccacacgtgtcatcttccatttcataatcaatgacaactacagttcatatagattacatgttcttcctttcacacgaaattcgaatcctatttagtactaacagagatcacatatcattccctgaaaccaaaaaacagaggaagacattgacatatggtctacgaatatgattcctacaagcttctgcacttattagtagtagaatatgattcctagttcctacaagcttctgcactaattagtagtagaacgcagtccttgtaccatgactgataaagatacgtttttcatgtgtaatttctgaaaaataatacttcctccgtttcacaatgtaagtcattctagcattttccacattatctagattcattaacatcaatatgaatgtagaaaatgctaggatgacttacattgtgaaacggagggagtagtagaattgagatgcagcagcacacagatagaataagagttttgttgagttcatcagttcctagtgtaccccagccttgcagcaactgaaactttcttgaaagaaacagaattgtaactgaaactttcttgaaacagaattgtttagttcaccaagattcagaactttggatttcctttagcaacagaacagagaattgtgaatttctgattgtgatctgaacacttggctcaacagaaccaatggaggcatttggtcatgagattacagagacaaaaagattgctcaagtacaaaaaagatgttatcttttattcataatcaatgatttatacaattcatagattacatgttcttctttccagttaaagaattcatcatcctatctaatctaagagatcacggtgccttccatgagaccaaaaaagaagaggaagacaagagacctagtctgataatcttgattcctacactagcttcttgcaatagttagtaaattactaaattagtgcactatatactaataatcacaatgccaagaaatcttcagcagcggcggcggcggcgttccggccaccggccgccgcagaactcgcagtgctattcggcggccttcctcttgcggccgccggagcaggacggggaggcggaggccgacgagctggaggacggcgaccccgactccgagcgacgggaaggctcgggggagcggaagatcttgcagagcacgagctcggcgacgccctcgccgccgtgttcctgggcgacgccctcgccgtcgtgttcctgggcgacgccgtactccaccatcatccatcggggcgccacgacgcccgccgccgtcctctccttgtacctgaacctctggcagtacccgcctccctccaccgccttcttggcgcccatcgagcaccaccgcttgccgccgccgccgccgaccgcgcgcgacgccgccctcttggatccggcgcgggcgcgggcgcgggcgcgggggcgcacgctgaaaaagtaccacgcct

SEQ ID NO: 62043 - DNA, 1988 bp, Oryza sativa
ctggtgggggtgcgcaggcgccgccgctaacacactggcgcaggcaagccaggtggtgacaacacatggtattttggttatttggacaaaaaaaaatatacagtactaaagaaggctaaccggatgatgatggtaattatagaagttaagtaaaagttgatggtttattatagaatgtgataaagtcagtggcaaatcgtagacatgtgaaaaactcagtggcatataatagattctttctggaaataactatgagcaacactaacactacagtgtataagaatcacccttgtaatttccatcatttaaagccttgaactagatataagagaggcaaaaaggaagctacattaagtcttaagctcttgattctcttagattattcaactttgaagaagtatttagtagcaaatagaaggaaatacaatggatgtaacaaagatttagtggattttgaatagagcatcgcaaattgaagtcaagatgattagagatcaataaaatcagtctcttcatctctgcatgcaacaaaagggaggcatatacgatgttgtcaaagctcgtcttaagagaagagagaatgagtaaggaatagaaggcaaattagcaatagcgaaggaagccaattcgtcactatgagaagtactacgagtgtgatggaaaggatgaaacaacactccactccttaatcccgactccttcatgattgcaccagacgatgacatcatgttcgatgggctaacatggccacttgtctttttctttagttactaccaatttctatcaaattaaactaggtgaatattattgttatgcatataggctaaaggtccatcccttacaaggcttaaaaaattgcctacccagaccggccatggtacaatccataagcctttaccattgaacatctacgactacctccgtcccataataattgtatttttaggattcaaatgtgtcccaaaataattatcgtaatagagtacgccctctgtcatagaatataagaatttttagggtttgacacaggtattaagaaagtaggtagaactaaatgggagaatgttgtgattggttgagaaatgtgggtatgtgagaaaataaaatgccggagagttgttattggttgagaaaaagagaatgttggtgaagaagaagttatattttgggacgagagtactaattaccccattaatcactttttgttgaaatttctctctattctaccctctaccactctctcacttttacctatacactatttaataaaggatatcatagtctttgttatcaaatcttaataactaaacaatttagaatacctcagaatttttagatatttaaccatttgccacatttagatgtggcaattaactttttgccacacatgttatagacacgtgtggacccacatgttattgagataggggtggcaaatagttatttgccaaatttaaaagtagcaaatagttaaaagccccaagaattttaccctcaactatccattcccctctccccaatttaccatacacacatggatgtagataggctacaaccaaagcaacacccatccatcacatcaccacatcaccaacaatggcatcactgctcaactcatcaccatcctccccttgcgaacccacacacgcgcgcccacagccgcggcgcccgcacccgatccccatccccgcaaaccctccccccacttctcccttcctccaaaccctagctcacgctctcatgtccaccgccgcggacccctcctccctctccggcgactcctccccgacctcctccggcgacgccgaatcctcctcctccccgtcctcctccgccgccgccgctgggggctccgacgaccccgcccccgtcgaccaagtcgtcgcctcgggctccggtgcaggcggcgatggcgacgccgccgcagccgtcccaacctcgccgcgcattggcatgtacttcgagacggaggaggacgcgtacgagtt

SEQ ID NO: 62044 - DNA, 2062 bp, Oryza sativa
attcctgcagccctgatgcactagatggatcagctacgtgagctgtaggaagtttgaatctgttggaattcagtgctgtcatgtactaaaggtacttgatctcaagaatataaaggaactcccagaacaatacattttgaggagatggagaaaagacgctcgttctgtcagaataggggaagaaccttctggtggatctagcagtatgcgttcagcctcagaagtccgcttcagtactatgtgccgttttcttagcttgatagcttcaagggctgccagatctgaggaggcaacgtcttatatcgaaagtcaatcaagtgttcttctgaagcatctagatgatattttacaaacaggttatcctgatataggaaatcatgttgttgcttcaagtagtcaaccaatttcttttgtgggaaaccaacttcctgaccatacatcacaagcaagaggagttccacagaccacaaatggtataaatttgaacatttctgccaaaatcatttattactgatttcaagtttttaacggaagtgatgaccttgtaggcctgatgggggtttgacagagcaattgcagtccagaccatactggctactatggtacgtatgatgtagctattttcgattactttttacatgccagaaatgtactgtactttgtggtatgtagcaatttgtacatgacttgaaccataacttgacatgttaagtagtactcgtggttctgaagggcataattatggagttgggggttcaagcattaaaattctttttttttttaatctactgatctagtcccatactcccatgccatgtgtccaatcaatagtaagtcttggtaattctctatttcaggaaaatgatttggtaacagcataacacagatgctatttgtacttgatgcctccaaccactgacatatatgccagtatatatgggtttatggtgggcactcagatgtttgatgcgtataggaatgatgctatattactatttgagaagtttttccttttaattgggcataattgtccaaaaactcttctcaacaagaaaatttaactctattagttttagtatttttgtgctttctggctaactcctttttgtactttctgttatatcggattaacattgttgcttgtttgcacttctgaaactactgagtgtttcggctattacacttgacttttgcatgttagagcttatgttaagtttccatgtgtcaatttcttattgttgatgagtacttctttggaagtactgataattggcttgtttcttaacttttaggtctgacatcattgttggggatttcaacggttgatgagtttgtaaaatccagcagacaattgggattgaccagtgggttctttgtagtgttagtcaaatgcaggagtatggctaggctatgtacagtatttatctggtaccatgttgatgcaagcaagtgtattctgtagatcctgtctttctcaaattatactttggtagctgttctgctaaatataaccaatcctgatgtctctgtgctttagcattttgccatggccttttatgattgttcaattatctggattagaaaaaagagcagtagtgttttttttatgaccgttgcaattgaaagggacaagggatgataaatttctcatgacaacttatccttccgtgttcaaatttattgatatatctgcaggcagtcacagcctcacaaattacaacaaatactttgaatatacattaccagaaaacaagggaataatgaaatattatgaatacatttgcattggtagaatttttcttttaattttatatagctactgcagctgtacttggaccccagaatcatatgtggcccctgccgtccagttctggggtactatgttcgtcggaactagccatgtgtcaccaccacggggagctccgctactaaataacatccttatagacagaggcccacttggtggagagacagcagcccacactgcaccatgagtccggctcataagttggcatgtcaaattcacagtctgcatcaagtcatgaacaggtatttagtacta

SEQ ID NO: 62045 - DNA, 1501 bp, Oryza sativa
attcctgcagccttgatctgtacatctacaattacaaatttatgttgtttactgtatagtgtttcactttacctcacaaagctggaccgcaatgatgtcctggttgccttgctggtaccagatctcaaattcaagatagttggggaaattgctgctctcagtaatcttgaaaacgatattcttgtttgggtaggtacaagaaaccctgtagtgtagaggaaaccagaaccatgacatgtcagtaacagcacatgcgtccataattccttatgcagatattgtttctatagtagttttcattttatttttcatctaagaaaacaaatagttatgccgttcaatcaagaattttggcagattaattatatgcgcagacctcctgtactcaatcccaaccacgccaagggttagcagcgctgtaccagcatctgtactctgcgccatcctggtgaaagcatgctggctgaggatgaaatcagtgccatcactcgccccagagtcggtgatcacaattgtgacgccatttggagagcaatagtaaggattcgtgcacctcacctattggtaattggcattgttggtaaaaatgaaaggatttttttttaatgattcacacagcctagtcatacagatggattacctggtagcatgcaccacagcctaccccatccctgtagaggcttgctgaagctgaaacatcaccattgttgagtgttgccccaaatgcgccatactcacatgcaccgtctagaagtacaattagaaacaagtacaatttctatgagctagcttagaaactttatgcatttccgagtttaagtataatttaacttcctttttttgggttcatgtgaggtatgctaacccaattgaagtaattttatctgaaaggtacttactttcggtcccttttatatcagagttggggtaatatgctgctctcgacacagtgaagtttgcatctgcagtagccttagagaggaacaagatgagagaaagtatgactgggagatgccgacgaagcagctgagccattggtggtttggaccgtggagacgcgtacaaagccttaagagatgcggtgcatgcaataggagaggtgaaacaagccaagtagttctatttgatgttgatcttgcctcagaggttgttatgtatttatagtgttgatattgcctggctgtttgctatccttaggttgctgatgagtttacgagctggaatttttttttattttttatttttatttttattttttggttttgaatgccaatgccgttgttgacaatgcttctctctgatgaatatgttcccccaagttgtgtgtttacacttttttcgctttctcaattgcaagaacatttttacattgttgttgtgtacttgtgtgtatgaaacttgctgtttgtgttctagttagttatatcccttttccctcccatttcagttttcagcgtcttgttctggtaacagtgccgtactgatttgaaggtaggagtag

SEQ ID NO: 62046 - DNA, 729 bp, Oryza sativa
tcacggctgacagataactacaccaaagagcgagtgcagtgatgtatctttgcgctacggttcccatcataccaccatgccggaggctcacacgggtcatgagaaatttgagcaaacgatggaagaaatcagtgaaaactgaaaactggaaggaagggggtaagttggaagagaaattgagtggtggttttttttttacctattgagttgtagaggggagagtgaaaatacatgtgacttgtagagggttatttggacttttcccataaaaattaagcttaagaaattttattatagttaactccaaatttggttgtaaattacaaatatgccctcgtaaccaattgttgtactaaaacacatgaatctgaaataatcatatagctctaagcttaatctgcgcaccatgcatcgggcgtaaagttaccatactatatggtgcatgagtatacgacggcatgagctcaagcttgaagcactgtaagatcatacacaatgccatcttggcctcaagcaatgcgaagttttgacctatgcaaatacgtggcccccaaccgaatgggaggaacgcgcccggattcttggatgccttggagatcccctcaacgaacctatctggcttaaactcgtgggcatcactcccccagatgtttgggtcatggtgtatgagtaacaccgggagctcgacaatcacaccagccgggtaagtgacacctccgatctccattt

SEQ ID NO: 62047 - DNA, 12421 bp, Oryza sativa
atctcttcccttgcacggtcttgccactctgggtgcatgcttaggagcaggatagtccaggtgagtagcactgacgttgtctccattcccgcgaagtagaacaacttgcactcctcgatgacctcctcgattgtcaatccatggtttgattggccatcctcttccgtgtgtctcatgtttgactcaagcaacaaacccagtagatcatctttggtgcattcaccttctttcatagcttgcattcttttgtcaactagaccccgtaaaatcgaatcggtctctttctttatttgatgcatcttccggttgtttttagtaggcaaggacctgagatgaagaatatatcccaacacaatcataaacagggagaatcatcaaaaagaagatgaccaaactaaccctcaactcatactaaattattcggtatattaagtgctgaattctcacatgtaaccaggaatgacaatcttctgcatgcatttcaggagacgctcagtttgctcggcctgcagctggaagatccttcttccttcaagatagctacttccgaatgcagtgcgagaaatgacatctccggtgaggatctgcatctccggccagacatccacttcgtacgagccgtcagaaccaagggactccatccacttactgaccagctcctcacagcatgcagaaaatgccggaagcatgagctgcagagtatcattcgtacattatattccaatgcagagaggtgcagaaaaacagaaaaaataaatctatctaatactactagtaaaaatagtctgggtaggtaccttgagtttctcgagatggaaagccgggttaaggatcctcctgtgcttgacccacttctcgccttcgtggttggcgaggctatccgaaaacagcttcgtcagagtcgggaacttgggcttctcaaagtggccgaacttgttggacaggacgcccttggccaggtcggggtcggtgattgtcaccttcggcgtcgggccgaaccaggtgaagcacgcgctgccgtgctccctgacggcgttgtggaggaacggcgcgacgcgcggcgcgatgtcgtggcaccgcagcggcagcggcctcgcccaggcctccctgttcagccgcccgtgctccccgaggtcgccggtgaggaagcggtagcgcgtgccgcggaggccctgcgcgcgcagcgccagctccagacgccgcggccgccaccacaggctgtgcagcaggcggccggcctgccacaggagcaccaggcccaggacaccgtacgccaggaggctccatggcacggaggctggactcatcaaccaggctccaagaaccattgctggagtcagtctatgagtgcaagtgagtggagtgaaaaggagttgatgcaagtgtgctttgactactggaggtggatatggtatgtacggtgctgggggtgaggttaaatagaggtgtcacttgcttgacggggccaatcagcattgctagcatagcatcgatcctaggaggtaccttgctggtaaggaacttggttgagaagaaattccagggggaactgatactctgattggtcaaagtcctctcggatgggcgacgcactggacggctacccgccatgtgaggagtgcttcgcggctgcttcgttttgcttgatttttatttttcgagtggtcgttttgcttgattagtggttactgctacgcattggagaaaaacgaatatgcggtgaacagtgataattcgaatagggatattttctcccaaatacgaatacgaatatgatatcagggtttccgacgggtacggatatccggtgaacagtgctatttagatatccgctaaagccataagatataccacatttctttataactctatgtctttcaatgtacatttttagaatttagtagtaacatatctcttaacactagtcaacactattaatattatttaaacttttaaatatgtttataaattatactatattttatataaaacgagctaattatatatgatgatattcgtttctattagaagttgaggtggttttcgtgttttgataaaaaaatattgccatattcatatctgattatattcgatccttattcgtatttgagataatttgtatttgtttctgtatccaagccattcgtattcgtttttacacccggcaaaaaatatgaaagcgaatatggtatgataattgttcgtccatatctgctctgtttttatccctggttactattgtgaactgagtctaatatgacttgggccgcttgaaaatgggccacaggccatatgcaggtagtccaaccagaattttggagtccttggctactacctccatcgcataatggattaggttgttttagagaaagaaaaaaaaaggaaaagactattatgtccataattaaatgaggagtatttgaaaagtgggaggtaggttggggtaaagtgtggagaaatttgaatgagagttgttggagggaaaagtaatactacttagggaaaacatttggtaaagttgacaagtgttaagctatgggggttgttcactttgatgcttaaatcaatatttactaagtttttgtgaaaggaagattctagaattatcaaagtttaatagtggaggcaagtttttggtaatgtttggattgttaacttgtaaaattttggtaaagccaaaacttggtaaggtttattttggcaataaactaaacatcccctatgttttgtttcttttgtcatgtttttgaggaagattatagaattaccaaactttggtagtggaggtaagttttggcaatgtttggattgttaccttcctaaattttgagaaagctaaaacttggtatggttaattttggctataaagtgaacatacccttaatctcttacattttgtgacaaaaatttgaatttgaataccccaattctttatattatattatgaacggaggtagtatagtggagtaatgtgtatacctggactaattgctcgctgaggaaatgctcacataatcacattaggggaaaaaaacatacccgtccatctagcatatactccatctgtctcatacaataggacattttgacttttttaagtcgattttttaaaatttgatcaagtttaaggaaaaatataataacattctcaacatcaaacaaacatataatatcaaaatatatgttagattcaatgaaactaattaaatattgtagatgttgttaaacttttctataaacttaattagtcaaactaaaagaagtttgacaaggaaaaaatccaagtgtaaaacggagaggtatataccaagtcataatgaacggcagagatataaaatgtgagttccttgtaaactatcaagtagaataaaaattacaaattcacaacaggaacaaatagtagtaacttgccacctactttttcaaactccaatacaataattactctaaagttgaagtctttataagaaaaacgaattggataaagataaaattattttgagacaatggagtaccgaccaacttcagtaaatacaacaaaagttggaaggaaacatagaagattaaaacaatattttttgtgcaaattctaactacatatcgagtacaataggttgaatcattgaatgacaccacattaccacatcgatgatacttcacctaaattatctctaaatttgggtttagaataaaaggagaattgtttagaagttgtcaatcgaaaatcagttaggccataattgagaggttatgaaacaaacccttttttagattaatgttttatatgtcctgtcctggaatagatactaggaggtgtcacaaatgagtttgaaaaaagtttaagattgaaatatgtgatacaatctcagggattgcaaaataacccgagtgattaagtgtacgattgcataataaaacaaaagaaccaaaatttgcaaaaataaaataaaattttgttgtatatcctcaacaaacgtaaaaataagtggagtgattaagtgtacaatcgcaaacatatattcaattggctttctctagctctataaattttcacctcaccatattcaattatttgtttgctttatttttcacgctcatcagcacgtacaagttcccctgacatccacacatactataccgtgtcaacatacgtgcacctagttacatactaatgtatgtgattattgtgaaccatttttctgtgtcgatccatatattagcctatggaaaatcgaaaatgacatatatatatataagcggattcacgggtggccgctgctaccaaaaccagatgatcatagtcttgtgagtataatttgtgcaccatgctgcggatgtagcgtgacactggcgtaaggagcatgggtgtacgagggcgacaactgaaactcaaagttctgaagtatcacgcataacgccatcttggcctcaagcatcgcgaagttctggccaatgcagatcctcgggccccaaccgaacgggaagaacgcctgctgattggtcttggtcgccttggagatcccatccgcgaacctctctggcttaaactcatgggcatccttcccccacacatcggtgttgtggtgaatcaggattatgggcagctcaaggcccacaccagccgggtacgtgatgcccccaatctgaatctccttgaatgttcttcggctcaacgtgaccgccggcgggtacagcctgagcacctcatgcagtatcatcgtcacctgcaaaagataaacagagtatctaggcatcgtgagcaagttaacatgtgtactaccacttgtgatcaaatatggatgaagaaatatgttcaggttttgacaagcacttgccgttttcagtcggctcaagccgtcgaagttgggtttgtcgcggccgaacgcgctcaagacctcttccctggcgcggtgctgccattcggggtgcatggatagcacgacgagcgtccaggtgagcagcaccgacgtggtctccatgccggcgaagtagaacagcttgcactcctcgatcacgtcctccgtgctcatcctcaggttggacggctcaccgctgtccatgttggacttgagcatcagcccgagcaggtcgtcgccgctgagctcgccgttctcgacggcgcggctcctcttctcgatgatgcccctcaggagcccttctatctctcggctgttctccttcatcctcctgttgttttcagttggaaagtacctgcatgacacaggaacaggatagcaacaactaatgtcagagatacagacatacgtatactgtacgatgacaagtgacacacaggggacgggagcattggttaattaagctggttctcacaagtagcctgggatgtagatatactggatggtcttgatgattcgatcagcttgctcttcctgcagctggaagatccttcgcccttccatgaagctgctgccgaacgccgtccgggagatcacgtctccggtgaggttctgaaactcctgccagatgtctagctcgaacggtccatcagagccagctagtttactgtcccaacggtcgatcatctcgctgcagcacgtcgagaaagccggcaacatgtgctgaaaacatcaaattcagttcagtaagcatacacgcacacacacaggtattgaggtataaatcactccctgctagcttgtaacaactaacatatacagtatgtaccttgagcttttcgagatggaaagcagggttcaggatcctcctgtgcctcgcccatttctcgccttcgtagctcgcgagcccgagggcgatcaatttcccgagacttttgagggtgaatttctcgaagtggccaaacttgttggataggatgtccttcactagctctggctcagcgatgaccactctcggcgttgtgccgaaccaggtgatgcacacgttgcctacattcagttcagtgttctgtgccgtcagatagagctcgatgaacagcgtaaactgaacataacagcacgcgcatactttctgaagtatatatgaacttgtgttcactattcacgaaactggaaaagtcatagcaatagaggcatgcatggaggcatgtcaagatggattctaatagctcgagtggacgtccacccgtttattgcatgtcaactagatggctacgaaaagttttcaaaacaattgagaagatagatcaatatgtaatatatcaatccacaaacatgcaagttcaaatttaacttctacaaattataacaaaaataacaaaatgtagaagttgaattttaacttgcatgtttgtgaattgatatattacacattgatatatcttatttatatttttttaatttttttataactatttagatgatatgcaataaacgggtggacgtccactcgatctgttaaaacagtttcccttatgcatggagcttaccgtactccttgacgatgtcctgaaggagcggggccacccgggggacaatgtcgtggcacggcggcatgggcttagcccgcgcctccttgctgcgccgggcgttctccggtaggtcgccggcggggaaccggtacgcggtgccgcggagcccctgcccctggagcgcgccggcgacccgccgcggccccagccagcacctctccgccgcccggtagagcgcgcctagcacgagcagggccgggacgccgtagtagagcatgccccacggcgccgccgccggcttacctgcttccagtgagactcccacctccattcccgtggcctcctccattattaccggttccctagctagttggctgacttgttgagactgcgaccacagctgccaagagcgcgcagtgagtggtttctgttggtacgagtggcagacgcgcgagcgttttataggcatacgctttgcttggcgtcacatgtttttctccgtctttgtgaggtttcttggcggccacggtcatacatacgtgcctggattttttttcagctagcgcgattgcatcgacaaagtgtggcagatagccagtgtgtgatttgctagttagttgtttgctaacttgctgcagaagctgctagcattttggatttttggtgctgtaaagttagtaaataaatgtggatttgttgctttcgttcctctggagtaaataaaacggccggagagctcaaagatgttctgactctagctagagtgtacgacatcctgacgtgcgcagaaacgtaggcagtgccgggtaacggaccggggcccaacgtcccagtccattacttttttggcccatccggagtcctgtcctcctgcccctttaggcactggaataagttcatttgaggtcccttaatttgataacgagtttgattttcatccgtcaaccataataccagatacaacgggtccctcaagtgtcaaaaaggatacaaacaaggtctctcaatagtttggatagcggttttggctgccgtggcacctacgtggctggtttcacttagtcctcgtcctacgtggtggtaatgtggcattggaagcaaaatataaaaattaaaacaagaaatgtggggcatatatgtaagttagacaaaagataaaaaatagtgggacctctctctctccacggacgagcatgcacagaggcccagagagggtgaagggtggcggtcgatgtgccgaagccagccgagcgcgtggatagggaggaggcagggaggccaagcgagtgggcaggggagggaggaggttggcgaggggggggaggctgagagaggtaggagtaaccgccaccgcccttctcaacctggcgccgctttcttgagtggcacttgcaacccaatggcagcctcttcctcgagaggtttaacgcgatgccagagtcattggagtcatccttgatgctcccaccaatggcctgatgatgacccatgtgccccaccgcctgctcaccgagattgatggctggaggctgcggtcgtggaggagtccgacctcgggggccttcttcctcccctgccctctcgccgacctcccctcctcctccctctccacacacttggctagcttcggcttgccagcggagagagaaggacggcggtcggcggaggggcggcggccagcccttctcgctgttgaggtcgccccaagtgaaggggagcgggaagggcaagcacgcggcgaggtgtggaagggggcttaggtttcagtcctccggcggctagcgtcgccctcgtagcgaggtatgtcgagacgcacgatggccgccacccccaccctctccggctctctgcgcgcgctcgcctgtggaggtagagaggagggtggaaccataggtaccactatttttttatattttgtttgactgacatgtgggcccctttgtttttaatttttatattttgcttctagtgctacatcatcgccacgtaggacgaggaccaactcaaaccagccacatagatgtcacgtcagctaaaatcgccatccacactaccgagggaccttgtctgcattggttttgacaattgaggggcccgttgtatttggtatttgcggtgcagtaacgaaaatcaaactcgttatcaagttaagggacctcagatgaacttatttctatgttgaacctttccgctggcccgtgaactgggaagtagataggcctactagactgtttcaccttaggtatgtattttagcccgacccatctctctgtttcacttactaattccagttcactgaggcattgcgtttgcatagcatagcatcagggagaacctgtatagtagaaaaaaaattgtcactgtagtatagattcacggcgatttgcaatttgatttgcattttatataaacataactgtgtttttatgcttacagttattatagtatgcttgttggggtatattggtaaataatcgcataaaaaactaaacttttaattctaagtcataagatccattgttttacccacgcatgaaataaacaaacaagtatatctttttttctctaatggagggacgaacagtatgtactagttacacatgttaatatagtggttacaaaaatgtttgacagataaaaataatcactcattcataaggcacgtacgtagatggtccgaagtcccaacttaacctctaattgtttttttcccagaggaaaacctttcctaattctattaccagaaatgacgtttataacaaagtcaacatatcccaacttacctttcaaaaaaaaaaatttatcccaactcatgatagttacatttaaagtgggcgagccccagacatattctgagctcacacaaacaataattcaacaccacatggtgggtgccccttccttgattttcttctccaccaagttccttctgatcaaggtttagaccgcccaaggctttgaccaataatacactatcagaggcaaccaagaaagctagcaagcaacttccttgattaacatcgataaccttaaacaaatgagcacacgaagaccaactgtcccagcgacactcctatataatcggattcgaatgcgctgaattcacatgtacacaacaccgtatactgtcccttccggtcaaagtacactgcccgctgacagtgaccagagattctactccagcttgctactcattttcgagggtgttgatcatggatccgacctcggtgccatggagctccatggtgtacggtctcctggggctcgcgcttctgtggcaggtccaccggctgctggtgcggctgtggtggcagccgcggcggctggagcgggcgctgcgggcgcagggcgtccgtggcacgtcctaccgcttcctcaccggcgacctcaaggactacggccggctgagcaaggaggcatgggcgaggccgctgccgctgcggtgccacgacatcgcgccgcgcgtggcgccgttcgtgcaccggaccatcgcggagcacggcaaggcgtgcctctcctggttcggccccatccccaaggtgaccatcgccgacgccgagatagccaaggacgtgctgtccaacaagatgggccacttcgagaagctcaagttccccgtgctgtcgaagctgctcgccgacggcgtggccaactacgagggcgagaagtgggccaagcaccggcggatcctcaaccctgccttccatctcgagaagctcaaggtacacgaattaaattacagtacagttttgtgatatctatatattacagcacaagtatttaccgtgatagactgtgtgactgtttccttgagtaatgtatcatgtatgcttctgcagctcatgctgccggcgttttctgcgtgctgcgaagaactggtcggcagatgggcggcgtctcttggttctgacggttcgaatgagatcgatgtttggccggagatgcagagcctcaccggagatgtcatttctcgcaccgcattcggcagcagctaccttgaaggaagaaggattttccagttgcaggctgagcaacaggagcttttcatgggtgccattcagaagatctccattccaggctacatgtgagtttgtttttctctgttcatcaacactgatttagtggtttatgctccacgcctctattgtaacactaaccagaccttacagttatacataatttctatcgaaattaaatgtttgttattcagtactcgtagttcctctctgtactgaaaatctgaagcggtgtgccctttcaggtccttgcctaccaaaaacaaccgaaggatgtatcaaattaagaacgaggttgaatcaattatacgagatctggtccagaaaaggatgcatgctatgaaagatggcgagagaaccaaagatgatttgctcgggatattactagagtcaagcacgaggcatgcagacgagaatggacattcaggcccggggatgaccatcgaagaagtgatggaagagtgcaaagtgttctattttgcagggatggagacgacagcgatactcctcacatggaccatggttgtgctaagcatgcacccagaatggcagcaccgtgcaagggaggaggtcctaagcctatttcagaaaaacaaacttgattatgaaggcctgagcaaactcaaaacgtgagtaataaatgttgaaattaagtaacttttttaggaaatccatgtttaagttatcttttagatgtagagatgatattgaaattactaaatcacatggcaactagaggtaattaacctttggtacatacaggtgacgatgatactttacgaggttctccgcttgtacccgccgggaattgggtttgtccggcaaacatacaaggagatggagatcggtggcgtcaagtaccctgcaggcgtgatgatcgagctaccgttgttgttcatccaccatgacccagacatctgggggagcgatgtgaacgagttcaaaccggagaggttcgccgaggggatctccagggcgtccaacgatcatggcgcgttcttcccgtttggctggggcccgaggatctgcatgggccagaacttcgcgctgctcgaggccaagatggcgctgtgtatgattctccagcgcttcgagttcgagctagcgccgtcttacactcacgctccccatattgtgttgatgctgcgtccgatgcatggggcaccaattaagcttagggcaatctgatcgtcgatcttgtgatgttcatatcatgcattgtaggctttttttttaaaaaaaatggcatgtttggtttataccaatcaaccatgccaccaaaaaataatttagccatatcaataaattaattctccatttagtttgtaaagaaaaggtattgtcaaatatttggtttgattgaatcgacactttaaaaatatagcaaaacgaatattttgcaacttcatcaaaattgtactacctccattccaggttataagactttctagcatatgtgaatgtgggcaataccagaaagtcttataatattaaacagatgaagtataaattttatagtaaactaataatagcgtgaccaatcttaataaaattccgaaaacaatcccaaataggggcggacccagagaggttcccggtatgcaccggcatacccaaaaatcgcaaaaaaaaaaaaatcagcaggtagtatatgcatcagtgggctgaaacttgcctccatgaaccaaggcccaagatgcccacttttactgaacttgcacagcccatcaaaagtgccagtgcgcgtgatgcgttgatggggaactctagtctaaatctaatcgattatctcttcaggatagaaatttctagtaaggtgagccatggttgatgacttggcttatcggttccgatttgtattgtcttgtattgacacctcaataggcttatgatggcttgccttggttaccctccctcctaggaagtgttgattctagggttgtcttgtccaaaaagaattagaggcccatttaggatattgtcttgagtagtcctaagctggcttttgagttagttg

SEQ ID NO: 62048 - DNA, 1516 bp, Oryza sativa
  unsure (1)..(1516): unsure at all n locations
ccctttctcatttcagttctaggcggcagctccgttcttatccaactgtcatcggctccacctgttgccaatcccagttagcacagataaaaactaaataaacacattatcttctttcgtattccctccatctcaaaataaaacaacataagataatatgggacataatctagtataatgaatttaaacatatgcatatgtatgtctaaatttgttgtggtaggttatgtcctgttctattctagattattttattttaggatggagatagtataaggcccaaagatatcaatatcttgtattgcagaccatttagcccacggcttggacagcccattacctggcattgcttctagaacgtctaattacgcctagcttctagaatgtataattgcattattgtggggtaatccaaatcaatgcggttctccgatggagcagagccatacagtagttagcacgaatggcgtctcatgaatacgctccctaaaatgtaccagggtggcagggtgcccatccatgcgtcactccattgctgcacaagcgccgattccccgctgtccggcggctgcatgtctgcatgtgcgtagggatgaaaatggtttagaaagttttaacattccggacatattttcgaaaatggaaggtattggtcaaattttttcgaaaactttcagaaacaaaaacgaatttaaattttttttctcagaaacaaaaacgaatatgataaactactatcttcggaatctggaatccgttggaaatattctgaaaacgaattcggatcttttcggagtagtaaatgacagttgtttggcttcagccttctctgctctagtgtttacatttacatttatatatattgtgtattgaggtgtttagttaaatggagatatttttttagtccaatgctttagaatttttttgcctaatgaatatttttattaggtcatgacatactacttataattacaattatagataaatatatttctttttctccaaaaaattttctaagaaagtaaagtgtacaactaattgtattgctattaattgataaaaattagcaatattgatttattgttttagaaaaaaaaaaagagttgcanntttctttttcnngttgaatntntngnaaggaaaaangnnttttccttggnntttaaaggatttttatattttgttaccgtattcactcgttttcgtatttgatgatacagtatttgattatgttttcaaacttttggtttccaattctaatttcaattccaaaaaaagaatgtgaaaaagggaaacgatggagatgattttcgttcatttttgagccgttttcatcctagatgtgagcacgtgacaatgtacacggaaggagcctcttacgcaagcgcttgggtcatcctctcagcattgtggaacgcagacttggagccttccctacctgacgtaatgcatgacacaaaccgcccattaaagcggagtagtatatatgatgcaggcgagcgattcacttgttgac

SEQ ID NO: 62049 - DNA, 2385 bp, Oryza sativa
tatgttctagtgataaatcataaatggcaaaattgagatgtctttaaacattaaatataactaaaaaactgcaatataattcttggtaaatactatctctgaagtaccctatctagtttggctagtgaacactatgtaaacctattatgttgtattatactgttgaaggcattgtgagaaaacaagaacccaagggtacaagcaaaatgctgttgaatctagaataattgcacaaactgcagtgtttagtgtgtgtgaatatgtatattcaggtcaggatttccttcttgaccatgtgtactttgttttttcctccttaatgaaataacatgcagctctcctgtgttgttccaaaaacaaattgcagtgtttagtatttctcctatatgttcatgtgagaaaatccatagccaatcgtgcatttggagtggaaaggcggagtatttgttagatataaaacagcatacgctgagacgactgacactactctcacaaggtacaatcatttgagacttaaagtgtgtgaccaatttcttaagttgtacacatctgaataatattaagagttgtgtaactttattcaaaaggtgtatagaagaatagcatcttatacaggcagtcaggaacaatactgaatgtagggctgcaatcttgtaaaatgtggccatgtatgggtttttcacatcctatataatgtttctttcagtttgggatatggattcgtataatatcaaatacaaattacatgcagatagatttaatatgaatatggtcatgaatacatgtggatattatgcatgaacattccagaaatgttaagcacataatagaaatatacatcaatagtattgtaggaatttatgttggcaaatactgaaacaattgttccaaaatttataaatcatacgcatgtaaaatgtagcagacaaacagaatatcaaaagtacacttcaaaggtgtggcggcatggtgaggcagggactctcaaggtggcaacagcatgcaacaatgaaaaatggacaagagcggtagaaaatggggatagcgagttagaaacagaaccaataaaggcagccaaggtatctatcctctcagtaccatttttacctgtgttcagactcttattcttgcaaggttatatttgagtaccatggtatctattttcccagaaccacattcatatgttgagccctgcttgcttcagctaattcgctggcttataaaccaaaaattctaagccttaagtaacagacagctttaccacagggacttttaaaagccaaaaatcatgatagaactaataaccagaagaaaattatgactctacccttcaacttgtggctgaaatcttaaaagcctaagccaaaacaagaatgttttgagcaaaaatatatgaattcacctaatagcctccaaatccttcccagaaatcaaacccacatagatgcatgatcagattggttcagagttgatttcttccattatgtaaccttaaaagaatagggtgtatctaggttcagtagttttgtcttgactagcattgtggtttcacttcaaggcttcaagctacttcagcaatgttaagtcactatactttccatcacaaaatatgtcggtccaagtaattaccaacaacctatatgatcaatcagatcaaaatcaaactattatcaatgaagattaatatcactagcatgcagcttcattaggcatttccctccacctgttctattagacaaactgcaaagtagaaaacgattggccggctgcatgctgaaccaaatttcaagttacagctcacattggcatgcaagaagtattaaatccttactgattgtctaccagttccaactttaaatcagcactacagatgtcatagacttttcggtggtaattaaacggtattgtgagcactataatctacagataatgaatcattgcaacaggtagcagcatcatagttgcatgataatcacaacattgtttgtggaatggcaactcacctgtgcatcaggatcagagagcataagcgctttgagcgccgcaggcaagtcagcatcaaggcaggcggtggcagatatgtgatacagcttcgcagcaccaacagcagcgatcatccggacgtaagcactggggtccttgagcccagtggcgagcggcgagacaaggtactcgacgaggttgggaacgcggagggagcagaggctgcggagtgccaggccgcgtatggtggggtcctggtcgtggcagtcgcgctggaggaagttgatggtgaggagcgcgaggtccgggtggttgcgcgcgtggacgccgacgtagaggtagcacatcttcttcagcacgacgtcggaggtggcggagcagagcaccatctccccgaacgcc

SEQ ID NO: 62050 - DNA, 2369 bp, Oryza sativa
aacatttcgaaacggagggagtatgttcttaatattttgggggaaaaacatttgaagttgatgtaaaacaaaatgttgaggatgtatgttcatgtggaataatcatgtgcatatggttgacaagagctactgtctaattggaatgtgcgctttgattaagattgtcacctacacatgttgggtatagttttcagtctccttgcaccttttaatgggattgaaaacgtaactgcagggaaaccatcattcacttggtttggcccaacgccaagagtgatgatttcagaccctgaatcaataagggaagttatgtctaataagtttggccactatggcaaaccaaagcctacccgtctcggaaagttgctagcctccggagttgtaagctatgaaggcgagaaatgggcaaagcaccggagaattctgaatcctgcctttcaccacgagaaaataaaggtgaaattcattttatcacttttagattgcagcattccatatttcttattgggtaatgtaccaaagttggctaacaatgttgtctcgttcacagcggatgctgccagttttttctaactgctgcacggaaatggttacaagatgggagaattcaatgtctattgaaggaatgtcagaggtagatgtttggcctgagttccaaaatcttacaggagatgtcatatcaaagacagcattcggtagcagctatgaggaaggaaggagaatttttcagctgcaagcagagtcagccgaacgcataatacaagcctttcggacaatttttataccaggatattggtttgttctttcttcttacactataaaagaaatcatttggacatgcatatcaaatatcttacgaacaatcctatgagttatataatatctttatttagtacttatgtgatatattacagttgccgaaaaccgttgtcaaaaatgcccctctgaggattgtgaaattaaagtataaccttcagtcatgtttttagatacaggggaaaacaataatatgtgaaaaatcattcagaatatggcagtcattgccagttgacatgtgagccaagagtcagacaaaaagatatattcgatctttggtttagaagaaaattttgcagtctgagcacatgcaagttttcagataatagaaaacacacactgatgagaacaaaatgcagtttttcatttcttttgtttgatgaattagttctttaacagtccttttataaatgtatcaatggtacgacaattatgacttggaatataccaaaatatggtacatcctctaagtacttcggtactacttcggaaggtagaactaataatacatatcagtgcaatttgaatgattgcaagaagagtctacgtatacatttttttagactaagctaaatttatacagtagcaattgagagtttactcttgcatgattgaaaattttacaggttcttaccaactaaaaacaacagaaggttgagagaaattgaaagagaggtcagcaaacttctacgaggaataattggaaagagagagcgggctattaaaaatggtgaaaccagtaatggtgacttgttgggcttattggtggagtcaaatatgagggagtcaaatgggaaagcagaactaggaatgactacggacgaaattattgaggaatgcaagctattttattttgcaggaatggagacaacatcagtattgctcacttggacattaattgtgctaagtatgcacccagagtggcaagagcgagcaagagaagaagtgctacaccactttggaagaaccacaccagactatgatagcttaagtcgtctgaagattgtaagtataagatgaacactgttctcttattttgccaaatatgcaaaatgcagtctattaattaagacactaagtttgtactggatttgttttgatcagttacttatataaaatctgaaaatattgcgttgaaatgataactatttgtcaccaaaagtaacaggagcttatgccatgtattttccatatgcttctagaatgttttttttttccatacagttcagatgatgttattttaaagctttatcagttatcaccggtaataaaattgaggggggttgaattgccaatatatgtaagtgaataaaagattctgattgttagattaagcaaggatttatttgaagcaaatgcgttttaatttcagattaattaacaacagtcatgatctctgttttgttactgcaggtaacaatgattctgtacgaggttcttaggttgtatccgccagtggtgttcttgaccagacgaacatacaaggaaatggagctcggcggcatcaaatatcccgctgaagtgacccttatgttgcccattttatttattca

SEQ ID NO: 62051 - DNA, 10011 bp, Oryza sativa
ccttcagcggttctcctttgagctttcaccatcgtacatccacgcaccattcactgtgataactctccacccacagcatggtgcacaaattaagctgaagaaaatctaaccatgctgctcacttgctcggattggtcaaggagaaacaagtcagtttgataagttatatatctttctcttttgtaaacagaggtagtctacaggtttcgtattcgaactagaaagattttacttattgatatactagcttttatgcagataaaaacatggtgagtgaaataatattccgagtttttaatacaatacaagagtgatttttaggctcttgaggatgtatcatattttatagtgtaaaatttaatctctctaatacaatgacatatgaaaaatttgcattaaaaattttaataccttttgatacctctcgaaaacagtaaaatatatcacaacacaatcattacatagtgacaccagccattgtgaaaacagagcaggtcttctaggcaccggcaggtacgtcccacaggatttccaccaaatctgcggttcgcaagaacaaaaccccttctttgtgattgcttcaagtcttcaaccaactccgctgggcttcgacagacgactcaaaggtgcgagtgtttcggtctttcaaggtcatccaactaccgagactacgagctgatcattgttcgttacccattgtaatgacacagcttatcagctgtagggcaggctcctctcttatggccaataacatgaagagtttgcatctcgctggtgcattattgtacaccgttcccactcggggccatgaagaaaatggaataagtagatgaagcagagtaaagtccccttccctaacaacacaatccgttgtgccaccctaaaggcctaaagtacccttttgaattagtacttggcccttttgaattagtacttggcaaatcattttatatttttttggaatacgcaagcagcacatcattgtattaaaaagagtaaagtttatataaaaggaaaaccgaaaaaaaaaacaggaaggggacagggtacatgagatacaaagagattagggcctaatctccaatcagattctgcgagcgggggaacatgctaggcgtggttagttctgtcatcaccgcatttgttaggcgtcatagctcagcatcagcagccataccctttgccacttcgacccagggcttgtgatgctgattgaaaaccctgttattcctctccttccaaatcgtccaggcaaccagggctgcgatggtgtcgaatccccgtcggtgagccttgtcaaccttcatgcggttatcacaaagccacaagtggaaggatgcttcattgaatggcaggaaattgggcaatctaattgctctgagggcaaaccaccaccattgccatgattccggacaagcgaccagaagattattgatagtctcgttgcattgatcacaaaagacacatcgatcaaggtgtggcaagccgcgattgtggagctgatcggccatccaacatctattgagatccaccaaccacatgaagtaacgacatcgaggaggcgccaacgacctccaaatcggcttgtcctagaactgcaccctttccagttcccacaaacagagacaggtaggcggaatatgacgagtattcccctgaagactcccaccaccagatgagggaatcgggctccttggagaggtcatccaaggagtggattgcaggccacagattgagatattcgaggattgcctagacccctaaggcactggtgatgtccttgatccatcttctatcttgtagtggcaaatcattttctggtaggtttgggagtgttgtcttgcctgaatggaatactaaatagcctaataattcgaggtacaaacaaatgtattaagtaaaagaatggtttaaatgtaatattttaaataacttatatgtaacttttaaaaaaaatcacaccaatagagaacatgtatattcttattctattttattctcggggaaagaacacaccttaacagtttaggatttaagaagaccagctgaatacccgtgatatggagtacggatactcatacacttcaactatgcaaggaactgcagcagcggttgtcagcaaatagtgttctgctttcatatcagagattgagatttcagagtgccggatgcccggaacatggagcttccagtgtttatcagcaaatgtgttctgctttgatatcagagattcagaatgccggatgcacggatctatacagacgatttcatttcatttcatctttttttctttccctaacccgacgatcagagtcggcgcagcctaaccggaacgccgtgctgcgggtgcagcgtcagcacggtgtagggcgcgtgcgcgtacgccggcgacagctcgaacgcgaagcgctgcaggatcatgccgagcgccaccttggcctccagcagcgcgaagttctggccgatgcagatgcgcgggccccagctgaacgggaagaacgcgccggcgccggggtccttgcacgccctggccacgccctccgcgaacctccccgggtcgaactcgccggcgtcgtgcccccacgcggcggcgtcgcggtggatgaacagcacgggcagcgacagcatcacgcccgccgggtacctgacgccgccgagctcgatctccttgtacgtgcggcggttcatcatcaccaccggcgggtacaggcgcagcacctcgtgcagcaccatggtcacctgccaaagatcggctccatcgatcatcaaatcgtgaacatcttttgcagaaaacggtgcaaaaattgcgttacggggcagagtgcacaactcacgactttcaggcggctaacgccattgatatcaggtttgtttcgcccaaagacctgcagaatctcctccctggcgcgatcctgccactccgggtgcatgctcagggcaaccattgtccaggtgagcaacacggcggttgtctccatcccggcgaagtagaacagcttgcattcgtcgatgatctcctcgacggtcatccccttgctggatttgccgtcctcgtcgctgtaataatccatgttggattgtaggagcaagccgagcagatcgtccttgctggcttcgccgttcttcgtggccttctgcctcttttctattatgcctcttagaatactctttatctctctgtctattgccttcatccttctgttgttttctgtcggtaaaagactggagggagagtattatgttagttctatcatctatggatgaaacgaataagtggatacaaaatgaatttagtttttttctctacataaaagttggatatattcccgaaacaatgaaagttggacacaaataatggcaaatgtaaggagcactttttggtctttggtggtccatccatgtttttctcacaactattatgttgtcctgtatgtacttaattttctcttgatattgataaattcggcaaaacaaaaacaaaacaaagaaagattaggagcactctgaactttaggtagtgttttaaatatatactatgcaggtaaaagttgatggatgatccactcgtttgtaaagataaactacatattatatattataaaactaacaaataacttagaataagtggtgtcaacaatgcagtaaaagaaagtttattaagagcatttttagaagtgtgaaacaaataatccagttataaattactacttctttcaggttataaggctttctagcattaacatctatatgaatgtgggcaatgctagaaagtcttatgtagtaatatgaaacggaggaagtataatccaacagatgagttgaaaaaagaaaacggggactgaaactaaagatgttgggacagtgatgagaaccatacgataagcctgggatgtaattactccggaaagattgaacaaggcgttcagcttgctcggcctgaagtaggaaaatttgtctgccttcgtggtgtctgacaccaaatgctgctcttgaaataacatctcctgataaattctgaaaatctggccaaatgtccagctcggcttttccaacagaagcagcaaccgcattctcccatctgccaattagttcgctacaagatgcggagaatgctggcaacatccgctgcaattagttccaagggaatatataagtcagggaaaggggaaaaataccaggaaagtaagtgtaaccaaattgatctccagttctaatatgtttagttcgacctgtttagtgactgcaaagaatgcaggcattcatcagattaatttaacttctgatcaaatagctaggctaaacgatcgtcttactaaatgataattcttacacatgaaatcctgaatactaaatacagtagtcaggtctcatattcacgaattctttcagtaaatcctagtaataatacctttagcttttctgcatgaaaggctggattcataatcctcctatgtttgacccatttttcaccatgaaggatcacaagcccaccaacgagtaacttagaaagccgagtggccagctttgtcttctcaaagtgaccaaatttgttcgatagaacttcacggaccaagtccggatcagtgattgtaacccttggcattggcccgaaccatgtaaaagaaaccctacctgtattttcatgcgcacagagatcagaacatggtacaaagacactgaaaaaaacaagataattgatgatcaaatagtggcatttctagatcaactgtacgatgaacttaaagttgcataacaacaatcaaatcttggatgtgttcgccgaaaaacaaaacaaaagaaaacaaatattgcagaagtagagcgagtacagtaccgtgttcctccaaggcacggtgaagcagaggcgcgacgcgcgggatgaagtcgtggggccggtccatgggcacgggcttggagcgggccgccgtgacgagccgcaggtcctcggtgaggtcgccatggaggaagcggtactgggtgcccctcaggccctgggccctgagggcccgttccatccgccgcggggccagccaggcccactccagcatctgcgcggcccagaccagcagcagcgcggccaccgcgccgccgagcaggctccacggcgaggcctcgccgaatggtagcgccgcgccggtgccggtgccgatgccgatgccgatgccgatgccgatgccgatgcccattgcttctttttctctctgcatgtaccgagcaaagcaaatgtgttgttgaagcaaacgggacggagagatcagtacgtgtgtgcagagtgcagtgcagatatactaaccaattactaacaaagtaacaatcaatgattgccttctcctgttctccaacactaaaaagaaaatgatatcctaaaaccaaaaccggaaattagtgaccatcctgtcccacagaataactccgaaatcctatctgatactactgacgtcactgattacggtagtgaatcactccacgtgacggcgccacgtagccggaggtgaggtgaggtcacagcgcgacctccgccgcattgccacggtggaggaattcagcaagacacgtgtgtgcagtatgcatgcagatgcagtacctggtaccttgtacgcgggcgaggcgtcgccggcgtcggcgtggtcgacggtgctcaggttggagatcaacgaagggggaggccgagaccggccgaacgagcaggcggggaggctgggggctgccagccggtgagcgtttgggagaaaaggcgaatggcgccggcgccgccggagagatgggaagaaattaagatggggggaggatttggaaggatctcaaacagaaaagacgtggctaacataggtgtatctcttgcaggagcgggacaacgacatggggagcatgggcgccgctgcgcatgtcgacgcgacgcaagcgggggttcacgcatcttggcgtggttctacgtgcctcgggcggtggtacacgactggcgctttgaatggaggagaggatgtatggttgcaaatcccggagataccgcaccgcgcgatagggccggaggaaggagaagctgatccaaagacagaccccccaaaatgttcagtcatcagtgggcctggaacggaaaacatcttccggcccatcaaacaccccatgttgatgcacacaggctataaccaacgaggcccatggatgcgtaaggtttagctgaagttttgatttctgggctaaaccttctgcttcagacgttctgatttctcaagctgacgctcgaacattgtgtttttttcttttaagaaaagaacatttgtgtcattttacttttttttaaaaaaaatacatacagagatgggcatgtcgcctacgtggcaccgtcccaccaccattacactgtcctccacctcactcattgcactcacagtcgtcgtccatctgacccttccctccaaaaaaaggtcggctatgaccctatccaagagctactggtgccgtcctcgaaaagccaacaagagagtggaggtagcggcacccccaagaagagtgcatgaggaagacgaggctatgtcttttctaggagttcaccgcctatgcctattcataatcttgtgttctttggttgtttcttcaacttcatgcttaggttaatggatggatggggcaactggcagaggaggcacaatgtgtggggacaggaagaatatgacttgcttggttctatgcgataccttcatgtacattttttttgttggtaccagacttgatatgcaacaactggcctcgataccttgtgggtattaggtatgataccagtatcataggtaccaggtctggtacccaaagcatcaaatctgatacctcaggtatcaactttggctcctgacaagcgtggtgatcagatacggacatgcggtaggcatgagataatgcatggtaagaaatgcgaacacgtgggtgtgtaggggagcagttgatgggggtaaagactcgtcatgataatctatcccattaagaaacatgatatcaggggctagcactcttttttttaattgagaaacacagtttatatgagcacccatgaaagtctagacctacatattttgatattaataaagttatcatgagcgactcgctaccaacgtgtgcattacctacgactaaaacaataataaccgtaagtacacttgtggacattacttcacctttagaagacttgatgtttgtcggagtgcgaaactcctctagaggagaagcaaggcactccccctatatgaattcgtctaggatacaagttttgagctcgggtcctgatcacacgtgagaatgagcacaaacaagtatataggttcctagttcaaaaatcaacctcaggggcaaattcgatgcttttttaaacaaaaacaaatttaaaacagtaagttcgatcgaaatttcgttgaaatctcagttttcaacgtttcgcggggttccaaattaatcaatgatagcgtgaaccgatcagagcaccccaaagcatctttaccagtaatcaggcctccaaaacctattcacgcatatgctctccctgcagcctccaagggcgattgatatggatttatctggactgttaatcacaaaagtctgcatcatcagcatgcgcatcgcctatatacgcacctactgacctgacctgcaacctaggcatgcccgggcctcatttttctatccgcgacgaatcgcgcatgcgttccctgcagatgacagcgatctcccctctcctcctccttgacgaaaaaacaccgcggccgggggcgagaccgggagagggggggttttcagttcaccggagtcaaacaccggatcagcaaaggaaataaagtttggtgccatgtcgctctcggcaaaggaaacgcttgcctcctggaaggcacgcctgccacttcgagatcaatttttaaaaaaggtgttagactacgacttatacgctgtctacgcatgtcatgtatgaacaggttaatttttcttcatagaaattttacaacaaagtcgcctcgcgtactctcaccggtaaaagagaagaccagctctagcagggtaagcgtgttttctgtgttattaatggacttgctctagatcaatctcaactttaagaggacaaaaaaaagcatatggctgcggtaatatcatagtatcatataggagtattacatcatgcaggtgtcttagctttcttatttgttgttacatgaccttgcttatgtcgacacttcagtctgttatgtcgacactttggtctaaacacatcctgtgtactgtacagcggcgaccgtcctccccccttatatgtcaataacaccttaaataacagtacatgtgaaaaaagaaagtttacaacataaaagaaaagaaaaacaaatactccatttgtttgcaaatatttgtttgtttggactaaaaccagcattttttaagtttaagataaaaagtcggcaggaaaattaaaaggggtgagctcctatataacaaatgtatttttaactattatatttgaagtaaatagctttaaaagtatattgcagactattaagaaagtaattttggttacataattatataacctaaaaatttttgttgagtacagtaatcagtttaagtcaaactaaaaaaatatttacgaggaagggagtacaaatcaaaataaaatatgcagcaataaagatgaaagccccaaaaagaaagtcttgaaaaaatgtctcaaatcaaactttaaagctctgaacatcaatatcttataaacatctaggctatggtcagtgaaaatatggatgacaatgttagaaatctagttattatttagcatattttaatccaaaaattatagcataataaatatgacataataaatatgacatgtatgcaggcgagtgatccaaagctggtgctaacattaacatgctaacagagacaatagcatctagacatatgtttaacaccagagtgaggagaacatacccgcagaacgctctggattcagaggttgtggtgttgatgttgtcgttcccgattgagccgttgccgttccctccattgctattcctgtcgcagttgtcgttgacgtcgttttcgatactgatcgacatgatccggaggttgatgtagaggaagcatatatgacttgatgccgaggaagtagtgctgatgtgaagcagaggaagaagtagagcagtcgcgcgaagaacacgctcccaaaaattttatcgcccacctaaccgtgcatgtactctggtggacggaattctggaggtctactcgtcccaaatacccgtatgcgcaagtactcagaactaggaaacaaccataggagcacataagcagaggaggtgtctacacaagaagaaccaaaaactgaggtagatagaaccgagagagagctctctatctacctagaggtggaagataacgcaagagaaacattactacgttaatctcgattgattgcactataggcctcgtctgttaccggagtaatgaatcatgccggttatgcttttactcataaaaacaaaacggctgaaaacgagcagcccgtccgaacccgccgctttgacgccctggctggcttggcttggctcgagcgcacgcgtgtgacattcccaccaccatctcaaccgctcagtaggtattctctagtagtctatttaagttaagatcatttttcattggtttttaatgtggtattaatctcttaacattaattgtgagcccttgaaattacaagaattaatttgggcctatcccatttaattctaatagataagacggagatacataaataaagaaaaaacaatttatatgtaaaacattttatatgtgtattatcagtttaaaagtcaaggctaaaaactataatatggtgaaaataattcaaaaatcctattgtagaattgtgttttatattaaatatttagttgtgtccgataagtaaggcttagattggatgtgcaaaaattatatgcgtagatttatcttgaatagtacttttatggtgctataaattatatgtag

SEQ ID NO: 62052 - DNA, 2820 bp, Oryza sativa
atatagacagactctagtctcctcttctaatattcctttttttaattctgaatttcaactatttctaaattgtatttctatatggactctagtctcctcttctaatattccttattttttaattccgaatttcagctatatttaaattgtatttctatatggactctgtcttttctttttctccgattaatgtgagaatttctaggccatgagagcgaacttggaggttcctttttctattcctttaattatatatttaattccaaatttctttctaaattgtatttctatatggactctagtctcctcttctaatatttcttatttttaattccgaatttcagctatttttaaattgtatttctatatggactctgtattttctttttctccgattaatgtgagaatttctaggccatgagagcgaacgtggaggctcctttttctattccttaaattatatatttaattctgaatttctattttttcctaattgtatttctatatggactatatagtctacttctaatattccttatttttaattccgaatttcagttatttcctaattgtatttctatatggagtctatactctacttctaatatttcttatttttaattccgaatttcaggtattttctaattgtatttctatatggactctagtcccctcttctaatattccttattttttaatttcgaatttcaactatttctaaattgtatttctatatgtactctgtttttctttttctccgattaatatgagaatttctaggccgtgagagcgaacgtggaggctcatttttctattcctttcataagttaatagatagattccacacaaaaataccatattcagccattgacagatattgagccatattctatgaatgttatcaaactttcttccaagttgttggattgacagtgagagcatctaatcgacagatattgattggaaccatattctacggatgttatcaaactttctgtaacacacagggagctataactcttacgcaacgtaccttgatcatggcttcgtccccaaattgcgcacatgtacttgcatttattctttggacatgttatgtgccataatgtggaacaatattctattgcatgaatatgatccgcgtcattatcacaagaattgcgcacatgcctttgacacctcagcgaaattgtcacgatctttggacaagcatatagcagagcagcagtctagcagacaaaataattgagcattagtttaatttgtcttgtcataaaaaactggagctattgtcgcatatacccgtctttgtctacgtgtggttcgcctttcatcggcactatatgatgatatgaatagggggtgttattagtggactaattgtttattgatatttcattaaattggtgggccagttcctacttaattaatcgattgtgctgttcagatgctgtagcctgtagccctgtagccaatatccagtccagtggccgtatatgtatccaggccaggacccaactagcctccaacgtaggatggaaatgattttgcagagatgagagggggcgagatggaggagtgcggggttaagcaacaaaaagctgtttcggataatatattaaatgaaaaaacttgaattatagctaagactattgtggccgtacaaattacctctctcaataaaaaaaccaaatatcctttaccctcaactttttatatcggacaaattaccacctgacaaactccggagcggttttaatcgtacgtgacgacacgtgctgtctaaccaacaacaaaaaaaaaaggtaggactcacatgtcgtgaccgagagaagtgatggaactgacaataggccctcactattttttttattttcttatgatgactgggctgctacgtatgcgccacgtatgaccaaaaccgctccggagtcggacatgggagtaattcatctggtataaaaagttgagggtgaaaaacgtctggttttttaattgacgagggtagttcgtattgccacaataggtggggggaggtaatttggactttttcctatattaaaaaatctattttcagcctaaattttttttcatgttttgatgaggacatcacttcgtcggatacacacataattcacacgttctaatgataattccaagtccaagtccagttcagccttaagagacatcactgacttcaaacggacctagcgtcttcatgccaactctgatttgggtgatcttggacttcatggaaagattatctcgccacctttcaaatacatttggtctcatatccaaattcattccgagtcaacaggaatcatcaaaacaagacagtgttgttcctgaaaccgaatttgggccttgggctttgtaatagactaggcctatctcggaaatgtctccctccacctccacgaattaacactaaaccctagatctattttcctctttaaatgtctatgtacaccctctagaacaattgggttttgtttagttgaattttgccaagtgtcattcaccttgtctctaatcctcgctcgattagtcggtgactatagattcagagcccccaatagatggtgtgttgatttgccaggttgattagatctaccacttcaatcggaactattcatttgtacttaattacctattcgcattatttagattgcatcttatcttgttcttgcagtgttctctcgtttgcattgcagggatcatcaaccgcatgtcacggttggtacgacatcatttgtgctgtagcgattacacgacgtccttggcttgttccggtaggtagccacatcgtaaacgtcg

SEQ ID NO: 62053 - DNA, 15455 bp, Oryza sativa
ttggactatgaaatagtagcatattacgagcccaaaagacccatcaagtctaaccctaattcctcatctattcccttccctaaccttatcctcatttcccttcccaccccacctagccgtcacgcggatagcggaagacggcagcggcaccagccacacgcgggcagcgagccggtgacggcggccccgcgcgggcggcgacggcggccacgcgtggacagcggaagcagcagccatgcgcgggcggcgtcggcggcctcttgcgggcggcggcgtcgacgaccaggggcgcagccatctgcgtcggcgtcagcgacgcatccgcgacggcgacggcaagggctagcatcgcatccacggcggcggcggcggctagggagggcacatccgtggtggcggcggccagggaggcgcatccgcggcggtggcggcagtgacgcccagtccctagccacctgtctgtagctgtccctcgtcggcgtcgccgctgctatgcggctcctctcttgtcagtactcaatcgtcagtcgttagccgggtggtgtgggccccgctcacccatgggtcccctgcgggggcggggacgggtgatggttttcacccgaccatctctgcggggccggggtgtcgaagcccgaaactaatcaatgaattaatgtatcaatccctggatcagtaaatattgatacatacaatatacctggtttttcattgcatatgttaaagttttacaatactaagggttttacaataataggtactcatctaattgagtaactagaattaatacacagcggaagtttctatacattctgactagggaggtataacctttagaggttttctaaattatgggggtcatcgtagtaatagttataagggtcctcctcttgaccgaaatctgaaaaggggttataagagcaaggatgagtatttacaatgctcagcaagttatcatggaaatatgttatgcattagcatataggagggttctttgcaaaaagcaataataaacaatctggaagaattatatcaagaattcataaatatatagactttaaatttctaaccagggtaccatatgagtcccggtactcaactccatgagtacggctattcgaatagtttcaaagatattttattgcagcagatgtacgctttacccgcagtccacgacttgctgataatcgtcggctttagtcatggcctagtattaagtcattaacaattgtggcacctgttccatgaacttatatccttatatgctctgaacgtattgttaacagcagcaagaggagttctggcgttcccgagatatttaaggggaactgatcgtatgacaccacgtcatctcgatcagggtttagaaatataccatatagtttatactcgagtatcacaaaccatttacctgtacatggtaatggttaaagttgcccttcgcggctatagttgcctcttgcgcgaggacttaaaaataagaaccactatacagaggtgccatattgctaattaacataataactaggtttgtccccattctagaaactgcggtcgtacctgttcgttcgacataagtacctggtaaaacttatatcgatcgagacagtactagccacccggaaatcatccaaatcttacgtactgtgccaatctaagtataaggtattttaaccagattgtaagcaaagtaggcaatactaaaattatctgggtttctatgattgatttatgcatataaaatagaatattgaatagaaggctataaataaataatttgtaaaatataggtctaaatgatcaaaagttatatggtaacttgccttgctcgatgtcctgagattcattgatattatctattgagtcagaagaatcctcaagacctagggttagacatataaaaattcaaatttaaaagaaattcaaataaaatccaaaaataagaaaaatggagaaaatgaaataaaatgcaaaaatagaaaaaaggggctcaaaagatagagaatgattttagaagaatattcgtccaaatttcactggaattggatctatattttaaaagatatgggcttctaaagttttgaaaatcaaataaatgtgaaatagcactgtgtgcggatcccacctgtcagtctctctctctctctcttctcttcttctacctccggccattccccaaatcgggcgatggagggggaaagtggttgcggccgaggaggggagggagctagggttctccggcgacggcgagcggcggcggaggggttaatttggtttgtggttgagctaacggctaggacggcagtggcatagttaagccgtgaaggtgatcggggtgatgtgagtgagacatggctaggggagggctcctagagcatctacgaggtacttagatggattccagcagcttgccgatctttggcaaggtacggagaatacttgctgacgagcgcctccattggcagcggtcgtgctcacgtcggcagcccagagggcgacatgatagtgcaaagtgattgctaaaatagaatctagggagtatgtagatggttaaaacggaagaactcaccgagatcggttgaaacggaggattgcggccggaaaaacttctcgggggcgaagaacagagcagtgcgagggcggcggtgcttggcttggcgcggcgaggtaaaactcgacgcagggcttgggttagggtctaatatactataacatagttgatataaggtgttctaaggggtatttagggcggaagatggatggagggatgtggagtcgatcgcgcacaaggtgttcgaccgacgggcgattggtgaatcaaagcttcggggttgtggggctatggttgttgatgatcgatgatggacaaggaagggattggggtcctatttatagggctaggaggaacggatgagctcggacaccgtcatcgccatggatgagctcaaggattggatatggctggggcggcagaggctgtgagaggacgggcaagatcaatttgagtggcgggaggccacgtttgaatacttaccagcgaaggattggcttgaccgcgtggaaatcggctggcgacgtgttggcgccaatccgggcgcgatgcgcagtggcggcgagggtgaaaacggccgactcgggggtgaatggtttgaattgtgagaggggataccaccgtctatcttcaatccaaccgtgcggcaagaattggcgtgattcaccatgggtagaatcaaaatcggactcggcggcggctttggacgggcgcgcatggcgtcgagcggcgatttcttgcggctgtcgtcgtcctggctttgtcgtcgtcaagatttgtgcggcggcggcggtctgagggcgtcggacgggcgacgacgcgccaaggcggtcgggcacgcgcaagcggccccgaggccgatgcgcggcgacacggcgcgcggctaagtcggatgcccgggcggcgcgccaaggggaggagaaggccaactaaaccacagtttttgagtgggatgtgggccccaaggattcaacatagactttgcaaaggattggacagggattgggctgagttagttgggctaggcattctgccgaacaccttgaaggcaatgaacagtgaaattcagtaaatttgagtatttttttctagaaaagattgaatttgaactatgaatttggaagagttttactagggtttggagtgtagtgaatcctcactaatgttaaggtaaacttaaggaaataatctaaagtttgaaatttgagagaatttgctcaaatttactaaggtttggaataaagggaatatttagggtaaattagtagggttataaggaagtaacacttgaaccaattaagaaatcaaataaatttttaaacacactaatttaatcaaaagtcagcatgatgcagtcaaattttagtttaaaatttgaggatgttacacggggccgggaggagaagtcggggagcgggggcgggggcgttctggcccaacccgtacctgacccgccccgttgccaaccctatgtctacgtgagtgttcagtgcttcctttacggcccaattatggataatgggatatggtccatcattaatcatgttaactagttgggccgagatggaaaatgtgtctttggtctttcgtgggggataagtccactaaccatctctcatctttacgttatgtttaaccgacatacttaattgtaaaactagaaaggttcgttcaatcttggcaaaacagtctaaattagatctcatggaaatataaatagttggttttcattgatgtggcatcctagtaaaaaaagatagataaacaaagcatgtggggccacatgtcagtgtacaattctttcttctatctttttccccaactacacacgcagttcaagggtggcagctatggacgcagagacggtcggtgagcctgtcctagaaaagaagggaggtgaggggccgacaagcttatactcctcctctgcagtgcgcatagcgcgcaagcctgaccttagtgaccttgggtgtcactgtggcaccaacacgggagggccatgtcctgtgacacgcacagccgagaggaggatgccgaaaagtacgccaaggccaacgcccacaaggcctcccgcatcagcgcccaaggtcaccaaagttgagctcgcatgccggctccctcgcctccctcttctccttcacagtcgcccttggccagcgaagataggggggtagccagcgagctcgtccgcgggaggtgacaactgtggtgggaggttggcgatatgggggcttcaatggtccgtgatggggggcctccctggcaacgatgaggtagcaacacgccacgtcatctggttggcaggacgatggcttggagggtgaaccagtggagcatgaagaagtcgtcgaggtggcgcttgtggaggaacgtggtgtggacagtggcacatgtgatggaggagggggtggcagttggagtggagcgcgtggtacatgaggtcagcctcccgtccttggagggggacatgaatgcaaggatgttgttgtggagcacagagcgcgagtgacgggaggggctccacaaggtacaccgtgctagggggcggcgacgatgtggggtgcactgcggcaccgcgcttggtgggaggctatcgccaaggcggcgtcggctgttgaatagtcccacattggtcgtggaagggcaaatgacctaacatataagtgagggagccccttacctcaatggctagcttttggggtggaaaagactctttacgatcctacaattttggcatcagagcctagctagtttaacatctttggtccgatagacatagtgtgtgcaggcctgatggaccgtgggtgcctgcggggcccgtatacctaagggaccgtggtgaaacggtgaaggggcggtgaagggttgagggacaccaatatgtgaagggggagattgttgaatagttccacattgatcgtggaagggtaaaggacctaacatataagtgggggagcccctcacctcaatggctagcttttggggtgggaaaagccctttacaatcctacatcggcatgcacgagcgggaggagtgctggcacaagatggcgtgctgagagtggcttggacaacggcatctctcgtggcatgagccacttaaatatgtgctcccacatagtacttttttattttctccttgatgactaggatgccacatcaatgaaaccagccatccatattatcataggacgtaatttttgcaagttaggggatcaagatttctggtattacagtctaggcaacgattttaaactcgatgaaaatgagggacataaagtggacttgttccttctgtgggtagatttcattgttcaatgagtaaatacttgggccaatcaaaagcccatatctccttgaatttttatttccaacatccatacaagtgaagaaagcatcatttcatagggcatttcataggtacaccgtacgcaagtcacaagaaacaataagtatgttacgtgaccgaatatcacgaccagattagatcatcctaagcttcatctgcgcgccgtgcatgggatgcaacgtcatgacggtgtgcggtgcgtgggtgtaggacgcagcgagctcgaactcgaagcgctggaggatcatgcacaaggccatcttagcctcgagcagcgcgaagttctggccgatgcagacccgcggcccccagccaaacgggaggaacgcgccgcggtcgttggacgccctggagatcccctcggcgaacctctccggcctgaactcgtgcacgtctctgccccagatttcgcggtcgtggtggataaacagcacaggcagttcgaggatcacgcctctggggtacacgacgcccccgatctccatctccttgtacgtcttccggctgaagacgatcgccggcgggtacaaccgaagaacctcgtataaaaccatggtgacctgaaagcataaatgcagagaccgataaatcgatgtctgaattaattgtcgacactgacaacatgaaaggaaatacgatattcagtgtagtgttattgtttctccgagtacttaccgtcttgagtcggctgaggccttcgtactcaggtttgtccctcccaaacagaccaagaacctcctcccttgcacggtcttgccattccgggtgcatgctcagaacaaccatggtccatgtgagcagcactgacgttgtctccattcctgcgaagtagaacagcttgcactcctcgataacatcttcagttgtcatccctgggctggatcgtccattctcgtctgcgtgcctcatattggactcgagcagcaggcccagcagatcatcgttggtgctttcgccttccgcgatggcctgcatcctttttccaattattcctcgcagaatggattcaacctcactgttgatcctccgcatccttctgttctttttggtaggcaagtacctgcagtatagaaaatcattcaacttgacattaacaagttcgatttaagaagggaatagtcagtgaccaaaatgtagcctgctgtaacagcagagttaaacagagtatgcccgaggggaccatggaatttgttgctcacatgtaacccggaatgacgaacttctgaatggctcctatgaagagctcagcttgctcagtctgcagctggaagatcctccttccttcactgtagctgctgccgaatgccgtgcgagagatgacatctccggtgagactctgcatctccggccaaacatccagctcgcacgaaccgtcgggaccaagggaatccatccatttcccgacaagctcttcacagcacgtagaaaacgccggcagcatgagctacaaatcaacccataccgcattactatacaatcctacgatcaacctagcgtacgtacgtctgtacgagtgagacgctttcacgtgatgtaccttgagcttctcgagatggaacgcagggttcatgatcctcctgtgcttgacccacttctcaccgtcgtggctggtgaggccgtcggcgagaagcttggtaagtgccgggagcttgggcttctcgaagtggccgagcttgttggacagcacgtccctgacctgggcggggtcggtgatggtgacgctggggatggggccgaaccaggagaagcagcacggcctgccgttatcccgcacgttgcggtgcacgaacggggtgacccggggcacgatgtcgtggcagcccagcggcagcggcgccgacgaccacgcctcctcgttgagccggccgaactccctgaggtcgccgaggaggaaccggtacgcggtgccgcggagcccctgcgcgcgcagcgcgcgctccagccgccgcggccgccaccacagccggtcgagcaggcggccggcctgccacagaagcaccggcccgacgaggccgtacgccaggaggctccatggtggtggcagtgaggctcggctgaacaactctccaaaaaccattgctgtggactctgaatagcaagaagctgatgcaactggactagtacttaatttgaccggagaagtggggatggatgaggtacggatttcgcgccatgttatatagagttgtcactgggttgcattagtctcctgtgctaatttgtttatggtttcttggagtgtaaacaagactaacgaacatttgggccagctatgcccaaatgaacttggtggagaagaaattccaacccagaaatgccacgatcgggacgaccatgaggtgctgtgagcctgtgactactaataaaataaaagaactcatttacacacctcagaaatgttgaaattcagaaaaaaaatatttatgagttgaaaagaagatttgtatcagaactaaagtccatagcaccacaagaatgaaatttgaaataaaaaataacagaaatggaaacttcaattaatgggaactcagtccaattacgacggtatatttatttataagaaaaaaaataaaatgatcgatggggaaattataattgaatcagaatatactatattttttgaaaactcttttttcacatacaagttggtaactattattccgtatgaataattacattttaaaaaatattaattatataatagaaaaattgatttggacaaaaaaaatgtatttctgcttatataaattaaaaaaataactcaaataaatacatgtgtaaaactatgtattttaaagtgaaaattatgaaagaaaaactattagaataatctgttttttaaagctaaaacgattttggccaatacacatttaaaaatataaaagaacaataatgaaattttacgtgcttcttttaagatataaaagaagttcttgagcttgaattagattttttttttgttggacttaataagccgatcgaattggcttcttagttaggcttaacaagctaagccatctttgttgtcaaaacctaagcatgtattaggttcgtatagtttccgacaaaaataaacaattaataacctaattcttatgtattctcgacaaaaaggcctatcctatacaaataggattgtacaatcttttaccaactttgtatacaccagaataatctagactaatataaaaagcaccagttttctttttagtacacccacctattcttaatcgttagatcctctcatccaacgatccacatcgtgagttggattaacacaggaattagaactcaaactagaattagattaacgctcccacgcctcttcccgtcgcaaaatccccgcccacgtcgtcaaatcccacgccgcgcccttccctctcgctccaaaccgccaccgggcggcacccaccctcccgagtggccgactcccgacgcacctcctcgccggcgccccaccctcccgacgcccctccccgccgccgccgccgccgccgccagcggcgcctcccgctcggccccggccggcgagtcgcgtaggagggaagcgccaccggcggcggccggggcgagatgagcggcaggggaggtggcggcggcggggagcaggggacaacgccatcctctgctccacgactgagcaggggacgccgatgcccaatgccctcgcacgtcgctgacgaacgcccaaacttttaatctcctgctttcaacaggtaaacctgctaattaacaatgtggttcattaatatatgcatgcttgctatgtctttgacggaatgcttgcctaccagtctaccactgccaactttgaggtcaatttatgagccttgccatatgtatgctgtgctatctagatatcgtacattgaggttcccacgtgcagtgccaaataataattgttcttctaattcattaataatggttcttctaattcagtgcttaataggattcttataataatgttgcaaatttggaaggcaagaaatgatcttaaatttcagggggaaaaaatggagcctcctcaagtctgcatggcagctgaagctatgatcaacacttaaaataaaattctcttcttataattcaatacaagagaatttgcaggaagaacaaagggggaggggacctggaagactgccagacggaaccagatgttacatagatgcagcatgggaaaatggaatcacaggaatggaaattttctttcatatgccatctactcataatgccatttttcttaaagcctcctccgaggttccttgctcttccttgcaggctgagttaatggcgcttcaacttgctttggaggtgactgtcttcttaacattgaaggagtgactctcctctctgataattctaccattgtggaaacccttagaaaaggaagatttcaaacggagccaggtcattggagcttaagacctatttggagtcagatcgttgccacaattcctgaatctcttttgcaggtcatgtggattcctaggggcataaacaagttagctgaccaactagcaaaagaaaccaaatccagtgttaatacagcccctgtctatgtttgtcaaaatatatcgcatttggcttatcctaccagaagatgtcatgctaatgacattagagacaatttcaattccaggaactttgtaatccggcatgttctatgcttctaaataaagtgtttaaggttttttaaaaaaaaggatagattaaatcactttccttcacctgatttgcttataccatggccaactgaaagcactgctatttttcacctgatttgtactgaggtcacagcaaactagcaggcagcaggcttgttttgttggtaacattttgcttctatgaattatcatgtatgcatgaagtatttagatctaattatatgtttttgcctactgttattaatttattatgcttctgctgatgcggtttctgaggaggttgctctggcatccttcatgaattctccctgttgaattgtctgtacaatgcacatatgtattccacttttactaccgtgtattcccacaatttgtagcaaccttacgaaaataaagggcaaaaaagattaaatatggatgcagattttataaaagctaaatcatatctaaatattaatggccagttcgccaggccagcaagccatacatgcacagcaaactaaagcttttttataaagcaccatcactaatctctctcaatgcacagccaaaatgaaatctactcccttacagctagaataaactaagcattaatattttgttcatgacttaagtgttattccattcgatatatgcatttcctgaaggttttcatacagtaacatcactaatctttctcaatgtacggtcttttatacggtaacatcactaatctttctcaatgcacagccaacataaaatctactccattacaactggaataaacaaagcaccaatattttgttcatgacttagtgtcactccattcgatatatgtcgacatgtcttgcacctgcacgctaactagtacaataaaacagaggactgttatacatctcttatctgttgtccagttgatgtttgtgttcattaatccaaagatcagcagcgcagccactcatagcacttctgacccccccccccttttttttttgaaagtaatccaatgtgttaaaattcttatgctcgacaagaaatcatttataatagatagcttctagttttatttcaaaggtacaaatatcacaactcatatacaatagttgtactataatgaatacatgctgaaacgatcatacaactaccagaaaaaaactatcatatagctctaagcttaatctgtgcaccatgcgtagggcgcaaagttattatactttgtggtgcatgagtgtatgacagagcgagctcaagctccaagtgttgaagaatcatacacaacgccatcttggtctcaagcaatgcgaagttttggccaatacagattctcgggccccaactaaatggtaggaacgcgcctggatccttggatgccttggaaatcccctcagcgaacctctctggattaaacttgtgcacatcacttccccatatgtctgggtcactgtggatgagcagcaaggggagctcgatgatcacgccagcggggtaagtgacgcctccaatctcaatctgcttatatgtttgccgagtcaaggtcacggccggtggatacagccgaagaacctcgtagaggatcattgtcacctgcaccatatacgtacagatcaacgagttttaatttgtagtagttttacacagctacgaaattgttgacgtcaacctcatggtattatcgaatcccacaagatactcatgattttgaggcggctcagaccttcgtattcaggtttgtttttcccaaatagtcctaggatttcttcccttgcatggtcttgccactctgggtgcatgcttagcagcagcatggtccatgtgagtagcactgatgttgtctccattcctgcgaagtagaacagcttgcattcctcgatgacctcctcgatcgtcaacccttggcttgactgaccatgctctgccgtgtgtctcatgtttgactcgagcaacaggcccagtagatcatccttggtgctttcaccttctctcatagcttgcattcttttcccaattagaccccgtagaatcgaatcaatctctttctttatttgatgcatcttccggttgtttttagtaggtaaggacctgaaatgaaaaatccattcacatttttacaatgcgaactgattaaacaaggaggtgatatttcttaatgtcatacagtcatagataaattaacagttattttcttgtttgcaaatgtcatttgtaagtagtaaactcacatgtaacccggaataataatcttctgaacgcatttcaagaggcgctcagcttgctctgcctgcagctggaagatccttctcccttcaaggtagctgcttccgaatgcggtgcgagaaatgacatctccggtcaggctctgcatctccggccagacatccacctcgtacgagccttcagaaccaagggactccatccacctgctgatcagctcttcgcagcacgtggaaaacgccggcagcatgcgctgcagagtctcgcacgttccaatattcagacacagaaaacagcagagagagagagagagagagagagagagagagagagagagagagagaagaagcaagagtttactagtgcagtgttgtgtggttctgtacttctgtgttgtgtggttcaccttgagcttctcgagatggaaagccgggttgaggatcctcctgtgcttaacccacttctcgccctcgtggctggcgacgccgtcggagagcagcttcgtcagaccctggaacttgtgcttctccaagtgaccgaatttgttggacagcacgtccttggccaggtccgggttggcgatggtcaccttggggatcgggccgaaccatgagaagcacgccttgccatgctccctgacgctgctgtggaggaacggcgcgacgcgcggcgcgatgtcgtggcaccgcagcggcagcggcctcgcccaggcctccctgttcagccgcccgtgctccccgaggtcgccggtgaggaagcggtagcgcgtgccgcggaggccctgcgcgcgcagcgccagctccagccgccgcggccgccaccacagccggtgcagcagccggccgccctgccacaggagcaccaggcccaggagaccgtacgccagcgagctccatggcacggaggctggacacctcaacccggctccaagaaccattgctggggtcagtccacgagtgcaagtgtgcagatgagtggtgtgaaaagaagcttttgactactggagatggatatggtacggtgttgggcgaggttaacaaaaattttgacaatttggtcctttacaaaaactatttttataaataaaccaccgccaaaatttattttaaaaatgacccttctatttagtgtcacatcgtgtggcgctgaacttagacacctcagcgccaaatagcgtggcgctgaatgtgcgttgccacgctgacttagcctcccatttgcggtggcacggcattcagcgccaattgacgtggcgctgaggtgtctaaggtcagcgctagatgatttggcgtggaaaaaaaattatttttaaagtaagttttagcggcggttcatttataaaattagtttttccaaagggttaaattgtcaaaatttgtgttaaatagaggtgctacttggttgcattagtcacttgtgttgatctgttcaagccgatccgagttgctagcattggtaggtagtactccctccctctttatagggacattttaattgcactatttgaccatttatcttattaaaaaattttaaaattattatttattttatttgcaacttacttattttaaacgtaacttttccttttattatatttatataaatattttaaataaaatgagtggtaaaacattataagaaagtgaatatctcgggagacgaaggtaaggaacttcgtagagaagaaattccagcgggaactgatattctgattagtcaaagtgctcgcggatggtgatgagtgacgccccgatgctactccctcaggttgataacgtcgttttggataagggcacggtctccaaaaaaaataactttgactattattttctattataattcgtataaaagtgttaacaaatatatgatcttattaaagtattttttaagactaatctagataaatattttaaaaatgatttataatcaaagattctcaagtttaacctcacccttatcaaaacgacaagtattattagaccggagggagtatcattttaggattgtttcgcggctgcttcgttttgcacttttgcttgcttggttactattgtgaagaatatcagatgaattgggctgcatgaaaatgggccacgggccatgggccacatgcccatacaggtagtctaagcagaattttggagtccttgtcatactggctatattggagtattttgtaactgaactaattactcaccgagaaaattctcacaaaataaaaacaatactaccaatttttttaatcataacaaagagactatacacgcgtcgtctcacatagcattaagtgtcatattagaaaacgagcgtgcctgttagcacaccaacaaatttatagccctgtgtgtattactatgtgttttgctgttaaattattgatttctacctagcaattggttttggttttctagaatataagatatgaacatggtaatagtatttgtcttaactgtatttatctcaatattttcttaatattgtaggaaaattcttggggttacttgcataagtacttgtaattacgcttgattagtcttaattttcaattaagtctgtagtagattgtatttgttcaaatgataaatctgtaaggctgtaactcctttggtttcactatttaatttatgttttattttctattcatataggatgttactatcatggagttacttgcctgaattttgatttaacatgtattaatt

SEQ ID NO: 62054 - DNA, 7539 bp, Oryza sativa
  unsure (1)..(7539): unsure at all n locations
accgctgcagaggcattttcaacgttgtttcagtcagctttgtccaaatttgggctttcttgatcctgagcattttatattggtgatgagcctgtcagtttctctgcttgtcctaccacatccttgaacgtcctaaagatttttggtacatctttaatgggaatgttgaagcatgagtttgaacatcctcaacagcatatacagcagggagagcacaggctggagttttttaaggatgtatttatggtggctcggtggagaaaaattagcattgtcgtatatttcatctggagaagtgagttgttgtggcttcttgtgtttctgaaggtgaatgtcacctgttttgtcgatgtagagacaatatagatacagcgctgcttctgtatgttagtactccgtatttcttacttgcacagagcaataaagctgttcattctaccaatatgaagtgacacatattaagcccctttacattgtgaagtaaatcgactgatttcttacttgcacttgtgaaacttagcttgcaatgctcacggacaagtttattgtaaattggatctgcccgtgtttggcaggttttttttcctataaataaaaatcaatagaaaaacgcagtaagatcaaattgaggatggttgttttgatcaaattctggttgaattattgtttcaaatttgaattctaaagaaccatttgaaatttcatccaaaatctacttgcatcccatgtcaaaacctcaaattttcacggtattcgatcggctttcgtcaaatcgaaaaccctggtcgcatccacttcgctgctagcatagtccacaattcattaggcaatgggagttctgaatctttcctcgccaccacgagcttgctgttttgcaaatcaagttatccacatccacaaaaacacacaataattgtcccagttttatgtcactaattataagtgattagtagtaagcatttgctnnctnngcaacnnngngtgatgtnannttttaggcttatactgtataccagatcatcacacaaaacgctgcaaaggaaagcaaatgcttactttctgagtagttcaatacttcaatcagaacggatcggaaagctaaataggtcacacagaagcataaacatgtactccctccggtttgaggccaaacttttataacttgaccattaataactttaaaaaatatttagtttaaaggaactagaacaacatatattataatagaaaagtaagattaaaaatatcttttagaccgtgtcattgtccaaaacgtcaattaaaatggaaccggaaggagtaggaatatacaaataacacagaaaatttctccataccataccgaagtattaatagcagatccatgacccgcacaataatagcaagagtttaatccaaagaagcatccacccatataacattattagattcatatagcaaaaacctctaaatccgcacagcagcatcaactgctcagaaggcacgatctaagaaagaactattactaaagtcactactaaagcggtagtaaaggggggcagatcgatcgcatctagggcttgaaggcgatcgtcagatcagaccgggctgaggagctgggcgagggagggcctcggctcggatctcatgccgacgacgatgatgagcgggatgaagccgtagtgcgccgccaccttggtcttcttcatggtccacgtggtccactccttgacgaaccgcaccgccgccgcagccgtggactgctcctcgtcggccgccggggatcccttcctcgcgcccttgaccttgggcttcggcttcagcgacggccgcgacgccatggcacctccctcttgattcgattcggggggtcgctgaacagaaaccctagggctgtgcggaagtgtcgttctggggtttgatgatcccttccggttcggtgatttggggggtaatattggcttgttcgtgggcctcttcgactctaacttgaggagagacctgatgggcccaaaagagcgtagttatattgggctgcgttaccatagagtttgggctggacatttttgacagcccaattgatcaggtcagcctgcagcctgcatgggacaaaacaacagtcgctcagaaatgagtagcactgtaccagtatggtagtctagtcaccggttggtcggcaatgccagcccatatgtaccgctcagcaatcagcatctctgtcatgaattcctcctcattttcacacagatacctcgccttgctacgctaacaccattgccgcatcttattagcatttatatttcaacccgacgaaaaaggtaaccgtcggtatcatgacaattgacagtcgtacggtatgcatatgaagctgaatctgaacgtagccgccaccgagccacggacgcccaaatcatctcattagctgaccgagtattcgagcgggtacacgcgcgtgcatattcgccggccggctcacccccaccttttgaaggaagcagcacctacgtacgttaccggtcccgcgaaaaactccaaacctgtccgagtcacggcccggccccgctgtctctggtagaaccgacacccgatggacacatcggggagcaggcatcaaaatcaaatcgccaaaaaagaagccgaaaaaggagctgaaacgcgcacgcggcggaacaaaccgcgcgccgccgggctcagctccaccacgtaacccaaccccacccgcgcgcgctacaccacctatatacgtcgcgttcgcgtccaccggccaccccgcgccgcgcgctgcacgaacacgcacaagatcgatccgagatccccccgcgcgtccacgacccaccacgccaacagcatatcacctcaactcaattgacctgcctgccgacacgcgcagccgctccccggcccggccccgggtcgatctcgtccgatccgcgcgcacgcacgcacgctcggaaatccctggagatcagcggaggaaaccagacggaatcacggaactcgatcgggagagggcctggaataacccacccggtcccgcgcccactgatgccgcctaccagccatcgtactatcgcggcgccgggccgttcacacggtcgcgcgcgcacgcacgcacgcacgcacgccggcgaatgaattacggccccgatcgatgcatgcccgggacccgggacccatcgctcgcgcgcggccccggccggaggagtctctgtagacggcgatcgatgcttcgcctccacgtacggtgcgatggccgacgggccacgccacgtgtggccggcggagcggtacacggctcggtgacaagcgcgcgtcgacgtcgatcgggttccgccgggttgtttgccgatttgggcgagcgcgcttgaccggcttagatagctaatggcgcacgtgcaggcgcggggaagtttgactccacgcgcgctgcgccgcgcagcgcgccgatcgatcgacgtataccggtatacgctagcttacggcgagacgtgcccggtggccggcctctccaccacgtacgtacaccagagtcgacgtacgccgttagtgcacaggccgcgcgcgagcgagcgagcccaacgtgacgggggactgtagctgcgcggctgtacgtacgggcgtcttgtattccgtgtactgtgcgcgcgctcgtggtgtgacgcgacgcccgcggcgctggccggccggccgtgactcgtggcatgggaggaaaacatgagagagtcgtgatctctctaacaaccgagaccagccagtagccgtggggcaacgtgcgccggccgtttttttataagcgggtctctgcttatttcgttgctatattctggagatttttttttactaatagggagatattttcctatcttataatgttttagttggattttgatttgaatggaatcaaacgacggtcctttaaaatataaaaatgttcaagaaaggtagtaattctctaagctaagtaccagctcgatctccagtatcgtttatgactcccaaattagctagaccaaataacacgcgctgggttagcataatccctcgagggaaatactcatcgtgtaactttttctttttaatttaacgtaattagttgtgaaatatttttaaaaaataacttggtaatacagagtatagtgacaactatcaatcccctaaaattaagtttaaacttgacctacatattgaaaaataaatgaattcaaatgttaacagtaccctactatttatataagtttattattttattatatctcgataagtgagttgagtttatttataccaaaaattttgttaactaatatatatatgtcatgtgagtgttgtcaaattttgtaagatttttctataacttcggattgtttttatttattgtttttaaataaaggagctagatatttttttcaagggattaaaatagtttcatggtcagcatacatacttcgcatcccaaatcacagctagccgtgaccaaatatgcatgcgactgatataacagtaaaaaaacgtgggacgctgagttgaggcaaataaggaataactatatctttaatttgtaatacttccagtatataaaaagtataatatatatgttgaatgatatagttttttttttcacttttaccagaaaatataccaaacacagtactgtaaagagttgatcagctgaaaatcataacatcatttttcttgtaaaaaatgttgatctatatgtgatgtaataagtttcgctggcatcaattcccgtatctatagatcactatgccagcgtcaagtatgttactccatccgtaaaatataatgcacccgtcttttataaaaatcaaaaattttaaattgtactactaataattaaatttacaatacgtgagagtttattagttacatgtagtactattatattcatatttgataagatttttatatgatgttaatttcgtagctgccgatgttatatcatgcaaaaaattaatggtcaagctataacataggagatcaccacgtaaaaatctaaatcaccttatactttatactttagaaaggagggagtatataattttgaataatgaaggtgctatacttctttatattgtttgatcttcagacaactcatcaatcaacagtcttggaaaaaagcagccataatataaaccttaattgatatagtggggtatttctataattaatctaggaactaattacgttatcatttatctctgtgtttcctcattatcataaaaatggcgaaaaaaggagggatcacctacagattaatttcatttgatcagcacatactcgaatccattatctctactacgtaccgtaagagcggtgccatcctcctgccagaccatcgctccttttccactaaaaaaaaacatcctaactcgaaaataaccaacccataaaaaaacagtatttccacgtgaaaatcaatcgactagaaaattaattagatagacgaaccacagctcatagaatcatccgtgtccatcttcctctagaaaaatacagttttcaggatattcatccctaaactttctctaaatatatatgccgacgattaacttcggcaaaagaagtgatcattatttcactatatgaaaagcaagacaaaaaatatcagtgatgagttaagtcaaccctccacgaaatcaacagaaattaaaaacttgtagacgtacatgttcgatgtagacacatctcacagatacacacgcatatactactatattttttgccatgttattcaattggaccatgaggtcaatgctagattgtgtagatcagaaggcaattgcaatgaacattcttctcgattttttttagacgtacgtctttcttctcgaatttttttttgacgtctttcttctctaatttttaaccgaatgaaatatttgtccttaataagatgagagtagtttggtagctgtgcactgtgcaagggtactgtgacagccgtacgtccaatatccaactataaatatgtacagctgtatatacgtatggatacatgtcatccttcaaaacggtacttgtgtggcacgtgtatgtcaagaaagagctgtagtgtactgtgcaaatcatttaaaatcttgaagcatgcctgatcatgcataaacatttgaatcgaaattcacatgcacagtttcgaactcttggctggatccccgtagatgtccgttaaaacgcggtggatgtaagtgagttacattgctcaaattaatggacacaaaacatgtacatagtatatgcatgctatgcccaatatataccaactccaaccgggaaatagtatcttaattcagcatacagtaagctgaactgtatggattcaactattcatagtacggcaggccctacacaatttaattacgttgacactggccggtcttatacctaatacctccctgaccaacagatgcgaaaagaatctaaattaagcacgctgatttcattaataaaacgtctctaccattaagaattgacgactagctagctagtatatatgtgtgtatatatattaatagtactgctggaattatggagtattatatatatataaacgaagatcactagacgccgcaccgagacagatttacatattccatcacaaaaagtcgtatcttgcgcctatccttttccagcgaaggaaaagaaagaaaaaacaaatcaaaagggaggtgagaccggttgaaagctgaaaccctcctcacttccacgcctctctttcctttccacacataagctagctccccatactctcacaccccatgtcttctggaggaggaggaggaggaggaggagatcgccatggcccctaccaccagcacgggcacctcggccgcggcgaaggcgctgattacgtgtacagcagcagcgacatggagagcttcttcttcagccaacccgggggcgtcggcatcggcgggggtggtggtggcgtcgtcggcgccggcggtgccgacgagatcatgccgtactccagcatcacggactacctgcaggggttattggacccctccgggctagctcggcacctcgacgtggcgtgcccgtcgtctcaggacacggtggtcaagcaggagctgtcggtggatgtgacgagccacgacagccagggcaccggcggcgtcgccggagaaggcgtcgcgcaggccacgccgaactcgtcggcgtccttctcgtccagcgacggagaggcggagggcggcaaatcgtcacgccggtgcaagaagggtcaggcgaaggcggaggaggaggacgacaaggatgaggaggatggagagaactccaagaaaccgtatgttaaatttccattgattctactctatactttgtctgattcttgtcttgatttcttgcttgattaattcttttttgatgcgtgtcttgagatggggatactttcttggggctagatctggttggtcatactgttgcggagttgcaaaatttgacctgaaattttctttcgtttatgctttctctctactgcatgcatggtgtgaacattagggtttgctagaattttggttccttagggttctttttgggctg

SEQ ID NO: 62055 - DNA, 1574 bp, Oryza sativa
atttaatttaatagacaaccaacctatgctccataatagatcttgcgtagaatgaatcaattttacgagttatagcttcaatttttgacttgctaggtctttgaagattatattatgatttccccttttagaaatgattcaaattaagatatattttcgtatcaccaccaaccacctaaatctacaatagttcctcagtacttttgcaaaattaacgctgatcttgccccataacatgcaatccaacagatatctagctagctagctaacttattagaccctaattaatactatatatcaaaataacaactatttctagcaaaacctggtgctaatctaacatgaaatagctagctattcccatagtccaccatgatcctacctatctagcaagctagttagctagtttgattgttggtgctctgaaaaagcccaaactaattaataattaggcctgattgagcttgtcaccgcagaaatatcaactgatcttctgaatccatatcatctctctgtttctagctaatccacctgaccttatttttgatattttgtaccatgcatctacacaggaacaagcccaagaagaaagctgagaagaggcagcggcagcctcgcgtggcgttcctcaccaagagcgaggttgatcacctcgaggacggctaccggtggcgcaagtacggccagaaggcagtcaagaacagcccatacccgaggtacacatctatatacatgtacaaaccttaatttcacccagttgttgtagcacatacatatatcgtagtataccatgttactgtgccatacaattgcatggcacgatggtgttcaagtactccaatttcaaaatgcaattcaattcgaattcgaatattgcaggagctactaccggtgcacgacgcccaagtgcggtgtgaagaagcgggtggagcggtcgtaccaggacccctccacggtgatcaccacgtacgaagggcagcacacgcaccacagcccggcgagcctccgcggcggcggcggcggcgtcggcatcgtcggagggcaccaccaccaccacctcttcatgcccggcgtgcatggcctgccgccgtcgcacctcatgccggcggggttccaccctgagctgatgggcctcatgcaccaccacccggccatggccgccgccgccgcaaaccctagcatgtacttcccgggcgtagctgcttctgctccgccgcctcctgctgtggctggcggcggtgcaatgccgcccaacgatcatcctcctcttcagcagcatcacttcactgactacgccctgctgcaagacttttcccttccacaatgcccagcagcaacccatgatgatgactgatctaactgattctgcacaaatatatactactcaatatttaactagcacccggaatttatcaagatgcttttcaaacattggagtcgttgcgccaaaaatgtgatggctagggagtgcttgatgatcagcttggtcttggtgagaatatataattgttattaattaattgattttctgcaagcttttcatcttgaacgtaacttgtgtgtgttgtgcactt

SEQ ID NO: 62056 - DNA, 1425 bp, Oryza sativa
atgttttctgttggtatttaatgaagtcgatttggtattcaacagtaacttaaacactaatcacgatccacttatctaatctcgtgtagaactctgctccccggctctgggaattagttttcccacgagaacaaatatatagttgaaggtagcacgaatggattgggtctaccactaccaccaaacagatgacatgcttgaagttgtatatactagttagcactgtattttctctatccttctgttggtatttttacgtgttgataacaaattcacaatcagcaggattgcaggaatataacaaaacttaagcactgagcagagtatgccttggacccctttgtactcgacttattacagcagccgaaagtctgttcaccttgctgtgtttttccgtgtgattgtgtatgtctcttgatctcctgaaacctttcatattcatgataatagaatctcataattctcactgaatttttaattttccatgcattgcaggtgaggcggtcacatttacaggagaatccttttcctttgtggttctttgttcttgacgacattgggtgtgtaaaaattgagaatgtatgttaaggttgaacttaagagattccgcattgtgaaggaggtgggaacaatagtaatgaatgttaggatctttgcttattaccagttgatgcaagtgtgccaggtgagatatttatttgttgacctaaagaatcctgtttccaaaatgattcatagctgttgctaaacaaaaaatgagaatcaggtgtcatttttcatggaaacattcttggtactttgtttgggattttcacaataatctcgtatagtgaaaagtaccacccatcaactatctacacctatgtaactgtttgagatctttctattatagcatagctaattaatttagttgggttttggaatgcatattgtataggtgatctggtcatgttctcattgttaacctgtaatcctggaccatgtagtgctattgcagatgaaatttaaaatgatgtggggtttcagtctcttcccttccctgtccctcccccagtgaccctgatattcttgagttatgctagaaagttttgattgatcaatcattatttcttttcatgaaattgaacggtgttatcgataaatgattatttgattaccataaatagatattttgttgttttgtcctcaagactttttacatgatttgctaatgcatacctgaatcaaataatacatatacttatcagttcactttattttttagtataaatttattaagttattcaggcatctttgtataccttattttactatgtgtctcttctgtattttaacaaaatattctaaattgcaggctgagtacttccgtcaattgcttaagcctgtcacgtagtccaaatacaggagtcgagattagtcacttta

SEQ ID NO: 62057 - DNA, 4180 bp, Oryza sativa
acactgttactcatgagaggatgagaaatatggtcacagttcttaggggaataatccctggtggagaccaattggatacagcctctgtcattgaagaagctgttagatacctgaagtttctcaagatggaggcgaagaaacttggcgtggaggtttcggataactagaactggcaactggtacagtggcgatactaaagctcacacataaataaaatctgaaggcatcaatgtgtgtatatatggtctttggtaaggcccttatcatcattgttacttgattgactttgtgtgggtgtggaaggtaaggcaggcagccagcttttgcttctttctgcaggcctcaaaagaggtattgtttgtgggattctgatgcttgatgtctggtagcatggtgttgctgcgctgtgagctttccctccctcatcatggtgtggcactatggttagatcgtcagacgaagttctggatgatgcattatgttttcaggcttacctttgccttttgtgacttaagcacctcagctctacctatcctatggtcagatcaccgtgctttgctctttttcaagctctgcttatatttgttgcactacttaaataatgtacatacttggcttgttaaattgtagtattgtgtaccgaacaagatcatgtcattgtgaactaaattacgatatgaaataatgtactttggatttatcatactatttgtcaagaggaatctgtctcattttatttgctttggaaatgatgatgatgatggttctcaccatcgaattaagcaaagggagatgattgtgatgatggtgtccaagagatagcacgacatttgtgcattcatttattccctgtgcttttttctgaaagctatgaaagcgaatcgggcattggcacaaacgtgcaatcttttgcaaaggccaattatgttgaactaaaggttggtgtttcccatgcttttgccttcagttggcttggctattgaagtggaagaagtttgttcaacattgccatgcagaaaatattcttatagtatatcagtatatgtatgcgtgttgtgtgtatgcatatatagtggcatatgttcagtaatcgaaaaaagaaagatgtgtgttcctaaaatagtggacatagcccctatcaagaaaaaaaagaagtggatatagctttcatatgaatgtcttcttttttcaattttgaactttttgtcgagtaagcgtgcataatattttttttccttaaaatgaggcttgaatttttgttaaggttatttatcatagaaggaagccattgttaccatataccagtggttctaattcaaagttttacaaactgagggatggactattagaaaagagaaaattccttatatatctctaaaatatttagccgatatattccagagttttgctcactcttgtatgcctttcacttttgactttattctttttcataccatttctatcaattaactattagttgaccgtttaatgtgtgaacaagttggttataccattggacatgaaggaacgtggaaatttattggcatccatcgttggaaatatttatggtaatttgttgtgtgactaatattctttaactttgttgtataacggattattatatgtggaaagaatattatgtattaaaaaaatgcatgtgtggcatttttcaatatgtaaacgtaacagttagtttctattcgaaaatatataataagtagaataataaatattgaaatttttttgccattatataaaagataaaaaaaacttgccactaataaaaccctacacaaaaacgcgaatattagggaataacctaatatccaataattagaaaaggtgagacttcaaacccaaatcgactagcgcaagagctgcctgaaggccctagatgtttctcaataaaaccccacacaacaaaatcataaatatagtagtctcatagaacaaactcctgcacacttccaataatatactttacagatttctatattcatttcataactatggacaaatttagccttttcatagctattacctagtcagctaatagacaactggtgaaatgggcataaagtagatcaaaaccaaattcgaggccataaagtgagcgagcaaaactcagaaatatataagagatcttctggaatttaggagccataaaagaaattttctcatcagaaaatgaggtcacaccatgttcttggtttgtacgccctgcttggagttccctgagaaacatgttccctttttcatcacttcctcatctttctttacccatttcatttcggtttattactatatctcacaagggcttaaggtcgctgcaaactcatgattgacgttgacatttgtaatcttgagttggtgtcgggcccagctggcctactcttcagcttcctatagacttctacacgacgagcaagcctaacatcctaattcgttttacagcttacaagcccgtttatcggcccacaagttttgtcacgttgcttactggcttaacctgccacatttaggaaaaagtacaccgaaggtccctcaacttatcatcgggataaaaaacgtcctcgaaccgcaaaacctgatatgcgaggtcccttaactatacaaaaccggtcacccgaggtccttcggcggttttgaccctagttttggtctacgtggcggcggaggcagtgtgggacccacgtgggccccacatttcaggtgtccacgtcacctctctctttcccctttcttttttctcttatttttttacttctcgttccttgctaatcacccgcccgcgcgctcgcccgcctgccaccaccgctgctccgcgcgctcgcacgccgccttcgccggccgccgctcgctcgttcgccgtgaccagcgcgaagctgatgtcaccgccaccgcgtacgcgcggccgcgccaccgtagcgtgttcccctcggccacgcacaccatcaccttctcgcataccaggttctccagacccggcgcccccgccgcggtcgggttcatctgggggtcatccgcgccgtccgccgcgtcggggcacacgaactcccatagccccttctgctccccatgtcgccgccttgccgccgatgggctccttgccccagaaccacgggtggatcatcacgatgccctttaggcggcacgagaggtgttggctggtcaggccgtggcacatgacaaggtgatggtagatgttgtcgctggcgctgtcgcccgcgaggaagacacgggagagggggccgtgcgcagcgagccacgggtcggcgacggagagcacccaggcgagtgctgcggtggagtcctcgtacgcggccgggagcgggtgctccagggtgaggcggtagcaacggagacggtgacggcagggcaggcggcggcaaggtcgttgaggcagcggcgatatccgggcgacgcagccgacccgatcacgaaccccccgccatggaagtagaccaccacggggagtctcttgtctccggcagcgggcggcgggaggtagagccgcacgaaggaggaggcggagaggtgcacgtccctggacaccatcactcttgcagcatgcaatccatatggctcgcgaggaggtgcttggcatggtggtcgagatccaggagcggcacgacgcgcctccacctccagatgtcgacgttgaccgccgcccgccgcctccattgcctctccacccgcggctctgccctcaccaccccacgtatcctcgctcacctcaccgccgccagagtccatgccggtgagctcgcaaaagcaccgccttcttcctttgcaccctcggtcggagcagccgccacagcaccggccatcgcaggcaaccggacctcctctcccgactcgccccaccggcctcctccgcacctgtcggtcgaccgtcggcctgctgagagtccctgacaagaaagtgttggagaggagaaagggagagaagatgggaaagagagagatgacatgaccagtctgacatgtggggcccacgtgggtcccacgttgactcagccgccacgtagactaaaaccggggtcgaaactaccgaaggacctcgggtgaccggttttgtatagttaagggacaccgtatatctagttttgcggttcgaggacgtttttatatcccgataacaaattgagggaccttcggtgtactgggctgcaggaat

SEQ ID NO: 62058 - DNA, 7051 bp, Oryza sativa
gcgaaatagcagatattgaagaacatgcacctcgtctcgacgttggtagcttcttagcttctctagtccaaagtcaaggggatttaccaagaatttgtaagaacacagtgtgatgtagatggacttaaagcatgaggctgttatgacatgacgccaggatcatgttcgtgttacaatcaggaccatgatatcatccgtccggccacgccacaccatgttacatacagtatgtgtttgttcaaaacccctcaatatttagtagctcccaacatcaataaccaacgtacctttttattaatggagtgaaatacattacacgttacattatattatcatttagatctgtgaatgcaaaatacacatttaaattcattatcttgatttgatcaaagcgtatcgacttgcacctccacgttggcaaatgttttgcgtttggcccccttcacagctaaccatggcagaaaaaataaattcacacccttcctgctacagtttagcttttttccttctccttttcgctcattgttcctttcttttctttctctttttttttgtcttcttccactgtaacaaccgtcgtcgaggtcgtagtgtccactaccacgcactcgagaggaaagggacgctgacgaatggcttaggtcttcgccacctccttcgcaagaagggaataatgcctggtgttgccaaagcgtggacaacagaggcatatggacctggaggccactggagccacgctctaggaatacattcctactccacccgttgactgctttacccagtatctcgaccccattctagcacctccaacacacctgctctatttatttcgccacctcttctattgctcctcgaagtccagctggcaacgtgcttgcatagacccatatggaacgagccaacggcaggtattggtggtgatggggatttactgcatccgcgctgcggcttggcgaatgtttcgtaactaactagtggaggcttaaaaggtgagagaaggggtagtgtacagaagatgctcgataaaatgcgcaaaataactcaagcttggtatcgtgcgtattcaagcaacagtgccagggtgcctccatcgacagcgtggtcttctccttgaccttcggtgccacctcattgtcgcatcatgcctccgcaaccttcaacaccacagtatcccaaggctttacatgtgaaaggagctgcaggaggaggctaatcgccgtcaggattgagctcccccttcaccatcccctttgctccaccattgttgccgtcagggtcaagctccaccatccccataccgctctgctccaccaccaatgtgtgaaggggaagttgctgccggagttccatgacagtggtgagctcggtctaattgcaatgtcagtgtttgctacgcgttgagctctcccgcacctttatgaaggaattagagaaaataaaaggaatatcaaatagaagaaagaagaaaaggaatagggtgaaaaaaaaagaacgcaaaatacatttacttcccattgcactgtagtgggaagggggcaaatgcatttttttctgccacggtgtgttgtggagagggttgaacgtaaaatgcttgccaacatggagcgccatgtcgccaatcatatccggtcaactgagatttagacctattgtgatacattaaactaacataatagacctaaatgtgcattttgtagattcatgaacctaagtgacagcaccgtaacttgaatgaccttagaatatatacttgccttgcttgccttcctatcagtacctccgagagactgacgatagtattgattgaataattatagacaacttactgttgatcaacaacacattgtctaagattgaatgaaacactcgtggcttgctagctcgtttgacctcttgggatttgttgactagcaaagataaagttttaacctgttaagtagataccaaaatgaacgaaagaaagcagcccaaggagaagaaaaagacatctctaaccctaaaactcctctccctattccatggaaacgtctccccactccccagctcccctctcctctcgttgtctcgctctcgcacggctaacgggtattggccaagtcaaggagtcacgacactgccctaggccacagttggctaccccactcccagcctctatctcgccacttactactttccatccccttctccacatatttgccattaacaacaccagatactagcagtgtcacgggctcgcgacaaaagccctagctggacgcctactccgcctcagcctcaccaatcaccagtcactatcatcttcgttggtcgccacccatagaattatagtagcactagtcacttgctagatttgtgggctcatgacaccacccagcccactgccagtagtcagactccacactttaccttgctgtctctagtcgccatcccctacaacacttcactcaatattttattgctcttgctcacaagctaattgacctaaaaaatgagccaagcaagcttagcttgttaggataaacagtcaaaccgaggcagaccaagctaagctggctcgatatctaaccttatcattgtccgtcactaaatagttataaatctgagcatccacatgagtcaaagacttaaactcgagcagacagattagaaatctaatcaacttatagctacaccaagtttgcctctttgcgatcttcatcttaccgagataaaatagtatcctagagttttcactcagtattggaaggttctataaatacccttgagttctatatatattgcctatccaaataaaaacagaaacgcaacagtttgaattataattgctacaacaaagttagtatagtacatatgtgtgtacagtacgtagcaaaatcttgcacacatccttccggtgaaatttaacactgcagtacagaggccaagcaagcaaatccccagttattaattacgggagaaaattttcttgttcgtactaatttccatcgctcgctactgctaccgtccaaagtccaaacacgatacatatacaccgaatctctgaaagggaggtgccacctataaatgtgcaaaaccgttgctatcaaaaggagaaattcgcaaagcggtaactctcaaggagtcgcattctcgaaccacaatatccagcagggtaaatgtttggtaattggtactggtcacttcaagggattctagttaaccacatgtgcttaaatattgttgcagcttccaggaaacatcacgtccgaccacattatcctcaaaagtttggttcgcaagatcttgtcttccccctttttccgttcactgatcctgaaacagagcatgaaagtctacttcaggacctgcaaaaacacggttattcatttttctccctttaataagcacaaacagaaaaccatcttaaccaattatatttatatgtcccgaactgcccaaaacatcgaacagagttatcatggagatatgattattgaaccatatgtgatgaagctttaggctgagttctttctcgattattcgtcggacggactatttgatacattttttgtaatatatatatatatatatatatatatatagataatttgcttccacttaaatgcataggcaacttattttaagctatttgctactttatttcttaaataattaacttatctatataatatattagacaatccgtagcaacaatccgctcaataatctgtgattattcaggaaacagtagcaggtgtgttggcttgatttcttcttttttctaattttcatatggctattggttttactccttccggtccttccggttccatattaattgatattttagacaaggctaagatcaaacttttataactttgaccatcaataactttaaaaatatttagtttaaaggaactagagcaacatatatagatttgtcttttaaagcactataataaaaataaacatgtatttatttattatatatattataataaaaaaataaggtcaaagatatatctggtagactgtgtccattgtttaaaacgtcaattaaaataaaatcagagatagcagttacttttgtaaggtatatcggttatattaaaacctactgggaatttgcgagctgagtgcgcttcggagcggcgtgttcgcacgcggaggcatccacgtcgcccgcgagcgctgggaggcgggtggattccgcgccccctcgagcgtccgcgcgagcggctcccgcgccgtccgatccctcacagcaacggctgagatcgcacgtggttcctagcgtgggtggacatttttcaaaaagacccattcttaatagataatttgttttatatccctcaccgtacgatccaacgttccgatttcttacgtatatactctccaaaactaggaaaatcctatgcgacgaagagaaaaacacgaaataggattgcgctctaaaaaagaaaagtcaaggggcttttctgaaacaacataaatccctacccctttcggcccttcttccccgaaaccctagccgccaccactcccgtgacggtgcgtcgcttccccctcctcgcgccgcctttccccgcaacaccgacaccctgcgcagttgcgccgccgctccatcctccagcacctaacctcgccccgacaccgccacatgcttcgccgcatgtcctccacttcctctctcttcttgctgccgatgccgctgggctcgagctagcgagtaggtcgatctggctttcaatcaggttaggtctccgtccttagcaccacctcgtcggcgatttaccttcgccacaatccaagccccacgctgccttcagatctggtggcatctaccttgcagcggccagatctggcgaagagaggaggagcgcatgcgggagcgggcctgaagtgtgtagctggcaacgtccccggtgtggtggtggttcactggttcaggtggacaatgcctcgagcttgctagaaatggcgttggcatggagttctccaaggtgaggtggcgaggtatatgtctggcggtgcatggcttgattttcgagtgatgtgggtgctccataagcagtggcaaagctcctatttttttctggccaccagatggaggaggagttgtctcccatcgcctagccgttctctggatgcagcaagccatctcccattagtatctgatttttgccgttctctggatgcagcaagccatcttccattggtatctgattttcgtttgtattccccacaaaaatttgaggtgtttgttttgtgtggtgtcctgcctacaaggtgttcgttgttttccctacaagcatgggaatgtggcaatcttacatgacctgttagtgtgtaagcctgaatggtttgttgggctttagatttggatcctagcttccacttaatttgccctaaacatttgaacctaccttaatgttagcagttaaaatatctaatgaaatgcatcattgaaaatattcatttgtagttagctctgtagatgcatgcatttcatatagataatgattgctgataactgcttcttttgctagaatatttatgtgactacctaaatagctaacaaacttctccaattataatcagtcattgcttgtccctgtgattcataaatctgtatggttcttgtgattcctgattgagttttcaaggaaaatactaacattaggtggggaatactgtgcaaatgattctgtcacagctgaaagacactctaaaaaacctctcatgtatttcacatttgaatgcaccattcaggtgggaaggagattacacattggtgatggcacaaagccacgggcagaacaactctcttgcgtgctcgagaaaaaagccagcggcagaaatgccatctttgttcattttattttcctttttttagttagtttgattagattaaggtgcttaacgagctggatttgctgttaaattttaaatgatttaaacagcgggccatgggttcactatttgctagaggtgttcgcatcgtttaattcttacatgcattccttggggtcctacatctacaatcctggttgcctttctaatttgagataatacaaagcatgtacagcctatatggctctatcggttttctgatcacaaaatttgtctgtatacatctattagttttctgatcacaaaatttttgttacaacattgaaaatgctggtctatctatgattagaaactttgctggttatttctgtgtataactgcaatatgatgttatctatatttgcgatacaattctgcaaattgctgattacagaagttgtcttgcaagagttgaaaaggacatgtttatgtgcttagatgttattctggttgcttgatctggcatcctgtcataatttgtttctaacactatcagaacaaaaggatagaatatatgttgcctaaatgctgtaattttcatggaaagaagcttgatgatattgccacctcatcccacaactatcatgtaagctatattggttgtatagaaaaccaagcatttgagaattttttttattgtcaaagattcaaaagccttgccaacccttggtattgtttgtattttctgtatttggtctatttggtagttaagaaattccctacaagtctgatttgatactttataaattcattctcttgcagtcctggagcattgttctgcttgacgggtggacagggataagtgtggccttttgttctgtagctgaaaaagtggaagctatgtaaggaatgttagctagcatatgatcagagtgatctaaggtttcagtctgttggataggattgtgttggcttaatgtttaagcttttgggtataggtggagatctcttagtagctttcttttaagctggtaacccccaagccttttgtcttctgaaaacatctctatgaaaatatttacagtttgtagttcagtaaagcaattgatcaacatgagtattatattttgatatgcgaatgttgttctcacaaaagaaaagtgttaattttgtcgttctaattctatagttaaaacgactgcaattcatgaattaattggttgtacccaattactacaca

SEQ ID NO: 62059 - DNA, 9329 bp, Oryza sativa
  unsure (1)..(9329): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnaatctgtgccccatgctgtggctggagcgtggggattgggaacggtgcgtgcgtgtaggacggagacagcccgaacgagaaccgttgcaggatcatgctcagcgccatcttggcctccagcaacgcgaagttctggccgacacagatccgtggcccccaactgaagggaaccaacgccggtgagtccttggacgccctggagacgccctccgcgaacctctccggcttgaactcgccgacgtcttctccccacacgtctggatcgtggtggatgcccgcgatcggcaacgcgaatgtcacccccggtggatacgtgacccctccgagctcggtctcttcgtatgcctctcggccaagcagcaggatcggtggatacagcctaagaacctcgtgtaatatcatggtcacctgtgacagagaacgggaactaactaaaaacagaacctgaacattttcttcatcttggtatatatgttgcactcacgactttgagatggtttatgccctcgaaatctggactgttctttccgaaaacgcgcagcacctcctccctggcacggtcctgccactcggggtgcatgcttaggaggaccattgtccatgtgagcaacaccgcggttgtatccgatcctgcaaagtagagcagcttcagctcctcgatgatgtccttcgtggtcatggttggcttggagcttccagcttcttggctctccttgatgttggtctccaatagcaatccaagcagatcatcgttaaccgcatggccatccttcatcgcgctctccctcttggtgattatgcctttcagaagctctctgacctcgcgtgcgtttgctttcgtccttctgttgagctctgtaggcagaaaccttcccaataagcaaaaaaaacaataagcaaaaaaatcgcatctcagatgtaatcaagtaatacctaacctctttaattcgggtttaattttgctattagtcaatcacctgtaacctgggaaatacaaagcttttgccatcttcataacgtttcgtgcctgctctgactgcaactggaagatcctcctcccttcactgaagctgctgccgaacgccgaccgggagatgacatcccccgtgagattctggaactccggccagacatcgatctcctgcgcaccatcagctcccacagaatcctgccatctgcttatcagctcgctggaacatgctgcaaacgccggcaacatcctctgcacaaagcatcaagcaatcctttcactgtaagaaattttacgatcctcaagaagtaaatacagacatctagactgacaaagccagaaaggatgtaaaaaaaaaatcggttatggacatgtggttgtgtcgtgtgtgcaggatggtggtgtctcaccttcagcttctcgagatggaaggcgtggttcattatcctccggtgagcgacccatttctcgccttggtggctcgtcagcccatctgccaacaaattctggacccaaagaatggacttctgcttcccgaaccgcccgttcttgttcgctaaaatctctcggaaaagtttaggatcactcacgatcactcgcacctccgggccgaaccaagtcacgcaaacattgcctgcattccatgcaacttccgtttgatctctcacgtttgcaggggcgtgtgtgtaagctgctgattaaaaggagagagccagtactacgcaccgtgctgcttgatggcggcgagttcgaacggaagcgctcgcgaggcgacgtcgtgcgacagcggcggcatgggcgcggcgagggcggcggcgagcagccgcgcgaactccttcaggtagccggacgggaagcggtagtcggtgccgcggaggccctgggaccgcagcgcccggcccagccgccgcgggcggagccagaaccggtcgagagcccgccacgcccaccacagcgccgccaatgcgccgagcgcgtagagcagcaagctccatggatgcaacggcggtgaagcgccatcgacaatctccatggtttcgatctcgtcgtatgtgtgtacatacctgcgtgttgacgtgatatactactaagtagcgtcaacaggaaatgcatggccaagaactatgttcggttgtccatgttcccaacccctcctcctcattttctacacgcatgcttttcaaactgctaaacggtgtgtttttttttgcaaaatgtttatatacgaaagttgtttaagaaatcatagtgatccattttaaaaaaaattagctaaaacttaattaatcgcatgctaaatgctgcttcgttttacgtgtaggggcactcccgaacacagccaaaagagactaagagtgaaacgtaacaaaaggagctttgtcacaagcgtccatggccaggcagatgcggtgatacaagttagctttgatttttctttggttgctgtatgcatgaagtacacaggtgtcgtttgtgtcattgctccaccgctcacatcgtcaaggaaaacaagagaactcttaactttaccgttgatttttctgcatctctatcggaggagttgctttggttggtctcccagtctcccagaccgtcacatcatctaagtcttggcctgggaacgacgccatacgcgactcgaaggctcaaaacaaggcacggctaaggattagatttagaatgcgctctcggcacggtaggagtgttgggttgttggcacattccgaccatggaagcatgatgggccgcacggactaaacatggtccaagaatcaccagcccaaagaaccttgtaccacagtggaattgtgaagttattctggagcaactcattagaacttagcggacatatacatttctctacagacatatagcaacggtgaggtggaagagaagcaggacaatagcaacgatgagcttctagatctgaaatcctcctttctccttccttcaacctcagatcctcctccctcctagccagcaagatatcggtgccgtcagaggtggcgcggcgagcttgggacatccgacggctgctcgttgtagccattgaagagatgagatgagggggaggggctccaatggctgacgggttccatgaggcgatggagatggcgacgaacaagacaacgcttgaaagagcaaatgggggtgagggaggtgaagggagcgcgaccccctatcgccccttgcacgcgcttgcccccacgcctgcacccacgcaaccccaagcctgcacccgtgcagccaggatgagcagcgaagctcgccgctagcgtttccagcgggcctggctcggaagaccgatttgcacgagcagagccaggccccgatggccatgcaggcaaccaaacatggctggcctgcacccacgcatgcgggccaggcatggtgcgagcaaccaaacacacccacactagacacaagtacacaacattagttgtcatcttcttaaatgtacataggtccactcttcatgagagcacacgtgactgacacattttgtacaaccatccgagcgaatcaaaagcacttaacaaacatcacaaaaaactaaaataaaaaaaaagttcacaaccgctcctagttcaggtaatttgacttgttctgaacacattgtccatgcaccaattatgctgtacattcagactagaaaaaagatagaccgaccgagcacgcagttctcgtctaggacaggacccaggaggtgtttgtcatcagtttagcctcgtgagcctgacctgcgcgccgtgctccggctgaagcaggccgacggggaacggcgcgtgggtgtaggacggtgagaggtcgaaggagaagcgctgcaggatcatggagaggcccatcttggcctcgagcagcgcgaagttctggccgatgcagatcctcggcccccacccgaacgggaagaaggccggcgcctccctggacgccttggagatcccctccgcaaacctctccggcctgaactcgtcggcgtccgcgccccacacgtccttgtcgtggtgcacgcacagcagcggcagcgtcagcaccacgcccgccgggtacctcaccccgccgagctccatcggcttgtacgtcttcctctgcagcgccgtcagcggcgtgtacagccgcagcacctcgtacaacaccatggtcacctgcaaaacccaaaacccaaaacccaaattagacttttatatctttaatttcgtgaatcatcagttaatcgtgtcgaagtgcttacgattcttaggcggcttaagccgtcgtaatccggggcgcggctgccgaagacgtggaggacctcctcccgggcgcggtcctgccactccgggtgcatggagagcacgaccatcgtccaggtgagcagcaccgacgtggtctccatgccggcgaagtagaacagcttgcactccccgatcacgtcgtcgatcgagatgccggagctcgcggcgccgccgttgcccttgctgtggtccaggttggactccagcaggaggccgaggagatcgtcgtcgctgcttgcctcgccggccttcaaggcgctctctctcttcgcgatgatgcgtttcagcatcccttcgatctccgcagcgatctgcttcatcctccggttggatttggtcggcaggtgtctgcatcgcaaacacgtcagatcattcattttgtcgcgtggaattcattgcactaccgtttgctactatcagcaggaggaaaacatatgaactttgcaggggaaatgggccgaacgagagatgatgaaagtgagaagggagctcacatgtaaccagggatatgtatcttattcatggtggcgacgatgagctcgatctgctcaccctggagctggaaaatcctcttgccttcaaggtagctgctgccgaatgcggcgcgtgagatgacatcccctgtcaggctctgcatctccggccaaacatcaacttcgtacggctcatcacctcctttggctaaaccttcccacttgtccaccagctcggtgcaacatgcagcgaacgctggcaacatgcgctgattattgagaagaaaaaattagtccgaaacaacggcgcctaggcccgatcactgttgccatgtccgtgacagaaatatctctctcaccttgagcttctcgagatgaaggccgggttgatgatcctcctgtgcttggcccatttctcgccctcgtggctgcccaatccgttgtgcagcaacctctggaaacgtccaaacttgagcttctcgaagtggccgaacttgttggacagcacttctcgcaccagctcaggcttggtgatggtcaccctgggcactggcccgaaccaggtgatcgacactttacctgccaacaaatatcacataattacgacaagacttcattttcgctctgaatttgtgattacatggatcccttcattcaaatgtatcatcgctttcacaaatatcgtatgataagttgcagttattttagtttataattcatgattatatatgataattgaacatgcttattcaagaaaaataaaaacgatagttttcactaaaagaaaataaaaagatatttctcacaaaaataaaaaagaaatccttgcaaaaagaaaaaaaataaaatttgtagtaacgactaaaaatagggggaaagggagataaggaagcatatcactcctctatattattgacttaataagagacctcgagtgctcatatattagattgtggaggatagaaaattatgcgaaataatggtgcatcccaaatagccaaatgggcatgttggggttcaaatgatagaaatctattattgacaggtatgcgtgaactccaaggtgccacaagattaaatccatatgtaaatccttggccttaataaatcaactgcagataatctgtcaccatcatgcaggaaatctggtttcatctctacgtgtatacctttacataccatgtggtaggacttctccgtattggaaatgtcgttggactgatttgagagaagtaatatatattcccctgcctcaaaatataagggattttaggtggatatgacttactactgcaacaaatctaaacagaaaaagatttgttggactaaaaagtgtcacatccgttcaaaatcacttatattagggacggagggagtgcacacacacacacacacacacacacacatatatatatatatatatatatatatatatatatatatatatatatatatatatatatatacacacacacacacacacacacacacacacacacacacacacacacacacacacacacacactaggaaagagcccttagatgctaaatggaaattttctgctacactcttttaagtattagcaggttgtatacacaagttcatctctttaagacaggagcccttctacagaatctagtgaagtaagaggctacaataaatcctatattcatgtattttgccactaaaaattaaaaatatgatagatttggcagcctaagctgattcttatggagacatgcatgcaagccactttaatttccaaatatgtaatatgtgaaaccacactcaaatataatccagagcataacaagatttccactgttgcttttatttcaattgcggcgtttagcgtctacatattttagtgttatcaatcagattcaaatgttgtttgagattttacattcaaggtatgaaatataattggcatattgtattttaaatttgtatagagcaatatatgtggcatcattttactaattacgtactccactcaccttattaacagtgttaattctaatggtatattaaaaaaaccatttccttccttattatgaggtcttccctctaacaaggttaataggttatataaccaatggatcaaggtctaaaagctagattagtccataaaaacttggagcgccaaaaaagatccaatagttagcttctggacattcatttgttccagatctgttgtactgtatgaaaacaatgattaattatctcaacagtgcttcaaattttatagcttaaacaggtggagcctgaaactatttgccagtgaggcacgcctttttctttttttaaaaacgaaagcaagagcactaacagatcattgatagtaggaaagtagaaaggtcaagccatttacagttacagagatcaggtgttcggccatgtctcgccctgattaaaatctcaaaaatttatggctatgatcaaacgagagagagagagaggagagtagaacatgtcgtaccgtgctccttcatggcctggtggaacagcggcatcgcgcgcggcacgacgtcgtggcagccgagcggcatggtccgcgccctcgcctcggcgctgagctgcacgttgagcggcgcgtcgcccgccggggagcggtacggcgtgccgcggaggccctgggcacggagcgcccgctccaggcgccgcggcctccaccacgcccactccatcgcccgcacggcgcaccacgcgagcaccgcgcccgcgaccgccgcccacacaagcatcagcggccgctcgtcacctgcggcgaagacgaccatccccatcgatcgtcccactcgctagcttatcgcagcagctaccctcgctcgcagagcagcttacttcccgcaacagctataacaaggagtgcagcagtgcgcagcagaaagagaaggggggaattgatcggtggtatgctcacgaccggttgtctgctactctgcctctcggctcaccaccccgctgttatatatatatatataaatcctatgtacaaacacggcgcgtgcgtggtttgttccccggcccgtattattgtttattctgcctttggaacatatgctccggattgctacttccgcgacggttctacagtctatggctggcatgcatgtcgttcactggggaaacttggaaatgtgggagcggtacggaaaggggaaaaaaaagaagaagcgaaaataagacttgtgttaattcgctgaccatcgatgttggtcgttgcatacacatctccgtccaattgggggtcaaatgatttaatttgtagcagctccctgggtctcgaagatcacacacacggtcagaagtcaaaggccagaacatgcccgcgaaccgtttcccctcgcccggtcttctcagaacggacgcccttttagattatgttgatatacatgttgtttctaaagtatattaataaagagattagcaaggagtcattggtaccgtaagacaccaatattgcattacatatggtggatccgctccaagcgatatgggtgcataatgatgattcggcagcctggtggggaagcccttatcttaacgagatactagccttttctttttttctaaaggactcattaacgagctactagctctccccgtaaaagctttatttttagctataaacttataaaaaaaacttgtctagatgcataagtataaataaaagtcttttccgagcaaacatagaaggtttttataaggactcattaacaactcaagtcgatttggcttattcatactaacaagttataaaacccacactctgctcgacgagttggcacgcttagctatttagcttgcttcaaaatatgtgtccaagaatagagcaaagatgtgatctctgagcgttagaagtggtcggatggtggataacagcatcaggtgacgctcatttcaaaagttatcaacaaagataatataatgcaattatgcaaatgaaaatgtcaagctctaggagccattccagccaaaaggttcgggagaatgggatgccaactaaaacatcaccagttggtagatctatgtatctaaatgtaacgtcccgcctcccccaggccgggcccacttacatctgatagctttcataggtcatagactgccctcacagaccaacacatgtcttcacgtccatgtgtccagtgccagttgcgctgtgtaaccactacactttgtcctcactcgtgtgcacccgggaagaatttcccggtcggtcacccatcccaaattgctctaggccaagcacgcttaaccctagagttctttggagattggcttccggaaaagaagttgcaacttgttgatatgagtattctattaatcctattaagccctaagccgggatattacactaaacctttcaatatgaaataaccacataagttcttacaaaaaaaggaggaagtcgacctgtggccacaataagggagaaggtgtggcatagctactgacggagcgtggggctcctcaccgggaggccgcgcaggcccccctttgccggttcggccgggg

SEQ ID NO: 62060 - DNA, 9765 bp, Oryza sativa
  unsure (1)..(9765): unsure at all n locations
tgccacctaacccgcgatctgaccggtcacacactgcgaccggtcacggaccggataagcgtgcgctgcgctgcatcaaatgcgtcgtggcgcgctcgtctaaaccgcaataaatgcggttaggtgagccccgctgtgctcacctaacctacacacgtggcgccaaaatcacagggggtcggggcgccccanccctcggggccgaaatgggagcggcccgacccctcggggagacagagggaggggtggccacgtcaccctcgggcccgacccccccgagggggtcaggccatgtgggtgaccgcggctacccaagcctctagtcacgataccctcggccccatgtcaccgacagtagcccccggcgttacgccagggcgattgcccccttcgagggaagcgctcgggcgtgacgccactccttaggcccggtgacaggtggggccggtccctacaggcgggcagaaacccagcggtcgcaaatcgcgcgcatcggcaagggaaaaccgactgacaataatgagtggcctcttcgagaccgctacattactcgagcagcgcgcgaatcgggacgagccggttcatttcgcctgtagacatgatgatggcgcttttctcggtcggcgagcgtatttaacgcgcgctcgatctgtcccatctcaaccgccacggccgcacatctgccgcgcgcgccgcaaacgggcaagtggggttagtggaggcgcgggcgcaagaaacgagggggcgaggtagtgggcgcgggaaacgaggagccgggaatagcgttggcaagggtataaagacgccgaggaagagattcgtttccttcctctcgccattcttccccttgccttcgccacttgagctctaactcttcgtttcctgcgccctacccttgccgcactcactcgctctcaagctcctcctccgccggcgtcatggcacggggctccgctccgctcgacggtagcgtgctgccgccttcccgcatcgtgagcgagaggcaggccgggctgccgcgccgattcatgccggaatctgccaccggcgggaggtggttgcgcggggcgagggacgcccggcgccacactacccggggcggtccgtcttcttcctttctttcgcaatggcagggctggtcccgccattctctaatttcttcatggatattctggagttttatgatctccagatggcgcacctcacgcccaacgcggtaatgacgttggccatcttcgcgcatctgtgcgagatgttcatcggggtgcgcccatctctccggctgttccgatggttgttcaccgtacagccggtatcgccgccgtcggtagtcggtggctgctacttccagccgcgggggcaggtgctgcaccgctacattccctgcgtcctccataagaagtgggacgactggaagagcgattggttctacacccccctcaccgacgaagcgagcctccgacttccgagccagcccccagcacaggcctccagctggcgggcgacggtagatctgggagacgactacgacgccgttcttgaccgcctggcgggtctgcgatcccagggactcacgggggccatggtgttcggcgactacgttcgtcgccggatcgcgccgctccaacggcgcgcccggggcgcctgggagtacaccgggcccgaggactccatgaggacccaccaggggtgcacatgggactgggaccctgaggacttcaggatggtggtccaacgggtgctgaatctcagctccgtggaggcatccctcatcccccaaggtgttctccccctctgcagcgatccagatcgcgccaacatcctgaccatcatgcaggcggtcggggcgtcgggggagcgggccctccgaggccacgatggcgcgggcgggagccgcagaggggaacaatctaccccgggagggggtcgtgcttctgggccctgcgacgggggcccggggggcagccgccctgccgacgcccgggggaagaggaagcaggagggtaccccttccccatctcctccccgagggggcggggcggtgcgtgccagcagcaggcgcccggagggtgccgtgccgacatcgcagcccgagggggagcggaagaagaaacggctccgcaagatgggggggaccgagccatgtcgggggaacctcatctcgcccccgaggtggtcgtttagccgacctcctcgcaggttcgtctccgcgcccatcgcggccgtattcattcccccatctcccaaggcgagttttcactcacccgtttctttttgtcttctggtttttcttctgcctcagcgagatcccgtcgcgccccctccgccattccaagtccggccggtccgaggccgaggagacagcgaccgcgaaggcccggagacgggaagctgaccggcgagaagccgcggaccgcctccgggaagccgaggaagccgcccaggaggccgtccgggttcgccaggctgaggaagccgctcgggaggaggccagactccgccgggccgaggagtccgtccgggaggcggaggcagggcacgcacgccaggcggcctgccaagcccccgacctgactccgcccgaggcgacgacgacttccgaggccacccacgacgaggccgcgggcgcaccgctcgggcccgaccccttgggtgacgctcaggacgagccagcttcgggggacgcccccgagtccggcacgtcgatcagcgggccgagccgcgcggcaccctcaccgaggcggctctctcctctgccttccgctgccccaccgagcgcggagcccctcttgcaggccttggccgccgcgaacaccacggtgttggacgggttaagcgcccagatggaggtcctgcaggcagagcgggcggagctcgacgcggcgtgggcgcgcgtcgaagaggggcggcgctcggtggaggccatggtggaggcgggccgcaaggcacaccgctggcacacctcagagctcgaggcccatcgtagggacctggcggagatcgccagggaggtggaggaggagcgggagactgccctcatcgccaccgccgtgttcaacgcggcgcgggacgacctccgcctccaatacgggagccgggcggcggagctagagaagaagctcgacgccgcccggggaatccttgatgctgccgctgcccgggaacggcgggcggcggagatcgaggcggcgtcccggcagcgtgaagaggcccttgaggctcgcgccacggtgctggaggagcgcgcccgcgcgaaggagagggacctggcggaccgcgaggccgccgtcgccgtccaggaggcaacactggcggcgcacgaggccgcctgcgctgaagaggagtccgcactccgcctccgcgaggacgcgctcaccgagcgggaacgagctctcgaggaggccgaggccgcggcgcagcggctggcggacagcctgttcctccgcgaggcagcgcgggaggagcaggcgtgccgcaatctggaaggcgcccgcgccgagagggccgcactggatcagcgggccgctgagcttgaggcgcgggtgaaggagctggacgcgagagcgcatagcggcggggcggccgcgggcaacggcgacctagccgcccgtctcgcagccgccgaacacaccatcgccgagctgcagggcgcgctggactcgtccgccggggaggtcgaggccctccgcttggcgggcgaggtagggcccggcatgcttcgggacgccgtctcccgtctagaccgcgccgggcggtaggcgggcctctggggtgggcggaccgcgaagtacgccgccaaccaggggggcctcgcccagcgcctctcagagatggccgggaccctccagcggctccccgaggagctcgaggagacgatcaagtcatcctcgagggacctcgcccggggggcggtggagctcgtactggccagctacaaggccagggaccctgacttctctccgtgggcagcgctggacgagttccctcccggaaccgaggacggcgcgcgcgcgcaggttcgggacgccgccaaccacatcgtccacaacttcgagggtacagcccctcggctcgcgttcgccctcgactccgacgaggagggcggtgacggtggtgcggacgacagcgaggacgaggccggcgacccgggcgcgtcggagtgagcccccaggcccccgccaatcttaaatagcttttccttcttcttccgaggccttcgggcccccttcttgtatagactgatttaatctgtaatcaaataaaaaggaaatttctatgttaattctatttgttgtgtgtatgagacggggatggtctgtgccgcggtccttctgtgtcttggcttgaacaagggctcgtgcccaggtcccagcctcaaacggcgcgggtcggggctagtgcctggggagatccacgtgtcgagactggccaggccgggagcgtggtgaccgagggttatggatgacccgattgtgggcctttgccgattcccccccggagttcaccacgccccggggcacggctcggttctgggccccttttgtcgattttagccggcccgggccaccgagggcaggatcgagcacgagcgtgctaattcaagccaagattcttcaaaaggaaacaatggcacagacacagtccttaggaaatcgaaaatgcttttattgaaatacgtaagataaaaaagataagtatatgcatgtggtagcccccggccaaccctgcacgcccggggggggggtgcggggttggcccgagcccgagacctgacacccgacccccattaggggtagaagcgacgaaggtgttcgatgttccacgggttaggcagctctgtgccgtcgcccgtggccagccgaacggagcccggccgggggacaccgatcactcgatacagaccctcccacattagtgagagcttgctcagtccagcacgtgtttggacacggcgtaggacgaggtcgtcgacgcagagtgatcgggcccggacgtggcgctgatggtagcgccacaggctctgctggtagcgtgcggctcggagggccgcgcgcctccttcgctcttccaagtagtcgaggtcatctctgcgaagctgatcttgatcagcctcgcagtacatggtggcccgaggggacctcagggtgagctcagatgggaggaccgcctccgcgccgtagacgaggaagaaaggcgtttccccgattgctcggcttggcgtggttcagttcgcccagagcaccgctggcagctcctcgatccacgagtcgccgtgcttcttgaggatgttgaaggtcttggttttaaggcccttgaggatttccgcgttggcgcgctccacttagccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctaaacggacccaggatatcgagcccccagacagcaaatggccacaaaagaggtatggtctgcagggcctgggccggctgatgggtttgcctggcgtggaactggcatgccctgcaccgccagaccaggtcgaccgcatcgttgagagccgtcggccaatagaaaccctggcgaaaggctttgccaaccaaggtgcgtgaggcggagtgggctccgcactcgccttcatggatatcggcaagaagctcgacgccttgttcccgaggaatgcacttcaggaggactccgttagccgcgcgccgatagagggtcccttccaccagcacgtagcgcttggagatgcgctggacgcgttcactcccttcgcggtcctcgggtagagtcttatctgcaaggtacgcctggatctcagcgatccaagcaatcaatctaagggagctgggaacgcttccctcgggtcccaaggcctggactccgacgggcctcgggggccgttcaggcgcgtccgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacctggcgcacgtaagcgtccatctgcgggtcagagcaccggtactccttacagacctggttaacgaccagctgggagtcgcctaataccaggaggcggcggatccccagtccagctgccaccctgagtcccgcaaggagtccctcgtactccgccatattattggtcgcccgaaagtcgaggcgaaccaggtatctgaggacgtctccgctcggcgaggtcaacgtgacccccgcaccggcgccctgaagagacagggagccgtcgaactgcatcacccagtaggcggtgtgaggcagctccgaggggcccgagctggcctcggggacggagacgggctcgggagctggggtccactctgccacaaagtcggcgagggcctggctcttgatcgcgtggcgtggttcaaagtgcaaatcgaattcagagagttcgattgcccatttcaccacccgtccagtaccctctcggttatgcaagatttggccgagggggtaagacgtaaccaccgtgacccgatgcgcctggaaataatagcgcaatttcctcgaggccatcagaatagcgtaaagcatcttctgggcctgagggtatcgggtcttggcgtcccggagggcctcgctaacaaagtagacgggccgctgcacctttcggcggggccgatcctcttcgctaggggccgcatctccagggcgctcttcgtccgagaggccgcgcggggcgcactcggcttctatgccgacgacctcggggtcagagggcgacaggcgcggccttcccgcagtggccccgaggccatcctgggggtcgagggcgcctggcaccgtcggacaagcgggcggagggccagctccggccgtcgggggcctcgggccaccgttcggctcgggggcctcttctccctgctctctcccgggtcgagtcgacacagggtggggatgcgcggagtgagggctgtcctcgtcgcgctccacgaccaatgccgcgctgaccacctgcggggttgccgccaggtagagtagcaacggctcatctggctccggggcgactaggaccgggggagaactgaggtacgccttcaactgagtgagggcccgctcagcctcctccgtccaggtaaacggcccgaagcgtttgaggagcttaaataggggtagcgccttctctcccagcctcgatatgaaccgacttagggcggccatgcagccggtgacgcattgcacatccctaagcttgctggggggcgcatccgctctatagctcgtatcttctcggggttggcctcgatgcctcgggcagagaccaagaacccgagaagcttgcccgcaggcacgccgaacacgcacttgtcggggttcagctttatgcgagcggagcggagactttcgaaagtttccgctagatccgagagtaaggtctcttggttgcgcgtcttcacaaccaagtcatcaacataggcctcaacattacgtcctatttggctacccaaagaaattcgagtagtacgttgaaaagtaggacctgcattctttaacccgaaaggcattgtcgtataacaataagttcctatgggggtaataaatgcagttttttcctcatcctccctagccatgcgaatctgatgataaccagagtatgcatctagaaaacacaaaaggtcgcaccccgcggtggagtcgacaatctgatctatgcgaggcagggggtaagggtccttaggacatgccttgttaaggtcggtgtagtcgatgcacatccgaagcttgccgttcgccttgggaacgacgaccgggttcgccagccactccggatggatgacctctcggatgaatccggcctccagaagtcgcgccacctcctcgcggatgaaggcttgacgttccagggcctgccgccgcactttctgccggactggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgacgcccagggcaacctccttgaccgggacctcgtcgcacgtgatcatccgctgcctcggggcggctgggacggaggtgctgagcctctcgtcgccacccgcgggcttggacgccgcggcgaggtggtccgcgcgctgctccatacaagcaagcgtgactttgaggtcgccatggatggtgatggggccaccggggcccggcatcttcatctggagataggcgtagtggaccgccgccatgaacttcaccaacgcgggcctccccaggaccacgttgtagggcagactgaggtccgccacatcgaagttcacccgctccgtgcggaagttggcggaaccatcgaaggtgaccgggaggtcgatatgacctagtggccaagtgtgccccggcgtcacaccgatgatcggctgggacggccggagcaccatccccggggccttgatgtcgtcaaaggctgcgggggaaaggatgttgagggctgcacccccgtctatgaggacacgccccaacttcacattgcaaacggtgggggaaaccaccatcgcgatctgtcccccccgggcaacgcacggcgggtgatcggtctggtcgaaggtgagggcaacctccgaccaccgcgcccgccgcgtcgcctcatgggtaggggccgcggccaaaagctctcgcttcatggccttgaggctccagcgagaagcgtgagcgcacgctcccccatcgacggtggcgatggtggcctcaggctcctggaaccccaggccatcgtcgccatcgtcgatgtcctcggcgggggccttctgcttggcctcacttcgccggttgccggcgggagccgccggggccttgccctcacggcgctcctacctcctctcctcccacttccttgtccgctcagccaaacttttgaccgcgcggcagtccgcgaggtcgtggagggaggtgttgtgcacggaacaccacttgccagtcgggcgctccctgctgggagcgccggcctccttctttttgtcgctcgcaggcctcccctttcgggtggcccgcgaagcgccctcgaccgcgaggacatgaccctcgtcgtcggaatgggccgacctcttcttcctcctcctgtcccgccgccctgaccgagcggcggacccgggggcggccgaagctgccacaccggaaccggaggagttccaggtccaggcctcctccttgcgagccacacggtccgcgagctgaaaaagctccgcggtggtctggggctccttggaggcgatcttctcgagcatgcggttgtgccgcacgccccccctgaacgcgtagatcaccgcgtgtgcggggatgcatggtatggtgttgcggacttgacagaaccgctgaatgtacgagcgaagagactcatcgtcccttcg

SEQ ID NO: 62061 - DNA, 6329 bp, Oryza sativa
  unsure (1)..(6329): unsure at all n locations
cttggtgacggaggaccgcctgccggcgcctaggcgctgctgtgctgtcatgaccaagtcggccacatcatccagccaacgtcgggctggagtctctggatcggggacgacgggcgggtgacgcaggaacgcgcccgcagcctggagcgcgccctggggcgtgctgccatcgccatagacgaggaggcgacgctccccgtctcgccgtccttctccatcgcccgcaagcggcgaagtcgcggatctttcgaccctctcgagcgcctcctcccgctcaagacttcggcgagagggggacggtggagtacgagcccgacggcgcgggttctgctccccgtcgtcaccgctagcactcggagagaggttatgcgccatcgcccgttcggccattgggctgagcgggtgaagcttggcgcacacgaaagaggacgagggcttagaaagacacacgcgccccctacctggcgcgccagatgatggagcgtggggctcctcaccgggaggccgcgcaggcccccctttgccggttcggccgggggcgctaggtgaggttctttaccctcgatctgtggaatgttcgcgagagagcaaatgcacaagacacgggcgatgtagacaggttcgggccgctgagaagcataataccctactcctgtgttctagtggatctgtgtgtgaaggaactacagaaagttggagagctaaagagttcaggtattctcagtgtcgcctgagagttcccctccttcggtgggcaaggtcctccttttatatctcaaggggataccacatgcaccacttctacctactcttcttttgggtggggacccaccctatcttgaccaaaacttggctcgcgccttcgcctggaagctaaatcacagcttgtccttgagtgaggcccagcgtcatcactcgcctgacacaggggatctccctgtcattccttcattaatgggtgaagatttgcaatggctgctgtccgaatgaccctccgatgggatgggtcatatctacctccactccgccggaagcagatgcaacgtgggagctcggttgtctgccgatgacgtgaccggcgtcagaccagtcacagaccggtcattcttgtccaccacgtgtcagtttagcacgccgcacgtctgcccttcttcatacaatgacttccttgcaatggttgcgatgaagcctggaatgtatctggccgggactgacgtgccaactccaggagttaacacgccggctccggctagggacgagagcatggaggctctcatcatttcgacgggacggggcgaggcgtgtgacaggccgcctgttgccacctaacccgcgatctgaccggtctgttcacacactgcgaccggtcacgaaccggataagcgtgcgctgcgctgcatcaaatgcgtcgtggcgcgctcgtctaaaccgcaataaatgcggttaggtgagccccgctgtgctcacctaacctacacacgtggcgccaaaatcacagggggtcggggcgccccagccctctgggccgaaatgggagcggcccgacccctcggggagacagagggaggggtggccacgtcaccctcgggcccgacccccccgagggggtcaggccatgtgggtgaccgcggctacccaagcctctagtcacgataccctcggccccatgtcacngncagctaccatcaagatggcaattatattgcacatgcagatatgtcatttgaattgcgcagacattataaaaactagttgagcggcccgcgcatttgcgtggctagcattaatttaaaaatatctatttttaccacatgattttatttaaattatcattaccgtgattctaataattttatagtttttaaaagcaacgtcagtcgctacccttactcctttgtcacctttttatttgcttacttgatctaccattacttatatttattctctttagaaatttaaaaattagaccttatagtttttagatttcattgccttagtgggtttcgttttcataatttttagaagtattgtcaaacatgccaatttattattctacggcccatctgctgccacatctttttattgtcattgggattttaaaaatcgaacataattattgtttgtgttctttttttactttctataagtcttgtcaatcgttagtggcttcaccactatactcttctacagccagcccgctgcctccctccttggtgtcattggaattttaaaaatcaaacataattaccattggggtttatttttactctccataagtcccgcaaaccgttgtgactatgctgcttaacggtatggccatcgccactccttttaatcatcattgggattctattggggttttgtttatagttttcagatatcccatcaaccaccagcactctactcctttataggcctactgcttctcccctctttattatcatttgtcatcgctgtgttttagatggaattttttttttgaaaattgcatatttttcattccgataatttttattcataaattatattgagtaaattacacccatggtacaacaacttggcaggtgtgtgcgatatagtgaaaaacttgagaattgaacgtccgagtacaacaacttgacaagtaggtgcattctagtaaaaaaaacatgaaaaatactgataatttagtattttggtgcatcaacttggctaagcatatgctaggtgggttttgttcacgatgtcaatatgccattatagtattcctacggatattaccttatagtattgaatttaatctttaagaattatactacacttacaatttacatctaattacctttaatttttttttgttttcttcaccttctcaaatatcaaccgaaatataataatttctacatctagttttattgactttcagttattaattattaggatacaaatataaatatgcttatacaaatccacgctagtatattttcaaaataaatacttaaaaaatgaaattatataaaaaaaatgctccaaataattaagttgtcacataaatttttaatttagtgtatgaaaattgtgcctatcttgcaagttgttgtatttatacgatcactcttatactaaattacacattcttaccaagttgttctattataacgctcatttctgaagttattgtaccaaattgcactcacctaccaagttgttgcaccgtgggtgcaatttactcaattattatattcctacttgaactcttataattatttttatatttctaaaacttattttatgtgttatttaaaactttaattaatctcgttatgtgttctacattgtcccatatttcaatagtctttattttttattacacattttagttattaataaattttattctagttgagctgttatttgtatttgtctattttctgaatatattttattttttatttcgagttttaattagtctcgtattgtgttatatatcgactattttttaatatatttttttttcaaatttcaatttttcaaaattatactcctacttgaactacattttttattttttatgattttggattttatttgattttttgttttgaattttaattaatatcatactggtttcttatatggactcttctttcaatattgcttattttaaatttcgaattttagttattttcaaattgtattcctatgtgaacttttcttttatttctattctagttgtggattttattttatttttattctgaattttaattaatctcatattggcttcttatatgtactcttctatcaatatttcttgtttttaattccgaatttcagttacattcctataatagatagatagatttcattgtggtattgaaaatggtaaacgctaatttggttagttagtgtcacgccccgaactagtaccgaccggaactagcccgtgacgctccaaattaacctgttaatcgatactagtcccaggaaacagtgctggtatcacaggaagacagattatcacagcaacagaggtctctttattatagagtagaggtacagtcatattgggctacggacagaccccgagctcacaactgcattacaaaaggaaagcggaagccaggactaggaccaaacatcacaggcgcgacttgggaactaggccgaaaccctaaaactcatcgtaaccggcttgctcctggaagaactcctcatcagcgggatctgcttcgtcttcttcagcaactggggggggattatttatatagagcaagggtgagtacgggagtactcagcaagccatgggaaattaagtgtttaatgcaggcttcaaggagaggctgttgtttttgcagttgattttatttgaattcttttctaaaaacaactaagtgagtgcttctcaaacgacacggatgagacagtgcgtctcgtccggtcggagtatgtgcaatgtatcagtctttagaattgaatcaaggttggcacccggccaacagcttttcaaacggccacctgggccaacaactttcaaacggccacccgggccctaaagccgtcgatatccccaatttnccaggggcccttgaacccaattcatatttttcaaacatcgaacccctttccacaacagcaatttcataagcagtagtcaaacaaaactacgctaggaatcacctcacatccgcccatgactgtgggcacggctgttcgaacaatttgttaacctctgtagagggggtacactttacccacacgacattactaacccggatcacctagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccctgacaccaccccggcgaatccacatgtctctcggcatcaaggctcccctgataagctagttactcagccaggggtgttccattccacccatgtggtcgtacttgtcttatgtttggatgaaattccaaggaaacggtccttaagtgcaagagcgggaaaccgtacacccgatacgttccccggtccgctgttttggaaattcatttagttcgcaagcaccgacccaggtgtcgggttttccaagtctttcgtaaaacccaagttttacccaagaagttttttagattttaagtttgaaggcgtccgtcgatactcgcacagggtgcacgaatatcaagacgcaactagatggttacaaggggacacgatataacaattatcaaaggaaggatcaaatgcaacaaattaggtaggtccgccaatctgccttgcaggcgagacaacagattaagtgcgatcctatcaatgcataatatttttaaaaaaacataattaatttcaaatataggctcaagatgttcaaaggtggcttgccttgctcgagatctggagcttgatcctcgaaatcctcgcactgcgggtcttcgggctccgaaactacacgcgaaacgggagaactcaacaaacggcgaaaataaagccctattaatgacctctaagcatgccattagatagatctcgagatttgaggaattttggaagttgaacggagtcaaacggatttacggttgggaagatattgaatttctaagattattgaatttttggtctaaaggaaaaggatttcattaaatcctttttgaaaaagaaaagaaaagaaaagagggagggaaaatagacttttcctcgggcggctagtgcgcggcccgagagaaacggagcggttcggccggcccaaggcggcccaagcgcgcgcgcgggagggaggagagagagagccggtggaccgggctcaccacgcgtggtcccgggtgggacccgcttgtcggtgacacggttcaccgtgcggagcgagcacgcggcgcacgcgcgtgggcggggaagggatgcggtgcactcgcgtggttcgcggaggaacggatgcggcgggcccacgcgcagcctcacggctcgcggtggaacgcgcgcacgggaggggctgaccggggtcggcccgacccgatctcggccgagctggcgccgacgtggcgcctacgtggctgccacgcgggctggcgggaggaagacgaaggcgtcggccacgaatggacggcgggcggcggcggcttctccggggcgccttgcgacgatgaggggcgacggggcgtacaccgggatgacgagggagaatgagagggagcgagccaacggcttggattcgccggagggtgtccgtcggcggcggattgcggcggcagcacccggcgga

SEQ ID NO: 62062 - DNA, 1308 bp, Oryza sativa
gggtagatgggccgagagggattcggcccatcgaccccgggggaggcaaaatagacttttgcggaggaatttgatttggagggatttggattcgggattgaactcgacgatagatcggggatttgagatcttgagatggcacggacactagacaacaagcaagaaacaatttcgcaattagggtttttatgagataattttcccgctaggcgccacgacggaacgggcgctacagttagtcaggccttatctcttattttggataaattgacttaacaagtgttttatgagccaattcgggatcagctcgttaatttagcactctactcggcttggtatcatggtatgaataagagttcaagccgcgcccaaagtgaaccaagccaactcatgctcttttacctttttcctatccctacccatgtcctacagtctacagatagactctttttgccaccgtattcttattggtaagtgacttaccgctagttgtttccaagatatcgtgtggctgtatttgacatgagagaaaagagaagattgagaaaatatgcaaaataaggtgactcattagcgtatgattaaatgggtatatattaactattttaaatttaaaaaataggttaatatgatttttaagcaactttcctatataattttcttttttgcaaaacacaccatttagtacttcgggaagcatgtgtgcggagaataagagaaatcttttctcaatcaccagctaccgaacacagagtgctgtctcattccttcttacgctataatatcctcttgaactatttaatgtacgttgatcagacatcgtcttatgtgcaagctagttattctcgcaagttattctcttagacttttttttgttccttttattaattttctatttttgagactccactcaatcctaatttcttatcctgtggactcatcattttctttttatgagttctccgaatctgatttcatcatatattagctttttttccaccatttttttctcctctttcaattttgatgactgcaaggaatgtaaacgagagcttgtcgggggcgtgtgatctcagcatcgacatcagcatggtagagacccctcgcgggcaataaccggtcggccgacggtttgaccatggtcgagaaaactgaggagaaccgtatgaaaccgtcacggcacacgacacggtcgcgcggaccattgaacggtaggagacgagacccgtagcaagtgggtgtgcaaccgtgctgtgcctatccaacgcgaccccatgccgattcgtctctccaagttcctctctccga

SEQ ID NO: 62063 - DNA, 2258 bp, Oryza sativa
gcatgagtgcgcgcgtgacagcgccaccacctgccgcctgctggatctcggcttaaaattgggactttagctagctttgttctcctgttggtgaggggcagcgatcacgtaaaacgggacagagggccatgtgaccacaaagtataaatgtctccgtatcggctagctatcagcctatcatcggtcgagccttcaggctgcagctcagctttggttggtttgcttggatcaggtgcgtcgtgtgtggtgtgccgggcggcacggcatgcatggggcggcggaccggccggcgtgcaaaagctgccgcagagaattcatttggaaaaggcgtgcgcttggtacaggtagaacacgtgcacacgcgctccaaggcgagttagagcacgttggctctcggtgcaaacgtgccacatgcatggtccgattcaagtctttgaatagaccctacccgcctagtatgtaccagctgtccgtagccaagttttctttagctttggttaaacttgtgttccacttttgattttttaccaaattaacatgacaactactgttgcttgaattctcgattcatttcgtgaattacgtgcccgcgcgcgtgccgacctgcgttagctgtcggaaaagatagtcaaagaagaattaccactaactctatggtgtttggcaggataaacatctagccacttgttgcaatcaaattgataagccaaaactgtacaacgaactatattattatattgttacgacttacgagatacacgtcatataatattgaattcgtgagtcaccttattctggtagttcttagaaatgcaatggacggcaaaaaaaaaaaaaaaactatagatactagcacagtggtccgcaaactatatcgaccaacctgcccatttataatttgaacctacaatctaacagtaaaaagctatttttattcaataatgtaagacaatccagggctccaaaaaaaattaatgacattttttaagttatatatatatatatatatatatatatatatatatatatatatatatatatatatattattttttacccgttgcaacgcacgtgtatttttctagtgtatatgatacatgaactctatggtgcctggtctataagatttaaatttagtataccaatttaaatgggtacgaaaaagttcaaaacttttttgggtatgaacattaactgaatttgaccttatatatgcgtctttggcttttttttttcctaaataattaattagggtatgtgatatgagatagtgaaatattttaaaattggagttattttgttgcaagttatggttatcaataagtaaattgttacacctaagtatgcacccataagttgaaagctttcaaaaaaatgagctaaattcctgtatctcaaacgagctgaggcctcaattcaatttatcataccgagaaacattctagattagcaagaacatctggcatttatattattatggttgtatatagatagcaaatttgaattcagaaaatagagcaacacggacataattatggtgttgtacaacatagcgttttctttcgcacaacaaggtcgtggagccaagcctcccgtagtgatgaacaaaaccgaactagagctggacaacgacataccatggattcaacaggaactttttcaacttttataatagtaaaaaaaagatatagagatagtactaccgaataattattcctgaaggcacaggcgaacatgcacatatatatattatgacacgactgaaggattatactgttgccaaatgtagttatatgcatatcattatccaaattggactttagttagttgtactatcatagatagattctcaaacaaaaaaggatactatattttctatctagattcctattcgaacaaggcctacaaacaggaggcatatatctataggctgaggtttgacgctttgttactccacgaggcatatctataggtctagccaagcataactgtaactctaccaaggaagaggaataagagtacatgagcaagctgctttgatctgaaccatccattgcaaccgaaagaattcacgtccagtctcgataatgttcgaatcgtcccatgagtggacattaattaatttatatgcctgtcctataattaaggtgcagatttgagaaatgaaaaacatgcataatgttttgtagaatatatccagtatattctcttggtgtttgagatgctcagcagctaggatcatgattttgcatgcacag

SEQ ID NO: 62064 - DNA, 939 bp, Oryza sativa
acatgtgctaaaaagtcaacggtgtcaaacatttcgaaacgaagggagtatattggaacaagaagcggtaagatctctttttgaaaattagaagaactttactgtttcctaaaagggtaaaatccgaagctaatctgcaagcacgatctcaactccgattagccttttatgtaccatcagatgttagctcagtactgtttcgtattaaaactggaaattcgctggagggagaggactataccgtgctcctcaacggctttgctgaacatcggcagcacgcgcgggatgatgtcgtggcagccgagcggcagcggcttcttccgggcctcccggttgagccggacgttctccggcacgtcgccggtgaagaggcggtaccggttgccccggatgccctgcgcccggagggcgcgctccagccgccgcggcgtccaccaggcccactccagcgtcgacacggccagccacagcagcgccgccacggccgccgccgcggcggcggccaggatccactgggaggccgcccctagcatcatcagcatcagcagaggcggcggcagcgcctcctccctcgcgggccgctcgccggtggcgcggtggggtgagaggaaagcagaggcgtacggtacggctgcacaggaccacaggtgatccgcgaaaccgtatagccgatattgttgatgatctcgacggtgatgtgtggcctttaaatatgtaggataggtgggatgacacgttccaagattacacaagaaaaaaaaaatctcccacgacatctggtactagagtctacaccaggttttactgttttagactacacggttaccgccagatttactatggtttcagaagttgataaggttactacatataataacggtgataaccgcatgataatcctacagttttgcaaaccctagtttaaacatgcgttgtttt

SEQ ID NO: 62065 - DNA, 13558 bp, Oryza sativa
  unsure (1)..(13558): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagattagtgaacttcagtgagcagctattccgttgagatggacggaaacatcttgatcttatatgtagcccatctgctgttgctgatttctcgcgtgtgttaatactagctttacttatgagcaatcatgtcagcatctggtgaaatttgtaaccgccttcgagtgtcaacatatatttttgctcttcactgttttcaggaagactggacataacctccactgtattttctgttgccaaaacattggtatagagttttttgtataaagattcttatgatgctttcacgattaaggaagacacaaataaagtaactttgctctcagatcaagaactgcccatctgtgtttgattgaagcaagttgtatggtttcacattctgtagtaagggacaagagcaagaaattcatgtgttttttctattgtaattgaaaattttgacgggggaagcgctgatatgcatacttcctgtgtgttctaaagcctgtgccttctacatgttgcagctccatttttgccatagtttagtaagcagcagctctgatgagtgataagtggacaattgatcagctctaatgaggctggaacctgaaatgaaatgactgacaaccagtatccagaattggtcctggtctgttctataattggcttttcatgggcctctcctgtacggtcgtattttctctctgctgggctgtaatcttgtgcgagattggccatgcctttgtaagaaatgggccttagtgggccatgtttactgtagctgggccctgtttgtttgtccagtgatggcccacctgtcagtccagtccgtggatacagacgccggaagcggatggacgtgactcccgctcgggcgcccggtggaaggagattaaaatcgggcgtcagcacccgatttactacgtgtaaactcatttttctcttaaattactcatccaaataatgatccgattgcaccattaaattcattgcaattaaatattaaaaaaacaagactatattccgacgaaaaaaatagcttattattaaattatttttaaatattgcacgatgtttcactaggtatataaaaacaagatcgaaagtgtttcactcgtttaaatcgggtgttatttcaccttatataaaaataaatatttcagcaaatagcgaaagaatgtttcagttcactgcaacattagatctatacataatgaaacattatgagtacactaggtgaatattttcggtggaacagaaaataaaccaaattattttaatagagagtttttaaaatatatgggtgatttgttgcaatgaagttgtgtgggtgtgtggaagtggcaggtgggtccgtgaggagagggagacacgtgggtgggccgcagggcgagcgtccgatcctggcgcacccgcgccggtcgaccgagaactagcattctcggaagcggacagcagcagaagcaacaagcagcaaccacttcccggcgggagaggcagctggaagccggagatggtcgccgccgccggagatcgcctggatctccccgtggtggacctcgcgtcctccgacctccgatcctccgccgaatccatccgaaaggtgcgcgcccttctccccgtggcaatttccgccaacttctgcgaggctccgctatgttccgtgggtgcggcgacgaggaagcgtgattcgtgtggtgtggattggtttcgcaggcttgcgtggagtgcggattcttctacgtggtcaaccatgggatcgaggaggggttgctggagaaggtgttcgcggagaacaggaggtttttcgagcagccgctggaggagaagatggcgctgctgaggaacagcagccacctggggtacaccccgccctacaccgagaagctcgacgcctcgtccaaattcagaggtcttcgccttctattagtcgattcatcgctagcttgcgatttgctgcatgctgacccgtctttttttaatggcaaaattaggtttgtgttaagtgaaattttagagatatgctttggtccaacagaaagtaccttttggcaccggtacctctcggtaccaaatcgtttccgatcgttggatctagcaatgcccatcctgccagctagatccaatgatcgggaatgatttggtaccgtaaggtattggtacctcgagatactttttgttgaatcggagcaaatctcgaaattttaagcctaaagtgtgcctgatagtactagataggttaatttaatagtagaacgtgaggagctggaatgggatgacccttgtgttagcaaaagacagagcttgacaagtcaatgcctgatggaatatccctccatcccactcactaagacacacgcattttaagatttgactttttaaatatttgactaataaatagtttattatgaattaaattttcatggttattgatgaaaataatatcattgaattgtcatttgaatttactttatatgattatgattttgttgctacaaacgttgtagtatactagtatatgagaaatttaaagtcaaagatagactactaagtttgatagcaccttagtgagtgggagagagggagtataagctaattaaaaatgtcccattgcttgtgaacgatgtcttttaaaactggccacaagccatgggtcaggtttgatacacctgaagatcacataatcttcaattagtaaaagtggatatgattcaagatggagcacataatgagacaagtgctgaagaaccatttaccagtttaccacatcctcactgcctatagtttgaacaattgatacatcttgtagattttaccttctggtgttttgtagtaatgtagttgagattgttttctgtgattttgtgatccaggagaccttagtgagacattcaaaattgggcctattggagacgaaggttttcagaatgatgctaaccaatggccttctgaaggtaaatcccactccccaccctccaccctttccaaaacataaacaaaaccctttccaaaacataaccaaattctatatttgggtgcagagcgcctgccatgttggaaggagacaatgaaactgtaccgtggaaccgcactgtaagttttcattttgctcgtctcagtgaaggaaattcaataattatattgctatcgacagccatccgtccatcactgattcgccgcgtcagtattgtgtttgtgtaatacttctatatgactgtttcattcatgatttgaatattcccacttatttgctactacttccaggggtactggcaaacggatactctctctagttgctctgagtttgaatctagacgctgaattctttgactgcccattggcatttcttcgattgttgcactacccaggtcaccttattgcatgtccctttctcatatgaagttaaccaaagttgtggagtaatgatatgcagtgtactgctatgtacatgcttgataatgtccttatctcgcttcttgccatgtcagaatgcagattgatgcttggatttgttcttttgcactgatttgttcaacaaatttctttctttgaacaaaatgctgtatgtcattctaaaggatgaagaacatgatatcctcctattgatgtagctttattgggttggcccttgggaacattacaaatatgtcaagtaaattataatgaaaaagtcatactgctacttgcatggtctcaattgcattttttactaaaacttcgtttaatatctcacttgttaacttgcactagtagctgacagagtagatctgcgtgatagaaatcgctaacagttcaaactaatttatcttgatgctgacatactgtatactggagtgtaatgataaatatgttcttgtaaatcaatatgaacctaagttatggaggttcctaaggtagctttgttttctgcattgttttgcttgctattgtcatactggaaagtaggatatgaactgaaaatatcatgaaacttcaacctgcttctaggaacttttgttttggaggactgactttgtttcgttgttattgtgttttcttccttatatagtagttattggttttgtctgaatagaaaataattctaaatgtaggtgaaatcaacgagtccgatgatggcaactatggagcatcagctcactcagattatggaatactaacccttctagcaacagatggcattcctgggctgcaggtacaccatgttcttcacatatattaattcaccaatttcaattctgttctcttttccagctaatcaatcatgtagacaaatacatgctcagaaggtttggtgagaatggggttatgtgatcaccttttaccactttcaagcaaaacaatactttcctgtttagaaaagcagaaaaataatatgtattatttatttttacatttatattctagttttctcactgttgtgcgtttgcagatatgcagggagaaggataggcatccccagctctgggaagatgttcatcacatcgatgggtaaatagtaaaatactttttggtgatattaatgaataacaattccaaatatactgttgctttgctcttagctctctggatcactgtcttgtgtgctccttagataaccaggtcttgtgtacagggctctgattattaacattggcgatttgctagaaaggtggacaaactgtgttttcaggtatcatccgtttgtacttcaattaatccattatgtggttgtgaggaagcctcatgtgctgtggtgactgttaagaaagttcaaataaaccagctacagttgtgagtagtttaaccaaaaactttctgttttttgcaactcgatatgattaaatatgctcgaaagcacaatgctttctaagttggtttaggcttgtcaatatcatgagcaggatagatcatgtccgtgttgtttctgaaattctacaggtcttttcgagttctgaaatttaaggaaaaagccttgtgtatgaattttgattattcttgctcttttgctgacttgtaggtctacactgcatcgtgttgtggcagttggtaaagagcgatactctgtgagtattactaaccactgaaattagaatttcattattgaggggtttcagctcattgaattattgctattttttgtggaagctcccattgaattcatgttctagagttggatgaaccccgctttaagggaaaactaacactgataatatatagcacttcagtgacttagactaaattgtgtgcttaacttcaggacctttctggtggacattctttcatacgcaagttttttttttttttaaatttgtcaggtggctttctttcttgacccagaccctgatttagtggttcagtgcttggaaagctgttgtagtgaggcatgcccaccaaggtcctcttctttctcaatcttagcattagtctagttcctttggcacttgcttctcatattgtttgaaatttgatgcattttcaggttcccacctataaaaagtggagactatttggaagagcgcttgagctctacatataaataaggaaaaatttgctacatgacacctaaagtttgttgttttagccgtaggacactcaaagaacgtgtaagcatggtaattatctgctggacaccgaacacactattttattattatattcgatgccaatggagggagaaacagtaatgaaagtacacatttacccttgtgttggtaaggtgtgtctagttcgaagcagccgctgtaattcttaatgctgctgccccagcagtagcttaaatgtaatgcagctaattacgtatcatattatgtacgatcatgactcaaaattagttaacattggaatgatctttccagaaataaaaaggaagttaactcgctcgccgcttgaatccaccgctcgccgattgaatccgctgttgcgcgctcgttgcttcaatcggccgccgcactcgccgcttcaatccgatattgcactcgctgcttgaatctgtcgctggcctaactttagtatctgtatacaaaactaattacataaataaaagttaatttgcgagataaattttttaagcctaattaatctataattagagaatgtttactgtagcatcacataggctaatcatggattaattaggctcaatagattcatcaagcgaattagtccaagattatggatgtgttttattaatagtctatgtttaatatttataattagtatccaaacatccgatgtgatagggacttaaaagttttagtcccatctaaacagggtctaaagctcacagccgatggtcaaccttgcaatcacagcaccatcgtcaccaccaaaacctaggattttagaaatttgaaccagacctactcgggttaaaaagaaactagcctcatgggtaaacttgtcccttttaaaagtttctccctctatttgaatcaaatataataaaataatgtgtttggtatccaacagctaattgtcaatttgccatgttttcacggtgtcctctagcatatatgcgatctttggatgtcctgtggctaagaccataaattttagatgtgttgatgtgaaaaacacgaggcctgaaagatctgcttaacttcagtgcaggtccaaaaatattgcttttaggttcgtgagcgtgccagttgatttgatcctgcaatcaacaagaaataaagacaaagaaaccgcggttaaatccataaatgatagccgatcggctagccgccgatgacatatcatttaactttaagctggtgtcatatgtgaattgataagtaatcatgaataaataagaaagaactaaatctactcgatcggttgtagatgttaacaatatataatccttatgtcgatatatacttaaatcaagtgattgggatagatcggtcgccatgccgagacaatataaatcacttagatcaaaatatatactaacaatgagattatagatgttcatagcatagccgatcagatagatctagcatgtatcggctaatactccgataccactctatattaagatattaaagcaagcaaaatatatcaaacagaagcctaatatattttattgtaataagatcttaacataatggcagatctagcatatcgattaagcacatgaaatataaagctaaatcaggtaagaccggctgaaaccccaatactaccctaatcggcaaccaaaagcaggctagagattaagattctaataatgacttataagatcaaactcaactgatgcagctataagtatgaaaagaaggacaacatctagatgatcaagccgttgtatgttttatagagtggtagatatcatgtataatctaagtcaacatagatatttaacctaattggctgccttccaataatagatgttagccggttgaaggttagacaacgatattgtcgaagattatacagagtatatgataactcgacgaattacataaacaagactagagtatcatgaagatggaagcactaatcccgagaatgcaagccgccataacaagttttacccctagttgaagatcgaaaacgatgcagctcaacccgaaagcaagaactcgtcgaaacaaaacgaaagtaaaagggtggcgatgcgctgagattgtattgaacgtgtgttgttgtattacatgaggctcggggtctattaatacccgagatttacaaaatatgtccgtgtcggacacgactcttatctctaacaaactctaagataccataagtctttgcgacagacttttgcccaaacatatctctaagaaaattacatgaaatatcctaattaatagatacaattgtcttctcaagactcgatccatacatggcaatcctcatgaagcacattaactcaacccgacagcgtgtaccgctccacattgttggcatcggctcaatcggccaaccttgtccgactcgaactctgccgatcctgatcatagccgattcggaattttagccgattctcgctttgtttccggaacgatctctatcttgaattccgcttcgatttatcttcatctccgatacttggattaccaaaatttgttgttaacaagatgtcctattgctaattttgcctacaacatttttacatgtgtaaagcttaaaattgataactggctcccattaaattggctgctacatgttgcagctccatttttaccataatttagtatgaagcagctctgatgagtgatgattgactattgactagtgagcagtgagtgatcagtggttgatcactgatcaggctgaaacctgaaatgaaaggaaaaagtccactttgactcccttaattgtatgccgaatctaattcgtacccctcaaccagaaaaccagagagaacgactccccgaactattgaaaccggtgcaatttgactcccttagcggtattggagggcggttttgctgatgtggcgctgacgtggcggtattgacccggtcttcgtcccacgtggcgcttaagtggcattagaattaaaaaaaaatgtgggacccatctgtcattcacaccaaaaaaaatatatttgtgggacccattgacatgtggggcccacatatcatcctctatctccaacccttcttcctcctcccttcctctcacatgagctgcgtcctcggccgcccctccgacccctncctttaccacccccagcagcccaaccccccccccgtcgccccggagaagccgcccgccgtcgccaagaaggcggccgaggaggaggaggagaagaagccgccgaagcaggctaggagggagaggcacgcatggtcgtcgcggtctgccgacgccgaggcggtcggcctggggctcggggggagcttcgccaacagggcgcgcggggagcaggtggcggccggctggcccgcctggctctccgccgtcgtcggcgaggccatcgacggctggaccctgcgccgcgccgactccttcgagaagatcgacaaggtacgtactcctgccctcgcgctcgccattgttggtggtgggggaagggaactgagctcatcggtcttgtcggtggcgcagatcgggcaggggacgtacatcaacgtgtacaaggcgcgggacacggtgacgggcaagatcgtggcgctcaagaaggtgcgccgcccccaccccggcgcgcgacatccccgcccgcaccggccgccgccgcctccccccagccgctccctcgtgccttcctcgccgccacggcctcctcgccccactgcgcccccgcgtccccgacgccggcaccgccgcccccgcccttcaccggccctaccgtccgatgggaaggagaaaaagggagagaaaagatagagaagggagagagagggaggaggaagaagggtgggagagagaggatgacatgtgggccccacatgtcaatgggtcccacaatatttttttttgtgtgaatgacatatgggtcccacgtatatttttttaattgtaatgccacttaagcgccacgtgagacaaagactgggttagcgccgccacgtcagcaaaaccgccctccattaccgctgggagagtcaaattgcaccgttttcaatagttcggggagtcgttctatccggttttctggttgaggggtacgaattagattcggcgtacaattaagggatttaaagtggactttttccgaaatgaaatgactggtaatcagtactcggaattgggcctagtcaagtctataataggcttttcatgggcctctcgcgatgggttagtcgtagtttctctctgctgggctgtatcttgtacgagacgggcactaatcttttattcggcattgttcgtttaatcccaaagggattttggtgggatgaaaagcccttccttttcaattgggtagggggtggtaattggggaatctcaagcatccgtttgcatttaagttactgagcttttactggaaatttgatgctgagcttttactggaaatttgatggctgaatggcagatacaagtatcaagtcgcacttatgtgatgcgtggctattaaacagtaagtgatcagtgatcaggctcaaaactgaactaacaactactatccgaaattgcgcgtcgtcgcttcagtcttttccggttttccctgaaaactaggatgtaatggaagccctggtgcgagatgatgcaatccacgaacagtttgatgacatatctgaaatttctgtctcaaattcatctagaaaaaatgattaaaaatgataaatgatatgcagccgatctatgatggagcagctggattattttcgggacatttaactttagaccacttttaagatgtgtcaattaattatttgccactcgctgtctatgacatgtgggctctcatgtgtctatgatatgtgggtccagtgacaaatcatttatcaccatccgtaagagtggtaaataattaattattccattatcttcaggtgaattgcctgtactttgtcttgcataattggcctcgtttaattcataataggcttcttaatgggcctttctttgtacgtgatgggatactaggccattagtgggcctaagtttctctctgctgggctattctctggttgtaaatgggccccaaatctttgagtaatgggccgttcgtggtcccgttttaccctagatgggccaagtttgcttccttctctgtaagcccagttaccgtggggatacagccgccggcggacgcggagggcggcggcggcagcagcagcaaaccgccgctttggcagaagaggaatccgggatggccggcggcggcggcggcgggaatcgcctggacctccccgtggtggacctcgcgtcctccgacccccgagccgccgccgagtccatccgaaaggtacccaatccattccggattccatggcaattttcctggaaacaatctgttccgtgggcgcggcggcggcggggagagagagagaacagggcgtgattcgtgtggtgtggtttggttttgcaggcgtgcgtggagtccggattcttctacgtggtcaaccatggggtggaggagggattgctgaagaggttgttcgcggagagctcgaagttcttcgagctgccgatggaggagaagatagcgctgcggaggaacagcaaccaccggggatacaccccgccctacgccgagaagctcgatccctcgtccaaattcgaaggtctgcgcctcctgttttgctctgctcgccgtgttaaactgctaattgttaaacctaagcatcctctcctttttgaagactgttgataaatttaatcctgaagtgtatgggataacactggcaagttagtataatagtagcacatgacagagccggagtgacccttttgtcggcaaaaatcagaagttgacatgttagtgcctgattatggaatattctttattagcagtattaagcaaattaaaaatgttccgatgtttgtgaaagatgcttttaaaaactgaactaggaaccatggttctggtttgatctatcctgaacatctcacaatcttcaataagtacaaggtgcatggagtaataaatacaagcgctcactgcctatactttgaacaaccgctaggttttgtggattttaccttctggtgtttgtagtgatgtacttatttaagatctgtaactgtgatttatgatacaggagacctcaaggaaagtttctatattgggcctattggagatgaaggtttgcagaatgatgctaaccagtggccttctgaaggtactcccttctccttttttatcacttctttccaaaacataaataaattctatctttggctacagagcgcttaccaagtcggagggagacaattaagatgtaccatgcaagtgcactgtaagtcctcgttttgctcatctcaccgaaggaaatccattaattgtattacgtcagcattgtgtttgtataatactttggtgttatttgtttaaataatttaaatattcctgcttatttgctaccactactaggtctactggcaaaaggatactctctctaatcgctctgagtttgaatcttgacgctgaattctttgagaacattggtgccttcagctgcccatcagcatttcttcgattattgcactacccaggtcaacttatttcatgctcctgtatgtcatatgacattaaccaaagtagtattctcatgatatgcagagaaatgctaaaaacatgtgtgctggtctttaggttgcttcttgttgtgttggattgctgataattgccaatggtttctttagctctgatttattcaacaagtttatttatttcaaacatgaatgagtgcactatatgtcattctaaagaatgaagaacttgatatcatcctattgttgtggtattgtcgtgtgggtgctcagaaacattacaaatctgtccattacagtgaatagggaaattgctactttcatgatcgcaattataatctttttctaaactataacaatttcatttgttagctaaaacttgcattgaagactacttttcagtttgtaaaaatatcttaactgttaacttacagtagcagctaatggagcagatctgtgtgatctctattgctaaaatttctcaaagcaactgtcttgctgctgcccgctgtttgctggagcataatgataaatatgttattgtaatctgtaagtcaatgttaatctaagttttaaagataccttaggttgcttcattttgttgattgttttgcttacctgttattatactggaaagcgggatgtgaactgaaaatatcgtgaagcttcttcaagcttctaggaacgtttgtttttgtgagctgactgtgtttccttcttgctgtggagctagttaagcgttgtgtttttcgtccgtactgtagtatttattggttttatctaaatagaaaataattttaaatgtaggtgaagtagacgactctgatgatggcaattatggtgcatcagctcactctgattatggaatgataaccctcctagcaacagacggcactcctgggctacaggtacaacattttctttgcacaataaattcaccaacttagctaaccaatcatgtagacaaatatatggtcagaaggtttggtgaggatggggttatgttcccaccttttaccactttcaagcaaaaaatagctcttgtttagaaaagtaagaatatctgttgtgaatttgcagatatgcagggaaaagaataggaatccccagctctgggaagatgttcatcacattgatgggtaaataaaagtaaataagtttttttaatatattaatggaaaaaaatcaaataaatcattactttgttgtttaatttgctggtctcttgtaccctcagggccctgattgttaacattggcgatttgctagaaaggtggacgaattgtatttacaggtacccttttccttttatttttgatgacatattctgtggttgtgaggaagcctcatgtaccatggttgttaaa

SEQ ID NO: 62066 - DNA, 1950 bp, Oryza sativa
gagcgctacatacaaatagtcctatgctttttcatgtgtaaggcttaacataaggttatttaaattccgttctgatttgcagtgattttttaggtggcccgtggagctacctcgggctcagttcctttgcttggacacttgacagtttacataaaaaaatgtgaattggatctgcatatcttttccaaaaacgcgcaagagaactacacaagttcaagcagtggatttttaggtcgacactaaccgtgtggaactgtggatgcaggtaaaaggaggctaacatgtgctacacggccggccatcgttctccattgtccatttttcttctgcgtttagacatcacagtagtccagaaggttgtttgtgttgttttactgtaacgctgtaaagaaaaagtctgcagtgatgtgctatgcttgatttctctctccactgctcgacaccaacctgaactttttattgtttgtcgttcaaaaaaaaaactttttattgtcacctgcgagctgactggtgtttggactagtattcttgttgacttggtaaagaaactccagtttgatcctgggaggcaagtgattccccatctccatccttcactttctaactcttgacaaagtgaagttgagttgtgatatctagattttgttcatacctgatgaacgcgactaaatatgccatcgagaagattgtgatgtcctgcatggctaacaactgcttgccatatggcttttttacattttggaccttttttaaaacttattttacaaatatatcttaaaaaaacttattccgcctttggtggcaccaatgtcattggtaccatggttcaacatgacggtgccgatgccccctagctttcccaaagaagccaagtcacttgtatgatggcgaatggcaccgatgacctatttgtaaaaaaattgaaaagaacttatttgtaataaaaatatttataaaataagtccttagcactaataaccttgatgctaaggacttatttgtaaataatttttattacaaataagtttttttttgatttttttaggttctcgacggcaatgtcgttggcatcgtgaaaaggatctattcctgctataagtttttttcgaggaactatttgtaaactaagtttttgcaagagaccaaaagtgaaaaaaaaatccactgcttgccatgaccggatccatgagcatgtcaaagagttacaagtgtgtatgctacaacttggtctgaaacggcagcttggtgggtggcggcttccatgacaagttcagaatggtcatcggatccatgcaaaagctcaaactactcatggttcgagccgttgctgttgattcgcttgccggtgaaagctcggaactctggcaagaagactggtgaccaaatgaagtagtatggtcaagcagagatggtagattattttagagcacgtttggtacagctctaactcctaaatttagctctaatagttaagtctggagtggagttgtggacctgcctaaacccagctccacaactctagtttatttggtgagagagctccacccagctacactcccatttggtggagttgaaactgtttggctgagctctaacttcagaaggggtggagctaaagttagagctgtgccaaatagaccggaagtgtcacacaactacacgtacaaagtgacaaatctcacctcaccaaacaggtcaatgacaggtgcgtttaggtattctgcgactctttgcaatgcgtaataattacatgattacatagagacaagcacattaaatatacgttgattaatctcggcatggcatcaaatacaaacacccggacaggtcaaacctgtacagtatgaatagagttacagtgtctactactgcttggtgcaactcaaaaattggttcgtcaagaaattcaggctgatatttgaaaactgcatgggagagttgccaaagtta

SEQ ID NO: 62067 - DNA, 2853 bp, Oryza sativa
tgcagccttctagatatgacaggcactgttttgtttgtaatgatcagttagctccattcatattttgaaactgaaatttggagatcatgtatatggactatggttgacattacaaaatgaatgtagatatgtcaggcacgtacctcgggtacgcatgcactgttacaaaatgaattcagctgaccctctcttttacttctggttataaacaaatagttgacattttggttgatttgaggataaagtttcggtcgagtaagttgtacatcattgtatctgaaaattggtttgcaatctaagttttctgaacaatatcagcacacgatagtggctagctagctactagacagattgtgtacttctggcagctcgaatactaggaagctatagctagtgcactagtagtaaattgttagcaaattagttgactatccaagtaaaggcatatttaaatcacttaagaatggaaggaaatgtattaaacttgtacgacatgtatctatatcctatatatttttaaagtttatccccattaatatatttcttttctctcattaagcaacatcagcttaattatttctaaactttggatgatctatagtccaaattatctccctcctttccgtatcccataaagtcatattaccttagttttatcttttaatgattaatctatattatcttctttttcttctgtcattgaggacacatcatcttagttttacttttaaatgattaacctatatatgatttaaattgttataaactgcaatatcttaattatttatattcttttccatggtcgaccaaaagataaaaattatatagagcatataaagttatatcgtctagctattaattacatgttatttatattattatcatacaaaactcctgcaacaatgtgcggggccttgtctgtcaggttgatgattcagtcaatggtgccggatttagggttcataaagttttttttggtgacggtggtttagaatcttacaaaagaatgaagatggtggccgatgctcattcatgttttgttacatgtgttagagttgctcggcattgtgactgctcgtctgcttactcgcggaatttcaatatttacagtttctttgttctatcttagtatctaactttttcattattttttataacaagaggactattgtaaatttgtaatattctttcctgttctgccaaaaaaaatggcattgcaatgccggatctttgatgaatagtaggggccggccggaaagcaatgaagttcaatttacttttagtaccccgtcatgacccacaaattcaggattttactatgctgcactttattactattctgtcgcaaattaagaacacaaatagtacgtctatgagcaaaagtcaaacagttttttctttttcatgataatgatcaagtcggacttttccccttatttttttttcatcaggccgggcagctccaacatttccatgtaatataaggagggaaggagaataatattgcagaaaattaagcattgacttgatttcattagcccattttgtacaaatttcatttgccaaattgcatccaataacattccttgtcttcataactccgacagcgaatttaacaattttaactagattgagacaacctaaagaaacgctaaaagtaacaaatttattttgaaaacatacctataaaattgtgtggtggcaattagtctatttaatcagtgaagtgcttttgcagaaataacccatcacctctcgcgcgcctactatataaatagatccctcgctgctcattttctcctcgtccagcttcaagctctcaactttctcatcactcgtctcctcgatttatttgtctccttccatccagacacctcgagccggcgatcgatcatccaaaccaagctccgccgcccgagacgacgaagtcgacgtcgccgccgccgccgctcgccgccggcacacagctagctgcaagctgctagacgacgacgtcgagctgatccgttctaaaacatcactataaactaatccatgtcctgttcttgatatccctctctctgttgcatcgaatgaccctatccatttcggccttagctatcttgctataaagctcgtggtagcttgttacctttgctagagttttgaattcctcatcttctcccgccgtttttagctagctgttttgttgcacacgtgcaacacaggacaagacgtgtgtaagagcttggatactgccgccatcgctgccatgtgcgaggctctcgttgaccggcaactcctccccccgtgcggttgcaatggcggcggcgacgtcgttgtcgttgtggtgccgaagacgtcggcggcgccggtgttggaggacaggccgaagacgtcggcggcggcggtgagcaagggcggcgaggcggcgtcgatcctgcggctgtcattgccgatgatcatgacggggctgatactgtacatccggccgatgatctcgatgctgttcctcggccggctcggcgagctcgcgctcgccggcgggtcgctcgccatcggattcgccaacatcacggggtactccgtgctgtccggcctcgccatgggcatggagccggtgtgcggccaggccgtgggcgccgggaacctccccctcgtcggcgccaccatgcagcggatggtgctcctcctcctcgccgtgtccgtgcccgtcgccttcctctgggcgtggatggagccgctcctcctgctgtgcggccaggacgccgccatcgccgccgccgcgcagcgctacattctcttctgcctccccgacctcctcttcctctcgctcctccacccgctccggatctacctccgcgtccagtcgat

SEQ ID NO: 62068 - DNA, 4436 bp, Oryza sativa
cgttcgccgtgtccgtgcccggcgcgtgggcgcgcatgttcacgccggacgccgacatcctcgcgctcacggcatcggtgctgccgatcctcggcctctgcgagctcggcaactgcccgcagaccaccggctgcggcgtgctccggggcagcgcgcggccgagagacggcgcccacatcaacctcggcgcgttctacggcgtcggcacgccggtcgccgtcgggctcgcgttctgggcgggcatggacttcagggggctctggctcggcctcctcgccgcgcaggcggcgtgcgtcgcggtgatgctcgtcgtgatccagcgcacggactgggacgtacaagccaagctcgcgcaggtgctcgccggcgccgcggccagtggcggcgaccacggcgtcaacgaagccggtgggaatgacgcggtcgcgcacgtcaaggtcgcggcgccccacggcgacgaggactcgagcttgctcatcaccgtgagcacgtagctgaccggagcaacgccgtgacaacgacgacgtacggccatgtctacgtacgtatgaaccacggtaactagctactccctccgtcttaaaatataatcatttttagctatgaatctagacaagtatgtgtctagatttataagccaaaagttgctatattttgagacggaggtaaaagtcattgtgtcgtgtgaaagcacaaagttcttccggagtctgaactctgaacattttttttggcagttcgcatgagttggtcagtgtatgtacggttatacttatacacttaattatacctagtatatagtgccatagttattgcagaaaaacacctgagcttaattttggtgaaaaatagctcggtgtttcctgtaattacatggccttcatagaacagtattaggtggtgttgagcgaactaatcagcacctagttaattgtcttcggttttagtaggtggcctgaggactcgtattttttgtatattttattcttttccacaagttatgtattgtcatgggtatatatatacttgtatatgtacacacaaaattgaaaactaagtgaaatttcggtgttccttttatattttgttggtacataattgctgtagtacaattcacacagatatgatgaaaattagtttagtagatggatcatgtacgccctcattcccagcgtgaaatccaaatagttatgaattttttttaaaaaaataaaagcatgtattgttgttgtgtactatatcgatcgaccacacaaacatccctgttaaatccgttcattcatcttttttttctcaaacaagcaagataactgcctgtcattttttaaaaagagaataaatgagttcatcttgtacacaaaattttagaaatctaactgtaatgtgactacacactttttatagtctaattttaattgtctctccatgtgtacagaaaatttaacatcttttttaggggagggatatataaaatctttattattagaagtttctataaccattgttgaccacatgaaaacaattgatgtcacatgcctaaaattgtttaaaaatagaagttctaatggaagatacatatccagttttcatacatgataactagtcaaactagtcaaattactcatgcgttgcaaaggattatccaaatagacaaaaaacaatttgaaaaaaatatttatctctagttgattatattcaaacaagattcttcatgcatcttaaaaaaaaaagtataccatctattttgaataggtatgttagtacactaacttcaattaatgtacggaatcttatgatcctatatactcactagtaaccatcatcatcaagagttatttgaagtagtatatataaatccgtgtatccaacagataagaaaactataacctttatgatgggacaaatgtagtataaaaaaaaatgctattggacataccataacaatttgttatgtaacaactaaaacagtaatctattagagcgtctgtatacaaatctacaatatataattagttgcatctcaaactcaattcggcctccgttcccatagcttccacggtagcttaagcagaatctaacaggctaagaaaaccttcctaccaccaagctagctagcgatcccggccgccaccttaatcctatcttactataaagttatctcccactaactccttaagtttaacatgcaaagatgccacatcatcatccactaacaagatgccacatcatcatccactaattaataagatgtcacgtcatcatccactaacaatcatcacatttaaacattatgcaaacatgctatatctttatagtttttataatttaagagctttttaaatacaaacatgttaaattatcatctaacataattcacataatgttttaatgtatatcttcatattaaattcccgcagcaatgcgcggggtttcacctagttaatcaaatattaaaacccaatttgtatagcaccagagttaatattgcaaagtggagtcgtaggtgcatgattccattgctataatttaaattatagttcccacaaatattaaacgcatactctctcctttttaaaatgtaagagattttggaaggatgtgactcatcctaatattacgaatctggaatatgtcacgtcccaccaaaatcccttctattatggggcgaaggaagtatgcatgtagtaatgtacttagactttcaacatgattttaataagatcagggattttaatgtgttagaaaacgtattcgtggagtacgagtgtaatactgttacgtgtgtaatggtatgtgcatctccgtgtaattgaaaaaaaaaaattaatgcaaagtataccggccctatagtacgtaagcgagaatatatacgtacgtaggcgcttacgcacgcgcccacaaacaaataatcaggtggcgtctgatcattgccactgttccctacgtaggcggccggcgtcgctgtcgatggcatgtcggccggggttgggtttgctagctgcaggctgtcttcccggccgccggcaccgtacccggccacgcgcgcgcggaggccggtgagaacggcggcgcgtagattagattgtccgcttcctcccatgccgccgcggcgccgtgtcgttggaattcgatcgagatcggctgtgtcggcaagttgaccatctatcgatcggcaattcggcatcgacacgacgtacgacgacgacgacgccacatgtgcatgcttatggtgaactactccctccgtcccataatataagggattttaagtttttacttgcaacgtttgaccactcgtcttattcaaaattttttaaaattattatttattttatttgttacttactttattatctacatcatcactttaagtacaacttttcgttttttatatttgtaaaaaaatttcaataagacgagtggtcaaatattgcaaataaattaaaacttaaaatcccttatattgtgcgacggagggagtacctagcttcgtcgcatatgcagccgtacgtatatgagtacgtatacttgcgttctcacgtcacatcgtccattgcaggctcttccccgctgcttgcccactggcgtgtgggccctaattagtgtgcaacagcggcttaggggcttaggatgtatttagttcacgctaaaattaaaaatttgattaaaattaaaacaatgtaacggaaaagttggaaatttgtgtgtgtataaaagttttgatgtgatagaaaagttaaaagtttgaaaaaaattttggcactaaacttggccttagttatattatggctagtcgatgcaccatacattaaaaaaaactatattttttttacaagtacaagtcgaatatataccactaaatacaagtgccaactcatatatattacccacctatatatattatgtccccatgcacacacttatatagctaccatgcatataaacaagattagaggccagtctcatatagtatgagttttggccatcaaacgcgtctacatgtatatactgaatttctcttgctctctagatttggcagttattacttggtcaaaaatattttggtttcttatataagcctgatattaaatgtcactaagaattactctctcgttcacgaatatatactcgtcaatttttatccattttatttattggcaaatatttttcacttcatgttttcgaatgtatttttttttctcatcttactcattaatttcatctttcatgttctctcaaccacacatttaggcttgttcggttaatccttacccccatgagattgaagggatcaattttacacctattaaattgtgaaattaattctcctcgattatctccaatggttctagaagcatctagctagttagctttgaaaggtactccatatcatatatggcgatataatatgaaagcaaatgattacctagatatat

SEQ ID NO: 62069 - DNA, 2996 bp, Oryza sativa
ttcacaatttctctaacaaatccacagccacatccaatcggactgcctccgtcccggtcgtcgcgatcgcctggccacctgagccgactcggcctgccatctaaccgagccgccgctgctgccaaccatcggcatgcatacatacatgtatcagcatgcatatatgcatacacgtcacgctacagtaccacgagtactgtagcacatatactcatcctccaatttcttaaccaatttcctcctcgaacaccgacgcttgcatgcacacctcgtgaagcccgttgcgaagatcttttccacacgatatccatccaccgtatgctatctcatatccaacttcgtcacccggtatccttgaccgtctggacctcaactcctccctgagtctagtcccgatccccaccgttgaccgaagttgatctccaagaatcctgactctagtcaccttctcacatggtatcctgaccgcactagacctctgttcctccttaaaacatagtcccgttcctcaccattgaccaaggctaacctcaagtcacctgcacacaatcagacaaaacaacagttcctgggcacagatatcacaacctgacccacattagtcgcacgcactcacaccaacatccacacatactctcaaaccaattcattgattaaatcatttacaaaaccaattattcatcacaaatattaatcatgacaataatttcacaactacttcagcatatgacaactaaaaaagtgcatgtaacatatgcagagtaattaattaggcattttgatgttataaatgcataatgcagaaggaaaaatggtgcacaaattactgctagctgtgagagtaataatccatacaacgactatgagcacatcctcaattaactcgctctttttgagaaaaaaaggttggtcgcttaagggtaaaatgttacactggaatagttctataacctcatctcgttccagctgatcttccgtggctgcaaatatatgtgcggtatgtttgtgctttttgtatatatgattatttgtttatagaaaaaatattgcatctttgcatattttttttcgcgatcgtaaaaaagattgcacgtcaatatattacaataaaagagtttttgttacacaatgcaatttgccaaaccggcctatgccaagggaagggagaaacaaagacaaaaaccaaggaagaaaaagaaaactcatacgacggataaacgctactccaatcagcgggatggggagggcgggaagggagcagagccatactacactcccaacaaatccccaaaagaagcaatgcctgctaacaaccatagatggccctccaagaggatggactctagaaccactaagaccgaagagagagcgcagagtcgaaaatcctggagctccgttccttctacagttaccaagagaccaagaggactagggagtcaaagccggcacggaggtgcttaggtaagcaggccctagaagatggccaccagtcctggtgctagctgccacggaggagagagagggcaacccagccaggaggcgacagcacccgtagctagacctgtcgagcgaacacgcagtcgaggaggatgtggttcgccgtctcaagctcctgagcgcaaaaggggcaggccgagtggctatcgatgccacacttccgaaggagatcagccgtccaacaacactgctgaaatgcaaaccagaggaagaatttgcatttagcataacccttcacgtgccagagaagatcagcacaagcaaaggagtgctggccatagaataacgcctggtacgctgaacgtgccgagtagcgttggtcactcgtcaagcgcgcatctttgcatatgaatatacatacacacatttgaggaaattttatttattatattttatacttaattagtacattaatttagtttgcattgctacacaagaacgctatgctggtatatatatgactgctcacctatatatatgatgcaaacagcaagttatcacgaaattagtctcaaaatatggaatgtatatagaagaccatgtaatttgtaagagagatgtgtttaactttttaaaaacttcaagatcacacaaccccttcaatcttctcaaacacaaaatagttacaaattctctgccaaaaaaatccacatgcactagaggcaaccaatttttttttctcaatgtgtagactttaaaattttacgagtaaagcacaagacctgttcctaaaattaaagcgaggttatattcccaattttaggccctatttagtttacgaaaagaaaatttttgggtgtcacatcggatatttgaccggatgtcggaaggggttttcggacacgaatgaaaaaactaatttcataactcgtctgtaaaccgcgagacgaatcttttgagcctaattaagcactgtagcactttatggctaattatggactaattaggctcaaaagattcgtgtcgcgatttccatgcaaaccgtacaattagtttttgtttttatctatatttaatactctatgcatgtgttcaaagattcgatgtgatgtttttaggaaaaaaattttgggaactaaaccaagccttgcaagttcagcatttaggtcgataatcctatatattttagagtaccactgctctctactagtagtataaagtaatccaaaccattgatcttatttgatcgaagggttaagatctatttctagctactaccatccaacttaacaggagtagaaatatggaggggtattattgtcccgggaaaaaatatggagggggtataatcataatttatcactgattaaccctagcggccattcattcgatccttcctcacgccgcgatccaatttctcgatggaatctgtatgtgtttgatgcgtttgagactgttgaacactggattcaagtcatgatgcatgccagcgattaagctatgattatcgtgactagcgtgaaactccggtgattatcgtgactaggggctgcaggaat

SEQ ID NO: 62070 - DNA, 2997 bp, Oryza sativa
agtcagatccaagggccgatgccagcgacctgctgacccgtgaggggaaaaaatgaaaatggctaagttaccctcgtaactgtgttaataagttactattttatccttaataagaaacggttcagatctttttattggtagtataattctaactaatagaaaacaccgaagtattgtcctatatattttaatgtatcttagcaagtccaaaacacatttaagtgggtttgaccgtcgatgtgtggctgtatgtccaccatgactggacaatatttgcatttagctccctccaatgtttgttcgcaccggtgacgccgcatcgaactgaccggccggccggtcaaggaagctgcagcgaggtagcaccgtagcagtgctcctgaagagcgcgatcaccttggtctccttcagaccgagctacataataaatcaacctcacaaaatatgatgtatactaacactacaaatctagatatacgtgtattcaaatttttagtattaggatgagtcacatttcgtatgaggttatgttgagattcttaatgttaggatgcatcacatactgtatgaggttatgttcagatttttagtattagaatacgtcacatcctgtacgaggttgttttattacaggacggagcgagtaggcgtcatccccctagctagctggcccagcgatcaagtatacgtaaccgcgcgctggcatggactgctgctgcctggagtgtactgtagcggcgctaggtggctgtatacttgaagcagtacgtcgatcgtacgtgttgtgtacgagtgcttgatattcatactgtttttttgtttctcatgccatcctgaaatagaccaaacagtaattaatttatgctttgtttgtttgcttccgtaggtagcttaaaaagattatataatgaatatataatcaaataccacagtacccttctagaaagcaaatacattaagctatgtatagtgtatgtactactactccgtattagctagctagagatcgatctgcagatcagatcagctgtcacgcgtggcctctgacgccttgaatgaggtaagttaattaacacttgttgtaaaatgtaaagagggcaaccgcggcagatcgatcgatcgatcgatcttcagaataatgcgatcggtgcctcagttccattggctatttctgatggccggctgggccgggttgcatttttgcatctaatataccagttcagaaaccaaaaggatacatatctttttgtactatcaattattattctgtcatgtattccgatgtgctgcatatcctatagcatttgcccttcgagctccgaagagactggccgggatcgaactaatttacacagcaaatgcagagggtaataattaagaaacactgcaatctatagtattatacttcatgctggttgaggtgcatatcgcttctatgcctatatctaactggtactgtaagttgacattttgatgtctcatattgaaaattctcaagggctcaaaagtcccattttttaattggttgaccatgcatgaggatgtacatagcagtgggacatggtcagagatgatctagatggatggcaaactaggggctgaactgtctactacctgcatggttacatgccagcacgctcacatgaaacctgcaagatgaacaagactaaccaatgatcttgtgtacaatgtacggcttcttcatgcgtgtaccaatggggattcgctgactagatggcggcatacattttatgcgagagaaacctttaattcgttcagagtattcagtgttgtgccatgttcaatgtgtaattattctactaccatgtatagatgccaaggtttaatataaagtatgtatagtccactggcttgatataatcgcaacataagttatagttcttctccgaacaaaccatatataaatagaaaagtagcactgaccgaatgtgctagttttttacgcaaacacgcaaaagtcttgcgtgcaatctatgtattagaaggtagaaatagttgcatagacgatgcaaccaatgtagcagttggtacggaaaggggtgaggcggggaaggcttcatgtgccacagggaggatattacaatgatgcaacctcctataataagaaaaaaacagaaaaatcacaaaggtttcgtgccttctataatctatttgtgtttcttgcagtatcaaatcagttgttattggataatttattttatctaagtttgaatatttttaatgcaatcttgtaagtatttatggttataattttatttcatgtaatttatagggttagataattattagtcaacgttttttattaaatattactcaacattttaggtaataaagatggtactttgtttaaataaatttcaagagtgatgagaatcattggattccatccaaggagagagaaaaatggcagaatttttttaaaagttcagtcacctaaaatctagacactacttaatacatactttctccatcaaaaaaaaacctaacctagtatgtatataggagtctgaccagattcattgtactagattatgtcccatttcatacatgttgggttttttttgggacggagggagtcgatcgatctgaggcaaatcgtttatccttatgctatttttgcttcttgacatcacgaaagccgacgaccctcagttgtgccgattttgcaaattttctttatagatacgtcatgtatatagcatattcatgccaacgtatacgattataactccaaatatatagttcatctttaaattagttaagaaattgatttcccttaaataagagatgaaaaagaagtactagcgtggccgtcatgcatgagatttccctgacgacgtctagcatatgcctattattgatcgtttatgtacatacacgcctgtgattcttatggacattcattgattatattgccgtctcacctctttttaattggttgactagttaaggaaaaaattgtagttatatgttact

SEQ ID NO: 62071 - DNA, 1412 bp, Oryza sativa
gggattataagtttgttaaggatggaggtccttggttacatcgaggtgatgctcttttggtggcagagtttgatggcctgacaagcccatcgcaagtcccactggaggtggttccaatttgggttagaatctatgatctcccgttggttttgatgacgaaggataggggaatcttatatggcagcaagctgggacatgttcgggaggtggatgtggaagcagatgggcggaacaagcatgatttctttcgtattcgagttgatctccccgttaatcgtgctttaaaaacacacatagctatcaagatcaatgtccaaggcaatgaggaggtttgagctgagatatgagagagtgccgcacttctgttttttctgcggttttatgggccactctgacagagaatgcgagaagaagctcactaatccagaccagccgttcagatctcggcggagtgagatgttctcccttgaaggcctttgagaggaagattaacacagtgaaggctgtgcaaagctctggggtggctaggaaactatcgtttagtggagcgggcagtgctagctccacttcatcgagacataagaaggttgagcaatgggatgaggcagttcctccaaggatggaggcttttgatggttttgaattaaatgagaaggaaggggatgctaatgttgacctgcagcttgccgatcagacccgcaatatgcaggtgtcagggggtggttctcaggatgccgaaggcctcacaaaaggaaggaaaactaaacaagctagaccggcaccttcaggtgatctggtttagtcaacggggaagctgtcgtcgggagagatgatacctgcaatgagggagttactccaacaagcgtcttttggtgaagtctccaccgaggacactactagccttaacaagaggaggtcgcctgattcgggaactaagtaggagggcagagtcaagcaagctgctttggagtacacacaggcaacaggggaaggaaagcagatcattgtgaagccggtctctgcaggaagagcactgaagcgtgtcaggaaggaggcaacgggggatacacagatggaggatatggaagcaaccagctcgggggctgctggtaaactgacgggtcccatggcggggtcctatcaggagcaatgaattgcttatcgtggaactgccgtggcatcgggaacgccacgacagttcaagagctttgtgccttggtcaaagaggccagttcccaatttgtatttttatgtgaaactaggcagccagtggataagattaagcgtttgcgtaatagattgggtttgagaggttttgcaggggttagcagtgatggaatgagtggtgggcttgctcttttctggcatgagtctgttcatgtggaaatcttaaataagaatgaaaggtttat

SEQ ID NO: 62072 - DNA, 3716 bp, Oryza sativa
  unsure (1)..(3716): unsure at all n locations
nnnnnnnnnnnnnnnnnnnnnnnnnnnnnnnnnnnnnnnnntccgacctgaacgttggctcgacgagcacggcgtgtttcagcaggaaagcccattcaagtttacagctttccaggtgaaattttactgaactcaccatcatcgtgatcgaattttctgaacttggtgatgagacagtcctgaattctgactacctgagtgaatcttgtgtaggccggcccaagaatctgcatcgggaaggatttcgcgtacaggcagatgaagatcttcgcggccgtgctgatccgttccttcgtgttcaaacttcgcgacaagaaggacaacgtcagttacaggacagcgattacgcttgccatcgatcaggatctccatctgactgctacggcaagatgagtgtacagtgtacactatacactatacagtgacagtggcacgtagggcagctgactctactcacgctagtgacagctccttgtgaaaacataataataatatctctcgaaaataatatagctgcaaacttaattgtgtctgattgcaaatattccgtctagcttgctggaataaattactatttcccgtgcatctaaaatttatttaaaattatacccatcctaacactactagaaaaatagtttttccaggcggcaaaaacagttttgtaagcaaaggcctgcgatgcccgcctacgaaaatcaggcggcatctccattattgtaggtgttagattccacctgcccgtgaaaatcatcaatgcgcacaaaaataaaaacagccgtcaccacccctacccgccggcgccaccattggcctcctcggccccctcccaaaacagccgtcaccacccctacccgccggcgccgccaccggcctcctcggccccctccccctccggcagacggctctccacctccgtccaaggggagtgccacttccgtaggccagctctcctcttccatccagacatgggaggggaagggcctgcgttgtctgcgccgccgctgccatccgctcctccgctgtcacaccccaatctggcaccgccgtacaacggcacctgacaggagcgtgtcgtgggaaaaagggcacgaaccgcttcctacgaaactgcgatctcagtaccagtcccaggacatagcgctggtacccacggtgacaaatatgaatcattgcaatccttaaaagaaatagaggacttatttaccttaacttaggttgcagctcagaacagcccgagattgcaaccgacgacgcggacgaggaaacaccaacaacagcggcagcagcggaaccaacggactaacacccaacaccacaggcgacggctgggaaccaggacgaaaccctaatcttcactttacgtcatcttcaacttccgggcggaggaactatatatatttatatagagcaagggtgagtactttcgtactcagcaagtcacgggaatttaggtgtttaatgcaagcttagaagagaggcaaggttgttttgcaaatcttttatttgaagacattttgaaatcactaagtgatttatttctttctaagtttggggcgaaaagagacttgcgtctcgattcgactttaagagatgtttttcaacagctcaattggtaatgtactgacctcccgggtcagatcattacttcttggctcccagagccattccacttgattaatcggctcccagagcctttttcattttctcggactcccagagtccagctgcccagcagcacaacaatccgcttccactcgggaagcctagtctatgatgcccgtagacatcccgaatcacacagattcgtttcttgaccactcaggtcatccatctgccacataggctgataatggtaacgattccccaccagaacaacttttcacaaagcacaggcaaacaaatctacgctacaggaaacacctcacatccgcccatgaccgcgggcacggctgtttgaacagttagttaatctctgcagagggggtatactttacccacacgacattactaacccggatcacccagcccgtgagatcagccacgtcgggagaccttaaggctttcatgacaaggcatttcgaaagccaacacaggttcaccatatgccaacgagaggggtcccagaccaacaccagattaggtcccagaccatactgtgccaggaagcccgagggttcttcccgacaccaccccgttgaatccacatgtctcttggcatcatggctccccccgattagctaattactcagccaggggcgtcccattgcacccgtgtggtcgcacttgttatatgctcggatgaatttcccacaggaatcagtccttatatgcgaatacgggacagtgccacacaggcacaacccccgcatcgcgagttttcacaatccattttattttcaaacacactgacgccacatgtcgggttttcaaggcttctcaaacccatttcccaagttttcgacaaacaatggtgtatgtgggatatttggtatacgcgctcagagagcacggataccgaggttccacaaaggtggagtgacaaggaaatcagggtagtacaacctacaggaattagtgcgagtgtgcgactactgggtaggtccgtcggtttggcacgcataccgagaccaagcaagttgagtgtgtgattctaataatgcaagttgcaaacaaaataataatgattttccaattataggagcaattggtcaaagggtgacttgccttgctcaaggtcttcacgaagcttcacgaatcttcgagaaaacccgcgatcgacgaaaatccggtaaccgcaactatacgcaaacaattgaaaacctaaacaaaagaccaaaagaaagatcctatttagactaattagtagtgacattaaatagatctcaattttatggaaatactggaagttgaacggagtcaatcagagctacggattgagagatatgaattttggaagtttaattggaatttctgggcaaaggaagatatttgtggaacaagaggaaattgatttatgaaatttatagaaataatattctcaagaatattattgaccgtcactgacgtgcgggaccaaggaaatgatttatggaattttgggaataaggaattgatttatggaataggggaaaaagggtttattaaatcccttgaaaaaagaaaggagggatgccatatagacttcctcgggcggcttaggcgcggcccgaggggtttatgcggcttggccggacctaatgggccggcgctagcgcgggaggggcggcccaagagagggggcgcggggagagagaggccgacgcgggtggacgcggtccaccacgcgggacccacatggcggtggttgggttcacggtggggagggcgcacgcgggggcgggcgctagggtttcgggggcgcgtggtttgggcgcggcgcaccgggtggacggatggtggcgggcccacgtgcagccgcacggcttgccgtggaccgtgcacacgggagggaagacggagggagggggcggctgaccggcttggcccggtcaaggccgaggtggcaccgagatggcgcctacgtggcagccacgcgggccggcgggccgagatggacggcggacggcgtctgagttcaccggagctcgtcgtgacgattcgagagagagggagtacacctgaacgatgggacggacgagagggagtgagccaccggatcggattcgccggagggaggc

SEQ ID NO: 62073 - DNA, 6423 bp, Oryza sativa
caagggcacggtggtggcgagggaatgaacgagagggagatggggtggctcagtttactagatggcaatgtcggtttagggaggaagaaccgacattggcagtcaaggagagcgagctggcggtcatcgacgcgtgcagccaaggcggcgacaggtgatgatgccggcagtgtcgggcaaaagtggaaaaggaggggaaaaaagtgagctcttctctttgccgagttggggagggagagggatgggagcgggagctcggcctcacggttttagcaggacacgcgtggagcggctcgggcacgcgctgcagagctcgcggcaggcagcggggccgagcggcagcgtagcgcaggcgctgacggtggcggcgaccgggcggtcggtcacgagtgtgtgcgcgcgcgcgggaacgagcggcacagccgaaaatcgaatggcggcagcgggaaattggcgatggcggcagcgctggcgtgggagagagagatcgaacgagagagagagacagcgagagagaggaagaggacgagagagcgagagaacgtccaagagagggaagggagagagagacagcgctctctctctcggtggtcacgtgcagcgcacgtggagatggagggagctgaggagagatgggccagcggcaggtttcggcccaaatcatcacgagagagataaaatagactttttctggaacttcctattaaggaatttgaggggcatttgagttgggatttgaccaaggtggggctttaaagcgggaattttggtatttttgggatagatttatatttggcggcacgaaggattatttcagaggatttcaaaaagggaagatcattattcaaaaatggaacaagggagatagcggtagaatgccatagatagatagatagatagaaagataggttgataggtagagggacggatagacagatggataggtcgagactcagagagagatgggatggaagagaaggaagaggaggaccggtaaaaggatgaaggaatccaacctatgagggaggttaaatagactttcacagagagatttaattaggaggttttagggttggagtctggattcgaatttcgaggttgatactcggtctcgggagaataggaaggagtcaaggaagggaacaatattcggagacgagtcaaagggtgatggataatttagagaaagagagtgtaacttgggagtttgagtttgactactcaacgagatatgtgggtaaggattttggagagaagtctgaatagaagggttcggacttcgagattattttggaacggaaatcatttcggggagaactcaaggcgaaagggattgaatcttggggtttagagttcaagggtggaagcgatctcgatttgcatattcagacttgggtccgaagttcgagaaataaaacaagggtagattgacgaaccgataaagagagaaagatagatgaatcaaaacctgagaggttgaattcgaatttgagaatcggtttgaaggaaccaaggagagagtttatgacgcgaaggtgaatccctggacggagttagggttcgggcattcgacaaagttcacggatggggttccaggagggaattccgaatagaaggaatcgagcttcgggactatattgggatggaaattttgaggagacgaactttgataacagggtatcgagacaagggagggatttaaattgagatctttggcacaacttagactcaacactcaaagaacgaaaattttcgcaattaggattttgccgaattagtttttaacgtcacgcaaaaagcggagcgttacatccgccgtcgccgcctccaccgccggcggacggatctggaggaagggagggagaggattggagcgtcgcctccatcggctcctcttccattcggatctaggagggagggaaggggcggggccggcaccgtcttcggtggacgcctccgccgtatctgggaggaagagagggagggagcgtcgtcaccgtcagctcctcttcccttctcactgagccgtcgccactcctcttggccgctcctccgtcgctcctcgccgagtcggacagctgtcacctcctccttgcatgcgccgatggccgtcggctcctcctcttctgacaccgacgccgccgccgccacctccttgcgcgcgctgagccgcctacggccgctagctcctcctcacggtagagaccactcatccaaatttcaaaaatcgtaggagagggagagggagagggagaggtagagatagaggtagagagggggagaggataaggatgggtgggtaggtgggtggttgttgggaaaggaaacatataagattttttttagtgagtggtcctattttcccaggcgggcctcttatgtggtccgtctgcaaaaatttggaccactttagaggtcatcctctgaaaataaaagtatttttacagacggatctcttaagggatacgcctataaaaaaatgattttcgtaggcggacgacggtctcacccccggttgccattttcgtaggcagttgtttggttctgaggaccaacccgcctggaaaaaaaaagatcacgtctgcgaaaatattttttctattagtgtagactatcaattcagaattttattttattttgtaaaatttaaaatccaaaactactactctatccttcccataatatagcaacatagtaccagataggacacttaatagtacaacgaatctggacatgcttcaagttcaaacatggtcctccatgagggtgtgcaagtggtcagccgaaccgggcccctgattttccttactctaatgtatttaaaatcatttcgctctctttttttaaaaaaaagatcactcttacttttaaattttttttgttagaatagttttttttagctttgataagtgtttgatggtaatcatgaccaccttagagaactatgactcatgacaccgatatgaacatatgtttcagacaataaagattctatttttttcgcttaataaaaaaataaatgactacatcaagggaaaaaactagctaaatactcatgctttgcattccttttccattccctcaatcactttgggaatggacagtttgcacgtgttactgtttagtgaccctatgtaccaacttcatagtcgcacatgtcaattggtgggtggtgacagattcaccattcatcaccaccactaaaatcttttaaaaggagtatagattatttttctgacttaggtagagctcaccgctaattcattctcttatttcttggcattttctaaacataagacatcaatttgtgtttcacaatggagtctcagattgttaagtacggcctaatgacaaatggaggccctttgcagatgtatacgttttcaaggatagttttatagatatttttattaagacgaataatcaataatttcatatattaaaaagctaacgtagtataaatttcacgtgcctagtactaaggatactcatagtggtaaattcaaaaggaatgaaacaattataaataatttatgggtaaaacttctatatctgtgttttagtgatttagaagttgatgtaaaaaaaataaactatattccaataagaaaacctcaaaatctattacaaatttaagtttttggtcgtacctcatgagccaacaaacaatgaatctgctgggagcaatggcgcgctccactactctgcctgcacgaggctgacaataactttcaaacggcaaatctacaattgtcgtctagcgctagcagccaagtacaggcaaattcaacgtactagacatctggaattttccaaatacaggcgaattcatcatacacctctggaatttcgggtttattcatacgtttctgcggctgcatctgtgattatgtgaatcagttctgagtaaagggtgtgtttattttacgctaaaattaaaagtttggttaaaattggaacgatgtaacgaaaaagttggaagtttgtgtgtagaaaagtttggatgtgatagaaaaattaaatgtttgaagaaaaagtttgcaactaaactcggccaaaagcatctccagcgacggcttgagcaatgaacagtagtgtttcgtatatcaaggccaagatacgatcatcaacatggatattttcttggtgtctcgtcctgctcgtacgatcgaatggtcgcacacgtttcacatgggataacttttgtaagctcaatgctggggcctgtggggtggtgatctgtctgctgtcttctgtgcaagaagggaagggaactgttctttcttttgtagtcggagcaatggcctagctatttgaatctcctacttcaacttgtttaccttttcagtgacatgcgaaaacgagataaaccgttagcacattaataattaaatattaattattacaaactttaaaaatacatttatttgggttgttaaaggattttttttatatatataaagtttttttttggagaagacaccattaacaatttgaaaagatactcatggaaaataagaaagctgtaatttgaagttgaagaaaataatggaacctaaatcggtatgccaggaacttcaaatacttccttcattttgaaataaccgacaagttattgtctcatgtttgaccaccaattactcttaaatggttgaactgtgataaattttgtgcttgtatttttaagatgccatacatttaataatacgatatcctttttaacatttggaaaaaaatctacataaaaagtgagtgctgaaagtttagaaataaatagtgtccgatgccaattatttaaaaacagaggaaatattaaactactatgctaagggcgtccctcctacttccataatggaagatgaattggagcttagctatgaaaattatctgacagcaaaaatgaatgaattaggttccttattgtagaattagctcagttaagattaagttctagatttggtacaaatgaccatatttatgactaattactttttcaatagtagaggtgtacatatctacatcgagacgtttctgatggctttgtgaatctcaggatatatatatataatgatccagtctatacaaatcgatctagtctatacaaggatcttgtaagttctagtgtgtgtctatgtatttgtaaaggcgagtgtatgtacatgtatgtgagcgtctgtgtttgtaccatgtttttagaagtattaaaaaagttgttagatttacatcaaagattttgtaagaaatgttgaaagttcccgcaaaaatccacataacataagctaccaaagattgcactacgataatactacatccgtttaaaaaaaactcaacataggtaagatgtgacctatcctagggcacatcctatcttatattgagttttttttaaatggagggagtataggccgagtttagttccaaaatttttcttcaaacttccaacttccaacttttccatcacatcattctaatttcaactaaacttacaattttggcgtgaactaaacacacccatagtttaatttaaatgatgtgtcgaagatagcagtagtacacaccaaattaatgggagtagcagcctcatcggctgcccacatttcctaaacggcttattagggaataaaaattaatttatacataaaacgtttgtaaatatactcttagtgacttaaaaaacaatataaaaaactatgttaaaaaatcttaaacttagcttcaaaattaagtttaaaaaaataaattttggctttgactttggcttattaggtcaatcgatggaaccctagaacataagctgctaagaattgtagtcctatgccagctcaaagcaaaacaacccaaaatcatgaataaatgtgatgaggatatcattgactcggatataactatgcttctattacatatcaacaagctaaatgtgcatttgttcaatattaggtttactcattatatatttgaacaaatattactacaccagttttgtatattcacatttgcagaactacttgtgtgtgcaaaagaaaggagagcaaactcacgaagtgtatggatgatcaaataagttgactagggatcagagtttatcacctacgtcatttctcaagctaaaatgtttgacatttctcaagtctactcatacatcaacacaatacttttggtttatataaggcaaaagattaaagtctccacatgttggattcggatttgggtatcctagcaatatcaacttcaaatggaactagtagataatctaaaagaaatctctaggcttatgagtacttgttgtaaagcttatgggtctactttcatatggttttggtcccacattaaatttactcattagttgttaggaatcgacaaaacaaaccacgtacctcatacaatccaagtttgatttgggtcctagacgttgtaattatatcg

SEQ ID NO: 62074 - DNA, 9331 bp, Oryza sativa
  unsure (1)..(9331): unsure at all n locations
ctaggcgaggtcaatcggacaacgtatggttgataaccagagtagaagtggtattacgattgcagggttcggatcatattgatcggaagccagaagccagaagccagatcgtgagtgtcaaattttcaccaaatcaatctaatcaatacctatcgaaagtttgctcatcagtacgtcattctcgatcggccggcggaaaggaaaaaaaagtaagaccaacttgctggaagcatacaaaacgaaccaccgtacggcaccgagttatcgccgccaggtcagttggtttagtgtttgtccttccgtgctagactgctactccctccgttttataatgtaaaactttctagcattatctatatacatatagattttaatgaatttaaacatatacatatgtttagattcattaatatttaaatgaatgtggataatattagaaatttttacattgtaaaagggagaaagtagtagtcaaacactccaaacctaaattgcccaatcacaagatatctaccactgtaggctgtagcatggcatgcggttcacgattccatccacatacttctgcccattcggaacccactaggctatctatcgatctgtataaaacgagagacgcatcgacgacgtaaaatctaaaaggagcacatctcactcaggctggccggccgaaatcgatcggcagcaaaggccaaccaaactaagccaagagcgagctagctaagctggttttctgcttgtgccatgggagaagatggcggcgtgaactcttcttccaactctccggcggccgccgttggtctcgtgctggtggtggcgatctgcacgtacctggccgtcgtcgccacccgcaagcagaagcggcggcggcggcggcggccgccggtggtcggcacggcattccaccagctgtaccacgtccggcgggtgcacgactaccacacggcgctgtcccgcgagcacatgaccttccggctgctggtgccggccggccgcgagcagatatacacgtgcgaccccgccgtcgtggagcacatcctccggaccaacttcgccaactacggcaaggtacgcagcgccactctttattactgcatgctcttgtgattctgtaaactgctttactactcctatacggctatactttagtccccgttctctctccctttgtccaattggagagatatttcccgtgaacctaaaatgagaaaagttattagcacataattaattaagtattaactattataaggttgaaaaatagatttacttgattttttaaacaatttctatgtaaaaactttttgtcaaaaagtatcatttaacagtttaaaaaatatgctaacggaaaacgtgaaaactgaagtttggagttgagaaaaaagaactaggcccagtcttttcttcaacttactcgtttttattagcacgttttccaaacggttaaatattgtgtattttgcaaaaggtttccatatagaagttattttaaaaattaaataaatttattttctaagttttaataattaatacttaattaaatatatactaatgagtgcacagaaaatctctctccaaacggatagaaccaacagtcttattactgctactagcataaccctatgtagtcaaaaaggatatttctctagtcaatttgacgcgtacggccccatctaatatgggccacacgtgcgccgcgaacatgttccagcccaacttgtacgtatcgtcacaatcctattcatcctatttattgtggaccatacgttagtcattgagttctcaataaaaaaagaaacgttagttattgtctttgatctaacacaactatcatgggcccaaatggattatcctaaaaatctactcgggtggaagaaagaggttgtgggcttgtggccacacaggccgcgacgttgacaacagcagcatagtgtggcggaggagagaaccgggacttccgggtacttgcacacgagtacttccgggtgtttgcacaccatgcacgaagagataaaaagagaggtgaagagccgaaggagaatgatgggagtagaggagaggaggaaaacgctataagttatggtacccggcaacccgatcaaataagtgggtaatctattggtcaatccatttaatttatttataaatagatttacgggttgatccattcatacctttttaattgtaggcagctcgatatctagctaggtaacagcgacgatatacatacccggttagtcagttacgagcgtgacactcgaaaggaaataggcaaaatttgttacaggatcctcaaaaactgtgtaatttgctggtatatatcataaaaacgtgccacggcttaaagacacttaaaaaaactcgtaatttgtccacggacacttttggcttaattgaagagagattcttcgaaaagacaagaatgcccctagggtcaaaaagcttttgagctgagattggagcaaagatgaaatataatatacactagtgatatacttagggtgatgacaaacttaaagttgcataattataaatgtttactgtaacatcatgtttgtagcatttggtactagaggcattcatgttgatcccaaaccagtcagctttgcaagcagccatttgaggctgctagctaggccggtgcggttcatgtttgtggatttgttgctgccctgacacgtatggtttctgtgaaaaatactaaggggtcgtttaaccacgggaacatgagcgacctgttcggggatggcatcttcgccgtcgacggcgacaagtggaagcagcagaggaagatcgccagctacgacttcaccaccagggccctccgcgacttcagcggcgacgtcttcaagaggaacgccgccaagctcgccggcgtcgtctccagccacgccgcgtcaaaccaatccatggacttccaggtaatcaaccgatcgtaactatcgatggcgccagtggtgtgttgtgtttgtatcgccattgaggacgtttgttcggttgtttcttcagggtttcttgatgagagcaacgatggactccatcttcaccatcgcgttcggccaagacctcaacacgctggacggctccggcgaggggcgccgcttcgccgcggcgttcgacgacgccagcgagttcaccatgctccgctacctcaacccgttctggaagctgtcgaggctcctcaacgtcggcgccgaggcgatgctcaaggagaggatcaaggtcgtcgacgggttcgtgtacaagctcatccgtgacaggtccgacgagctctccaacaccaaggcacacgacactgtaagcactacctgatatgtccaattgtccatccattttgtgagtgatcaaacacttgaaattaaggtgaactttttgtgtgcaataggattcgaggcaggatatcctgacaagattcatccaggcaacgactagcgattctgggacggttgattacaagtacctgagagacatcatattgaacattgtcatagccggcaaggacaccacagccgggtcgcttgcttggttcctgtacatgatgtgcaaacacccggaagtacaggagaagatctgccacgaagccatggaggccaccaacgccggcgaggccgcttccatcgacgagttctcgcagagcctgaccgacgaggcactgaacaagatgcactatctgcacgctgcactgacggagacgctcaggctataccctgcagttccactggtaattaattacgatcacaaagttaatcaaacgaaattaattctcttgcccaatgccaaatgaatcgaagtatagtaacaaacgtagtgtcactttgtttctgacgatgtttcaggataacaagcagtgcttctcagacgatgtattgcccaacggattcaacgtcagcaagggggacatcgtgttctacatcccctacgcgatgggccggatggagagcttgtggggcaaagacgctgaatccttccggcctgaacgttggctcgatgagaacggcgtctttcagcaggagagcccgttcaaatttacagctttccaggtgaaatttactgaactccaagaatctttctgagttccggttacccacttctgaaagttttctgaactttgtgatgagacaattctgaattctgatcacctgctccttctgtaggccggcccaagaatctgcctcgggaaggatttcgcgtacaggcagatgaagatcttcgcggccgtgctgctccgtttcttcgtgctcaagctgcgggacgagaaggagatcatcagctaccggaccatgattacactctccgtcgatcagggtctccatctgacggctatggcgagatgagggcacacactacagtctgggcacgcacagcagctggctcctgtactcatgcaagtgatagctccttgtgcataccaaaacgaacgagatctgcaaaccttaattatgtctgatcgtgaataacccgcattgcaccctagaataataagtgcatctgaactgcagtcagggtcagagtaacttattggagtgaactggtgttgtagggaacttcaattgtacaacttggagggcgcaatacaaatgaatggattaaatagtagaaagttgattttaaaagggctttcaacaaatgctgatgatttttttacaaaattgtaatgtttttatgagcttggaaaaggtaagtttggaaaaataaaaaaagataactcaaaactcatggcatcagcttgcattgagctcggcttagttcggctcgaactcataatcaactactttggttgcgttcggcactgcttgttaccatcctctactctctcgtttttcatacacatgttttccaaactgcttaacggcgtattttttgcaaaaaaaaaatctatagaaaagttgttttcaaaaattatactaacccattttttaagtttttttagctaatatttaatttttcgtgcannnnnnnnnnnnnnnnnnnnnnnnnnagaaaatgagggctgccaaccctcactcaagaactctgccttagtttggctcggagtaataataataagtcaagctgatgtgggatttcaagtcgtgagcataacaagccagctcatgagctacttgtttagttatcttcgaatacttagttctttcagttacaataaatcaaagttttgtcatcggcaaaaactcaaatatatttataataaatctataacccaagttgacaagaaataaggtgattctcatttttagtctggtcttatgaatgtcaaaagtactttcttaaatatgggtttttggattgtcaataatgggaaacaaattagattttggaaagataaatgaattggtaacttggcttttaaagataaatatccatctttgtatgcaattgttcggaggaaaacatcttctattgccaccgttatgggatcgatctgttccgcttaatgtttctttcaggagagctttagatggtcataatcttgtttgttggcatgagttgtgtgcctctatagtacatattcaattgaatgattcgtatgatagttttagatggaatttcaatcagaatggcttgttctcggtgagatctatgtaccaagctttaattaataatggctatatcgagagaaacaattgtatttggaagcttaaattgccacttaagattaaaattttcatgtggtacttgcttaaaggggttgtgttaaataaggataatttggcaaggcgtaactggaatggcagcttaaagtgttctttttgtttaaagaatgagtctattcaacatctctttatggattgtcattttgcgaagttcctatggagagcagttcagttctcttttggttttattcttccagttagcatatctcatatttttaatgggtgacttttgggagttgataagaaaatgagtaaactgatacttgttggagcttctgccatttgttgggcaatatggctgagtaggaacgatatggtttttgacaaatcaccatcattttcctatatgtaggttattttcagggcaactcattggctccggttttaggcacaactacaaaggtgtgatgaagatgaagagtttctgaaagttgtatgccgaaagttggagaccacggttgtcgaggagtgatcctctctagcgggagatcgtgagaacccccccccccctcatgagttcagccgggggaagaagctcgcctctagaaatcgcatatccgtccccaaggctcctagctagctcgcacacaaccaaattatacaggttcgggccgctatgaagcgtaataccctactcctgtgtatgggatttagactgagagttacaagggttcctaagctcgggagaacactcttacttccctcctccacaagctcagattttctgagagtcgtcccctttctcggtgggcaaggtccaccttttatacctcaaggggataccacatgcaccacctctacctactcttctttcgggtggggacccaccctatcttgactggaactcgaccagtgccttcgcctggaagctaaaccacagcttgtccttgagcggggcccagcgccgtccctcgcctgacacgggggacagccctgttattccctcattaataggtgaagacttgtggtggccgccgtccgaatgaccccctgatgggacgggtcatacctacctccactccgccggaagcagatgcgacgtgggaacacggttgtccgtccagtcatacgtgaccggcgtcaggccggtcacagaccggtcattcttgaccatcgtgcatcagtttagcacgccacacgtctgccccactgcattaaatacgacagggggcagttggggcgctgcgcgcattaaagtaagtttagcctgggccccctcctcgcttgcttcccccgccaaacagcggctaggcgagggcctaggggcaaagcagtgcaagggcccgaggggcataacgtggcaccccgaggccccgaccccccggccgctcctgcggttcacggaatgcggggacaggaccaggctgtagggacacgtggcaggatgggaaggtagattcccctcacttcgcataccctcgggcccatatctccgacaacggttatgcaactttttgctaattatggtttgagattttcaaatagacttcaataattgtgatctccttacgttaggctggtttctttgtttttcttttcggtgtgttctattcatttagatttatactatattattgaaagctactatgtaataattggttgtagttcttttgagtaaaggccggaatattatattccattatgtaaaaaaaactcaaattctaagtgttgccattaatgaggacatgtttcagtaaataccatcctataaacgattttatccaacaaatgacatcgccatcaactttctagtagcaaacatctgttatgatgttgtgcaaaggccattttaccccccacgtataacacgtactccctccgtcccaaaatgtagctatttctagcacagtgtcttgtcccaaaataaatctatttcttcacctacctcctcctctcaaccaatcacaaccattcttcttcacctactttctcttctcaaccaatcacacacttcctccaatcattctcacctactttcttaatacccgtgccaacctcaaaaatggcttcattttgggacggaggaagtagttaccttattactacaaggcccagatctgctgctacattgcctcgtccggcatccctgccatcgtctcgaagcctagaagcattgtgccactgctacctcgaagagccagcccaacaccactcagacagccacactgtccccacctaggctgtgtttagatccaaagtttggatccaaacttcagtcctttttcatcacatcaacatgtcatacacacataacttttcagtcacatcattttcaatttcaaccaaaatccaaactttgcgctaaactaaacacaaccctagattcatcctgctactgcttggaagttggaaatgccacgccaccatcttcctcgcctggatcaactgcactgctgccggatgcaaggacctcgcgacccttgccatcctagggtctctgccatgtcaccattactgtgaacaatgcaccgacgccgagcccacctccactgtttcactcatcgcctctgccgacaccttcctctgcattgccgtccatccctattaatgggatccggatctggtttttatcaatcctgccccgctgtccgccattggttaattatttttgtgttccattttacctagatatgccaatgccaaaaacacctatgcaccttgggacatgggtcgtggcccaagtagcaatggactgccttttgtataactagaaatttcgacataggaaaaagtacaccgaaggtccctcaacttgtcatcgagttacaaaatcatcccccaatcccaaaaccagatatccggcatccattaaccaatcaaaaccgattacaataggtcctttggtggttttggacccagttttgtcctacgtggcggcagagtcagcgtgggacctttatgtgggccccacgtgtcagatgccacgtcaatctcttttccttcctcctctctctttctctctctcactcttctcttctcgttcgacgccgtgaggagggcatggcggccggcggcggagaagcacacgctcttggcgatgccactgccgccgaggaggaggaggtgaggcggcagcccggcggcggcggcggtcacatcgtccttgccgaactgggtgctcttgtcatcggagtggtggcgcttgcgaggggatgcgccggcggtggtggtgaaggaggcgaagcgatgtactccagcaggcgaagcggcggcgtcgacgggcgagcgcggtggcggagtggcggcgtcggtgggcgagcacggctgcggagaggcggcgtcagcgggcgagagcggcggcggcggcgggcgagcgccgctgcggatggggatgcatcagccttgtcgtcgtcgacggctccaggcgaatgcggcggccgcttggattgtggcggcacgggcgccacgccgccggcgacgctgttcgaggtcacgctggggaagggcggcggcggcggcggcgccggtgacctggactactacgacgtgagcctcgtcgacgggtacagcctgcccatcgtcgccgtcccgcaggccggcggcggctgcgccaccaccggctgcacggccgacctcaaccgctgtacgtaacgtgtcacacatccatgcgtcatgcatgcatgtcgtacatggcgaacgtgtttgtgctgcatgagcatatgtgcagcgtgtccgaa

SEQ ID NO: 62075 - DNA, 3966 bp, Oryza sativa
accttcacctgcaacgccgccgcctacaccatcgcctacaaaacagcgtcaccggcggcatggcgcccgtgccgccgcactccaagtggccgatgcagtcgccggtctggcgcttgtttcatcagcatggagacagagacaaccatatacaaatggatgaccaccactcagcactcagcaggaccagcgcgagtacagaacgaacagcaaaatactccgtactagtagtatattacatctacagtaatcgaagtgcggcttgcgagccacgaatcacgaacagatgcaggacgctactatctcaagcatcgatcacaaaaggagcaagcgggacatttgatttctccgaagctgcacagatgctgcaaataaatcgagggcttcgaaacccgacaccccggaggagtctatcgatgccttccttccgcgatgcagaaaagaacaggcagtgcagagtgcgggttacctgctggggcgcattgtggtcgggcggggcacagaagacgtcggcgtcgagcggcatgtcgacggcggagccgagctggcgccggtactcgctggtctccccggcgaagcacgcggtcgcgccaccaccgccgaccagcctgcccagggagatgagagagagagaggggaagggagaggagggaaagagaacatgatgacgtggcgtgctgatatgtgaggcccacgctaactcacccgccacgtcagacaaaaccgagttcaaaaccatcgaaggatgtaaagtgaactgttttgtaagttaagggatgttatatatctagttttgcggttgacggacgattttgtaattcgatgacaagttgagggaccttcggtgtactttttcctttcgacataccaacgttcggcccgagcccaataaagactaaaccctggttcctccctactagtactacggtctcaccggatgtgagaacaagacaaggggcatagtgccgccgatgccgatgcctcctaacacaactgtctccctgctcgacgcttgctccaggcgcctcccgcccagcggcctaggcccggccggttgccgccgcgcttccaacaacctgccaatccacaaggcgcctgccgcccctacccggcaaccccgacttgctggtaggcggcgatgccttatcagctcaactccttggctcgccggtgccgtcacaacattaagcaaggaggcagaaggccaggagcagccggcccgagcatatcaagaccagcccctttaggaccttgatcaacgaccagagatcactgagtttttcggtatctcttattattctcaaagagcaattttacgggacttgaggagatatcatgaggtactatttttttctattgtaaatttggtacctcttgatatttaggtattatgaggtaccaaattttacactaagttttggtacctcatggtatttcctcaaggaccgtagaattactctaaaaaaattgagtaattcattttggtatataagtgtattttgtaggttagttacttacacccttacctctcgttagtggtattttaaattcttcttccgaaattttcttaactaccatatgtactaattcatgtctttgatatgcatttttttttctctctataggatcaagatccataactacaattgaagagctaaggacagtataatattatgcttagaggaagctaacctataacaaggtatttgtatttatgtaacaaaccacaattaaatttgtattgtatctttttatcatgcattaaggaatatcctgtgtcgctgctactactcccttcattttatagtgtagggcacaactattttttttataatgtttcataatacaatacgtgtatgcttataagcaacttattgggttgatccaaacaaggaaatgattatatttttttcttaatctatacgttaatagtagttgcataaaatattttacaatggagggaatattaattatctacttcagtactgattgtgttactactcccatttcaattactgttctgccattatataatttacccttttttgttttggtgctaacaatgaatcagtgttgtgatttctgaattcagtggtgcgctctgagatttgataagtccagaagcagcatcagatctaccctgtttttgcttgcttgttttatcagccaagtgcgtttctggaagatagggttcttctttccggtggattgatcgttgtttgggggcaattctctatttgccattgctaatctttcatgatgattgttgatcacttctggattttagtattttgcggttaataatttaatactataccccctctggttctatattaattaacgttttggacaatgttgaggttaaacttttataactttgaccatcaataacttaaaaaatatttagtttaaagaaactagaaaaacatatatagatttatctttcaaaacactataataaaagtaaaacatgcattatttattgtatatattataatagaaaaataaggtcaaaggtatattttgtagagcgtgtcattgtccaaagcgtcaattaaaatgaaaccggagggagtatatagtttatctcatccatttctgcgtgttcaagtagacaatgtagtgttcttgcgtgcgacaatgaccaatgaccagctagatagggttacccatcgatttgatcttgtttagattagtgctgaaattgtgaagtccaaatggcaatttggacattgaagaagaattgacccttatgcagctgaatggacggaacccattaatgtattccatggatgggggctgttcgatcaggcatttatacaaaatttgactgggcaaacggaagtcaaccaatagaaacgtgacagcggtggcaaataaaaaagggacattgacatttgtacgatgatgtcttctagaaggaaaaaaaatgtctcaattatcttcataaactattatagtccaaattatctcctcaatcaaaacaacttcatattttttttcatttgactcttcaaatcagacgaataaacctcgtatcctaatacaaccagttttgatagggcgtgccatataatggggcaataaaatctagttttcatcctacattgcaacagtgctcacgtgacatcctctatctttccatccacatcttctccatgtgctgcatcatactatccacattcgcatctccatatccgtcggatttctaaaagcacgtaccatatcctcgtttcggacagatttggattggatattatcttattcgttttcacccctacccccccccccccccaaaaaaaaaaatcttcctccatttttaaaaatagttgacagtggtattttttattttcaaactttgatctctcattttctataaaagaattacaaataaaaattatatagtataatcaatgtattgtactatagtgatatacttttgttcgtcatattctaaccatttagagcatgtttggtacagctccaactcctaaatttagcttcaggagttgggtctggagtagagttgtggagctgcctaaacccagctccacaactatagttcattttgtgagagagttccacccagctccactcccagttttagtggagttgaaactgtttggttagaactgtgccaaacaggcccttaggagtatttttgataactcaaaaactttatttccgtttcagaaacatagaactactacattatttaccgtacagttggttgcactaaaatggtctttcaaagctctagcgtaacaacaattgctaggattttttttgacagttataaactggagaacttagttgctgcattctagcatcttttactagtttatcggctatcgattaacttctcctatgatccacgtaacctgcatcatggtctgaggaatatttgcttgcattcgactaatcaaaggttggcctggtttttcctcaaagttttttctcctttatagt

SEQ ID NO: 62076 - DNA, 20982 bp, Oryza sativa
gaaaactgtgctaagacatcttactccctccgtctctaaatataagggaatttgtttgttcgtgtagtaggatgtatcacatccaatcaaaatcttttatactccctccaacctaaaatataggccgtgtttatattcaaacttttttcttcaaacttattacttttctgtcacatcaaatgttcggacatatgcatggagcattaaatatggacgaaaaaaatcaattgcacagtttgcatgtaaatcgcgagacgaatcttttgagcctaattacgtcatgatttgataatatggtgctacagtaaatatttgctaatgacggattaattagacttaatagattcatctcacagtttacaggtggaatttgtaatttgtttagttattagtatatgtttaatacttcaaatgtgtgtccgtatacttaaaaaaattttgtcacacgaactaaacacagccatcataacttttgggtggatgggacatattctagtatagtactattatatgtctcattcaccctaaaattgttatattttaggacggagggagtatattataggagagagggaggaccagctgaaagaaaaacaatcaagatacagaagtcattctcagccattaaaagaaagaacgacaacttgttggaagcataataaataaacctgagtaaggtaatgcggtgctcgtccaatgctccagcctactccctccgtcccataaaaaaataacctagtaccgaatatgatacatcctagtatttcgattatggacatacatacgtctagattcatagtagtagaatatgtctggttctagattcgttttttatgggacggatggagtatcgacgaatgacaatcccatcattaattatatcctgcctatttggaacctacccggctataactaaagagatgcattatacagaatgacaaagatatcccatcactaattcgcgcaaaatacagaagggcgcatcactcagcgcggcaatccacaactaaagccaatctaactaaatatggaaaaactaagaaatgttattgataaacactcaaatataagaaatatcatcaacaagtgagagttacctaaaatactatcatacatgtgattttatcctagaaatatcattgttgttaagtttccattaatcggatccatatgccattataacttctttgattttgaaaaatatcataattatttgtttatttgaagatatgttattacaatttgaccgaaattagtaatatgccactagtaccatttcaatgtaattataaaaaagatttggactaaattacccctcctcctctctccttttttgttcaggatccaatgaagtcatgccaccggcaatggagctaacggtggagtggtcgggtagtctaggtggtgggggcgagtcctcaatgcttggtaggaatcagagcttctcatgttggctatgttgtggtgttgtggacgacgagagtggagaacagagggagtgcctatccggtgagttgggtggggattgccggatcggacttgtggaagagatgacaaatagtgagagggagaaggaagaagggggtgaagggaggaggaggggggcatttgtccaattttttaattgtgttgaaggggtacgtaatggcatatttctaatttacatcaaattgtaatggcatgtctcttaatatacgaatagtaagaacatcctgccgctgtggatctccattctctcgtccccgcttagtctgctgtaattggatttttttttctctctccttagtctgttgtttctctcctcccttcctctgttgtcggttgatgtaagtaacctttgttaatttaattcacgtggggacttctcccccagtgttttcagttaaaaaaaattatacgaatagtaatggtatgttttgaaatcgaagaaattacaacaatatggattcaattaacccataaataattgctcatggaactattcatgttcaacccttgacctcccatatttttcaaaacaaaatacaaatatttaaaaagagattatataatccaagtatattgtatcttaattgcaatcataagataaaacttcctactatttaagagtaactaattgtcaaattgtatgtgtagtagtcaacgctaaagtatattttaaaacgtaaggaccgccaaacaaaaccaaaaaaaatgtcaggaacaaatgtcattctctatcggacatattatatactgtatatataaaaaagaagaaaggcgaacgtgttgggaagcttttcttcttctttttttttatatacatatagtagatgaagtaatctgggagcataataaacactaaagaaacctgaggaccacgccaagtcattgccgtcgggccagttgattagtgttgtactgctgtcatgctgggctagtcgaacactaatgacgtatgacaggatatcttccgcttctgattgacagatatcccatatctccctgcccccttaaaaaaataatcgatagcgaaactattcgttctcattgtcaaactttgatctcttgttttattttgaaaatgttacgaagaattaaaacgatatgacaccatccaaagtatattgtgtcttaaatttcacgtattttaaccattcatgaggaattaatgatacagctataattgcaagtaaaaaaagatttggagggagagacgtctcacaaaaaaattaagaagaaattgtgaatatattgtggattgaacacgagactttaagattgaaaacaacaccccttgctactgcagtatcaaatgcatctctataatatgtcttgtctaaaggtaaagcctgatacagaatattaattagacaatacacattttatttagagactattcccttaaatttttgaaataataaatactctaatcattaattaaaaagttttttattactattattttatattttattctcatgcagccaagttctattttataaaaactaagagttgttattcatgagttgtcaatagtaacggcaatgttttatctctcttctctctgtttttccgtgtcagcaaatattcttaattagtaatataacagccattgtacatataaccggactagtgaatgttgatcgacatttaaaaaacggagggaggactaaactcattgcaaaaaccaaaaataaggaaataataatatataaatgtcattgtcagccattaaaataaataaagacaacttgctggtggaagagtcaagagtggaagcatgataattaaacaaatctgagaatagtgtagtgctgtgctagtccaacactccaaacatgtttacatgtcgacggctgacaagatatcttccactattttatcatgcagtccacatggagtaccccataagcccatcgctaattatatcctgccaatttggaaccttctcctatctataaattaaagagatgcattcgcgccaaatacaaaaggggaaaacactctcagtcgcgcgtccagcaatcggcagctagctaatcccatctcgttgttgcttgtagccatgggagcggaacgcggcggggactcttgctactctccggcggcggtaatggccaccgccggcgccctcgctctggtggcgatctgctcgtacctggccgtcaccagcaacaagcagaagcggcggcggcggccgccggtggtcggcacggtgttccaccagctgtacaacgtccggcgcatacacgactaccacacggcgctgtcccgcgagcacacgaccttccggatgctcgtgccggccggcggcgaccagatatacacctgcgaccccgccgtcgtcgagcacatcctcaagaccaacttcgccaactacggcaaggtttatctcctctcttcttttctttctttttttttttggaatttcacttagataggtatgattttttaaaaaaagaaactaagaagatggattgacgttatattttttagtttaaatttaacgtctacaagttgtaaaaaatatatatggttgtcaatatatgtatggtaaccaaagtttaaatatttgttttcttttgttgtaacttttggaatttcacttagataggtatgttttttttaaaaaaaaataaattaagaagatggattgacgttatatttaagtttaagtttaacatctacaagttgttaaaaatatatatatggttgtgaatatatgtatactaaataaagtttaatttgttttcttatattgtaacttgtaaaaaaaataagatttggagagagagacgtaccttcaaatattttttaagagaaaattgtgagtgtattggaaattgaatacataactttagagttgaaaccacacaccccttatcactgtataatcaagtgcatcttttttttttaatataacttgtagaaattgaaattggatttaaatgtttaaagattgtttgtaaactgctacagtatacgtagcttctagttaagttaaccctatatgtaaacctagttgaatattattccctccgttgaaaattataggacacataatatttcggaaagtcaaattttgtgtgtttgaccaatgattaatcaaattataagtatatttagtgcataaaacttatatcttttaaaaaaatttcccaagacattagttctacagataacaagaatatattttataggtggtcagtggtcaaatcttgtcttaagtacttgttccaaataaaatatgccctatggctataatctgctacggagggagtaacttctactatatgaaaaccacaattctacgcaatcatgtttggagttcgccaccaagcactgagagtcagtgtgttacatctacatgaggtttaaatatgatgcttaaaaatgacgtttaatagtttaaatgttttctggaacaaatagtcacaagatttctcttttattatgggccggacataagcctcagatgcattccggccttccacggacgccgtgctcgtctgataggcccattaattatcagcctcggtcgtaatcccgttccgacccaactatcaagggcccaaacagatcatcataaaccagaaatggaataagtacatgttaggtacttaggtcccttatcttaacattgggtttgaatcatttcattgaacatcaatatcagatataacacgtccctcaacttacgtctctcaacttgtaaaactgatgtacccaaaatcccaggacagtataatgccgatttcagctaaagtatcggctaagtcagcgtgagacccacatatcaaacgtctcactttaccatctctcattaggccaggaggtagacaatgagcaacgtggacaggggtagcgaccgatggggagaggaggggagaagacgaagaaagagtgttctgactctgactaaaataccctgacatgtgggtccaacactgacttagctgtcacctcaatcaaaaccaggaacgatactgttctaggacttctggtacaccagttttgtaaaaatgaggggcgtatgtatatctggttttgcattttaagaagacgattcaaacacgacgttaagatgagagacctaaaataaacttatccactcagaaaatcacaatagttcgaacatcccataggtaggcccatcggctttgcgcaagcagctatttcatgtttgtgccagtgtcgtggaagtcggccggcacagccgtttaatcgtccgtcaaaacggaaacggtagccagaccgtaccgtatcatcaagtcggagcaacattactatttcagagtaattatacagttgtatggcatgattagtcggttatttatcgataaatcagatgtctgtttatgaaactaacataaacttgcaacttgcagcccagctgcactattttgactaacaagcccaatactattgcgctactaaccatcagtattgatatctattgaactaataaatggtattttcataatatagttagagatttatacaaatattttttattaagatgatgcattttgtctccaccgttgccattaacatcaattatgtacatcttagtgcgaacgccaaaaatccgtataattccgtttaatcatccgtattacgattaatcgcttgacggcacctcgtccgtccgccacccgtatttcgttttccacgacactggtttgtgctgacacgtactgtacgaaacaaaggggccgtttaaccacgggaacgccaaggacctgttcggggacggcatcttcgccatcgacggcgagaagtggaagcagcagaggaagatcgccagctacgacttctccaccagggccctccgcgacttcagctgcgccgtcttcaagaggaacgccgccaagctcgccggcatcgtctccaaccacgccgcgtcaaaccaatccatggacttccaggtaaattaagcgatcgtaactaccaaatggctaataatgcacggcgccggtgagacggtgagtgacgtacggtttgtgtcgaacgtttgttcagggtttgatgctgagagcaacgatggactccatcttcaccatcgcattcggcacagacctcaacacgctggacggctccggcgaggggagccgcttcgccgcggcgttcgacgacgccagtgagttcaccatgctccgctacatcagcccgctctggaagctggcaaggctcctcaacgtcggcgtcgaggccatgctcaaggagaggatcaaggtcgtcgacgaattcgtgtacaggctcatccgtgccaggtccgacgagctctccaactcacacgactccgtaagcaacccctgaaactaagcagctcactacactccggtttgactgacatatatatgatagatccatttctggatgtgtaactaagctgaattttgtatctgtacagggttcgaggcaggatatcctatcaagatttctccaggcaacgaccagcgattctgtggtcgattacaagtacctgcgagacatcatactgaacattgtcatagccggcaaggacaccacagctggggcgcttgcttggttcctgtacatggtgtgcaagcacccggaagtccaggagaagatctgccacgaagccatggtggccaccagcgccggggacaccgcttccgtcgacgagttcttgcagagcttgactgaccaagcgctgaacaacatgcactacctgcacgccgcactgacggagacgctccggctttacccttcagttccaatggtgattaattatgatcagtttcatactaccatcgagctaattaatcaaacgacatttctctcatcgagtgcgtaacaaacgtctcttgttgatgatgatccttttctttttcaggaaaacaagcagtgcttttcagacgatgtattgcccaacggttttaacgtcagcaagggggacatcgtgttcttcatcccctacgcgatgggccggatggagagcttgtggggcaaagacgctgaatacttccggcctgaacgttggctcgacgaaaacggcgtctttcagcaggaaagcccgttcaagtttacagcatttcaggtgaagtttaccgaactcagcacacaatcatcaatttctctgaagaagttggtgactagatttctgaattctgtttacctgcttcttccgtaggccgggccaagaatctgcctcgggaaggagttcgcgtacaggcagatgaagatcttcgcggccgtgctgctccgtttcttcgtgctcaaacttcgcgacgagaaggagatcgttagctacaggaccacgcttacactcgccatcgaccagggtctccatctgacggctacggcgagatgagtgcatgtcacactacacagcctgggcacatactgcagctgtcacctgtacactgtactcaatgcaagtgacagctcttgtgtgccaaatcgaatgatatctgtagaccttaataacgtctgatcgcgaatgatccgtattgcactctggaaataataaagctgccggtgcatgtacctaaatagcagtcagcgtcagagaaacggtgcccgacgaactatacattcggttttcagttcagatggcacacgttttggcttttgggcgttggtgttcatggcagatgcaacgcattcatcagtcatcactgtgccgcgaaatgtatcatggacgatcagacgatcacatcgtgtcaattaaagctacagcgccatgctgactgctgatgttaatcttgatctggacatggatcgagtagacatgccgatcaagctcaggaagacgcgtagaaaatgcaccgaaaaatgaatgaatcgaggaattggagtacagtgaatcagtggccatggcgtcagaatcaatggatcagcgtgtgaccatcctagtggttatagaattagttaggccattagttaaagtgacagtctacaacacacatcaatccagttcgactgcaataatgcaatgtgattgataaactaatccgtcgcgaccatattaatttccgcttcaaatatgcatggttgccgtgtcaggcaggacgcgggcagggcttatccgagccgtcgccatccatatcatagatgcggtggattggtggaacaataaactagaacaacaaggaaaacctaaacagaaggtggccatgcatggaacaagctgatttgcccaggccttgacttggtacttataattttagtactagcaacagtagctattagttagatcaagctagaaacatgtgcgggaaggagtatgtagggggtcatctttaggtggtgatgttcatttttttttaaaaaaataaagataaggatgaaattaggttatgcaaaacaagaatgtcattattttagttgagttttaattattataaatttaatagtggattttcgtttatattttaaaacaacttctatattgttgttttgtaaaacacaccgtttaatagtttaaaaatattaatgaaaatggaggtaaaattttacttcctctgtcaaaagtattatgaacatgagacacagtactagaatatgttatattacatattaaattaatttattttaaaatttaggaagtactttctttaaccaaaagatttaaattttaggaaagaatcaagacacgtagggagtactatcttaatagcacaagaacaccgcctttctcagcgagagaaatgggtacccgtgcgtctctgacatgcatcatgcatgagcaaaagtgtccgatacatataaaatggcgggaggagctagagtacgttcgagcctaccaaccagacacgacggccgtgctggtgcggtgcaggcacgtactacagtactaccatccatccgttcgtcacgttggattcttggatacttgtgccacgggctaaacatactcctcctccatacacaccgtcaccgagcaacctgtcctggatagcctaatgcagtacaacccacttagcttaatcatcaaacaaacatcgccacaggaactatggttaactggagagtggtagtttaatcctcgggaaccgggctgattaaaaagagagagaaagattaatcttctcgagagccgtggttgcaaagtttgcaagctcgtgggcagcaaatgtgtctgcatcctacaagacgatgtgctcgtgtacgtacgtttgctcgccgaggaggagagagatgcgagctagctagcgtggggttgggttgggttgtggtggagtggctacccaaaaaaagagcagtggatcgagtaggatgatggactgatgtccagtagcgccgcgtttgcctttggacgcgagcgagtgaccggccgaatctggtttggggatggatgtccgggttttgtctcatctccttcattcctcggtctcttccccgccatggcaagttcaaaatgcggctttgctccggggcaaattcaaacgcatgacgggtattacgtgcaatttgtgatgaattgcggtttcgcatgatggatggtgattggtgatccatacgccccctgtgcaccggcgggcggcggtggctctcgtcaaagcgtcctgagttgttgacgcggcttcacacgtccgtcgtcaaaaccccggggccccaaaccggtcaaccgaccattgaccaccaccacctcggcacctcctccatatacaatggccgaatggcgccgtcccgccttgtctcactccactacacacctccaccgccgctagctttcaaaaaaaaatggacgccaatccgcctcaccggctcaccaccactccagccactgacaggtgagcccccactcgaaaatatctccgtccgatccacccagcgcagtcgcagcggcacacgggcacgtacgcacgcacgcccgccggaatagggaggaaccccgatcccgaccggtccagctatcgccagtccacatgagagtacgtacgccacaggagccatccgggccccggtacgcgcgctacgcatctttcgaacccaaacccccccgcgacgacgccacgccactgccctccagctcactgccagtgctcccccatcactccactctccccccacgtctcgcctcgccgcaacagagaagcttttcagcttactccctgtggcaccctataaaacctcgcgctgcctctcctcgccggcattgtattgtacacacgatggagtggtcgtcgatgcggtggtggtgcctcgccgtggtgctcctcctgtccacgccgctgctcgccgcgggttacctgcaggagaggaagaactacatcgtgcacctcgagccgagggacgaggccgccgccgccgctggcgacgcctccgtcgaggagtggcaccgctcgttcctgccgcaggtggccaagctcgattccgactccgacggcgccgacggaggcccgcgcattgtgtactcctacagcgacgtgttcaccgggttcgccgcgcggctcacggacgaggaggccgaggcggtgagggccacggcggggtgcctcaggctgtaccccgaggagttcctgccgctggcgacgacgcgctcgccggggttccttgggctccacctcgggaacgaggcgttctggagccactcggggtttggccgcggcgtcgtgattgggatcttggacaccgggatcctgcccagccacccgtcgttcggcgacgacggcctccagccgccgcccaagaactggaagggcacgtgtgagttcaaggcgatcgccggcggcggatgcaacaacaagatcatcggcgcccgcgcgttcgggagcgccgcggtgaactcgtcggcgccgccggtggacgacgcggggcacggcacgcacacggccagcacggccgcgggcaacttcgtggagaacgccaatgtccggggcaacgccgacggcacggcctccgggatggcgccgcacgcgcacctcgcgatatacaaggtgtgcacccgcagccgctgctccatcatggacatcatcgccgggctggacgccgccgtgaaggacggcgtcgacgtgctgtcattctccatcggcgcgtcctccggcacgcagttcaactacgaccccatcgccatcgccgggttcaaggccatggagcgtggcatcgtcgtcagctgcgccgcgggcaactccggcccggaccccggcacggtcggcaacggcgcgccgtggatgctcaccgtcgcggccggcaccatggaccgcgcgatacgcaccaccgtgaggctcggtaacggcgacgaattcgacggcgagtcactgttccagccggggaacaactccgccgcgaacccgctcccgctcgtgtaccccggcgcagacggctccgacacaagccgcgactgcagcgtgctccgcgacgccgaggtgaccggcaaggtggtgctctgcgagagcagaggcctgaacggccgcatcgaggccggccagaccgtggcggcgtacggcggcgccggcatcatcgtgatgaacagagcagccgaggggtacaccaccttcgccgacgcgcacgtgctcccggcgtcgcacgtcagcttcgacgccgggaccaaaatcgcggcgtacgtgaactccacggacaacccgacggcgagcatcgcgttcaaggggacggtgattggctcgtccccgtcgccggccgtcaccttcttctcgtcgcgtgggccaagcaaggccagcccgggcatcctgaagccggacatcaccgggcccggcatgaacatcctcgccgcgtgggcgccgagcgagtcgcacacggagttctccgacggcgtcggcctctccttcttcgtcgagtccggcacgtccatgtcgacgcctcacctgagcggcattgccgctctcctcaagagcctccacccggactggtcccccgcggcgatcaagtcggcgatcatgacgacgtcggacgccgtggaccgcaccggcgtccccatcaaggacgagcaataccgccacgccaccttctacgccatgggcgccggctacgtcaacccggcgctcgcgttcgaccccggcctagtctacgacctccacgccgacgactacatcccctacctctgcgggctggggatcggagacgacggcgtgaaggagatagcccaccggccggtcacctgctccgacgtcaagaccatcaccgaggcagagctcaactacccatccctcgtcgtcaacctgctcgcgcagccgatcacggtgaaccggacggtgaccaacgtcgggaagcccagttccgtgtacacggccgtcgtcgacatgcccaaggacgtgtccgtgatcgtgcagccgccgatgcttcggttcacggagctgaaggagatgcagagcttcaccgtgacggtgcggtgggccggccagccgaacgtcgccggcgccgagggcaacctgaagtgggtctcggacgaacacatcgtgaggagccccatcatcatcccagccacggccgcgtagtaattttttgcaacttcagcatgtacagtatgtcagtaaatagctaagatcaataaagatccatcaccttggtttgacctgtgttctgttggtcaagatgtgaagaatgtagcactccttgactagttggccgatcctgtcaactttgacagctactactggagtactactaattaatttccatcttattcatcagaaactatacatcagagattatcattaatagatgagtcaatgctcattcatactctctccgtctaaaaaaaagacaaatctggtttccgtacccaatgtttaacaattataaaaaaaattaaaaaaacaagccacgcacaaaatattaatcatgttttatcatctaataccaataaaaatacgaattataaaaaaatttcatataagacggacagtcaaagttagacacgtaaatttagggtttgcctttttttttttttggacggagggagtattcaaagaaacaggtggttagatgcttcagggagtacagtttgctctgctttgcttacagaagaactgcttttgtttggtagtaggaggacaaacctattgcacatccatttccagcctgttaacaattgttgcgtcttgacgaaaggtcaggctaaacagtagtagtcagcattaaagtatgtacatgtagtaccaaatgtatcatctgctttttgtttgcctttgcacatgccctctgcaaacctgtcttgcgcttgctgtcacgcttactcagtacttagatctgaagttcatgtaccgtaattacgagcagttcccatctaaaattactggtcattgtgctgtattatgctgtactgtaatcttcaaaactgcacatgttcatgccattcactcacctcatgactgtacttttgtgaagacatgaatttttatccgacttcaaaagaaggcaaccgttgtttcaaccaccctactttcaaatgaaaattatcctagttcgtctgcagcaagcaatgccatggtggatcttcattgttcagaagatgggagatgtcactaccgaaacaggaatggcttgcaaacgtgtcagttgagacaatcaaattactgtttctgaaggtaccagagcagtcaatttgctgggacctccaagtcccctgagaccacacaaatattcagagaccacaagaaaaagatcaaagtcttcgggaagaatcaactcacattgatccgtctctgtggtcatgaactgatctgcataactgtgaatggctgatgtaaccagatcctgaatattgcaagtgaaaccaggaggcacgatgaaaacaaatgaccacttctaaaaaaaaaaaacaaatgaccacatcaaactgttgttttttcagcaatgaatttgatgcagtccttgtttttttcagcaatcaaactgcacacggtaaggtttggtcccgtttactttttaaaatgggacaccatcttaatataaaacatcggcaacggtctaactgttcgaaaaaaaaattgatgcagtccttgttttgcaacagaactaatgagaacatcgaacatggtggcctcacaaaagcagcagatatttttccatccgctactattcggatcttcaagaattccagatggagtacatgtctagctgaaagcaagcaacacacatcagcaaaagagattgataaactgaaaaggggaaggatcagattccagatcgtagtacttcctgctactatcctacagtactatcttctacaagcaaggatcatggagaaaagcttgatgaaagcattcaggcaaagcaaccttcggatgctgatgacagatgccaaaatgccatcaattatactgaccggggaccccagatccagcttgccgattcggcggctatcgcaagctatcatcgtgtgcaccgtgcagtgcagacaaattgttccaggtcgcattgatcaacagagggaggtcatcaaaccgagtggaaagggttatcagtggaagggagatcgctcgccgcgcagtcgctgacggctcgccggagattggccggcaccaccgatttgatccgcttcgtgggggagattgggagaagggaaactatatggtttgggttggggctctgaagccatcgtatgtattgggccggtatgctgatgtggctgaaaagtgggcccaatatagtactaaggtttgttgggccgaactaggccgttccgccaccttggcccaatggtactctgtctgactattgcttttgaaaggaagaagtcagtcaggtatggatccttgagtacgatccaagcaaaagatgagaacgagaagattcagatataccaatcgtcctaatcttctgtcattgcagatactactacgcggtttcagtgtatatatatgtgaatccatctgccaaaaacggagacagaatcatagataccagtataataattccacgggattcaattagccatccacagatcgaactcgaaactcgaacgtttgttcctttctgaacccagagagacagcgaatgcgatcgtttcccacccatgagaccacgatcatgtggctgatggcgtgatcaagaaatgagttttgcgcgtgtgcgtggcaaaaacggttggctctggtcagggcgtcaggccgttgggcatcagtgcagcaccctgatctgatcatcagcggattcagaaagtttcagttatcatactgatccgaggaaccttagcggcatggcatggcactcgtgatgcttagcctgtaagaaatggtgagacgtcagctattcaaagatgcattaaaatatttgcccttgtcaatgtataattggtatagtaaccattcaccctatccaataatggggagaaactagcagtttgcacgaaatggtgtctgtgtctctagcagtttttgtgaagaaaaaaaatattctatcaatatggttttggacaatgttccaagctgagattataactttgaatgtttatatatttttattttaaaatgtttaaattggatcaatggaaaccatatatgcatattcgactcgaaaatgtgtattatactagattagttttaaattgttctgcagtaggaattaacggtcaagtagcatcttgaaatcgtattagatgtccaatgtggcatattcttttgatgtcgggaaggaagtagtccaccaaaaagtaaaaattacaattgaaagctcaaaacacatattagactcgagcattgaaaaaaaagccatggagaccttttcgtacgtgacactgaccccacctacggaatgtatgagaaaagacaaaaaaagaagatttacttttttcagtataatatttacactccttccgtttcagttttatatgataagtctttcaacaatttcctagccaaactaagtttataaaaaaaattatcaacatataaaatatcaaattagtttcattgaatatattttgataatatgtttgttttatattgaaattattatgtatttttctataaatttgattaaattttaaaaaaagttgattagataaaaagtcaaacgatttaaaatataaattgaatagagtacattatgagttgcggtctttcaaaaagaaaaagagagagaaaaaataaataatttcctgctaagcaaatactgtccgtcacgaaatctccaatcgcgtcatcagctataccaacgcaacgcgcgttctcctcccccacccccctctccccagtgacgatgacacgtgggccccacacgacgttaggaacgaggcggtccgctcgcggaactataaaccggtcagcgtccgcacggcaccaaccttccttccttgtgcagttgtgcgggttggccggcccgcccgtggatcgtcttccaaccgggcgcgagtcggagtcgcgaccgcgaccgcgacctcacccaccgtttctcgatcgtttctctccctcctcctcccgcgatccggtcttcttcctcctccccgtcgtgctcgccgcccacgactcctcctcctcctccaccaccacccctccacgacgcggcgggcggcgagcgcgcgcctcgtctcaccctcacgcctcccacgccttggaacccaattggagatagaagaggggagcgcgaggtcaaaccaggggaatcggaatcggaatcggaatccgcgacgagacgaccctacccccgcgctccggcgaccgaccggcggcgatggagggcggaaaccacggtgggggagggtacccctacccgccgccgcagcagtatccttacccgtacgggcagtacccataccagtatcctccaccgcagcagcagccgccgccgccctccgcctacctctcgccgtcccgttcgttccacggttacccctccgcgccgccgccgcagccgcagccgcagccgtacgcgcaccattccgccccgctccagccttacccgccgccgccgcagcaccatgcctacccgccgccgcagccgcatccgccctcgccgtacgtctacgacccttaccacgcgcccgccgcggcgtacccttcctacccgagccccaaccccagcccgtccatctccccgagctccagcttccaccaccaccctgaaccgccatcgccatcgccctccgcgccgtcgtacccctccattgcggatgggctcgccaacatgcacgtctccgaccgccacgactacccgccgccgccgtcgccggcggccgtgcccgcggcgtcgtccccctccgtgctcccgccttccgcgtcgttccccggcggcgggagcagccacggcggtggcgggatgcagatggtgccgtacggccctcctgccggagggtcgcagcacggtgggatgcagatggtggcgtacggctcgccggccggagggtcgcagcacggcagcgtgaggccatccctgaaggtggtgctgctccacggcaccctcgacgtctgggtgtacgacgctcggaacctcccgaacaaggatctcttctccaagagggtcggcgacctcctcggtccgcgcctcatcggcgccgtcggcagcaaaatgtccagcgccaacatgaccagcgacccctatgttaccatccaggtctcctatgccaccgtcgcgcgcacctacgtcgttcccaacaatgagaaccccgtttggacgcagaatttccttgtccctgttgggcatgatgccgccgaggtcgagttcgttgtcaaggacaatgatgtcttcggtgctcagctcataggcacagtgtcgattcctgctgagaagctcctttttggagaaaggattaacggcatctacgatgtgcttgagtccaatgggaagccatgcgctcaaggtgctgtgttgcggctgtccatacagtacatcccggtggctcagctcaaaatgtatcaccatggtgtcattgccggcccagatagcctgggagttcctaatacttacttcccgatgcggcgtggcaatagagtgacactgtatcaggacgcacatgtgcctgatggttgtctcccggatttctgtcttgatcacggaatgcgctatcagcacgggcagtgttggcgtgatatctacgatgctatatgccaagcacggcggttgatttacattgtgggatggtcagtgttccacacaatccacctcatcagggaaggagttgagaagatgccatcacttggggaactgttgaagatgaagtcacaggaaggggtgagggtgttgcttcttgtgtgggacgatccaacatcaaggagtattcttggaattaagacggtatgagttattcattgagttcaaaattgctttgttcatgacttttacaccgcacacgagaacatgattttgtgtccaaactccaaactgcaaatttataaattgaagtgctgcaatgtttatggaaaaattgggaaacattggcacttgaagattgtctaatcctcaatacacaaatacaaaaaggcatcagaaagggcatttttacaactgctgttatcacattaaagaatttacaaaacatccggttgcatcaatataacattgagaggatcttcatcaagctcatctatttcctccaaatttttctgtaatagtttggtagcttgtcctttaggtgcatgtaccttatctttggtcccatgtttcatgatgctggaaagtttgaagtagattatgctgcttatccacttgtaggatggtttcatgggcacacgagatgaggagacccgcagatttttcaagcactcttcagttcaagtattgctttgcccacgatctgctgggaaacggcacagctgggtgaaacagcaggtattgtgatgccacacaaacttatccattatgatattccatttttgtttgtcacctaaattactacaattgattgcaccaagtgagtggtttcaaactttttatatgtctactcttcatgcttggaagttatgctgtacttcacaatcgctgttccttatacctgatcaggaagagaaatttgatattcacataatgcacacatatatttgttgttggattcttttgtataatggcatttatcaagcaatcttgtattgtattaattcttttagtaccatgtatttatcatatgatggtattgaaattcaggaaacaggaaccatttttactcatcatcagaaaacagttattttggatgctgatgctggcaatcataagaggaaaataattgcttttgttggtggcctcgatttatgcggtgggcgatatgatacacctagccatcctctatttaggtctcttcagactgtgcacaaggaggattattacaatccaaattttgctgtaagtgtttgattcctttaacatatacttgtatcttgatgtggtttctgatgtaaagctacaattaacttcttgcttttgagatgatgatagtaagaaacgtatctaatatttagttcctaaccatggaatatctttcgacagaaagctgttccatctttctcttatctttggttcctgaaagtttctttctctctctgcttttttttttctgcagacagttgatgctcgtggcccaagggaaccatggcaccacttgcattccaagattgatggtccagcggcatatgatgttttgcaaaattttcaggagcgttggttaaaggcatccaaacgccatgggattaaaaagttaggaaaatcatatgatgatgccctcctcagtattgaaagaatacctgattttataagcattaatgacgcaatatattttagtgacaatgatccagagacgtggcatgttcaggtatttatagtatcttgtagtcagtgtgtgtaagtttttccttgttttaactttctacttaaactttatttgctttgaaacctaggtgtttcgttctattgattcaaattctgccaaaggatttccaaaggatccacgggaagcaacccgcaaggtaattgagtactgtttgcatgtactaatattatattcattattatgtgcttttcgctaacaccttgctttgcctagcagaatcttgtttgtgggaagaatgtactgattgatatgagcatacatactgcatatgtcaatgctattcgtggagcgcagcacttcatttatattgagaaccagtatttcattggatcttcgtttaattgggattcaaacaaagatattggtaagcatatggtgtaaagttatttttttaattaatgtgcacccaccaataaaaaaaatccagaaacaaaatacagtgcacattacattttcttgatttgcaaaccatttcagcaattcagaacacagcaaatcccttatctgatcctaaattggtattcaaattgtgagttttcaggggctaataatttaataccaatcgaaattgctctcaaaattgcaaacaagataaaggcaaaagagagattctctgcatatatagtaattcccatgtggcctgagggtaatccaacaggtgctcctacacaaagaattctttactggcaggttagatcaacatgtctgctttgtgtcttgtttaatgtttatatagattatacccagttagttcatttgacatgatcgcatgttttttttgttgctcctgtagcacaagacaatgcaaatgatgt

SEQ ID NO: 62077 - DNA, 8480 bp, Oryza sativa
cttgttctctgatcctacatggaggccaaatatccaagccactttagtttctttatcagatgatacatggaaattctggttttgtacacttgtgccttttatttagaagaaaacattcgatcggttagaatgatttggctcaattgtctagatgttctacaataatgtttcatcttgttggagcactgtgtatagtatttaacttttgatttatcaaaattacaggatatattaatatgtatgatatgcttgctagcaatctcgctgaactttgttatttttttaacatctgacttgcatgaaaactgcctgcatgcaacctcgttcatttattctacatttactacccaggaacaagctaggaaacatagaagattcatggtatatgtacattcaaaaggcatgattgtggatgatgaatatgtgataattggatcagctaatatcaatcagaggtccatggaaggtatcagagatactgagattgcgatgggtgcgtatcagccacagtatacatgggcaagtaaggtttctgcaccccgtggacaggtaacaacacttcatgcctgtatggctgtatcacatttctggagatctacagagaaccgagctggcatcatatgctcatatattaaacattgcgccttcagtgattgtacatttgcaactcgtttgctttacactgttattgtctgttgttcagcactactgcatcaatccagccatatatatttgttgcaattatcttttgttttggcagagtaacctaaagggaaattcgtaccctatcaatcatatttttttagataaggctaaaaaaagctaccactcactcttaagaatatgttaattggaagaaaaaaagagaagctaccattcattctcaagaatatgttaattgaagaaaaagagagctatctacaccatccatcatggtgggaccagattgtagctacaaatgtatggaaaatacaaatgtatttgtagaaatagagaaaaagttgcatatcaagtacagtcatatttcaaatagccctgtacaactgtgaaggaatctcgactagttgtctcttggtttgagggatatacctattttaggatgactgatatttctagaaccacactctaattcaaatctgctgatttcatgtgtagatttatgggtacagaatgtctctttgggcggagcatattggagtggttgaggaaggcttcaactatccagagaccatggaatgcatgagacgagttcgccaaatcggtgaacagaactgggaacgatttgttgataatgaggtgactgagatgagaggccacctaatgaagtaccctgtaagtgttgaccgtaagggcaaggtgaaacccttgccaggatgtacgtcattcccagacatgggtggtaacatctgtggatcattccgagccatccaagaaaacctcacaatatgaatttcgattatctgtaagtatacaattgctagtgattctgagctattctgcttcctgaggttatagatagcgtgaaaattttgctagcaatataggttgaaaccaagtaggacatgacaagaaaaggttattaccctgcattttttatgcctttcttaagagaattcaacatttccatcttaataggttttctttttatgtatactttttatcaatgtatagaagattaagaatgtttgaaagcccggaaccctctgtttagggaacatggctttggtagcaactttgattgatttaagtatgtagcgacatgtaaagccattaaaataagtttctagtgtaattattttcagccttgatttgctggttccattttctaagtgtcaatgaaatctaatccatttatttcttcgtcatgcccttggtaacataagtttccgctttgtttttgcaatgcttcttcaaggttacataatcaacaagcagatactgaacctatgtctagagaagagtaaaaattaagtgggtgcaaataaaatctactctaaactctaaagacagttgaacattttcttttccttgaattacatgcatttttttgctcctgaaacgaaattatcttttgttcatcatttcttccatctctcggactgaatcttcacacccatatacctgcccagtgtccatattgaaaactatactgttagtgtgttgttactcatggcaatgcactttcatgagctaaaatgatgccagttacctgccgagcatcatgacggtggcctgagggttggtgccgggggagtacttgaaggtggagctgtcgatcaccctgagcccctgcaccccgaacacccggtaatcgtcgtcgacgacggcgccgacatggcagccgccgtggtagtgccagatggtcatgacggtgtccatgcagtactgctccggcgagcgcgagtcgttgacatggcgcggcagcaggttgacggggaagttggcggaatcggtgaagatggactcgacggaggcgttggcgtaggtgaagttggagaaggcccgcgactggatcacccgctcgatcgtctcgatgccatggacgcaccgctccagatcctctgcctcgcggaagtagttgaacgtcaccgacgggttcgccctcgggtcggtggttcgcagctcgacgtggccggaggacaccggcccgaggatcttctccaggatgaagcctccccggaacgccctcctgtccagccgcatcatcgcctccgccgcccgctgcagcgcctccggcgtcctctgcttcggcggcagcgtgccgagctgccccgtctgcggcgacagcatcccgaagctgcgcgcccaccggagcgcgccgtccgacaccggcatgccgaactccgacccgctcaccccctcgatgaagctgccggagcgggtgatgccgacgacctgcaccagggagagctccaccggcaccggcgacgggatgaacaccgagttcatcgggttgtcggcgacgccctgcccgaccatgggttggtccacgatcacctcgatgccgtgcgcctccaggtgcgcctgcggcccgacgccgctcagcatcagcagctgcgggctccccagcgtccccgccgacacgatcacctcgttcttgtcgccgtcgcggaggtacacccggtgctgcacccccagcgggtccgagaacaccaccccgtacgccaccgggtacggcaccccgtctgcacgccatggcaaaagctcgccgtcgtgaggtcaagcttcttcggcgcacagcacattttccattttcatcgtagctgtgtaccttggcttttgaagaggatacgggagacggtggcgtaaaggaggacggtgaggccgcgggggcgggcgtggcggaggaagtcggcggcggtgtggcgctggccggagttgtcgaagatggtgccgccgatcttggtgccggtgacgtggtcgaaggtgaagccgttgtcgggcgtgacgccgacctcgagcagcgcgtcgcggagcgccgcctgccacggcggcacgtcggggcggaacaccagcgagcgctccacccaccggtacgacgagttcaccagccgcgcgtcccacccggaggcgcgcacgtactcgttgctcgcccgcgtgtagaacccggcgttgaggcagctcccgccgccgagcacccgcgcccgggcgttcaccacgccgtcctccgagatgaaccgctgcgccggcgacgccggcgacgtgtcggccagcgcgtccgtgaagtgctgctcgctcgacatgttggcgtacggcaggccgccgcgctccagcagcagcacgcgcgagtgctccgacagcgtcgccgccagcgggcaccccgccgtgccgccgccgatgacgatgtagttgtagctcgacaccagcggcgcgtcctgcgcgtgccgcacgaaccgcaggttctccagttgctctgcacaacgccatcgcacgccatgaacacgacgacgacgcaacacgcatcaacgcaaagatacaacgcaacgtttacgcaccttgctcttccgagagcgcggcgaggcagagcgagaggagcacggcggcggcggcggcaagcaccggcgccgacgagctcgcgcggccaagtgctgccattttcgccgggcaaattcgctaactttcacattcccctgggacgaaacgttcggtctgtttatatatccggagttagctcaatggtagatcaagagtagatgtcttgaataatcttgcagattgctttgcactgcaaagaagatcttcgagcagctttgtaaattgtggagccctgagaagaatataacatgcatgcagaagtgatgagctgatgaaacattgatcaatgatctgatgtggttgtgagcaagcaagcaggagagtttacttgccaatcttgcgattgtttcgaacgtgctttgatatttttgccattttaaaatcataatttagtcgttgctgagttatttttctgttacgagacagtcggggcaggctggatttcaatggtttcttcttgatttattaagtcgtaaaagaagcgtaattttaatgagttgggtcagctcttgggcaagattatgacggtgcttaccatgtatgcatctcaactaaatctgataaagccccattgaaacggtccatttgtacaaaaaaatattaaaatattaggtgatttaattttagagtaaattttactatagacgaacttttattagcgatgtttatcaatgttctcactttataccggttattattcttacccatcctcaactcttttatccatatataacttgtcatataccgatgaatggttttacatatatatgtgagagtttattgatgagtaggagccaatgtaatcgagattgttcatgctcgagaagagagatgggtggtatgtggtccaaagtgaagcatctgtaacaaaaggtggtccaaatgaatttgctcttaactttaaattaacttcttggcccattgcagttgtattgcccaatggtaaagttgtaagttttaagacggttggtttctttttttgtgttttactcctcctccttctttcttcgtcttcggattgctatacgccagtctagtaaaaaaaatatccatttccctaaaccacattcgattgaaaattaagaggaaaatcttacaaatatctaacctttatatctacctcacaatttctgctctctgcctctccaacaatgttgattatgtccagagacattgacagtggtctgaccagttagagagagcataggttcctccgcttagagtgaggctaaggagatagcggcctgatggtggacggtggcattgggaaggcaacgagatgacagtgacgccgtcgtagctacgaggacaatggatagtggttatggcgagagaatcccgatcatgtaattaggtgatggtgagttgctcgagacggaagatgagaatagggtcaggcacctcgctagattggttaggtggtggtggtcatgaattcagcgacaagaccattagagacgaggaagacaacagcgtaaggacataagaaatggtgatggcacatgagaagccatctcaaggaggatgatggcaatagggatggcgatggaggtgcttgtcggcgagcatcaccagcgttgagggagatgccattgaggctaaatggtggtggtgcagagggcatgattggttcagcgtagcacagggtgaggttaggaggagcgatgtggaagtggtggctagggcttgactatttgtttgtattggagggtggagataaaatgtagattttagatgacagatcttgcgattgagaatttgaaaaatctggtgggggattttcttactaatattacttggggttatttggttagttgcttcactttgtaatgccacattttgattatggcgtagttttctaggtaaatgtttgcttcgcccccacacctttttagccttaggacatagtatatgttatactactacctccgtttcaaaatatattttagtccaatttatagtattgggctgagtttagtgtcatagaaaatagggggagaatttactatttgcaactaccaaaatgatagcactcaaataccactctcctaaattttcattcccaaatgccatccgaacgcacatgtcagcctcacttttcattcaaacataagtggtgaggtccgggtgacatttaggaatgaatatttgggagagtggcatttgagcactagtattttggtagagtgacaaatggtaaattcttcaattgaaagcttaactatattacacttaactatttcttagccgcacttttatcaacacgccacaattacggcaagcttgcttacgcatctaacaaacatcagtctcagttttttcttttaccaaccactgcatcagttcacttcaggtaaccaactgacaactagcctctagtataacggaatgaacaaagcacacacacaccaggcaaggttgcctgcctaactactaccactacactactagccacttactagccagtagccactcgcagcgtcctctgttccagtacgtgtggttctggttcatcatcgtcaaacgaagcaaacgacgacgaaacaaactcccggatacggcgcccttctttggtcagaatctttcaaacttcaaagcaagaaaaaacacaaacaaacaagaaccatctctgcattccgccatacattcgcgtcgatcggtgtccactgtacaggttgatcgatctctcgatcgatcagagatagatcaacgcgttgatcgatcagcaagttcagttcagttgcggcggccggggcgcggcgtgatcttgatgacgaggccggggaagacgtcgtcggggtcgtggacgtgcgggttctgctccaggatgtacgggtcgccgcacctgtcgctgatgctgtgcagcgtctccccttcctccaccacgtatatctcctcgcacggccgcgccgccgccagccgcgccccgcgcaccaccaccacctcctcctccttctccaccgaccccaccagcagcagcgccaccacgcccagcgccaagcaccacgccaccgcctccgccgacgccctcctcctcctcctactctctcccgccattgccatgcagctagttgttcttgcctcttctctgctttggttttggttggtgcttgagtagccgggtagagagtaggggtggtttatatagggtgagacatggaagcaggtgagattcagagagatggctccggtgttagcacttggcatgggggagaggatcaactggagaaatggatgctgatgtgttgctgtgtgctataagtgctcactgatgagtgctgaggcctgacagaaattgtattttttttcttctttgacatttttaaaacctgatgaatagttgatgatttctggtgcagagaattgattggtgagttatgggttcagcgtatctgttgctgccatcttgttatatactactagaagtatcttaatttttatacgtacaggtgtattcaggaatcaggatagtatctttcatcggttcaaattatccagaaaaagtatctatcatggtccacaagtaaacatatgcatcatttgacatacacaggacaagggcataaaaacatggcattaggtaattgaattacctggctcacgtgcaataatccgcatttgtgatctggtgattacctttacctttggaaagatctttaaacgtgtaacagcggaagacagagcagcagcagtacactgcaccagtacagacacctcacaacgacaaccgattcaacgaagcgcacacatgctcccgattggttgcgagtgcgtcgacggaaagcgccgcaacgcgcacacacacagacgcaacagcaacgcaatcacgcaacgtgattccatgtcatccaaacattcgtgaacctaaactcgttgtcgtcgaggagaaaaagcccttgaagatggtagtttatctcaacaggcaggagcagaattggcacgatcgatgcccaaaaagtcctacaaagcagcttcttttttgtgagctggtgctgtcctttgtggccatggaaacaagggcgacgtagtggtgtgattttgttattgctcacggtcactagcccgccttctaaatcttcgcgtttgggatcatgtgaacatccgtgagctggacgacgaactagtttactgccacttttgtacccatcggacgaaaaaattactacaattggcagtaagttgttgcctccgtctcagctccaaacccagataattctgaaaaacacctaattagcaattttctctgaaaagcttgctttttgattcattttatagatttcataactataattttctatatttaaaatgaaaaactaaatcattgaaagagtttctgattctgaaaaaaaaattacagctgcctgaagctcccaggcctaaactccaagcagcacggtgcgcccgtcagatcgccagtaaaatcctgtgacgccgtgcaccgcaca

SEQ ID NO: 62078 - DNA, 15231 bp, Oryza sativa
cgacgacgaccccggggcggcggccggcaaagtcgtttcatccatgcatgcggatgatggaatgtatcgatcgatatttgcgcttttgatctgcacgatcgatggaggagtacgtgcgtgcgtagagcagataaataacagactataaaccaactataaacacattttgatttcgagtaaataaaaaaaaaaagaagagcagcgggctatatatttatagtcagctgtagcacgaattctaagatacaagtgcgtataacatgtgagattagatattaattgtgtagaatatgtttataggtaaatattatataaattgactattaagttaattataaatgatttaaagtcagcagttggctatactattaaactcgtacgcacgcaacgcatatgcttgggcggctttcggaattcggaaatcggaatcgcttttgcacttttttgccagtgtatgaacgttccgcgcgcgggtgatcgatagatgttgctgtcgtgcaccatttgctctccatgcagcgtgaaaatggaaaggaaaggatgggggagggtgatgactgatgagaggggggagatagtgggttaggccggaggcacgtacaacgcctatgtatgattcttttaattatgtcatatatgatatcttttgtcatttgtcaccttttgtatcatatcatacaacgcatggtcgattgttagtcagggtgtatgtatccctctctgtcttcctatatcttccttttcgcgaatgggaaatttctgatgagaaaagggaagaggtatggtttggtgtgtaatgtttgctgacaccgttgacatagtgacggtatggtacagcacggagcttaaaacgcaatttattcaccatagtacatggcctacaataatttcgacttatataaaaatgtcattatatatctaaatatcattcaacgaaaggtcattatctaaaaaagatctttcaacgaaaaatggagtaaaaaaatttagacggaatatggagtaaaaaaagtacactaggaaagttaattacaaaaccatattggtgttaattagaatataatctctctctgtcccaaaataagtgtagttttacattattcatgtgtaatatttgaccattaatcttatttaaaattttttattagtattatttttgttgttgttagatgataaaacatgaatggtactttatgtgattaattttttttatttttttaataagacggacgatcaaatgttggacatggatacccacgcctacatttttttaaggatgaatgtagtaactataatataattacaatataggtacattgtacctttaatataagtcaagataaacaatcaacacgtctggttgctcagttggtaagccttctctttgaaacacactttactctttttcttcttagaggcagtagcatatggatctcaaacacattgtgacatttttttaataaaaaaacagtaaactgcacgaccaagccctagacttgctcactcgtattatataggtcctaaactcttcaaatacatttctacatcatgaacttggtaattaaaatgtgacattagatcctaagttgccacggcacctgcgggatcttatgtggtgacatgatcatgacatgccacatggccattgcctctttctcctttttttcctttttcttcctctttcttccgttctttcattcatgtttcatatatggtggaaaagaaaaagatgaaaaaaaggaaaaggtagagaagaaaaaaaataaaaaggaaaatttgttattgtaatgttcatgtggcatgtcacgtaggatccctgagatattgttgtaattatagattagaatgacacactttaatattttcgaatattaaaaaaaatactttaagagttaaggatctgagtaacatggatgaatagatttatggatcaaccatgtaatttactcgtaaaataatataggggtagaattatagcgaatccgtttgactttatagatagcaacatactccatcagtctcgtaaaaatcaatttaggattaaacaagatatatctttttactttttatactaggatatgccctatgttggtttctatgaggcggagtacgtacaccgttccgctggccggtaggcaaaacgcgcgtgacacaagcaagtggtactctaactttctgtactggcaacgggtatggtttgggccagcggtcagcctagtgtgtgatcgtgctgggcttgtagcgtttaacatttcattcagggccaggttggcaaactacaatgacccggaggcccacatgaacacaacggagggggcgtatcagagaagaaggccgagacacaccatttattttgggtgggctgcatcaggcattcatcagaattgcagcctctaaaaacaagaattccaagtgaatagcacaatatcttcttctcgaacagaaaagtgaattatatattgtgccttctcaaccgtttccctgtgacgacgtactaaaaccaaatggaaatgtcaagtgcaataattagggactatacagtacggagacacgcatacggcttccaaaaaacttccaaactcttaagtcagagagctgacaaatttgccttcgggacccattgatcactagtgagcattaaatttcatttctataacaatagtatcttgtaattttttcaattgatccctcaagtactcctccactactaactacttactaaggtgcattagacaatcgcgacaaaacattcctttaatcaactttccctttctttctcaacatagttaatgttatcaagttcgaatgctaaaactaccaatgatgcatctttactggaaaaatttagataaaactctagaataaaaggtgacctgatgggtctgctgacgttgatctgttacatgaacataaacttatccaattatctcagttcaatgtcagcaattaagtgacacatgacccaatcattttcatcaaccgatctaccaccactactactaccaccttcgcaataacggcaatgacaccccggctagatcgatcggacggcgggcgacaacttggtggtgcacatagggcgcaacagtcgccgtccgatctgatatataggtaaccagtgtcaaaacttttggctaaagtagcagtagtagtagatcatggccaatggggccaattgccaaccaatctgatgattctgtactttggtagtcttggctccttctatatttttaagagagagatgaaatggatgtttcgcggctattctgtgagttctaaaattcaatgagggggaggggggattctacacgattgagatagagatgggaaatggatgtttagcatctattcctttgagttctagaagcatgtatttttgaactgatgtttaggattaacttttctttatcttacaaatgtactatgagccttcattggcttgaatgttgtatcataaagtacaaaccatgaactcagcgtactatcatcaatcaataatgaacctggctgatttctcagcttgccaataacccattgaattattgagaatggttgaatatagtgtttcgtcaacaaatacgctgtcctagttaggcttgcctaaattctctacattttctagccatcctatcctggttgtctgccctatgaaaccactctctacagtattggattcttcacaagaacaggcttgggtcaagaacagactcgatagaaatcataattttcaagtcaaaaaagaatagtaaaattcataaaaccacatattctctagcagaactactacgcaactacagatttaacataaatttatcatgcaattacatatttttatagaggaatatgacaaatttgccaattatgacaaaacaacataagttagagtttagattctttaacactatggttttgctgaacctaataaacaatataggtttgtgataaatttttttattaaatatgtagttttacagtactatgtagttctataaaaaaagttgaaaactaaacatatagttctgcgatacaccacttaagatgtagttttgcctgtcgcaatagtttggctaaaatacatgtacttttacataatttacccaaaacaaaaaattaagtgtagtactacaaccgtacaagcgaatgatccaattcaagcaaattggggtgcttttctgcttgtttccccccaactctccagtctccacacaaaataatgcccctgatcgttttgtttatctttaggccttttagcagctcaccctcctcacctcccacgagcctcctcgcggcgcacaaaaacaaacccagacacacaaacaggcgcacacatccccatagcccccaaaaaccaaacaaaagaggagcaaaaaaagaagagaagaagagaaaaaaaaaatcccacgccgcgttggctcgcgatcccctcctcccccctcccctgtcgatttgctccccggtggtggccgcccacgacgaacccccgcgccgcgcgcgattcgatcgctccttccggattctgctcccggactcggatctcctcctcctcgtcgagctcctcccgccactgcccgtgtaggtctacctgagtttggggggcggagggggggaggggagggggaggtgatggggattggccgggcgcgctgggtggcgctgcttgtcggcctcgcggcagcggccgtggtggcgacgttgggtgcgtccgagggcgacgccgatccgctctacaggtatgtagggctcgtgactccgtggattctttgtccagtgttgcgacatctcttcaaagatttggtgatttggcgaggcttgtgggggtgtgtgtgtgttttacgtttggttcgaggagctgattgcgtgtgcaatggaatcagcgagggtgtgtggcggtagtcgttcttaggcatttgctcgaacacctggtgctcgttggctgtagagcgcaagatttggtttggcctcaaagcatgattcgcccccctgaatactggtattttggtcattgatttcttatgaagagattgcaccaaggaagctaaactttttagaagtaactcccaatgtgtgtgtgctcttttgattatctaacctatatccatgatcatgcgtgagaaacaaagctttgtagggtatttcatgaccaaagctgggagatgtgacctcctgatgaagtcctgtgatttatacatacaaccttagtatttgaatccgtacataaaaaaactgtttagttctctgttctataaacatgttgggatgttgaaggttgaactgatgagcaatgacaagctaactgcctgatttgtccccaacttgtacagagcctgtgttgacgaatgcgaaaagacgggttccctccgagagacctccgtgaggcactgccaagttccaactgatgaccatcctgctgataaatcatggtacgcacatgaaccattgtacttgcagtggaaagaatggaactgcaagagtgaatgcagataccactgtatgatggagagggaaagtgaaagggagcaacttggattagggtcagttaagtatcatggcaaatggcctatgaagcgtgcatctgtgtttcaggtaatcaatcaatcatgtactaattaattgcttagcttttttataaacttgatctgtctaggcattcctttttcagttctaccttgtgtccttcacctatcactaattgcttttttttttcccttcttgcaggagcctatttctgctgctctttccgcgctctctctccttgtacaatttaatgggtggctatcttttttcctcctgctttcttacaagctgcctcttaggcctgaaactcaaatgacatactatgaatacactggcctatggcacatttatggtcttctggccatgaatgcatggttttggcgtgccatctatcacagttggtaagcccaatacattgatgaaaagtatgattccagtatatgtgtttgatcataattagttgaacttgattcttccattgcttgcagtgatacagtttggacagaaaagttgtattattcatcatttgctgcttttattgggtactcccttatcttggcaatattgcgaactctaaatctgaaggatgaagcttccagagtgatggtggcagctccaattctggcattcacaacaactcatattttgtatctcaatttctatgaacttgataaaggtaaattttagctggacatgatattgaacttttgaaaccattttacttattataggtttttcatgatgaatgcatcattcctgagtcatgacttcctgcagataattgaaatactgtcttgccaatcgatctgtatattttgtagtagtgactagtattgcttgtaaaacttaagcagtagtgaagttctgagtaggtatcatgttgctctatttaaacctgttactgtactaatgtcgaacctgcactctacatttctacactcagattatgtaataaactattgaggatctacctaactgttagaaaatatttgtgtgtcaatatttcagtaggtatgtgttaaaatgatattgcgtaaccttttagaaagtttacatctatgtatgctgatggttccttttttttttcttttcttttgcaggcctaaacacaaaggtttgcactgctgctagccttgctcagttcctcctatgggcagtatgggctgtcatgacaaaacatccttcatgttttaagatcttgtttgtcattattggaaacgtattctcaatagtcttggaaacctatgacataccaccacgttggggatatgttgatggccgtgtattttgtgttgctatttctattcccctcacatatctctggtggaaatttgccaaggaagacgctgagatgcgcacttcaacaatcatcaagaaaacaaggtagtgttcagcacaagtgaatagcacaaggatttgagcctatgtgaaatcttatgctcgagattcagtcttaccttgtaaaaatttgatcgttcatgttctttctaggcagcttgtgaattatgtttttttccatccctttttgcctcagctcagaggtttagggttaatgcttagggtgtgactagtcactttatattcattttcttgtaatcccgacagtgtaacacggtatgcttgtagctgtggtaatgtaacagaggaacgtagattcgaagctttctgaatgtatcattgtgatctgtggcataataataattctggttcatgaaagcatgtgatgcttgtgctttgttggtccctactttgcttttttctctttttccttggggatgttgttcatatctctgtcacccaagagaacatttcatgaatgccttttcccctttacacccgacacgatgaagactgctgaaaagagaatttcgttacccgggttaagtgcagtctaattggccttaggttgatgacctgtagagtgtacatttacatccaaacagaacagtaatcttcttgtttccattgccactctgacaaaactatatacagatgcatctgctttattccactgcccctaactcactacccccctatatcaaccttcactgaatctgttctatctcacgtttacattacactcgatttgacaactttgacatccaaacaaagaactacttcggcaacgcaatcaggtcactcaccagctcgtgcaacagctcgtccatcgccatggccgccaccaccacgccggcctcgcgctcctcctcgccggcgtgcatccaccgccggctccgctccatctccgccatgacatcctcgccgtggtacagcacgtcgttcaacgtccacggtgttcccgtgccctcaagccaggccttggcaagtctcatcgtttcgccgttctctcgccgtctcctctctcgtaacagactggtcggtgcatgcaactcaatatttctggagctgcacttcgcctcgacgaagaagtcgaggaggagcctctcggtgacgtcatccaccacgccgaccgacacggtgtccgccagtaggtctaggaggctgtcctcgtcgtcgtcgggatctttttgggagacgccgtcgttccgatgatcgtcgtgtcgtggcggcgccgccgctacgtcgtcggtaatgcactggtgctgtactgggacgatgccggcaaggcggtcggactccgaggcggcgaagcgtgcctcgagatccacgccgctgagctccgccatgctcccgagccgtcggatcttgggctgcagttgcatctttctccctgatccacggtaaacggtaaaaatatactaatgagttatacttcaagtaagtcgtaggaggctagaagcagcaagtacttgttgaccccatacaatttttaatatagagtttgtatatacaaatataaaaaggtaaaagggatagagttactagtagctagtaactttacttaagcatagagttcttttacatggcttagggatagagtttagtagcagaaattatttattttgagaactattagaaagtatttaaaacctcatttcaaaaagaaagaaagtgtttaaaacatttagggcttgttcggatcgtaggataggaattcagctcacatggaaaatagatgatcgaaaacatagaaatacaggagatagaatcgttcggagtaaaagattatgatgtgacatgcactctatttattaggaattttttcaagaaatctcacctcacctcatactaagaatcttatgaaattagcttgtaagattacaatccttaggaattttgtgggatccattcttatgaaatgaatgatgcatatagaaaaaaaatccaaggaatttaattcctacaatcatcttatgaaaaacctctaaatcgaatgagcccttagtgaatagtatttcccaaaaataatgtggaaaccctataatcctaacaagcccttaattaaccaatcccaaatccagtaaatttcgagagtcaaatatgctcaatcaaccaagataaaaaaaaaagctgagaaaaccactggcctagtatgtgccttttgtggccatctccgacagtcactggtcgggtgggcccagtaggatctttacacgatccgggatttccgcctttcccgggggcccgtatgaacagtacaaaaatcggaacatcttcttttgtccatgccccgtttcgtgtccgagcaagagacagaaacagagcagattccggttcggcactagcactaggcgacgaacacctcggacccgtcccgacccatctcatctgaagatttgacaccattgtgtagactacacaacactactatcacacagttaactcgacacgttatgcattttatagtacgtaattgtcctttggttttaggataaactttggtttgtgacagattcttcagaaaaaggatgagtgtacgtgttcagttcaatcagtttgcttactctggagctgggcgaggctgtcgctgaaagagaacgagcacgcgccggcggcgaccctctcgtcctcgtcgacggcggcggcgtcgtcgtcgtcttcgtcgaaggggaagtccatgacgcccaccggactgagctgctccttgtcgtcagcctcctcctcctcatcctcctccttggatcccctcttcatcacctgcatcacaccgtacaccagcaatcatccaccaattttgtctcaaccacacaaccccattttgtcatctcgtccatttctaatccacgacctttcgccacggcagcgtcagtccaagcgacgcgtctgtagcggcgtacggcacgacacatcgtccggctttcccggacgtcggctatagtgctaagctaacttgtcgtttcagcgataacgatgctactatcagcgctgaaacgacgagttggtttaattttagttggggcattaaaccatgtggccgtcgtgtgcacatgcagagagcggaagctacgcgaggtgagggtagagcgtgccatgcacaggacactggccccgctgcatcatgcttccggacaagcccgcactaactgtgcaacggcccgctttgcatttacgctttgcaaccactgccccttctggtccactgagccacagagctactgctcatgcatgcacagcaccagcgagccaaccacaccacagaggcctctaatctctacgaataattaattagtggtatcatctgcaatgctacttctatccttgctgatcaatggccgtaaaatcagtagccaggtacaaccctactgattgatcgatcaatgcatggatggacaggtcatttcgaccgatctcgatcgatcaatcaccacaattggagcagcagctagcacagggcagtagtagtactacgtattatcgcacatggtacacgaattactactgtactactctacaccctgtgtacataggtccatgtttggctgtatacgctcatcaatgcaggagtcagtagctagggctcccctttggatactcgtaacatgaacaagtcaggagattatccgaacaatcgagcaatccatgtgttggtgaataatggatcgctgctaccgaatgaatgtgcttcggttgtggcatttaatcgccgtgggtggggtctccgcttcgatcgttaattggtggctaatcccacttcgccctggagtttacgcaaattttggggcactaatgcaactaaacccaagctaccagcagctgaattaacgcccaattattgattcctcatcaaggttagtgagtgagtgagtgagtgattgagtaggagagaagtgaggttgatggaatggttgattacctcgtggtcggctccggtggtggagggctcgccggcggcgtggaggctgtcgtcggagctggctgacgagatttctgagtagtcggagtgggagcgcgacttcctcccgcctgtggaattgctggactcggacgtctcggagtcggagctggagctgcagcagctggccacggcgggggcggtggagctcgccgtcgccggcggcgccgcggcggcggcggcggcttcctcgtcttcttcctcgcgccgcctccagaagcctcccctgagccgccgggacaggctcttcgagaggctggacagcttgggccgccgcattgcggacgacgaccggtcggcgacgaggcggtgccgcattggcggcgccgccgcctcagccgcgccgccggcgacgcagaggcggcgagggtagcagcggaagccagcggcgctgcaggactcgcagtccagctccaggaggtccttgagcctcagcggcttactccctcccgccattgccgccatcccagactcggatccgatgacagaacgagcaatgcaatgcaatgcaacgcagagacggagacgcgagaggtagcaagcgcgcggtagcttctccgggcgagtaaagaaatgtgcgtggggtttttgatgtttttggagcttgtttggatcgacgcgagagcacgtacaggtgagctgcgggttgtcggttgggagatgcagcgagcagcgggcagcgacggtggtggcggtgggcggagcggctgagctggggagagtgggagaaggaggaggagagagatcgcctgctaaatacacgctcggctcagcgcggcggatttggtttgccccgaggccgaggttatcgtggcgtttctacctgctactagtactcactccatgggaggcgcggtggctacgatgtaggagtacgagctataggagtttttatggtttggtcgctgcctagctttgtgaccaaacgggagtaggagtagcttggaatgacgaaaccggagtgagctttgtgaccaaattaaagcagtaatccctcagtttcatattataataagagcccctttgattcgaggataggaaaaatacaagacgtgaaatagtatgtttctcaaatcctacaggaatcaacaggaaagataataggagctatttgatcgtgctatgagaaaaacaaaggaaagttcacgctattttttctatgaaatgtgaagcatatgaatacaatcctatagaacttttgtttcttttctatgaatcaaagcaacatgtaggaaacaaatctataggaatttgaatcctataaaaatcgtttgccaattatatgaatcaaaggttcctaaatcgttttgattttttgttaaacttttttggtttgatcaagtttattgaaatatataataacatttttacacaaaataaatatattatcaaaatatacttagtgttatattaactaattcaatattatatatgttgctaatttttttataaatttagttaaacataaacaatattttttttaaaaaataaaacaacttgtaatacgaaatgacaggggcagtagcttggaattactaatccaatagagtaggttggcactgtctgtagtactagtactcgagggaactggataggcggtcaatgcgtgtaataataaggaccgttccgtgtctctactcgtacacgagtgtttgctgggtgaaaactgatgtgcacgaacacatgctggtaagaagttaataagatcgatccgacgaccgaacaaggttgaattccgtaagaaaaacagagagatcgaaagcgatcacttggtgatgcgtactagtagtagtagtaacgtaaatactcgatcggtacaatttctcagtcaaaagaatacttcctctatctcttaatataagagatttttaacattttacttgtttgaccactcatcttattaaaattttttttataaatataaaaaacaaaaagttatgtataaagtattttgaataataaaggaagttacaaataaaatagataataattttattttttttaaaataaaacgaatagtcaaacagtacaacaaaataaaaaaaatctctagagggcggatacagtataaaagaagtagtcggtacaatgcagtggttgtactgtacgctactctgtttctctaggactgaccacgtaagatgtgaaaggctcccctgtttctgtcgcaaccagggtggtgtcccgtgtctgggtgatcgcggcgtgaactcgtgtggccttcgccaaattacagcagcagcggcggcggtaaaactcggcagaaacgacgacggatcggatcggtgaatttgtttgggggccttggaccggtgacccggtcccgactcgtaccacgcagtaccggattcgcggcgaggcgagcctcggagcaggggccagtaggggcgcgtgcagccagcgtccgcggcgccattacgccggcgacgtggcgcgcgtcccatcgcgtgaaacgcggccgcgcctgccggcaaaactaggttctattcttctctacctacgcgcagatcgaacgccaatctcaacgccacgttccaaaataaaccaatcccatatgggatttaacacatcaggtttctcttattgcttttggtacggttacaaaacctccgcgataaactacgtggtaaccgtgagacatatcgtggttaaaaaactgaaaagattaccgtgtatggtaattgtgataaccacgtgataaccgtacggttttgttaaatccttctgtacattttaccgtgtatcggatctgcaaaatcgaagcgggcaaatttttacacgctttgcttcagcttcgaactgaaccacacaacttttttacaataaccttcactaatgtgatttgttgttcgtgtttccagacgattaaactactgctccgacgagctttcggcgcggcttccgcggccgccgtggcgacgattcgacgcgatgcgattcgattctgcatctggcctgcagatttcgctcgtgtagccttctgcacgagtcaagtacagttgactgctacacgtggagagttggaggggaatagatactgtctgcctgcctccattcttttacttcgaaaacgaggctcgagcagccgagctctagtccagtccagctgtgccttttgattctccttgcctgttctccttgtcccctgcctgattattccacccagtaatggaaattaaccgtgtgcacaattttaattcactctgttcaacgaggtcaatcaatcttcaggagagtcgtcagaggcttcaatttttttcgaaggtaatcgaacatgaatgcagaggtctcgaactcgaaccaaattggcggcaccaagcaaatgcatcgaatcaatgcagcctgggcgagcaactgccgacggaacagaagcacgacggacgctttgatggtatggtcgccactagctgctgcctcctcctccattggcagatgggagacggctcaggacaccggtctcgcgattgcagcctcgtttgggcaggctaaacttgatataaccatccgtacgaagcgcaggtctcgacgaatttgagttaggccgctcaatttgcattagtaaactcggtcgagttgcaacagcagcagcaaacagctgtaaccagagttgcctcatgtgctcaacccgcagcagtaggatacgatgaaaaattgggggttttttctttttcctgcggtactgatgtactgtagcctgcataacctgcagtctgcatgcagcgcgagctgcacgtaaatgtgccggccggctcacagtttcgccgcggcttctggtcgtcgtcgtcgttgcggcagccgatacaggagggcgtttccagagatgaacctacagctgtgtgcgtgttgagtcgccgcgttggtagaagcagaaccaaaactgcatctttattgttgcctgttaccacttcgtggaagctgctaatgagggcatgtaactatggttgtccgactcttaaaacttgtaatgtcgacggttttattccttattgaaaatattacttgcggttcgaaattttggctctatagaacagttgcggatctagaatttataggataggtattcagaattttaaaatagcttttccaagatataacgatacagattgatatgttgacggtacgatacactattttcatattactatgacttgtgcgcatatatgataaaatatatagacttgtgcacctcttatcttgtgttagaaaaataactacatcatatctaaggaaactttaagtttataggaatgattttgaatttaaggtttaattaaatttttggtgtaggagtatatagagactatgtgatgaaaaagggtttcaaggagaaggtcttgttttaaaaatgggactaatataaattagaggtttggaacttagaagtaacatgtaatatggacatcttggatcttacacccctcccc

SEQ ID NO: 62079 - DNA, 1945 bp, Oryza sativa
cccccccccccccccccccccgcgtgtttcacattataagatgttttgaccccctctatctctcgtctagatttactaacatccatatgaaaccaaacaaatatatgaagcacatacatggatgtatttcagaaggaagtatgagcacatatatatgaagtacatacatttgaaacaaaggaagtatttcagaaggaagagatttaaatataaaactcaaccaagaaactccaaatcaataaaaaggtcgaaattataaagttgagatgatactaatttgggcttttctagaaatggatggaaataagaaatggttcaaaattctaggaatttaaagcaagatacatcaaacattcaataaaaaggtttaagattcaaaaatttgaatcaagacataaaaggatagaaatatctgaaatcaacttttcagattaaaagacacactttatatttctccgaatagaagaaataatcgaagtaataagcaaagaatcgtcatggtgcatttttgaaaatgttaaaattttcaggatggtacattgatcttaccccttgtacaaattgaatccataatgaatctattaagaatacaaatcgttcgttcggacacccaaaaccagatcatctggagtatcttgttttgttaggatatgccaattttggttgtcaacagtcctcaagtcattgcatacaaatagaccaaacaactatttctaggcacatatgttgtaatctggcatacacttatgccaacatccaccaaaactccgaaccaatttttttaaaaaaaaatcatagtcaaatttcttcactaatttttcatcccaaaatataaaccattgttttacgcaccaacagctgtataaacaattttgtttttacaagcgacatttttccatgatgtgaaaattgtcaatgctattggaaacattttttcacattatgagaaaacaccagtggtgtgatggtggagttgtgggtgtatgactttacccattaggatctaaatcatggtgcccacgaatattacacatatgcaggtgggcttttaacagaattttagtgagataagggatgtgcagttggttttcgtttgttagagcctgtgttagctgacgtattcatgggggtgtgagtgcactgttaatgtgtataatgatgtgcatatatgcgtctgcggtataattggggggtgggattgtctttaaagcgtatgttagagggcacattcgtgagatgtgagtatggtgttgcggatatagtgatgtgtgcgcacttctgccatataatcgaaaaaaaatcacattacctgcttgtctcaaactcaaaccgttgactaatctaggagagtaggagtatcttttgcaagaaaaaggtgtccgtgtaactgtatgtcccagtatccatatagtacattgtatgtgtattgtgtcaccatcatccacttggatcacacccacgctacgtctacgtagaggcgcatcaccacgtacgcacgtatagtacgttaggacacacattcctccgtacgtccacgtctcagggcgatcgatcctcaccacaccacctgcagctgcatctgctcgatccatccatcgatcgatcatggcgttgcactcgcgcacataccctcctccattacccacagtacgtggtcgaacactcagctgtgatcccacaacctcaccacgccgccgccctcgtccattattccaccgccgtccgcctgcaggccgagcatcaccggcggtgggctgatcatcagcccctccgccatgctcaccatcagcctcggcatctccagcacgtcgtcctcgtccaccacgccgccgccgccgcccccgtcctcgagctgacgccgactgtcgtcgtcctcctcctggtgtgccatcgcggcggcggcggcggtggccgcggcgcgcacgtcttcgggggacgcagacgc

SEQ ID NO: 62080 - DNA, 15794 bp, Oryza sativa
atatcctgctcggcttccggagctcccggatctccgacacccacttccccgccctgaaccgcacgccgcggtacaccgggtgccgcgtctccgccctcgcccgcctgatcccgcacgccgccgcgctctgcctcctcccctgccgctgctgcgccgccgccgccgcccgttgctccatgccacaacccaacacaccaatccacacctacgtgcctctcacattgctcaccacactgccacactgatcgatcactcgatcagctcatcaacatgcacgtacttatacgtacactggcctgctctaccaatagaatttcgcaccgtctagtacggatcgtaaaaaaaaacaaactggcttatattagaggaagatgtgtactaaactcgaccgaaacggaggattgcgagggtataaaaacgggcgggagttggtgaaaacattggggacaaatcgggatacgcgtttcttgcttgctcgatcgacgctgggctagggattagctgtgaagcacagggagcaaaaaagagtggctgtttcaggcttacaggacggtcaggccaatggcgtctcgccacattgggggagatctcacatgtcgcaaagccgctttcgcgttagtgcgcgacgaggttagtacgatcctcgcgtccaagtggcggctgatcaagccgtgatctgcaggatgttaatttatttttgacccggtctcgaacaccataattaagggtttaatggaaaaggtgaaagggatcagtcttggcatgatgagtagatgatgaatcgctagattcttttgttttcttgccacctaccatatccagttactagatcacgaagctagctagcttgtaggagccatgcatggtgagagatttttgtttcctctgaaagacaacgacgagaatataatcgctgcaacactccattttcagaggctcatatgctttggatggtgaattagtgataactgatcaccagtctgaataactgatcgccggctgtaccacgatcgatcaaaatatgaaaaacatttttgtgtgcgttgacgagtgtgctagttgttaagcacggccagcttgcagagagaagaaacagcaagtcctaccaacactgcaggagaattcagctgttagcctgtaacttgttagcaacttagcatcagtgctccacgacgatacgatcgaattgctgcactacacgaagctgtggatgcccccacaaggccactagtatgcatgggacctgaaggggtttttggcgatatctccctgaaggcccacatggtgatgaatgcatgcactaccaagctaagctagccccagctgcttgattgattgatgatcgatgctagctagctgcagatccatctgtggttagcttggagtaaagctcaatccaagcattttgtttgccttttggaatttgggggaaaaggacgttcttgaacttatcccccaaatagtatactattctgcgagaatgtcaaaagccagatcatccttttatgagcgttcagcatcttacattctgcaagcttccttgaaagtcgaaagctatctggacgatgggaacacttttggcgtggtcgtgaagttgtacatgcatgagtttgccattagttagtgcgtagatcctgataatcataagaagtatctacgtgtcatttcgcccccttctccccgccgcctcaccgccccaccaccacaatcggctccaacacggacctaccgtacatcactctggtcatccctctaagccggaaacaccttctactttctccaccccgactcaaatactcactgatgtttgctggaactcgtcggagataaatccatagcataaatcatagatacaatttgcaaggttagaaatttacgtggtttcacccccaaaaatgtgtcaagtgatgcgcagcattctgatgaagatattacacacttgaacgtgcttagaaaataatttgttaggttcatggattacccataccaaaatctattgaacatgtgctgaaggattgtacatatcggtgtggtatgcatataagtggtgcgtgcgcgtgttccactcaaccagcaaaatactccatagtttctacaagagcggtggtgattggtgaagctacatgcctactgtagcctcacacaaacattttctcccttaatgtctgacgttgataagtcatcggcgatcccatctaggcgtcagctgttgtatcttgctgccatccgtcgagtggcccgatgccccaagctggagcagcaggtaagttctcctccaatacggcgaaacccctaaatccttgtccaattgccacttgctctctaattctcctaatcctataccctaatcctctggatctgataatggaaacatctgctgaatgaatacttaattttgcggttttccttcttgtttacaatttcagccacattaaaattggtcaagtgctcaaccaagatcaatgaaacatatatgttaccttattttggtgcttacgagatgtttggaggctcagagctaatagatatattgaaaattgaaccttcttttgtattttttttttgaccgggaagggggggggcaaaatgtccacctaaatacattacgtcgaccttcttttgtatgttaaaacatatgttagtttcttatgtagttcgaggaagcctatgagtataaacatgtataaattgattgttatttgttttgtgtattggccttgtgtatgtcttgcatctgtgtgttatcctcattctagtagaatctgtatcaagcggcccatgccatggcccgtgtatagtcatagcagcatgaacgacttttgggctgcctggcccatccagcacggcccatgaaaagaatcacgcccaagccatccgttgtacgttcaaaatgacacttgttactatggggcgaaggcgcaaaagctacacgtttcagggaaactttacttcgagcaattctgaaacaaactagtggcgaagagaaataactgatatttttattcttgtttttatttctaggctttaatggtcttatcagctattcagctgtaacccgtggaaataaagtttttgtgagacaaattttaaatgctaaagataaatactctaggacggtcactcactcactcagttacgcagtctcctttaagtcaggaggaaaaggattggtgtagtatggacctggtggccacttgtaatatgaaaatggaaccgtgccaaatcgattggtcctcttccctatcatgatcagtcaggcccatacgcccactttggtgatgcgatgtgagtatgtgaccacaccgagagataagttatagccatattggctgtactaataaatcaaagcaaaagctaaaatttgaattttcaaattttattttgaaattggttttaagatatttttaatgtactttctttttcagcatcgacttttagaatgttaataacacatatataaaagtttcacctataaattatttttattctctaatattatagcttgctagggaatatgagcaatcgataagaacctcaagaaatggcgaaagagcgtgcctggattaggcctttcatccgacactgcacatgcacactgcacacatcgcgtccaggctttggccgaacatatctagtgttaaacgagtactaataataataaaaagaagagtaattaaacgatgaataaccaattgcagaaacgcaatcgttctagacagccatcgccgccagaatattgaattgttgcggagacatctgtagtcgaagattttgacaggggcaggcgccggccgtatccttcctgtccgtttttttctacacggcaagcaacgacaggttgatggctggcccatcagcttcatccggcaatggacccaggataatggagggttataaaataaacggtttaccacgactaaggttagacgtaacaaaataagtatactatgtcaggatatataagtgttacgtggacgtgcaattttttacgtgtttatgaaaaaaataagtattgtgaatgagcactgatgatgttttagggtgatgtaaacggtttggctgtatttgatacctttgggtgaaaggtgaaacggaaattttggagaaatttcaaaagaagtagaagtttattggaagaataataacggagcctcaaaattctctctcccatatgacagcgcgcgttgggagagccgtgtcgtgcggtgttgaatttccacttgttaacgacgcccgccatcactgactttggccgtctcgcgtgcatgcatccacctttttttttttgttttcagcattgacatcagttgactacacaagtcctgcattgtgcttatccaattaacttgccagccaccattacaaaaaaattgcatcttgtggtcgtggcaagcttaattttagcttgttctagtagatcaagcagtaccataaaagcagttggaaacaatattaacttatcctctctccgtattttaatatatgacgccgttaacattttaatcaacatttgattattcgtcttattcaaaaatgtatgtaattatcatttattttattgttacttgatttatcatcaaatattgtttaagcttgatacaaatatttttatatttaaacaaaaaaatttaaataagacgaatggtcaaacgttggttgaaaagtcaacggcgtcatatattaaaatatagagagagtattattttctggaaacggtcttaatatggtggggaatttttcatattgatgaatttaactatttagtggtgacattagtatgatgctgaatgaaattagaaaaatctaagttctatagatggctagaaacaaaaaacggttggaaacgataccattttcatatttattgtataaaaataatctcggtatatgaacggaaattttcataccgtttccatccttcgcagttgtttcactaaaaaaggtatacaaagtactatactagtagaaagcgacctttactttactctagaagtagaattagtcaggccaatcacgtttgcctaaacaagccactagtagtactagcattcttcccaaaacgtcaatcatactgtagtcagatctgcatatcaacattaaccgccacgttcttatctgatgaagtaaccatcaagaatgattcttcgagcttatcacatctcccatttgcataccactaatagttacagacttacagcaagagaggtatggaaagcaccggcgatactgtccatcgattgagagccgagacagcaacgcaattggctggccactgcatctgcatcagccatcaatggagggaaagctacagaaaggaagctcacagctgcttcgcgccactcgtcagggtcacactcaacagagtgaaaggcacacggaaaacgaaggaaagactggaaagttatgcggcattgctgtccaacagcgaaagccattggttaattagactccagcaattcagggtcacagaataatcatgtgttcaaaatcaaagccagctctgctttggttgtgagaattgcttggatagtagtacaggtaaaggagttgttttaagtgttttgaattaggagaagatattttttggactgcactaatcttgcggaattaacggggttgatgatttaccatatagtatatagttttgatctttgcatcaactatattcacattcacaagtccaagctgcttgaggaaattgttaccctgtaacccaacactagtttgctcatcgtttgctctacagaaaatgaatgaaacaactaaaaataatttatggtaaaacttttaaatcatgttctcagcgatataaaagcaatgctaaaaaatattataataaaagaacttaaaatcaatcaaattttagttgcggcataaatcaacaagcaaacggtgataacaccgcatcacagagtaaccaaccttctagaagcaaagccacccaatatatgcatctatgtgactatgactaagatgccaacaagatgtcatctaatgcaatgtttcctaaagtgcctcaatagtcctaattaatcatctcattccacttgctatcttgtacattgccgtatatatcaatccttatactacacatttctggtaggttttgatcaaaagttaaattaatacaaacaaaggaacttcttgatatggtatgaatatgatttaggcttctgttcagagacatgcattaatatacatcatcatacattaatatgcacacacaacctagagtttaagccctaaatacacacctaaataaatctatacaattgcttgcgtgcatatagttgtacgcaatcgaagtttaaaggatggaatcatgcacatacaactcctgtacataccaatgccgctaaattaggaggcggcgtgcagttaaatagaggacacatgagtattgagcgacaagccgacaacgagcgtgttccaactagatgattgaataggttgttcctttttccttgaaaaacctttgaaaagggtatggtattcctgtaatttgctatacaagaatatagttgattcagtttatgaggaaaatcagaatcgaaaaacttaatataaccaccacgaatgaaaacacatgactcaagtgacacaaacctatgataacgtcaggtgaaacgttcactccacagaaagttattgtcgttgctcccacgttgaataagagccctaacttcaacaagggcatgccgacagaatgacaacattgtccaatccaaaatggatctataggttcacacacccaaaggacttcctaaatgtggtattcacaaaattcccatagtatcatctctagaaggtgaacggtgtccgaaggcagtgacgtaactagcactttcaccctagagacacacacgcgaccaccagaatgccaaaactgctaataaggtcaccgcccatcgcacctcaacagcacgcatggatacgattgagctctaacttcaactaaaaagtgtagttgctttgatgtcagcattatcaacctcatcaactgatgcagcaacttcgatgccacctagactcagcctatcatagaatatcgtatgccagcaccatacactgctacatgacaacatcgaacatctctatgtttatcattacccacgccccaagcgagtcttgccaatgcaagaaaaccctaaaacacaaaaacaactcctctatcataaattcagagaaacatgagtccttcacatgtaagacccaccctcataaactcacacgtcatatgctcgtgtctctctaacattcgttagaaaagcctcatggcctaaaacacagtgcggttaggctggctagcacggagataagcgatcaaagctgtaggttagaccgttagattccgatcagacggcaggatcgactcacaaccaatcgctcccaaatcccaatgactaagggtgtgtttggttcacggtcatgcatggtgtgatatggcgatccattttttattggatgacgatccaattttttgttttatttgtatagatatgatgaccaaattacttgtttggttggagggatatagcatgaatgggaaaaggcaaaagttagtgggacccatttttcatatatatatatatatatatatatatatttcaaaatataataatccgaaatcttgttttaaaagatttagttgtaacaaatataaaggtgtgatcaaatcataaattagataaacggtttaagagaaaaaaaatcatttggagcttacttaatagaaaatcaaaccaaccacagccaatcagaataggacacatcatccagaccaaaactggatggcttcatctagccaaatcggctagatgcactcatccagtatattgaggtaatattccctatttcgagccgccccatccaccttaccctctaaccaaacaccacagaaaatcagacggtcatctcctatcaatactcgttcattcaaccaaacacaccctaaatcaatatggttcgcgtgtttaaccaccatttataacccttcactttcatccgcaatctccgtcaattacacggtgaacaacaccaataaccgggggagccttcaagcccttcaccctcatccgcagtctccgtcaattacactgtgaacaacaccaattaccgaagcctttaaggcagaagcaagaaataaacagtaaacagccaattgtaagcagcaaaccagagccaaaccgctgccgaccagccgctgccgccgtgtgtttataaaaagtcagcaaaaccttcccccaccacctcgttagctaaaactgtgaaaactctccattttccttgcctctctctctccccacccaatcccaacccaccacctctcctctcgccgccgccgccgccgccgccgcgcgccgttctatggcctacacctcctcctccctccacctccacaagcacctcctcctccccaagaccaacccctcctcctcctactcgcggcctccgcctccgtcgttcgtcgccgcggcggccaagatcaacggcgtcaacggacactcctccaagaagtcccccaacggcaaggcgcagatcaacggcgacggcaagaagggggtcaacgggagcgggaggaagaaggcggcggcgcagcacatcaacgggaatgaccggatccatctgtcggtgagcacgggcggcgccgggggccaggatgggttcgggctcagggtggcgttccagggcgcgccgggcgcgtacagcgagttcgcggcgaagacggcgctccccgggtgcgacaccgtgccctgccgcgcgttcgccgacgcgctggcggcggtcgacggcggcgccgtcgaccgcgcgatactgcccgtcgagtccaccatggagggcaccgcgctgcggaactacgacctcctgctgaggcatgacctcgtcgtggtccaggagatcaacctgttcgtgcactactgcctcctcgccatgcccggtgtccgcgccgccgaggtgcgccgggtgattagccaccccatggcgctcgcgcactgcggccgtgcgctggcgcggctcggcgtggacagggagcccgtggaggacaccgccggcgccgtggagatgctgcggtccaaccggatgctcgacaccgccgccatcgccagcccgcgcgccgccgacctctacggcctcgacgtgctcgcgcacggcctccaggacgagtcatggaacgtcacccgcttcctgctcctctccaagccgccctcgccggtgacgctgcccatggacgccgacgccaagaccagcatggtggtcgcccaccggggcggctccatgatggtggtcctcaaggtcctctccgccttctcctcccgcaacatcaacctgaccaagctggaggtcatcaacaacaacgacggcggcggcggcggcggtggcgccgcggcgggccaccccgtgatgatcctcgacacgagcgcccgcggcgcgccgacgctccgcgcgttcccgcacgtcctctacgtcgactgcgagggcgcctctcacgacccgcgcgtcctcgacgccatcaaggagatcgagagattcgcggtgttcgtccgcgttcttggctgctacgccgccgattccaacgtctacgacctgcaatgaggcggccatcgatcgaacacacagctgcggatccacatcaaatcagctagtcttgcaagatttggatcactgatcagttggattagagctctccattccagcactcacttcagtgagctacagatgctatactttgcttgcttgctgctgatgctgctgctgctgcctgctatgcgatttttgtacagatgcaataagaaatctttaccatttctgctgctggcttaggtatgtgcataggtttttaatcctggtattgatgccttctagctgaaggaaagtgtaagatggcacaggattgatgtaattttggtgtgctagatcttgattgatagtgagtattccttaatccccatttggtcctagatcttcctctgtattcatcccaccacactatgcagtgttctgttgatctaaagattagaccttgggattcatctgatcttggagcacctgaatttgtcactgttactaactgtaatacactgaattttgtacagaagacaatgtaatttacacacctaatgttgtgtacttgttgatctactactctgcttacaaggtgagctctggtattttgtaaattttgtattatcaagtttgagactttgtaaaccactaaaacatgtggattccaactgttaaatatagttgattacctccacaagaaatgcactacttgggtacttaacgcacacgagctgcacgagtctctgcttagtgatatgatatatagtactaattcttttgctaatattagaaaatgatctgggcatctacgactgattttaaaatctgatactgacatgataaccggggaagacaatatttttacaggctccttttcttttggggggggcatctgtcctcaatcaagagccgacaggggaatctgaatccatgtggagctttgtgcggggtggtcacggaatctttcatgtgaattttcagagaatctctaaccttagcattagaaggaaagctccaaccatctgattatgctttagttacacttaaaacagttaaattactggttcatcaacgagcttcttttggcaaggggaatcaaatcaaatcgaggccctacccctgtcactcttccagtggctcaggctcattcaacagagcagggaaaaagatctgaggagtagtaactatcactgataagcgagggccctgataactgagagtcacaagaacactgagagagaactgcaacctcatgctcacatgtgaccgaaataaaaccggtctactcaggctgcaacgaaatgaaaggcacaagcgagcgatagcaaaggctcagatcccgtatcaaaatgtgcgaattttcatcgcatgtgtggcacatggaaccgtacggcggtttggccgcatttggcggtggaaacggacacatcgcgcgctgcaaacccacagaattccagcgaaaacggtgcgtttctcccccgttctttctttttttttgctgaaagcttataagaaattcagagctctgaaacagtggagttctcttctctgccgtggctggtgagaatggcttgattggtggaagctgtgcgtgtgcgatgcatctccacatggcctgtggcccggagactttgggagtcacgatgagcagcgtaccaaccgggttacttgggtggtagtatgtacttggtcattgtggtcacagttctttgctgtcattttaaccttacttacccacctccaactcccattgcaagagaccttgctttgtcacctgccaaattggcaagatctgaattatgtaccatatcttggacaataatgcagggagatagagagagatagagagggtgaccacacggttgaattgttccgagcaatgcttgctctcccatgtagctggagaggaatccgggacctgaactgatcatgcagtgtgtaagccgcatcttgcacgcgtatcatgaacaactgaaacgtcgctgccaggctgccagccgctgaattttctttgaagttagctagatttgatgtttttgatccatacctttcaggaatatatttacatgcaacataatgaatacggcagtggagaaggaaagggaaatttcaccggatcccaatggcgctcatacttcaagtaaaacctgaagcaaagagcgtgtcgcacatgcgaaaaggaatgtgttgcaaatggcattagtgaaacctctatagctagaggttctagaaggaatcgtgttgggactagggagcacatataaattattaattgatgcagggttgcgatgcgatgtggagaagaaaggtgtgatgtaatataagatatactacctccgtcccaaaataagtgtagccgtggatatccgtgcccaacgtttgactcgtccatcttatttgaaaaatttgtgaaaaaattgaaaatatttagtcacacataaagtactatttatgttttatcatataatagcaataaaaatactagtcataaaaaatattcaaataagacgaacggtcgaacgtttgaacgtaaatagtgtaaaactgcatttattttgggacggagggagtatcaagtcgtggacggagcacatcagtggctcacatgcaaccggtgattcggcgtgggttgttaggtcgtagtcgcgggggtggcctttacgccatgaacaaatactgggagtgggagagatagacgcatataggatcgcttggtttgcctcgacgggaagtaatttgctaaactcggtttcagctaacaagcaagacaacagggcacatggccgtatggtgctagctagtaccatgcttattccttctctgttccaaaagctagcttattcatcgtacgtggcatgcatgatggggtctcatcagtacctgtcattatagatgctgtgctggtgtcggtttagaccagagagagcaaatgatccaaggcgaaaaagatcttagggtagctctggtcgcgtcgtgtacggtccagatgcggcggggccgtagtcgtgcgcgacgcggcacgcacgctgattacgctcgtttccgcgtgaaattgcaccggaaaactgcccgcccgattcggcccatctccccagtcccaacccaacccaacccaccccaccccacccccggtcgcgacacgagccagcgcgagagaggccgcctgcctcgcgtcgcaccgaccgccgaatggtggccgggccggcccacgcgacgtagcggttggcgccacggggcctccaacattgggcaaacaaggccgcgcgctgcggtttctggcgtcccccagctgcttgctcgcgcttcgcgtccctgttccctgcctccctgccgaggctggcagcgtacagtatgtttgtgtgggaaaaagtacaccgaaggtccctgagcttatcataggataaaaaacattctcgaacagtaaaaccagatatgcggggtcccttaactacataaaaccggtcacccgaggtccttcggtggttttgactccggttttagtctatgggcggctgagtcagcgtagtacccacatgtcagcgtgccacgtcaactttccctttctcctcttctctctcccttcctccctctctgctctctctctctcgcaggccgggccaagggtagggagcagacgcccaggcggcgagcggggctgagtggcggcgccgcgacggcggccggcggccgcgtcggccgcgcacacctagcggatcctcgcttcgagcctcttgacttgcaggcaaacggtaagaagagcaccaccatcagccagaactagcggggacggcgggatctgcgaggacgccagattggtggggacgcgatgccacaccgactccaccttgatggtgtcgatgccgcaggcaagctcccccatggcgcccatgaactgcgccgcccacggctcgttactcgcaatcgatctcgcctacacttcccatgttatctgcatcgatcaatctgaccttgtgactgcatgcatttctagctcccagctacctgtgtcaaacattccatttgcaagataatagggcatgccagagccagatgataagaacaaattaaccgatacttgaagaactgagactaatcatcgcgtgcaagtgcaactgggcctctttaatctacccatgacaatactgtcagccaggttcaactagtgctcgggtcctcctccgctcaggccccgtcgttcactgagctgctcatcgctgggtgggggcgtcggcgggcggtgacgccattggcaacctcgagcagagtccagccttcccaatctctgctcagaaggatctgcgtgctcgagctcttcagcgcacaccgcgtctagtcgctccaccacgtccgcgaggaagaggcggcgcccctagttcgcgtcgtcgccgacataaggtcaccgctggggccatcagttgcaggaggaggcggcgtcttctccggctccgtcgcggccggggaacccatcgccttctccgactccaccgtggtgttgcgcagggccggtcttatgatttcgtgggccctatgcgaactcatcacgatggcccctataagctatatataaaattttatgatatatatagacgctaattttacttgcaaaatgaaaacaaacatatccatatattaaatttaacatatctgttaattatcgagaaataaagtcaaccaaaacaacaatatatttataccttggaactaatatcattatcttaatgaagaaaagaacccaatcatatccattgcttctcatgaaaagatacttcttcgggcatttctgatgcaaaatcatcaataacggtattaagatcaatagtgtctaagattgggcgacgaggtgacgacgctccaactcctctcgtttcggcgtttttgcttctaggtaggccatagacaggtactagactactagtattaggtgttggtccccccactatcatgggccccccaccatcatgggcccccggcggtcacctcggctgcatagggccagggccggccctggtgttgcgtaccgtgaggccataggcgatttgggaggaggggttgtcgggggcggtggatgtgtcgccagtggtggatgcggctccgccgccgtcccgcccgccacctcctcgcactgcggttgctgctcccgctcccttctcatctctacggccgatgacctcctcagcctcctcaacgacaatgacgacgatgacaacccgttccccgccgctgctaacgccatcgccgccgccgaccccggccgcgcgcgccgccttgggcgccctagcgccggcatccccatgccctgcgagagcagagagagagagggagggaggaagcagagaaacagagaaagaaaagaggtgaaaggggaagttgacgtggcacgctgacatgtggggcccacgtgggtcccacgctgactcagctgccacatagaccaaaaccggggtcaaaactaccgaaggatcttcggtgaccgattttatatagttaagggacctcgtatatctggttttgcggtttgaggacgttttttttatccccatgataagttcagggatcttcggtgtacttcttccttatgtgtgtgactactcatgctattcacgagattttcgtgcggattccataggaaacggttcaatttctatgcgtaaagagaagatttttctcacgtttcaaaccggggctttcgtcttttttgcacaagaggagtaccagtctggagtgtcggagccaaaaagatttttaagctcggataaattttaatataactaatatttactatagaaatttattcattattgatttactcatccatatcaaaatttattggagttttcgctggcgggccgggtggtgactccgccccctgactacttaatttgaggtaaaaagtttctatcttagtctaatacatgaaaaatgaaaattaataacacctgaaagtctcgagcaaaagatcaagtatcagtatataattggaagatttagttctaacaaattctaaaaggaaaaattatgaattacccctcgaactatcgcggtcgtctgaaatacccccctgaaccacaaaaccggacattcttcacctcgaactatgtaaaccggacgaattacccccctcgacccaacccgcggtggttttggtctacgtggcgtacgcgtggctgtttaatcagcattttatttattaataaaatgtgggacccacatatcaaattcctatccaacta

SEQ ID NO: 62081 - DNA, 5871 bp, Oryza sativa
tgcgctagcctctccaccccttggcctcttcctttgcccccgccgccgcctcgcgtcgcctcgccgcgctcctgcgtctgccgccgccgtctaaaggagaagagagagagagagtgagagatagaagagagagagagaagccgataggtagggccaacctattttttaataaatatattgctgactggactgccttgtagaccaaaactaccgcggattggataaggagggtaattcgtccggtttacatagtttggggtaaagaatgtctggttttgtagttcaggggggtaattcagactttttccattctaaaagcataatggttttcaacataatatgaccagcttattgcttgagtactatctttactcttttagtattaatatttgatataattcaaaataagctgtataatctagttgaaacgaattccaacatacggctagctagccttatccgatcgccttgacgaagaagatgatcgatgcatgcatgcgcgccggccggcacaagaacagctcgcttttcttgattaaaaacaagctaagctaagagcaggtacaatagcaactattagccagttataaacatattttaattagataaaatatgagagagaagagcagcgggctacagatatgtagtcaactacagcacggattttaagacgcagtatgcgcatgacaggtgggaccatatattaataatatagtaagttgaattggctattagactgactataaatgaatttgagttagtagtgggctgtaatattaaatttgctctaaggcaggtgggtgatggcctcttggtgctagaaacagctgtaacctgttgtttgtgctaagctttgggggtaagcatcattgtttaatttctgacttcctgtaggtgatgattaattagtgcaggtcaaacccttatctgcaagactgcaagctaactagcataggtaggtagctagcgctgtttcttctccttcatggtattgcgcctgtgcgcctgtgtttaagttccatatcaaaacgggaagtttaaaaaaattagaacgatatgataaaaaaattgaaagtttgtgtgtagaaaagttcgatgtgacaaaaaagttaaagttaaaagtttaaagaagaaaaattagaatctaaacagggcctgcatatggatatatcttgtatactgtgagacaacatttgaggggatgggctaaacatacaagtgggatttacaaaaaaagataaaaaagagttattagataaattggacttgcttgataaaaaagctgaatccactctattaacttaggatgaaattgatattagatggttttatagaaatagattatctttgcttttgagagaagaggaaattaagtggtaccagagggctaagtctaaagatatcttggagggagactctaatactaagtattttcatttggttgcgaatggtaagcatagaaaaacaagaatttttcaattgcaagacggtgatcaccaagtaataaatggtgatgcaaaaaccttaaatcgcatattaccaccttttataaaggtttatttggtcctcccgatgattccggtttacaacttgatgaaaataaaattgatgacattcctcaagtatctcaattggagaatgaagctttaacacaagaatttactgaggatgaaattaaaaaggcaattttccaaatggaacataacaaggctccgggtcctgatggatttccagctgagttttaccaagttttttggaatgttattaaatctgatttgttagatctttttatagagtttcataatggtactttgcctctattctctcttaattttggtcctatcattcttttgcctaagtgtatggaggccatgaaaatccagcaatataggcccatctgcttacttaatgttagctttaaaatttttaccaaagttgctactaatagaattattggagtggctcaaaaggtaattagccctactcaaactgcttttatccctgggagaaatattatggaaggggttgttattcgtcatgagactatatatgaattgcatcgtaaaaataaaagtggtgtaatctttaagattgattttaagaaagcgttcgacaaggttaaatggtcttttgttcaacagacattgaggatgaaaggcttttcacctaaaaggtgtcaatggatagcttctttcattcaaggtggtcatgttggtattaaagtaaatgatcaagttggaaataacttccaaacctataaagggcttaggcaaggagatcctctgtctccgattctttttaatatcgtggctgatatgctagctttactaattaagagggctaaagatgatggtatgttaagtgaggtaatacctcatttaatggatgatggtttatctattttgcaatatgctgatgataccatcatatttttggagcatgatttacaagaagccaagaatttgaaattgattttaacagtgtttgaaaagttatctggcttgaaaataaattttcacaaaagtgagttattttgttttggtcaagcaaaggaatataatgatcaatattctaatatctttggctgcaagctaggttcttttcctgttaagtatctcggtattccaatgcattttagaaagcttggcaataaagattggaagattatcgaacaaagaattgagaagaaacttagtagttggaaaggtaaacatatgtctgtggggggaagattggttttgattaattctgttctatcaagtttggctatgtttatgatatctttttttgagattccaaagggagttcttcaaaaaattgattattatagatcacgtttcttttgcaaggtgatgatcataagaaaaaatatagactgacaagatgggatataatttgtcaacccaaagaccaagggggtttaggtgttcataatttagagatccaaaataaatgtcttttgagtaaatggttgttcaagttaataaatgagcaaggggtttggcaggacttattaaaaggaagtatctctctaaccattatataactcaagttgataggaaaccaggggattctcatttctggtcaagtctcatgaaagttaaaaaatactttcttgaatatgggttcctggattgtgaataatggggaacaaactagattttgggaagataaatggataggtaacgttgcttttaaagataagtatccgtctatatatgccattgttcgaatgaagaattcttcaattgctaatgttatgagatttgttccgctgaatgtttcttttaggagagctttggttggtaagaatttagcacattggcataacttgtgtgcttctattgtgcatattcagttgagtcaactgaatgattgttttagatggaattatcatcaaaatgggcaatttactgttcggacaatgtatttagccttaataaacaataattatattgagagaaacaagattatttggaaacttaggatgcctcttaagatcaagatcttcatgtggtacttgcttaaaggggttgtattaactaaagataatttggcaaggaggaattggaatggtagcttgagatattttttctgtatgaaaaatgaaactattcaacatctttttgtggagtgtcattatgcaaagtttttatggagagcagttcagttttcttttagtctttaccttcctcatggtatatctcatatttttgataattggcttctaggggtggacaaaaaaagaagaaaacttgttctcataggagcatttgctatatgttgggctctatggttgagtaggaattatgttatttttgacaagtcaccatctatttcatatatgcaggtagttttcagggcaacacattggctccggtcttgggcacaactacaaaagtgtgaggaagatagtgagcttttaaaggctgcatgccgtattcttgagacaacggttatgcaactttttgtcaattttggatggaggttcacaaacagaattcaataattgtgtactctttatcttgggttggcagtttttaggttgtttcttcttgatggttggtttcatcctttaagtttctttgaacttcactcattttaagtgtgagattataataattggctgtagctctttgagcaaagaccgggatgctctattccattatctaaaaaaaaaggcctgacgtcttctcctcattgtacaatatggttgcgttggacgcacatttttgtcgccgtgttgcactgcaagatttacttgctgtgatgcttggacatctataccaattaattgcacatttgcactggacagctatatatgcagaattaagctggcagactattgtacaactgcctctgctccctcagttcaaaactcacaaaaaaaatgtcaatgcaattgatgtggggaaaacaacagtgtttccacagtatcaagtttaatttaattatatgaaaaaatatatgggctaaatgtaaaatagtatatgcatgcattggtatgtgttgcagttcttttttttcctttgcaaatcaacacttaattagagtgcgccaatttttattgaatatatagtagaaagagattttgtatagataaaagaaactaacaaaggtaaatgggaaaactaaggtaaaagctttgttggatttggtgagagatttccatgccttccagtgagttttccgcttccccttttcagctccccaccaaaaattatacatatatcacttttcaataaatatttttatagaaacaagaagtcaaaattgtgttttggagaccgtgtcgctgtccaaaacgacttcctttatgagtatggagggagtacatgtacagctctcgcgagcatctactggaactaactactagtaatctacatggaaataatttggtggttattgcctaccatctactccctctgtcccatggtataagaaattttggagggatgtgacatatcgtagtactacgaatttgaacagactccatgttctggacagactccatgttctggacagactccctgctcagatttatagtattaggatgtgttacatccctctgaaataccttatatattaggacgaagggaatatatggtactccctccatctattttttataagcatatttccaaatcaaaaaaaaatacttttgataggcatatttcaatctaaccaactatcctcttaatgactttctcggatttaatgtgtgactctccattcttccatactccctccggttccatattaattgacgttttggacaagattgaggtcaaacttttataactttaaccatcaataactttaaaagtatttagtttaaaagaactagaacaacatatatagatttatcttttaaattactataataaaagtaaacatgcatttatttattatatatattataatagaaaaataaggtcaaagatatatcttgtagaccgtgtcattgtccaaaacgtcgattaaaatgaaactagagggagtacaagattggctacatgggcatcaagaaatgtaaatattaatgaatcgcttatttacgaggaataactagtagcttaaatagatgataagtaaaattacttattcctggtcactgtgctaagatgaaatatgactatcaaaagtagatagagtgagttctatctaataaataaagaacaaacgggtaagacctatggggctagcttgtcattggttacaattcaaatattgtactcccttcgttaaaaaaaatctaagaacgggatatgacatattctagtacaacgaatctggacaaatgtatgactagaatttgtagtactaggatgtgtcatattcagtattagtttggttttttatgcgacagag

SEQ ID NO: 62082 - DNA, 2586 bp, Oryza sativa
tagtacttctttttcatctcttatttaagggaaatcaatttcttaatttaaagatgaactagatggattttgaactacatatttggaattataatcgtatacgttggcatgaatatgctatatacatgacgtacgtatctctaaaacctctttttgtaaaatcggcacaaaactgaaggtcgttctcttcccccctccagactcttaatctcatctaatggaccttgtattctacctcaaatacaatggcaaattcaggttggcaagctctccgccccgtgatttagtaaaaaaaaaaaacaactgagggctcgtcgactttcgtgatgtcaagaagcaaaattagcagataaacgatttgccgcagatcgatcattagctgtaatcaacaacatatatgcctatatatacttcctccgtactactcgtaaagaaagtcgtttacgacagtatttaagtcaaaccttaggaatataaaccatgaataactctcaagttgttgagtttgaaaatataaaaattatatgaatagatttgtcttgaaaaatactttcataaaagtatacatataccacttttcaataaatatttttatagaaacaaaaagtcaaagttgtgttttgtagaccgtgtcgttgtccaaaacgacttcttttagaagtacggagggagcatgtactagagagtgtcagattttaggtgactgcactttaaaaaaaattctgccatttttctcactccttggatggaatccaatgattgaactttatttaaacaaagtaccatctttattacctaaaatgtggagtaatattcaatcaaaaaatgttgactaataattatctaatcctataaattacatgaaataaaattataatcataaatacttacaagattgcattaaaaatattcaaacttagataaaataaactatccaataacgactgatttgatactgcacgaagaacgcaaatggattatagaaggcacgaaacctttatggtatttaggcatgtaagaaattcttattttttcgctttttttttctcataggaggttgcacattgtaatatcctccccatggcacatgaagcctcccccgccttaccccttttcgtaccaactgctacattagttgtaacgtgtacgcaactatttctacattctaacgcatagattgcagttcggagaagaaactacaacttattgttatgattatatctagctaactaatggactatacatagttatattaaaccttggcatctatatatagtagaataattacacgttgaacatggcacaccacataataatctgaacgaattaaaaggtttctcacgcataaactgataaacatgtatgccgccatctagtcagcgaatcctcattggtacacgcatgaagaagccgtaatcttgttcatcttgcaggtttcatgtgagcgtgctggcatgtaggcagtagacagttcagcccccagtttgtcatccatctgatcatctctgaccttgctccactgctatgcatcagtactagtacatcctcattgtcaaccaaataaaaaatgggactttgagcccttaagaattctttaatatgagacatcagaatgtcaacttacagtacgagagcgtcccccccgggttgctcgcgccgcgcgatgctccctgccgaggctcagcgcacagtatgtgttcatgtgtgtgtgactactcactcatgctattcacgagattttcgtgcggattccattggaaacggttcaatttctgtgagtgaagagaagatttttctcacgtctcaaaccagggtttcgggcttgttcactttgctaccattttcaacattatcttttttaagcaaaattactaaaaaaatggctacatttaatttgttgccaaattttaataagtacatatgaaatcttgccaaaatttgataattttgctaaaattttagcaactttactaaaatttggcaataccaaaacttgttaaggttgaaaatagtagcaaagtgaacaagcccttcgtctttttttcacaagaggggccgtaatgttaattactatcagtggtgaagccaaaaagattttgctagtatttgctataaaaatatcatcatcgatttacttatcaatattaaaatttattggagttttcgccggcacgcccgagcagccacccgagctagccgggcgatggctccaacccctgactactgctccctccggcacaaaatataatcatttttagaatagtgacaagtcaaatattttaaactttaactattaatagtaaaaaaataaaaataaaatcaatcatataaaattgatgttactagatttattactgaacaaactatcataatatgcagcctctttttatttaaaatattttacttttatatatattattggtcaaagtagcatctcggagaccgtatcaaagtcaaaaaatgcttatattttgggatggagagagtactatacttaatacttaatttgaggtaaaaaatttctatctcagtctaatacatgaaaataaaaattaatgacacctgaaaatgatgtctcgagcaaaa

SEQ ID NO: 62083 - DNA, 1406 bp, Oryza sativa
tttttataatgtttcaatccaaatcatttcatcatttttttttattatctaatatatatcccgcaacaaagcgtgggacatcgtcagtttcttgattaaaaacaagctaggtaaggtaggtgggcgttggcctcttggtgcttgaaacagctgtaacatgttgtttctgctaagctttgggggtaagtatcattgtttaatttctgacttcctgtaggtggtgattaattagtgctggtcaaacccttatctgcaagctaattaactagcatcggtagctagctgtttcttcttcttcatggcattgcaaatggatatatcttgcatgctgtggcctctacttcttcttcattgtacaatggttgcgttggacgcacatttttgtcgccgtgttgcactgcaagatatacttgctgatgcttggacatctataccaattaattgcacatttgcacaggacagctatatatgcagaattaaggtggcagacaggcccagaatggttgttagccttgctagatacagtttcggcagaagatggtatgcgtatactgatgattttgtggcgaatttggtacattcataatgagatagtgcacgataaaagaccaacacccataagtgcattgaaaaggttcttggaaagctatgtccaatccttgctgatgataaagaatggccaaaggagtgacctggtgaaggggatcggaagaagatccagggcgacacaatttgccaaacgcaaaaggatgataagccaaaagaatgctgtaaacgacctccctcaggattggcaaaactgaacatcgatagctccttccttgagtccgatggtagtgctgggatcagtgcaattcttcgggactacaatggtgaaaccatctttacgatgtgcaagtcacttgcaaactgctcttcagcgttagagactgaacttgccgcctgtgtggagggccttcggttagcactgcaatggacactgctgctggttgcaattgaaacggactgcatctcagttgtgcatctactcactaataaggaggactgcttaaccctggcgtttctagtcagagaagcaagatggcttcgatcaggagaaaggacgacttctattacgaagatccagcgggaacaaaatttgattagccatgaattagcaaacaaagctagaagggacgattactcaggcttttgggctgggtttgagtccaattctgtttcatggttgattgaaaaagactgtaatttgtcccatgtgatttaatgaagtcctttttcccgaaaaaaaaaagaattaaggtggcagactattgtacaactgcctctgctcagctcgttcaaaactcacaaagaaaatgacaatgcaattaattaattagcgaaaacaacagtgtttccacagtatc

SEQ ID NO: 62084 - DNA, 2535 bp, Oryza sativa
ccttttttgggtgcctcaaggtagattgtcagcgccgtctaccagctatgtaccaacgtagtggtggtccaattgatcaatttggtctgctcttgcgacgttcagtttgatactatgtcttatgttttctttatctgtagtccatgagaaggtgaaaggatgcctcaaagatgtgcctatggaatgggccgtgtcaccaggggatatttggttgcttactaactttgccaaatcccatattaggcaaggtgtggctgccacaaaatgtgtggttagcaaaatactagccacaacttagccaaagttagcaaaaaatactagtgtatgacatgtggggccatatagagaaaatgtgtggctagccacagttgtgtcatgaaccaaacaatagctaaaaaaccgtggcatgactaactttagacgtggcaacttgtggcatgcaaccaaacaacccctgaagctagctagctaggcatgcaagcacacgaaagaacaacctactaatccattaggggtcatgtgatatatacagctctcgcgagcatctcttagaactactagtaatccacatggacataatttggtggttattgctatctagggaaactttttgatcctacgggggatatctcctcgttgtttgcatgtcacttaaatgattatgaagcaatttgaaaaaaaaattaagaagatatattaacatgtgatatattacttcacaaacatgcaagttcaaattcaactctacatcttgcaatgaaaaaaataaattaaactacagctaattaaagtatattcatagtcaaatttgtttttttgttgtaagatgtagaagttgaatttgaacttgcatgtttgtagagtgatatatcacatgtttatatatcttcttaatttttttataatcatttaaatgacatgcaaataaggagtggacatccccttgagggatcaaaatccactcccctactatctgcagtatttggtatcatctaataaataaagaacaaacgggcaagacctatggttagctagagtctcggctagcttgcaattggtttcaattcaaatattgtcctccttccgtccaaaaacaaatctaaaattggatatgacacattctagtacaatgaatctggacagagatatgtccagatttgtaatactaagatgtgtcacattcaatactaggttgattttttacgggacggagggagtatgcatgattgtatcgatcgcagcacatactctctttatatttctttcgaaaaaatggaagatggtacaagtattacattttctgtactatactattactaaagttgatacatatgtttagattttctgtttccagtaatttaaatcaaacggttaaaatcaatgttttttttgcggggaaagggagatatattactactcacagacaaaatgtgagatgaaattacaagtgttcttaggccaaaaatctgaaatagattcacagcgagccttattcgctaacagatggctcacacgattttggtcacgatggcccttcacaattttaatctcccttattccagctaacagatctttcacctctcggacaagaaaagctaggtccgatttatcctccccatctgcttgaagcatgtggatagccaccaggcaatcagtctctactatcaacggcaacagagtccattgcagggacagcacaatccctgttttaaaagctagcaactctgcttccagcgcactatagcactaatcaaggtaggaacaggacgtaaagataatcttcccatcactatctctgagaacagcaccagttccccccttattaacctgtgcgtcaaaggacccgtcgatattcaccttcatccaccctagcgccagcttctcccatttcttcaagttcacctgttgtctgaaattttgaccaacaggactgttcggtatgaaactaaccacatgtttgcctttctccagattagcttaaggatgttgcttaatctctaaaagtgatttcatatagctctgtaagaaccgttgtgaagcctctatcgaagggctcggtttcccatgtatgatctcattatggacgaaccaaattcgccacagaaccataagaaacatgggctgttcatgatccggcaacaaggccagccgattgaaaagccaggatgggcctaataagtgatcatccatccttagtgacagatcatttgattccttcatggctaaccagaggtgtttagcttgcggacagcggcatagggcatgcattgtatcttccttctccatgccacagatgacgcacgtatcagaaatctccaggttccgtttcttcttgttgtcccaagtaggaaggcagttagaggttgctctccaagtgaagattttaactttggatggaacattacatttccataacaattcccaagctttcctgatgttgacatcagaggaactcgagcttgcttcctctttagcccaattctctgccagcctataagctgtgcgaactgaaaaattcccgagtttatccggatg

SEQ ID NO: 62085 - DNA, 2029 bp, Oryza sativa
ccaaaaattccgggtcaagcttgttaggtcctcgcaaaccgactccggcaatttaaaaatccccataacatagacaggaattgcttggatgacagccttgataagaacttcctttccgccgctcgataggtaattctcaccccattgtagaatctttttccatattctttctcgcaagctctgaaacctacctttgtgcattcgtcctcccggagtggggagaccaaggtatttatcttcaaactccgtgcttgcaatttgcaagcagtttgtgatggcatctcgagaagctatcggcaaggagttaccaaacaagatagagcactttgttggattgattagctgacctgtactagtagcataactgccgaacacctccttgatagcttgtgactgtgaaagatcagccttgaagaataacagtgtgtcatctgcaaacagtagatgagagatccctggtgcttggtggcaaacccggattggggagatagctccctgttccaccttctcttcaagtagcaaggataaaccatcggccacaaacagaaagagaaaggggtcacaacgggtccccttgtcgcagacctcgggtcggagcgaatgtgttcagtagggtcccattaaacttaactgcatatctcaccgtggatatacaggtcatgacccaactaacccaacaatgagaaaaaccccacttatacattgattgctccaaaaacctccagtcgacgcgatcataagccttggagagatcaagcttatacgcgcaggcagccgatctcggattcttatttctctgaatgaaatgaaagcattcaaaagcaagaagtgcattatcggtgatcattctcctaggaacaaaagcactctgatttttagagatcaattcatccaaaaaaggcctcagcctattaaccagacacttggacagaaccttgtagatcacattacataagctaattggcctgaagtctcgcaagtctctaggttgttcaatttttggaataagaacgatggcagtatcattcaccccttccagcataatcccagaatggaagaattcttttactgctctcacgatatcatttttgatgcagccccaattacgttggtagaatctggccagaaagccgtcagtacccggtgcctttaaaggccctatctgaaacaaggcatttgctatttcatcttctgagaattcagagcataatctgttgttcatttcttccgtaacttttggttgaattaatctagtcaccggggaatgatccaagtttgggtcagcagtaaacatatctttaaaatactgtgttgccatttgttccatcaccattttcgacctatgaaaagtaccagcagcatctcgcagcttggtaattttgttcttcttggctctccaggccactctattgtaaagaattttgtattacgatctccttctttcagccagttaacgcgggatcgttgaagccacaacatctcttcccgatacaacaattcattcatgtaatccgaggtttgccgtatagcagctttatcagttccagcttctaaaaggtttgagagtttcttccttgttttctccaattctctgccaatattcttgtattttttcttactccaagactgcagcgctgccataactttcctcagtgacagagagatatcccccagatcagacttccccctgtttcgttccatgcatccgaaactacttcgctgatccctgcatctctctcccaaaaaatctcatagtgcagacatttctgacagacctgatctgggacagaaccatgtaatttaagaacaataggacaatggttagaacagggagaaaccaaatgttggacttggtactgactgaacaaatccctccactcgtcatctgccaaagcacgatccaagcgaacctttacattgttccagccgccccttctattatcatacgtgtgtggtaacccagaaattcccaaatcatgaagctcacatgtgtccaacacgtccctaaggcctgcatttgagcatcact

SEQ ID NO: 62086 - DNA, 8372 bp, Oryza sativa
  unsure (1)..(8372): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctctcaaatatctgagaaaatggtaggaacaattgcttcaccctgcttttgtactgccaatggagtgccaatgctctgcatctgatgcaatttttacttatcttatgtaggtcggattgtcgagtggagtgctattcctgctgtttggtatcatgtcatacttgtcaggaccagaaggagaattataatgcccccagaaagtcatgcataaggagaattatcatgttcatcatggccggttaacaagcttgttttcactacgacttgatctcatcttagtaggtggacgatggcgacgaaagcgctgatcctttgcaaggaggatggcgattacttagcttagtcaacacattgtaaacatttcactcatcattcataaataacaagatggtaccaaagactctactggttgcttcgtgttagtcccagcaccagacaacattcagccaaaactgtcggagtagttgctgcatactaccatactatttttttggtcgcaactatgcataagaactgctagtcttcggactaaattgcctggactgaagaggggttacaaatcataaaaagtgatttcagaattagttgtttttctaacatcacccttcacatttttaaaatctttattctttgggatttcggatttgtcctgcagagactacattcaactggactataagacaggcaatgtgtgtgctgaatcagtcggcatgaagccagactctgtgtctgggagctctgaaccacaggccagaattagttgcttatctcttgtaggaataagttcatctgatgtcccttaacttgtttacgaatccgattttcgtccttcaaccgaaaaaccagatacaacgggtccttcaactgtgaaaaccagtgcaaaataagttcctcggcggtttgaacggcggttctagctgacgtggctaatttaacttggtcttcatctgacatggaattgacgtgccgctaacgtggcaattcgatccgaaaaaatattaaaccctgtgggacctacatgtcagtatcacacataaattaattaaaaaatggtggggctcacgtgggccccacatgtcattctcaccccccaccacttcttcctcctccatccccatctcccctctccggccacggtcacggcggcgccggggacaacgacctcaagaaggcggacgaggccagtcttgacgcccttcccacgtcctccgccactcacctcggcggtgcgctcggccggtggagagaggaagcgcagtggagatggcccaggcggcgggagtggagatcggagggagttgggggcgccgccggcagattgccgccgctccgtcccaccggcttcgcgcgccgccaccgccccactccgtctcgccgctctgctcgccccgccccgccggcttcgtgccgctgcgcgccggatgacgacgacgacgaggctggcgcccttcgcttggctccgcagccccgccggcttcgggcgccgccactccgcccgcgccgcgcgtccgccggccgctgccccactccgccccgccgatctgcccgcccagccccgccggattcgcgccgctgcgcgccggaagacgacgacgacaaggcatgaagaagcaggagcagactacaaaacaatggcattaatcatgttaggattccacattcagagagtgagctggagcacatcattgatttttgtgcagagagccagagatcgatggatcgattgattctgtcgccgatgactctaccaattctgtccaggctaatcaactcagctgaagtgcttgcaatttacatcggccgtcaggctgccgctgccgtcgccggcggatggctggatggtggtggccacgctgttcgctgccatgacnnnnnnnnnnnnnnnnnnnnngccggggtggatgccgaggcccagggactggttcgcggtgcttctcgccgccgatccgacacgatggaccaggccgggaaggcgatgctgtacctgatcgtcaacccgtgcaccttcgcacctccacggcgccgccaccctcctccacgctgccgccggtcaccgccgttcgcattgcctgctaccgcgccgccgacgctgagagggaagggagagaaacagatagagagagggggaaggagaggatgtattgacatgtgggccccacctttttttcctgacatgtggccccgccattttttaattatttttttttgtgtagctgacaggtgggcccatggtttttattatttttatgatatataattgtcacgtaagcgccacgtcaatgccacgtggtaagagaccttagtcaaaccaaccacgtatgcaccacgtcagccaaaaccgcctttaaaaccgccgagtgacctcgtttgcaccgattttaacagctcggggaccggttatatctggttttgtggtttaaggacgaatatcggattcggtgtaaaattaagggacctcagatgaacttaatcctctcttgtacactgtctctctttctctcaactcaactgggccagagaccgggatttctaacctgggccaaatttgttcacactgtctctctttctcttaacttaactgggccagagaccgggatttctaacctgggccaaatttgttcacttccagtggtagtttgctggtggaaaaagtacactgaaggtccctcaacttgtcatcgggataaaaaatcgtcttcgaaccgcaaaactagatatgtggggtcgcttaattatacaaaaccggtcacaagaggtccctcagatcccggttttgtcctacatggctgctgagtcagcgtgggacccacgtgtcaggtgctcctcgcgtggagacgaagaagccggcgatggctgcctcagtcacacgatgagcccgcgcatgaactcccactcatcatcatcctcggccacgccggcggccgacacctccgagtcgctgctcatgccgctgctctcccctctggccatcgctgcggcctccgggtagaacgacaggtacggcattgcgccgaacgctttggcgagtgcggcggcggtggcgccgtcggttctctgcttgaacacctcgtgctcgtgctgcatcgagcggaccacgtcggcgcaggaaggccccgccgctctacgacacgcgcaccacgctcggcccgccgaacaggttgtggagcccgccgagggcctcctggtaggtgccgccgaggtagtagccgcgggtgccgtggacggggagctcgtgcagcggcaggctgtgcctcccgctgatgaagtggtcgaccttgccgtcgctgtcggaggtgaggtcggagaggacgccgtcgattgcagggcgctcaccaaggcactggattgggatgattgggaacatctgcccgattgcccacatgtccggcagggaggtgaacacggacaggttgctgtggtacgtgaacacgaacacggacagcgaagaatcaaatcaaaggaaaaaagaatgaggtgtttggatggatggatcgagattagcaagaagaagaaatctaaagcaagaaaaagaaatggaaagaaagaaagggaagggaaattgtatcaaggatgccaaaagagagttttggaaggggaggtagaagaactccaggacgggattttggatctcgggcaccccacgccggcggtcaggagagagcctcgtcgaagctatccacgggccaagaacccaaccgtcgtcgccggcgtctaggagggtggtatgacccggcgctgagggctcctcctcctcgcgcgtgtggctccagctccgccactgctcatcctcgttggcgagcacggagaggaggctgccgccgccgccttcctccccacccgtcggctggtggcgccggcctgcccagagccatagagagaagagtgagagagagagagagaaggggaagagagaaaagaggggaaagaaagagaaggctgggctgacatgtggggcccacgtgggtcccacgctgactcagcagcacgtaggacaaaaaccggaatcaaaactgccgagggacctattgtgaccgttttgtatagttaagagaccccgcatatctggttttgcggttcgaggacgtttttctatcccgatgacaagttgagggaccttcggtgtactttttcctttgttggtggaagttggaacacaccatgatgttgcgtggtgacgggctagagtctaagcatactccctccatctataaaagttacacctattttacatttgagtttttccaaataagtttttcctgagtttttccaaataagttgttcctatttgtaatctttatgcattcaagaattaaatgaagagatgttttattagaacacaaggagtcatctaaatactcattggttgcatgcttacattcactccttaattttgtaacatctaaggtgatttagtttttccttggtcttgatgtcaaaataatatgtgtaacttttgtgggtggagggagtacattggtgcgacctaattttaatttggttacaaatttacaagtctagcaagatgttgcgttttgaaacacgagacacaaatgctgatatactccctccgtcccacaataattcaactcctggattcccaatgcaaacttagtacaaccatgaaaataccaaaatgccctcaacaacaacattacacagaattgtactgtgttctctacactgtcctcactgaaaaaaaaggtttaactgggttctctgcacccatcgattacacaggtatccagaaaaaaaaatgaagttttaaaccgaatatgctaacaaaaaattaagaacctctagtttgaaaaaagaaatcgttaaaaaaatactactccacaatctgcaagatggtttgcatccacaatctgtcaaaaaatacttctccacaatctagaaggagtatgaattaatctgcaagaactagaaagaacaaagaaaggtgtttgtatccaccaaggtggcctgtagtcatgtgtgtatttatccagattgaccctgcaagaagtcatcaccaaaatccaagaacttagtatagttaacaaggtgaaagggtagaaataaacaccagagaagaaagagtgatggaaaaagagtagtagaaaagagtacctgggctcattctaatggcaaagcttctcgaaccacctcagctttgggagacacaaaatcgttggctccttcatcagatccgctattgcaaaagcttgtgcatcaggctccctgcaacagatccactggcgctggagactataggcttgcgcctccgccggcgtagccgagcagcacctacacgttgcgttcgccttctcctgcatcacaatcgcaagcccctacctctgccgccgtgctgctagtgcctcatccgagccatctcaatccgccggggccggcgccgctcccgccgacctgtcacatccatgacatcacgggaggtcgcagggagggagagatggatggagcgtggagggaggggaagcgactcatcgccgtcgagggatgggtgaaggtcgtgaggagaggaaggagatgagaccggtggtggtgggttttttttagcgcggttgtgtggtgggcgagaggagagagacgggcagggataaggatcattgaatatttctcgggtgttgcgcaggagtcggttttttctgggacaaatcctcacccccagaaatcgcttctttctgggacggagggagtacacgcacacacgtatcccaattgaacgcatatatgtatgtgctgctcttatgataatatatgaagactgaggtcacagtgtatcgctgtcatgtcaacaagtacattatctatcattgaaaaataattataccctttaaaatctattataaataagaaatgttaaaatatattacatggaaaaataaataaataaaatttgctttcgaaaagccgctgaaagaagcttttcaattattctttttatgaaggggaaatgccttttccatgacttgatcgaggaatgtcctctagtctgacttcaaaatatagttgcaaatcatatctctagcctactctttggttaagaaagcgcaaggtgctagccagacttctgggttgcgcctagtgggcatatatatcataccaactaatcaaataaaagaaattagcaatcatattacataaaaaatagaccataataataaatagcaataaattaaaacaccactaagatagttaagttgcctaatgcatcaaccaatgcctaattgcgacgactaccagctcctaccttaatggtcgcataagtggcgcctagagttgaatttacaaacgctaagcctactataataaattattaatgtattacaattagattgttaattatattatttaattctgacttgttcaatattgtgcttacatttgctatacaatcaattagagaggcatcaatgattgttactttcgtcctcgcgaaaaaatgattgttacttttgtgctaggctcgtctgcatcctttctatgtatgttttagagctcattggttgccctaataagtgaaagcaaaaactggaatttaaatttaaatttaattttgaagttgattttaagatattttcaacgtagtttctttttcagtatagacttttaagtcactaagaacacatatataaaatttttacttacaaattaatttttattacctaataaatcttttggcttattaataaatatgggcaaatgatgatgaccttacactttaattgttatctgctttaattgctagataacaggaataatttcatttaatttagaaaataaaattacaccctgcctttgcgcctatcaggatgtgcgcgcaaaaaaaagtaaatttcacaaaactacatatattttgataaaattatcacaaaactacagatttaagaaggtgtatcccaacactacagatttaggacaaattttatcaaaaaactacaaatttaagatgggcaatcaccacactatagatttagttttaaaattatcataaaactaaatgttttataccatgttaaatgcaaaattacaacatttataacattagtggtaaggatttaaactacaaaatctataattttgtgataactctagtattaaatctatagttttatgatatttgaccttaaatgtgtagttttataatatgttgtcttaaatctgtaactgtacgataatttgatcaaaatacttgtagttttatgaaatttactttaaaataaccataagacaaacacgaacatatatattatcttgcaacaattcagtcacatatcgaaagaacacggagacctagttaactacaaattaaacaacaccgcctttatgaaagaaactatagcttgtccgatccgttacaatcgtccagagccagaactagattttcatccataatctgagacgatagcttgaacaaatcatattgcacataagcatcgatgttaccagatcaggacacatggggttctctcattactcctcatatagctcagtttgattttcgattgatgtttctacgcttcatagtttagtacatcactgttgattagtacggcctatcaggagcacaaagccacaaatccacatcatttgatcgaactacataccactttaattatagcacatccacaacacataccctaatattcctccaaagcagaaaagattgagcatgcatgcaccctctcatgctgccacaaacacaatcaatccaatgtgcttcaatgtttcattgcctctctaataagacaattaatcaaacccaagctagcttgggcatgatgataccattagtgttcactttactttcccctcctagctactccctccgtttcgaaatgtttgacgccgttaactttttagcatatgtttgaccattcgtcttattcaaaaaattttagtaattattattcttttcctatcatttgatttattgttaaatatatttttatgtaggcatataattttacatatttcacaaaagtttttgaataagacgaacggtcaaacatgtgctaaaaagtcaacggtttcaa

SEQ ID NO: 62087 - DNA, 756 bp, Oryza sativa
gcgcctgaacggcccccgaggcccgtcggagtccagccttgggacccgagggaagtgttcccagctcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctctcaatgatgcggtcgacctggtccggcgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataatggcacccaattcactagtgaactcttcggcgactactgcgaagacatgggcatcaagctctgcttcgcctcacctgcccaccccagaagca

SEQ ID NO: 62088 - DNA, 1134 bp, Oryza sativa
tttcgagcaaattatctttcaaagagacttttacatcatttggtttgcgagactaggttgtcatgcaccatttgacatagcgtcactccagatctaatccgccaattttacttagacaacataatcccaagaaagagctattagatttgactaggaggtacgtagccaccaagcaaaccagatggaacattttggaatggtttaagaccagccatccagagtagaagagaagagcctacaccatgcttatttcaatcccgttgcttttttttttactgcatcaaaactgcatgtagatatggtattcttggtttgtagatgtttataagacctgtaactgctacagaaacaattggtacaggcttcaggtaatttttcacattttcacacatggctacataagaattccgcatgcactaatgttccattagtgaaggtagttacttacgacaaccgagtgtgaaaatagcttttgcaaagcggtttcactaatggttgtatttccataggtcatagctgactgcctctggaaccacattttcacaagagccttgcataaccacgtgtgttctctagaaatcttcatcttctcgcagcttattgtagcgccacttcagtgatcatgcgccgcttcatctcctactcttctttgttagttgagatgcggcgaacgacgccagccctaaaacacagtgcaatcctttcctctccaaaccatcgctcctttctagacaaggattagaagacaagcagctcgccatcatcggagaaggcaccggtgtcgtcttccgatgacctcccctctttgctgccattgctcagggatgagtgggactcagatgacaagtggtttttttaacgattccccaccgctgaaggactccgatgatggggacaacaaggacgatggcaataatgataaggacaatgacgcgacagcaaaacgaggaggaaggcaaggacatggccgagaacaggtgcgctcagtgggacaaggacaagtaggctcggtgggaggtgcgtgaaggatcgaatacaagaatcaagccaaccagagagggggttgaatgattggaacaccaaaaacctaaaactttttgtgcaattaaaagttaccttcgtatagcaaatgga

SEQ ID NO: 62089 - DNA, 1537 bp, Oryza sativa
acatgtatctctctaccaccaggttgattcattgagtagctagtgagggaggaagaaaaaaaaaacaagcgttctttcatttcattctcattcaccaagagatggaaattttgaatattgtacgaatccttatacattgtagttaacgacaagtccattatcgcactaaattcaatttgaaagtactgagaatagtgataaatctttgatcatatttctattaaaaacacacgtatattacacatgtgtaatattattggacatcagaatttaaatcctatcatacaaagacatgcacctagctatgactcaatcttatctatgatagtttccattgattttgaggaaattttagcacgttctgtttgaggattctcctcattcaagggttggaatggtctattgatcgcgcagaaccatccaaaaattacttaaatcaaaccagtaaagtcgatttcagagtaagaatctaagtggtccaatcaccgtacagatctctccaaagcaaacgcatcatgtaccaagttggtacgaggtatctctgctacttgcacatcatcactgccctaaactaaagtcaaccaaagcgttctaacttccaagacatgcttaaccccgtaattagcagatctaattaggagcttagatcctaattaagctaactaatgtgggagtgaagcaaagaaaaaaaacaaatacctggagctggcaaagtcatagagacggctggtgctggagaagacgaggaggccgacctcggcatcgcagaggatggagagctccctcgccttcttgaacagcccgctccgccgcttcgagaatgtcacctgtcggctcgtcgccgttgtcgatcctctttatctctatcttccctctccccatcttccccttcgatctccttctccttttccctcttacagatctacgcagaaataacaattagcagcagcaacaacctcggctatctttcaagccaagctctctatctatctctaatcttgtgctaatctccttagagtgctctttacaggtagctctatttctctaatcaaggctggttagctagctaggtagctagccctgatgcactacaacttcttccttaagaaagtattccaagagaggacataaaataaaaaaaatatatagttaaacaagtacagggcgcgtttggaggctgcacgatgcaggcagggtcttccaggatcaatcaattaatcccttttttagctttcgtctacctcgtcctcatttgttaatgtgccatgataaacatatcaaaaccttcatcgtatcgatggccgacgcgtgcatgagaggatgccccatcataatgctgcaaattaattgattaattcagctgtgtttgtcgtaagctataggttagcttctaatttaattaggttgctagctaatgcggtttcctttattgtttttctgagtttcgtttttggaaaggaaggtgtgatgactgacgaggttcatgaagatgtggaataattagctaagtaaagcaaatcttcatgatactctgtca

SEQ ID NO: 62090 - DNA, 1639 bp, Oryza sativa
tcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacactttttttgtctccaaaatgtagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttattacttaacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagttcattgacggcgtgcactattttttgagagtggccgaagctaacaggaaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcaatttgttggatttgaaggaaatcaaacgggcgaggaggaaatagctgctgatggtaacgacgttgcggatgatcttggtcaaatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtacgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatg

SEQ ID NO: 62091 - DNA, 1907 bp, Oryza sativa
agtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagatgcccttcagaatgaagtggtgcaatgtctcgtcagttttgagttgatatttccaccttcatttttcaatataatgacacatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtaccggaatcacgccatgaagggagactacggggaaagggaactctcggaaggaaagcaattatgacggtagacaacaatttattccgtaaagcccatttcactgttctgcaacactcttcattggtagctccttacatcgaggagcacttggctctagttcgcgccaggaacatcggtaagtccgatgtatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaa

SEQ ID NO: 62092 - DNA, 4168 bp, Oryza sativa
ctcccggttgttgagaacaaccgggagtaaagatccgggggtatatatattcccggtgcgccctcgtcttcttcaccaacacttagacgttttcggccgatcgatctctctcggcctctctccttcgccgcactgcctagggcaaatccccgcgccgacgccgccgtatctcgccgtcgtctcgagctcgtcgtcctcgccgccgcctccgcctcctccgctgccgccgcatctctggggtgagagccgccgccgccagatctccctctctcgatctctccgatctcagctcgatctctctccgtctctctccgtcgccgccgccacgccacgccgccgccgccacggccccgcaacgccacgccgccgccgccgccgtcgccacgccaccgtcgccacgccgtcaccacgtacgccgccgccgtcgccacgccgccgtcgccacgccgtcgccacgccgccgccgtcgccacgccgtcgccacgccgccgccgtcgccacggcgccaaccgccgccccgatgccgccacaccgccattaacgaacgagaacgagaacgatcgaacgaacgagaagcgagaacgaacacgtcaacgtacgttgccgtgagaacgtgaacgagaacgagaacgatcgaacgaacgagagcgagaacgaacacgtcaatgtatgttgccgcgagaacgtgaacgagaacgagaacgatcgaacgaagacaagtgagaacgagggaacgaacgtgaacgagctagggaacgtgaacgagcgaacgaacgaggacgaacgttaacgtgaaatgcaatatatatatatatatgtatatatatatatatgtatatatatatatatgtatatgttacttctcatttatcctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgagttttaatataagattactttatttgtaattagacttagtatataattattgactacggaagtggtgcgacaagtagcaattgactattgtagtcttaattacacttagcatatacgcacgaaacacttagcagacatgactattttagtcttagcatgtaattaatattatttgagttttaatataagattactttatttgagattagacttagtatataattatttactacggaaatggtgcgacaagtagcaattgactattgttgtcttaattagacttagcatatatgcacgaaacacttagcatacatgactattttagtcttagcatgtaatattatttgagttttaatataagattactttatttgtaattagacttagtatataattatttactagctagggttgtataatatacgtcacctagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgaggagatcatgagagctttgtcccagattcggagaaagagatgctgtggaccacaatgctcgagacattcacccttcctgcgggtacagaggacaaagtgaaaaggtggactctgaagaaaatggcagaacagtttcagaacttcaagggagatctgtacaagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtattcggcgttcagatacgagaggctgcgcaacgactaacagatgcagtggaagcctcctctcagggcacgttccgacccgacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcgcagagcatggacgccatgcaaacactggacgaatcgacctgtcccgttgatgacatcactcagcggacaccatgtgagctgcatattcctttcaagaacttatcaataaaggtaagatttagccattccgctagttcctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcatgatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctgcaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacgggtcaattgctaggagtcgcaccaatcgaaaaggcggaagtgaaatacatgtacga

SEQ ID NO: 62093 - DNA, 1307 bp, Oryza sativa
  unsure (1)..(1307): unsure at all n locations
tactcccttttatcgttgtagaatggagattcaaagggcccgacggcggagggttttcgatactggattcatcgaccctcggagagtaaacgtcgcaatgctcgaccaatatccacaagaaacagaggacaatctcgtccatctcctgaaggcgcagcattacaagacgttcatactgttgccgtacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttaattatgttaattgctattacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcagtacgtagcgatttcttgttttattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactactcgctagctaggacannnatggattgtaattaatacatgactacatctgtttctatatgcatgtgtacacattttctacaatgtaaatatattttggtcatatatttctatatacatatgcatttgcataacatatatatgtataaatacatatatattatgcatgtatatatatacatataatataatataatatatatatatacatatatatatgtatgcatatatatgtattgaaacatatatatgcatggtttatatatatatataaaccatgcagcaacaggggctgcaggaat

SEQ ID NO: 62094 - DNA, 7297 bp, Oryza sativa
ttactttaaattatacttgttttttagatgcatttaaattaagatagtgccagagccagcggcgtcgtcaagccccggcgactaatagtgttttacgatgattgattaatttttataggtgtcaacggctatggacagtggagatggcagcgactcggacggttgcccgacttgtccgggaggtggctccgccactaaattaataggacttttatgatataatttaccgataatatgccttgctagtattaataagtacactttaaaaatttgcaaaaaatttaaatagaaaaacaattttaattttatattaaattctatttaatttaagtgagaggacaaatcaatataaatatttggatcatttatgctagtagtatatattgcttgtaaattataaggtaaacgttatcaaattgagatgctaatttaattagtcaaacaacctactatgtgtttcctttcgctacctaggacggaaggattggtctaaacaactgtgctggtaggtacagcagcaagtgtttaatttatagggcttaagctgagtttgtttgagcatattggctaggctaaatacttacatgcaaaacaaaaaaaaagtaattagtatatgattaattaaatattaaatgttataaattaaaaaacagatttatttggttagaaaacttgtatatagaaagttttttttttaaaaaaatcaccatttaatagttcacggagtgtactaacaggttgaagctagttgctctttagaactgggcctattacgtactccatccgtttgaggctatttgacgttttgactttggttagagttaaattgttttaagtttgactaagtttatagacaaatatagtaatatttataatactaaattagtttcatcaaatcaataattgaatatattttcataataaatctgtcttaggttaaaaatgttactacttttttctataaacttagtcaaacttaaagcagtttgactttgtctaaagtcagaatgttttataatctgaaacgaaggtagtatatatatacacagggcttcgctttaattaatttgtaagtaaaaatagcaatgtccagttccttactcattactaatttgcttataaagcgaagatatgtaaattgggataactagcacatgcacgttgaatattaccagtcatgccatgaaagtaaagaaggtttaagtacgtgtccttaatccaccttagagaatctgaataatgtatttatcgtatttatatttttttgcagggtattcataatttatataataataatcaatcactacgtaaaagtataacaagtcatgacgcaatatatgccttaacccaaaatctctcagcttgaacatggccaaacgcatgcgtatctctgagctatacaaaccaccaaaccacatgaacaagggcatatatgcctttttaccgtgaagttaatactattaagttgacttaacggaatagagataaacttatgatttggttaaaagaaaagcgaggacaaaatcataaagttgatgcgaagtgggtatagctcaattgtttaggttccttgtggtagaaccaacccactcggggtcaagtcctagatttgacacgggttatcgtatttacgactatttttctttcagtggtagacgacgtgctcttcgactgcgagatgtctgtggtaaaaaaaaaatctcccaattgccatgcatatatcatctagctatattcatatataacaataacaaatctatatatgttctatattcatatataacaatgacagaaattaattaaagctcattttttacagcttttagacggaaaacttcaaccattacaatggagagataagggtttagtgatcaccatatatatagatgcggttgaccagctcatcaatatcggtcattaagttacttatcattgccatttctcaaaacattgctgaaaaggtatcttttaaatgattttagccctttgttttgtttatcctatatcgtgattcgtggggatatgtggtccattattgatttgtcgtctagttcatatgcatgtgaggaaaccactatattatatctctctcaggtgaagtcaataatacttctgaagtccaattcgtaaccgtgaagcaagacaattcaatttagtataattaaattaatcacttgattttaagcatgcgaaatagtgtatatattacgtaaacttaattacttgtttgggcttgtcagtcaagctaaaaagatgaagtccaaacaaacagataagttttcgattgggattttcataaccataaactcactctcttttcctatttaagctaaaagctagattttaataactttttttcttatgtggattagattagctagaatactatccttgaacttttgaggggcttaaaatctactggcttatgcaccataaaaaccgaaaaatcagcttaaaatcttaagctaataagtctaaatctaaaggtgccttactctaactttaagttttgttcatatatcaaaagaaaccatcatagttagcgtctcatatataaaagggttaattggatccatgccattgtaaatttgcctattagaagaatgctattataattcgtctatttggaaccgtgccactggaattttacaaaattagaaccgtgccactaccgtcacgttttccatccatctcttccttttccatcttcttccttctttctcccgtcttcttccctagcctcctccgccgccagccgcacccttcctcaccggcggttgtcacctctcctattgtctgggcacagcgagagtgagagcgacggtggcttgcaacgatgagtttcgatggatgaatcggcaccggaggaggaggagggcgcgcatccactctgcacaagcacgagaggatccatggagcccgagcacaagccgcactacatctcattcccccgctccaaaccctagccgccaccagctactcttccgcccgggcaagtcgacgcccttcaagcactccttcgctcgcccgcctgtccgccgaggaggacgcagacgagcaaacacctgtccaccggagtaggccactgcgtcggagtccacaccgctagatctgagccatagtagcattaccctcgtgccgtccagcgtttgctgatcctcctcgcgtcgttggtgtcgtccagtcgtcctcctcgtgtcgccgctacaatccgctctccatcctcgagctgccggcgggagcccgtccatcctgctcgtgtagtcgccgtcgtccacttgccatcggaggaggaggaggaggagctccagtggaggcctgggcttcactggacatgagaggggaaaaataagaaggaagaaaaggaaagaggaagaagaggaagatggaggaagaagaagaaaacaaaaaaaagaacaagagatggatggaaaatgcgacggcagtggcacggttctaattttgtaaaattccagtggcatggttacgaatagacgaattgtaatgacaattttctaaataggcaaatttgcaatggcatggatcctggtggtcctcctcgcgtcgttggcgtcgtctggtcatcctcctcgtgtcagcaccactgtcctctctccatcctcgagctgggagcccatccgtcctgctcgcgtcgtcgctatcgtccacttgccatcagaggaggaggaggaggaggtctagtggaggcttggcttcactggacatgagaggggaagaatgagaaggaggaaaaggaaagaggaagaagacgaagacggaggaagaagaagaaaactgaaaaaaaaaatgaagagatggatggaaaacatgacggcagtggcacggttctaattttgtaaaattctagtggcacggttacgaatagactaattgtaatggtatttttctgaataagcaaatttgcaatagcatggatccaattaacctatataatgccatcgaaattgtgcagttgaagcatctgaattttttttgtggggaagaagcatctgaattttgaccaaggccaactgatgatgggagcctagttaacataatttctccaaccaaccactgtgcatttcgaaatttagccatggctacatcatagctcatcgcgtggtaggctggtaagtggcggtgagtgcattttacaatgtagtaatttgcttcgatgtgtagcctcaagggtcctaggataggattgcaggaataggatgaaaccatacttaagccactctcctcttccaacgtatgcctttagttctgataaaggatttttttagtccctaaaattttctagtccgctccgcacaatgttccaatttataggtaaattcagaatctatctattactctctccgtttcatactataagtcgtttgactttttctctatgtcaaacttctttaagttcgaccaagtttatagaaaaatatagtagtattttcaacacaaaacaaatatattatcaaactatattcaatgttaagtttaataaaactaattggatattttagatgttattaaattttataaaaacttagttaaacttttcgatcggacggccgagcaccgagatcgaggcaacgaaaccttagcccgaccttggttgccaccgaaaccctagccacttctcctccctccctcgccggagcgggagcgccggtgaaagtggcggcaccgccgcacaccccctcgccggtgtgtgcactcgcccgagggtgagtgcgccaccgtcgagcagccgtgccgcggagctccggagccgccgtgaccgcgtgcccctcacggtgtcggtgatgtccggtggcggtagactttccgcgtgcatcggccggcaatgaccgacagctgcggttggacttcccgcgtgcgtcggcgatggccgacagcggcggatttcccgcacggcgtcggtggacttcccgcacaacgtctaataacaacaaaaatactaatcataaaaaaatttcaaataaaacgaacggtcaaatattggatatgcagaactatacttatattcggacggagggagtaagttttaaacttttaacatgattaaagtggttcggactaataattgataataattgtagtatgagtagtttaatggtaaagtcaccgttataagtatgggttgttataataaggacaaaatttaaacaatataagatgttatattttaggatagagggtgtaaggcagaggctatatgattagtttgagggctacctagttttcagccaattgaaaataccccaaatttcagtcaatttttttgaacggccaaggttgcatcgagatatttgtgtgaacagtaaatcttatcatctcctcttccctttccactccacaactgcattcaagctcaggagctccatgcactcgagctcgctaacaccaccctttttccatcgcttgatcatgttgtccctagcctcaccagcaagctagaagatcacgtcaatggtgctggcgagccctgccaaactgggatcctcccccttacaactcctcgccttcctccctaagccagcagtgacaccatcccctcccccccaacccagccatccactctcttcctcatctctggaggcttgcgttgtcggattcgctgccactgactgccacatcctaacccatagcctccctctcttccactgccaaccctgcccaccgtcagcccatctccatggctccggtggcacccctaccgcctcaccacctatccgtcgacaccatccaccactgttctagccactgcccaaggccatccctctaaacctggggaaacccttcttagcccccctcctaacctgacctcggccacaaaccctaaactctaaactcaccatcactgccacattgtcaacggagaagaggagctcgctgttgctgtcgccaccgctaggaagtcatcctcgggtgagtctctcctccggcttctccttcctccactggctgaagctttaagacgtatgattctctgatcgttggatttcaatctaatggctaggaagcattgactaagaattgggggaatcacagtcacctgaggagtattagttttatttttttacatggcatgcatgcaatattatattttaactattattttcttaaaattatatgaaagtagtttcaaacacaaattcaattgtgttacatactaattatatataaatatatatattgttaactaaattattattggtcagaatctagaaatgttgatttcttagtaaaaacatgcacggcttatattttaaactaccctaatcttcttcatagcggacttgtctcccacctccgcactgtagtagcatttgatgatttaatcgtcatgatgaacaattgtcaaaggtgagtgtttgttgaaaatatagtgaatagtgtttttggtttgagaacgatgttgtccactctgggaggcagttcagaccggacgggtaccaccggtcagaccggtggtgattgggtggtctgactggatagtccgacagtcaaactagtagactccaggaggaagttggtttcgggttgtcttcgtggattgtctagattgctttatgtttatgacttctagatggtatctatttgtatgtgatactattgtgtgctaatgtgagtgatcaagttggtgcaaacttatactcggatatggagtttctttgttgttcatgtgcaggtgttgcttgaggccatgggagtatagccagcgatggatcgggactagccactaggcttgggataaattgtggtctagacggtcaaggatagcacacgggatgctcagtctatagaacaatgcatgtggagatgaatgtttccatatggcatacacgtggtattgtgtgcacatggaaagatgagtcaaatttggattggagtccaagtttggaaagattggagtatggagttgtatggggatgttgtttcccttgtttggtaggtttcctatgtgattaggagtcctagttctagttggattcgtggataggggcaatcacattgagggtataaatagatgaggggttgagatgggaagatatcgattttttcggagagaaaagttagggtttgcctcaaggtttcaaccctagttcgtcagttgagagaggagtgctttagatgcacttgtagacacatattgatggaataaagttgatctactcacaagagtttcgtcaatacgtgtttttctggatcccgatggtttagactggctaggaggcagcggttagactggcgagacaccgacggttagaccggtgacatcaatctggtcaaaccg

SEQ ID NO: 62095 - DNA, 6507 bp, Oryza sativa
tcatccatggcagatgcttctcgacttctggcgagtgagattgagatgataatgatattagttcaaggtggaatgggtatggttgcaggttgcttatgctagtcctacccttgttagtgctcaaagataaaaactttctggacaagataaagcgacaacagaaggagcaggggccaaatggacattccacatcagcaacgacacattggcacaacactctgttaccgttgcatggacgaaaatagcacaaaattataaaaaaaagaatcattccctctcttcgtaaacattagcgcaaaattaagaaacagggccgattctgagattttggtggcctaggacgaaattaaaaaacatgggcccttaattttacatctaaactcccgcaagaaaaaaattacatctaaataataatcaatatagcgctaaatagcacacaacgttttacttatgcataaatatttttttaccgctacatatttaatctgcatccaaaagcaatacttacagaaaacatcataaacatttctagacgcaaagtcattatgatagtatccatatcaatctcatctagtggtgtctcttttttttttacgaaatctagcatttctttgtcaatgtacaaagttgccaaaccgtttaaccatttaatttatcgacgacatggtatgtagaacaagcttagacaatgaaaagttggaatattagtggtcaaactcatatgggttacaaaacttagaaagtgcatagttaattcaaacaaatctttatttgcaaatatgcaaaaggatatattaaaaagaaatcaacatcatgatcagttggaagtcatcacaaagaagagatcagaagccgggatagcagcagactcttataaagaatttaaacaaggggttgtggctgggcggatgtatgatggtagatctgtactcgttggcttgtcaagctcgtaggctgccagcaggcttgtggcgggatcgggattaggtgcccctcccccctcccccatatcccgggatcgggattaggtgcccctcccccataccccgtggctccatcctcagcaccaggcaaatattctctctcttcgcaaacatattagaacaaatacaaaaatgattacaaacagtttaaaattttccggttttaaaagaccatatccaagccacaagggtgacctactgatcgattatcaacttgtcctactccgaatttttctatcagccccctcccagattttgtaggagcatatgcctctcaccacgtggacttacagtatcccgtaccctgcccccctgccctcacgtaatagggcctcagtgcctcaccatgatgccctttatcattcgctcaccactagagcacctacacctttccagtgggcccaccacgccctggacacttgttaacagtttatcaatgtaccatatccatttcatcaaatgccatatctgagagcgagagagagagcataaagctatgggtatggccaataataaagaggccaagcagcagctggtgaaagaagagacaaaatagagtacagtgatgtaaatgtacatgaacacagtggaacagcgacacacacacacacaccatgcactttgctcagcttgtttcagagcatctatcagctctgagtcgtcttgagtcttgactactactcgtactaccactagctctcttgagcttgagcaccagcccaggctctactgcagcagctgccatacatttctagtagctgattacatatcgtatacttaattagcactttgcacttgtgtactagtatgtgaatgtgaccatgaacaccccccccccctctctctctctcgcctgcatctcatctcttcttttactacctctgttttttaatatctaacgtcaacgacgttttggcaacgtttaaccattcatcttataaaacttttttgcaaatataaaaaagtttagagattttctccggtccagcaaaaagtacctcgaggtaccggtacattacggtactgaatcgtttccgatcgttggatctagctggacagtatggacattgttagatccaacaatcgaaaacgatttggtaccgtgaggtaccggtacctcgaggtactttttattggactatagcaaatctaaaaaaattaagtcatgtttagaaaacatttgacgataaatcaagtcacaataaataaatgataattacataaattttttgaataaaatgaatgatcaatcgtatctcaaaaagtcaatgatgtcatatattaaaaaacagatggattaaggtttagttttgccccttccattgatctggtcataccacaacacacaattgcacacatagaattaagaagaacaagaagacgtgtgtacaagtgtagtactccctccgtttcgtaatgtaagacttttgctcatattcatatatatgttaatgaatctagacacatacatatgtctagatttattaacttctatatctagattcattaacatctatatgaatgtgggtaatgctagaaagacttacattatgaaatggaggaagtagactagtagtgacggcaatggtagaattatcactatcagttattgcatccatattacatgtactatcactatgttgtgtacttgagctaggaagagcataattcagtttctgcctgatataaagacacacataatctcaagtggagttgttattggttggggttagtgctatcttcagcttcactaatgatacctccttaccctaacaacaaccttcaccatcaccaccaccattgcagctcaaaccaagaaccacacttaccattacatccaccagctttcctcatgtccgcgccgtcgtcgtcgtcgtcgccgtcgacgctggacgagtacgacgcgcgcttcttcttccccggcgccgacgcgtacaccgccggccaccggcaggatgaggagacgctggaggccgtgctgcggcagccggtgacgacgacggccgcggcggcggcggcggtggagggaggtggcggcggtggaggaggaggcgccgggggatcccccgcggcggcggcggcggcgacgcggaggcggccgttccggacggaccggcacagcaagatccgcacggcgcagggcgtgcgggaccggcggatgcggctgtccgtcggcgtcgcgcgcgacttcttcgcgctgcaggacaagctcggcttcgacaaggccagcaggacggtggagtggctgctcacccagtccaagcacgccatcaaccgcctcacccttcccgactccgccgacgcggcggcggcgcccgcgttcgccgccgctccaccgccggcggatcagcattcctcggccatggccgccgccgcagcatcggctgcgaaggagaaaggggaggcgagctcgtcgagcaccaccaatgcgtcgtcggcgcgggcgagaaacagagaccacgacggatcatcgccggtggcgcccatggacgagcgcgggcgccgcggtgtcgagctcgactggacggcggcggcggcggcgagcaccgagcagccgatggacggattggagtactacttccaatactacaatcatctggaggagataatgagctgcgacccaacgacgacaacggatgagtaaagccagtaaaggtgatttcttgtgttaaacaatcaaacaaaaataggtatgaaaactttgaaggctttgtatttatatggcttggttaatttggccttcctctgtcatgatattttgctacttaatttgctagttcacttctctatgaatcaattatcaataccggtttggcttgttatttgttgttttttttattttgagaaaagacttgttgatttgttgataacttgatatgctaatttcgagtatttgttacttccgatttttggatatgtgctatagtttttttctggctatattttctgatttttggtttgtttctatgtgctagtttttggctgacttaattttggtttgtccatgtgctaactttgagatttttgaagtttctctaattagttctccggtgatccgtggttggccatacgagtactcaattcttaggaacattttgtatcgaaaggtttgagctagaaatttcaggtgtaatccctgcaccctagaattctagctagatagaagaaatttaatactcgatcttgatgtttttataacagtaacagcatgatgacaaaccaatattttgtcctaaaaaatataccattgaacagtaattgatgttgtaaaatcatttcagtttctctgctaatgaaaattgagggttccttcctcgtcatttttctaaaataatggtaaaatttattgttttgcatgagaaggatgtttttaacttgctagcactagatctgcaatcacctgcatcaggatcataagaaccataagtgcctaagttgagaaactcaaaagcatgcataaatatatgatatatgatgatgtatgaaacattttatgaatttggtcatggtcagaaactaacatcaacaggtaaatgtatatcctttgtccaaattaagtttggggacagaggatgaacaagctagttacctatggttttgcaagtaatttctactatataaaagaacctagtggtggtgaatctgccatcccctcaaatagagatgaggtcttctatggatgaataaatatatcttttgtgcatgtggcttggactttttggatggatgtttgcttgctaattctatatatttttttccgagaatatataattctcaagttaaaagatatgatatttaaaaaaaatcattgcaatgcatgtaatttttgaaacctagtacaacataggacatcatgaatacatttaacatatatgtgttatagttgccttcacaaatgatagatgcttttgtagttgcaaaagagtgactataatatatactcctatatctttttagttaccttcacaaatgaagtaatacactgccaatataatagcttatttcatcctaattcttcaacaacatcaataccattatttttttcaatgacattaaccaatgcagtccttattttaattttattgcacgcaccatacatcccgcaatgaagatataaattgtgccttactacgcatacctgaatgcagatatacaatcatgctctttatatgatatgtactaataactgcatatgtccacataagagtatagaaagcttttgttactttcttacagacaaaaagggtaacttgatcatgctccattgattggttaagaatggcaaatatctcatatagctgtatcatacacaaagcagagcaacaccagctggtttagagtaggataattaatttatcccatgcatcagcaaaatttatctaggtggtataatcagttttctatcttaaagtgtataattttttttataacagataaataagcttcggaccacttttcataaatgtttttttttatgtagaggcagacctaattaactttaatttttggggtgtgatttggtattcttccaccagaaaacatttgaatcttaaattgaaatataaaatttaaatatttcctgcatatttattactgtacagtattgactctatataatttattgcaatcacttatgcaatgacaaggacaaattaaaaagtatctggagtcaattaaatcaatttcctttttattgctcatgtatttacatactgcatttctgaattatacagactagctatagtaaacgtatgtgtaattgtcattttcatgtctataaaattatatgtatgaaaaggatatggtaaattgaattgtatttatatatcatggattttttatgcatgcatttttttattccagttccatgaaattatgtatttttttggttgattgcatgacagcatgcagggagggaattaaggtcttgtttagttcacccccaacttccaaatttctatcacatcacatcacatccaaaactttcctacacacataaactcctaattttttttcaaactaccaactttccccaaactttcaacttttttcaggaactaaacatagcctaagacatgcatccatatcagtatattattatatacctaatcttactgatcccgcatatacatataagcaggaggaaattaaaattttgttttgttatttgttttagatatatcggtgcttacactgagatttgtctatggtgcactctacaacaattattattactctgtcaaacggaacataactaaatgtttggatgcatttgtaactgacctttttagcttcattgatcaaggtcttgtgaatatagagattaaaaaaataactcagaataaaactaacgggctaggtgccaacttttttaactactaggtgaaacctcgcacgttgctgcatgagtttagtatgataacaataagtaaaaataatgtataagatagctaaacaacataaacttatataagcactaaaatcaattgatgtgatatggcttaattagagaagagagaaataa

SEQ ID NO: 62096 - DNA, 10081 bp, Oryza sativa
atcatatttatcatttaaactactcagtgccaacattaatacgatgaaaaataaattagaaaaaataaactttataaatagctaaaacggtactctttatatacggaaatagcgctcggttgatagggaatttctgtaaccgttttggcccgtagtcctcacggcctcaccctacccttctctctctaagatgaagttcgtgcgcttgtcttaatttctgattggatgccaagctagcgtgcaatccacggatgtttcctctttcgtgatctctccgtgattgatttggacggccacggacggttcagatcgatgtccggtattacgcgtttctcgtttcagaatttggcttagggcagcaccaatagtcccctaatccattcccaaaactggttttgagatattttagtccagaaaacagctccaacagatccctactctcatgcccaagatttggagttccctctcctgaatttgcctctcccgctcccagtcgtgtgctcctcacctctctcttcccattcccgcgcttgggtgcgatctctttccacgcgggaggaagaaaacgaaaatttatgttggtacgtagtttatttaatagaagggtccacttttagtttttaggaattgaatttaggctctcttttagagggagtaattttttcgcttcctatattttcagtttaggaaatgaaaaattaaattttgggaagctaatctattggtgatgctcttagctggatttacagatggtagggaattcattggctatcttggatgagtaaattttgctttgcgccaccctttattatcgttgtttcgatttggtccaccttttaataaatagtttcactttgaactgggtaatttatttttataacaatttggaccacactcaatgattttatctatctgcggctgtgtttagttcgtgtgccaaaatttttttcaagtatatggacacacatttgatgtattaaacatcttgtaaaccgcgagacgaatctattaagcctaattaatttatcattagtaaatgtttactgtagaaccatattgtcaaatcatggcgtaattaagctcaaaagattcgtcttgtgatttacatgcaaattgtgcaattgattttttcgtccacctttaatgctctatgcatgtgtccaagcatttaatgtgacggaaaagttgaaaatttgaagaaaatagtttgaatctaaacacggcctgcatcaacttgtcataatataactgtgggagtttattagtgtgtaggtgttgacgtcgcactttaaatcattagtatgcttgagaaatgagttgggatgatcctaaaattacctgatccaattcaaagagagaacatttgttaaaggttagcataaaataaaacatctggtactaaaagatgattcaaaataaaatttactttttatatgtacagtacgtggctatagatcgaattgaattgggcacagtgctggctggccggttgcggatggaacgttttgtaggttttggcggcacgtcgtcgcagcagcagcagcgattggacgcgcaggacatttgttattaaaaactggctgccggggccgggtataatgtacagtccgctgctagtagctgactgttcaaagcgcactagtagcagctggcagcagcatgcagcaggccagcagctactaggatggatatgatgcagatctctgaagtctacaaacctgatctccgagagcattcaccgtgtgtaacagtggcatttaactatttatcgcttttaagatacgatgataatagatttgccacttgttatctgacatgtagacccttatatgtgtctatgatatattaaaccggtgacaaatctgttatcaccatttataagagtggcaaatagttagttattcctatgtaatacggtaataagataagatccatctactatgcataaagcaatagagagatatgtgtaatgtatagaacacatcaactctataatgggacacatacctatgagtatcaagatggactcatgccatacttataataaaatattatttttttatttaaagtacgtacctggtcttaagggaagagcactacttttgctatgttagtgcttgagacctgtgtttgcaatgtgtagaacttttgctacattgaaaagattttctcagttacaatgtataataaaggttaatttataatgtgggaattagctagacatgtgcttgagacctgtatttgcaatgtatggaggctttgacggcaccgaagagggagggttcgacagtcgcactgatgggccaatatgtggctgctgcagcagcttccagagccagcacgttggtgagaagggaagcaaaatccccgagcacggctaggacgacctccatgagcaagcgctagctactcctaccactccaccgctgcaaaatcctcccccttctcaaggagcaacctgagcatggctaggacgtcctccacaaccgccacctccagagcaccgcttgctgcctcgggcactagaagatcttgccacggctgttgtagtggtgcgaggggaattcttggtggtgtcggcattgaggccggtaatggtgggaggtatgacgataggtgtggcaatttcctcgatgaggatggggacccagtggttacccgcccctacggggccggcggcagtcccaattcctacccctcaagtgagttgggtcgaggtttaagggtaaaatttttttgtcatgtcacatcggatatatggacacacgtttgaagtattagacatagtctaataacaaaacaaaattacagaatctgtcagtaaactgcgagacgaatttattaagcctaattaatccgtcattagcaaacgtttaatgtagcaccatattgtcaaatcatggaacagctaggcttaaaagattcgtctcgcaaattagttgcaatttgtgctattagttattttttagcctatatttaatacttcatataggtatttaagcgttcgatgtaatagggtgaaaaattttagggtgggatctaaatagggccttaggaccggaatgatacaatttaacaaattctaaaacccacatctatgttaataagattgcagtcctgagtttaaaaaccggccatacgctttattcgaaaaataaaaaaaaaacactaacgaaacacttaaggcggccatatatacacgagactgtgaagaccagtactgtggccactatagctagtaggagtatgttggatgttgctagtatagcgctagtacagtactcgatcgtacgtagctggtccgggctagctaggtgaggcgggcggcgaggtaagagctgcggagcgatcccaccaccggtggggcggcgccagacgccgcgacgtgcgtacaagcatatgatgatcatcaacgcgcgcgcgcggtgtgagggccggccggccgccaagaaatttaaggtgcgtgcggcgccggtggcgaggcatggcatggcgtacgtgtggattgcgcgcggagttcgatcgtgcgcgcgtcgtcgtcagagaggtgccgcaggttcgatcgtgcgcgcgggccggctgccggccgacggggctcgcccccgcgatgtgagaaagtactctgggatgccagcgaggatgttgctagctctcctcgagcaaagaacacgcaggatcgcagtgtctcagcagcacgaactcgttgctatgggttaatatggaatccatgtcattgcaaatttatccaattaaacaattccactattttcgtgacatcaattggttgccatcagaattacgtaaaatttaaaccatatcattacagggtggatccagaataaaatttaaaaggagactcatctccttcttccttttaagttcccctactcttcattttctccctattcttcccctttcatctccccttctatcaatggtgatccagcgggccggggtagggggactcaagtccccccagcacccacgctggatctgcccctatatcattatatacgtcgtctcggacacagctggaccaggtttttacctaccatacccggccctagcctttagaggctggcaagtggggcccaccttggcgaggctggtccttgcatgggagctcgaggaggacagcgacaggtctccaagtcttattcatgccactttggtcgtcatattcgagaaggatggggatggagctcaccgtcgtcttcgagtcttcgtcattgctgccacctggcctccttgcaacacttcgctccaagccgctgttgaacccgtctgtcactagcattggcaactttttttgacaagttgacaagcacgattgcaacacctaacgtcttgcggtaatcctagagtcgccaaccacctcaatctagtaaaaactagaccaagatgggttttgataactaaaccgactagcgaagccgatttctagataactacccgtctcatgggcaaaatggaaggttttcaggacaaacctacaaagaggtgtcgcactctcgcagtggcggcggacggtttacagcccaaaccgacaaagatggacaaactaaaagaaaactaaagcaatatgaaaaacgattcgattgattgattgtagattgattagttacaattaaaccggccatgtccctataaggggttggtcttaccctctacaggccctcctccacgttcaactcggggtagaaaccaaaggaaacctgaaacatgccttctcgagcaaggaaacttcgagacccgacaaaacacactcagactcggaccctgccggtcagaccggccacacaccgccggtctgaccggccaacacatggcggtcagaccggcccacttcagaggaaatcggcagacttccaaactttggcaattttttcctattttaatcctaggtgccaaatttgggtataaacaattggatcttctcgcgctactactagaccctccaccactgcgagaagctcgccgccaccaccagatgtgctccatccactaccaaacgtgtgttgacgaaaaatctgcactcgatcgatggtgctagatctgtgttggcgcgaactaagttgacgaacacaacagcctgggagttctgcttagctccagtgcaggttctaaaatcgatgagatgtgggcgtgccagtcaatttgatccagcaactggtaaaatagataaatatgttgatcaccaaagagtcgatcggctaacgagccgatagagcgatactagccgatatggataccagccaatgctgatgggattttgagcaatcggatatatgtccaatgtagaacctgacacttgagtaaatttttttttacggttaaacaatacgagaggctcctactgtgctatattaataaaagaatggatgtacaaagggtggatatacaaggggggaggaagaggaagcaaaaaataaagaaaaacaattaaacaaacaattagatcagctaaagttttgtttctatgattgccagctgggtttgtctgcaacctttcttcatggaagtgctaggaattggatgttggaatatctcgaatagaagaaatgatctcatattcaataatgtgcccatcaaccttagtaaatggaaatccgacttcagagaggattttactcggcatatgcacagagtaaaagttgcagacacttgagtaaataatggcataaagacaatcggctgatgataatgtaataaaacaataatataatccaacataaaccaatcggctaataatggtatgatacaataagcattgatccaaaggttaaagcatatatcggctggaagtttgatgttgttaaatccaaacgaatagataatcagtgaaacctttattgcgattggctaaaaccaatttgtatgtaatccttataagttgatgcaacatccagataactcattggctgaaaccccgatgaaacccttattggtaatcaaaaagtagtctagagactatggttctaagcacgacttagtaggtcaaacccaattgatacaacactaagtataaaaagaaatataatatcttgacaatcaagcctttgattgattttcaaggtggtggataccttagctaatctagatcaacaaaataatttagctgatactggcaaaaccctagaaaagatctgacggatacaagtaaattgaataatcgacttggattaactaagatatatgataaacaggtaggcaaatatatcaaccaaaccatagcgatacaagaggtcgaagcgatgtagtcttgaacaacgccaatgtagccgatacaattactaaagctgacggacgtaggacttaccccttcgccgaagatcgaaagccaatgcagccccgtgtgcaaggtgccaaattctgccggttggtaaagaaaacctcaaaaaagagggtagcgatgcgccaagagtagttgtattgatatgtgagataaatccagcaaccctgggtgtacatatttatacccatgggtagataagagtccttatgggacatgacacaaattttcttaaagataaaaagaaaaacataaaagccttatcggacactaaacacattttcctaacaattaaaggaaactaatagacatttactaattaataaataaacccccataccgcattctccttgaactcggtttcttttagataaacttactttaattgattaattttcttaaccaaatctacccagaatctgaattgcatgttgatatgacacacttgcatgttaagttttaggagtcagtggacatcaaatgtatagtaagataggatatggtatgtaaaaacttgatcagcctatagatctaacaaggtttttaattgtgccgcatatttcactttgttggatcagcctgcaatattaagagcatttgcaataaaaaaattatcatattatggtatctttctctatgcgagtagtttgagtagaccctaaaaagatagtactgtcatactatctcggtcgactgaattaccccccctctcaaatactatatattttacattctcaactatttaaatcggacaaataaccccctgactcgattcatagtggttcagatcctacgtggcagtccaatcagtgctttttattaaaaaaatatggagcccacctatcagatagaagatagaatctaacaggtgggctccaccgatcatagtgttgtgtttatatagttaatatattttatctatatccgtgggccccataataattcctagggatatttatacattgtaggaattttcactacttggtatagttaatataggccataactctaataatatcctactacgagcgctcataaaacaaatataccgcgtgaaaactactctttgggtatgtttaggggaagcttctagctgctgtagcttctcctaggattagaagctcctccaaacaattcagcttttgatccagattctgagaaactgtagttgtagaatatagaaaataaactagaagccagaagctgggaaacccagcttttccaaattctctgtgcatatgccgagtaaaatcttctcggaagttatttcttcgaattttaagctcccgagagtcactttgattgagtgctcataggccacatgtaccccttgttgagctggcaggtcaaatatgacgtggaagtatgaagcactcgcaagtcaccgtactgtcctcatgagaagctgctcagcaggcgtcacctctgcgcctgtagcttcagaaagcttgtacacaaaagcagcgacagacggggtagcagtagtagcacgtcatacctgtttagaagccgagcaacacatgtaccatcacaaaagtctctaaacaaaagcatcatattcataccacttatgtaacacctttttcttaggcattcctattgttaatcactggactatgcacggtatctcacaagcaacatagaggaacacaaaaaccaattagctagaagtagcagtttactacctcaaacaattgcaagatgctagctgtgataaagctccaaatgtacaagtatgtgaccaatgtttcatactgaaaaatgctacgtttagtctacgtgacttacatgatttacatcttcaaaagcggtataccgtgttcatcctgatgcatgacagcaatttttttttactgtaattaattcgttgcggtttatctagatttgatgggggctatctacaagctataagcatcgaaacagcagagcctcttcttcagcagccaccactcgcaggttcaatcgagctccggaggccattgcccctgagcgacgtgcagtgctcctctgcctccgactgagagcagatgatcaccactgacagcccgtttacatgagcctcctgcatgatgttgacggcattgtcgacggtcatcccggggataactttcatcaggacttggacgacgtactcacgcctgttgtagttgtcgttgtggaggaggactcgatacggaggcgtcattttgcgggattttctgcagatcaggggaattgtgttatatcagtattgaccaacaaaaactatttcaacaggtacaagacatccgatgtgaaaaaatattactcagtccgtctgaaaaccgatagaaattccatgtagcctttcaacaaggcaatgcttttgtgtagggacacatgtcttgctaaggcacaatgagcaatattcaagaatagcaactatgtctttagccaatctgctggtctggtcagactacagaacatcagctacatgacatatgctcacaaggataaaatgatcaatgtatcagaagccacttaattcagaaactagacagcgggtccagtaatcattgaaagtaaaactcaagacatgtcactatggtttcaaacagattaaagcattggcaaacaaatcattgtaatggtacttgtgtacaacacataataaaaatcaaacatgtttaaggaaaatcaagcaatgatgacaatagaacatctaaaccacctttaaaagaaaagaacatctaaacgagctaatctgaatatagaattggttcataatgtgctgcaacaatcaactttgtttatgcctgaaaaagatagtaaatgtaaaatgcgtagcaacaaaggtaatcctatcttcctatatatttggtacccactaaggggcatttactcttataaagcaagacatgcaagaagccacatcaacaattttaaaccatcagatcacattagcacaatgataacaacctttggatcaagaagctacttattcatccaattcaattttatttaacccttcctcccaaaaaaggcaatcaacggacatatcagtatatcccctactaggagaaaatatgcagagatggttctgacaccatttaaaggaacgattatgttcccacactagcagttgattttgatggcatgccctacttgacataactctgataagagcaagagggtgtttctgaaaagatgcaaactgaaaattgcgaaacagacatggctagaaaacacttcagtagttcagtttcagtcaagcgggatcctatgactcctgaatatttttgtacatgtgcaattccactatgcctaggaagaaattggctttattttgcaggagggctctcccttttactgttgtcctaacaaactggaatttggctagatgacttttatagtggtttggtccaaatatttgagtcataatgaaaatcttgaaatccgtttggtagcacttaatgaaaattctgtaattacaactttccatcattatctggggtaagttcacaagctcagacctcagagcctagtatgaaattttagttcacatcgtaccatttcttttcagaatcctagagaatctgtactttacacaagatagagaaaacaaatgaactgtaaatagcacattgttacctaacatcgaattcagactggcgaccaggagtaactttctctattggccgatcaagcacgccaccacctttccctggtgcagctgctgctgccagagccataggaatggcaggattcgggcaccttcccctgtaaatcgcatatctttctcctgcacaacatgtacagaaaagatgaaca

SEQ ID NO: 62097 - DNA, 1892 bp, Oryza sativa
ccaattaattgccaaggacacacacgccaaggccccccttccttccaggcctccagccaagtgccaacccacccaacaatttccaaaccgaccgaattttcgggcaatttccaacaggagcaaccctaagagcccaattacgcctatttcgggtcagtggcagtgccaaactaatatctcccatacttgtagcgaagaactaacttgcccccatcatccttatccagctactagaacaaatagacagagaggagagggggggttacctcccaccgcgtggtggtggtggttggagagccggctcgcggagagcgccacacggctgggcaccgccgcctccatggctgcctctccctctctctctctctctctctctctctctctctctctctctctcgccgtcgtcggagtgtggtggcctcgcggccgcggcggcggtggtgtggctcggtgggccgtgtggatgcagcgggtgggcgtgcgtgcggcgaggagagtaggggggagtatttgtggcccagttgggttgttgggttggcgtcgccggagccacctgttcggggtccggactcctaggccactgatcctgatccccccctcagattttttttttaatttccttcttcctctcgccacaaagcattgcagtagcaggttcaggttgttgataacgatggactaataatggacatgcgtctgcagggagattgggagaaaacccaaggaggaaaaaaaaagaaaatgctacttaatggtattccgttcggacggaatgatacctcacatgtattatctgatacctgataacctggtagatatcggctgatactctattcgaacgggatgatacctctgagacagtcgatatagctcatccgtctgaatagaataccgtcctcccaaaagaagttgtgaaatgaaatgataatgaggttaattagacagtgatgaggattgaggggggaaatttacctggttaagaaaacagcccctttgggcgatgattcatctctaagataataatacgtttttcttaggttttcgttaactcactttttaaaatgttgaagggtgcattttgtgtaaaaactttctatataaaaactgctatgaaatatcagataatttttttgggttttataataattaaaatttaattaattttatgctttaatggttatttctttcctctttctatgccataacttcattctttgtagaaacgaacagtcgaacaccaaatgcgacattgatttgtatggcaaaatagccattttcgtccctaaactatcgcccgaggctcagtttggtccctgaactatcaaattgtccaatttcgtccttcaacaattgatttcgaactcaatctcgtcagttccccttgatagcacgccacgtggccagctagacatgcgaaatgtccgtcctgcccctcgctcaattctttacatgttggatggctgatggcgtttcaggctccccgttgcctccctctcatcctcgtcttctctgttcgtcatggcaactatataggtaggttagggttttggcttgggggctggggcggagatcagtacaggacgacggcgtgttcgaaggggtggaggcgcaccccttctcctggtggaggcgtgcccttgtccttgggcagacggactgctcataggcaaccaagacacaggaagaggagaggacgtgctgcaaaggtaagatgagtggcacttcactagttttgcacttgagtttgatttccttgtagaatgtttaaatttgaccatatagttgatctatagggccacgaagcaatgtctgaatttgaggtactggaagttcaatttcattttaatggggaatttgttcttgatgagtcaaagatgtcgtattgcaatggg

SEQ ID NO: 62098 - DNA, 20382 bp, Oryza sativa
atgctgtgtttggaaggtccaacccatggtcaggatagtccgaatgaagaagcagcagaagatttagaagcagagagtgatggctgtgatgctacaggtttcacaagtgatgaagatgatgaagttagagagataagaaccaaatacaaagagtttatgtcagaagtaaagaagagaggagatattccaatagacaatccaattgaggttgatggcatacaaggtggagatattccattgggtaataatcaagtcttagaaggtggagatggtgctgaatactttgattcagatggtgatgcatcgtacgatgaggacagtgatggtgtctttacaagaaggaagtgcaggttcccaatatttgacagtttcgctgatactccacagtttgcagttgacatgtgctttagaggaaaggaccaattgaaggatgctatagagaggtatgctctgaagaagaagataaatatcagatatgtgaagaatgagcagaaaaggattagggctgtttgtaggtggaaaggttgtccttggcttctatatgcttcccataactcaaggagtgattggtttcagattgtaacttataatcccaaccatgcttgttgtcctgagcttaaaaataaaaggttatctacaagaaggatatgtgataggtatgagagtactatcaaggctaatccatcttggaaggctagagaaatgaaggagacagtacaagaggacatgggagtggatgtgccaatcacaatgattaagagagcaaaggcacatgtaatgaagaaaataatggatactcagactggtgagtattccaagctgtttgactatgctctggagttgcagcgtagtaatcctggaactagtgtgcatgttgcccttgacccagaggaagaggaccatgtgtttcagaggttttatgtatgttttgatgcatgtagaagaggatttttagaaggatgtaggaggataattgggcttgatggatgtttccttaaggggccattgaaaggtgagttgttatcagctattggcagggatgcaaataatcagctttatccaattgcatgggctgttgtggaatatgagaataaagactcgtggaattggtttcttgggcatcttcagaaagacatcaacatacctgttggagcagcaggctgggtgtttataacagaccaacagaaggtaaatttctatctatttttgtccattttatgtagaggcttttttaatcattaaaataaaatggttaaatcatttgtgtccattttatgcaggggctgctaagcatagtatctacattgtttccatttgctgagcataggatgtgtgcacgccacatatatgccaactggagaaagaaacataggctgcaggagtaccaaaagaggttttggaagattgcaaaagcacctaatgagcagttgtttaaccattacaagagaaagcttgctgcaaaaactcctcgtggatggcaggatttggagaaaacaaatcctattcattggtctcgagcttggttcagacttggatcaaattgtgaatcagttgacaacaacatgagtgaatcattcaatagttggattatagaatcaaggttcaagcctattattactattgacggagcgtggggctcctcaccgggagaccgcactggcccccctttgccggttcggccggggaccctgggtgagactctaagctcccaatctgtggaaggttcgcgagacaggaagcacacaagacgccggcgatgtatacaggttcgggccgctgagaagcgtaataccctactcctgtgttttggtggattcgtgtatgaaggaactacaaagtatgagccagcctctccctcgttctgggttcccaatctggaaaaatccaaaatcccctctctaagtgggcaaggtcctccttttatatcttaaggggataccacatgcaccatctccccctctctttcttccaatttgacttctcttcattaacagacggagatttgcatcgtcgccgtccgaatgaccttctgacgggacggcccatacctacctccacttccgccggaggcaggcgcgacgtgggaagatggctgtctgctgatgacttgaccattgtcagactggtcacaaatcggtcattcttgtccaccacgtgtcagtttaacaatctgcatgttcgcccttcttcatacaatatcttgcctgtaatggttaggatgaagcctggcatatatctgaccggaaccaacgtgccatctccaggagctaacacgccggctccagctagggacgagtgcttggaggctctcgtcctgacgggatggggcgaggcgtgcgtcagaccgcctgtcgccacctaacccatgatctgaccggtctgtgactggtcacagaccggataaacgagcgtgctgtactgcgatacatgcggcgtgacgcgctcgtcaaaactgcaataaatgtggttaggtgagccccgccatgctcacctaccccatatacgtggcgcaaaacccacaaggggtcggggcgcttcggccctcggggccgagacgggagcggcccaaccccttggggagacaaagagaagggcggccgtatcaccctcgggcccgacccccccccgagggagttaggccacgtgggtgatcgtgtctgcctcaagtctctaagtcatgatactcccggtaaagaggagggcgaacacatcaccctcgggcccgacgccccctgacggtgccaggccacatgggcgattgtgtctgcctcaagcctctagtcatgatactcccggtcccatgtcaccgacagtagcccccggcgttatgccagggcgatcgccctctttaagggaagcggtcgggcgtgacgccactcctaaggcctggtgacaggtgggaccggtctccacgattgggcagaaacccaacggtcacaaatcacgcacatcggcagtggtaactcggctgtcaataatgagcggtctcttcaagactgccacattactcgagtagcacacgaatctggacatggcgattcgtttcgtttggagatatggtaacgtcgcttcggtcggcgagcgtaattaacgcgcgcacgatatgatctatctcgactgccacaaccgcatgtccacctcatgctccgcaagcgggcgaatgggattagtggaagcgtgggcgcgagaaacgagggggcgaaatagtgggcgcgagaagcgaggagccgggcacagcgttggtaagagtataaaggcactgaggaagggatctgtttccttcctttcgccattattccccttgtcttcgtcgcttgcgccctaactccttctttcctgtgccctaccttcaccacacgcgctcgctcttaatcttctcttcctccggggccatggcacggggctccgctctgctcgatggtagcgtgctgccgccttcccgcatcgtgagcgagaggcaggctgggctgccgcgccgcttcatgccggaatctgccaccggccgggagatagtcacgctgggcgagggacgcccggcaccagactacccggggcggtccgtcttctttctcccctttgcaatggcagggctggttccgccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagttggtggctgctacttccagccacgggggccggtgctgaaccgctacatcccctgcgccctccgcaagaagtgggacgactggaagagcgactggttctacaccccccttgccgacgaagcgcgcctccgacttccgagccagcccccggcgcaggcctccagctggcgggcgccggtagatctgggggatggctatgacgccgtcctcgaccgcctggcgggcctgcgatcccaggggctcacaggggccatggtgtacggcgactacctccgtcgtcggattgcgccgctccagcggcgcgctcggggcgcctgggagtacaccgggtccgaagacttcatgaggacccaccagggagtgagatgggactaggctcctgaggacttcaagatattggtccaacgggtgctgaatctcaactccgtggaggcgtccctcattccccaaggaatcctccccctctgcagcgatccagactgcgcctccatcctaaccattatgatggcggtcggggcctcagaggagcgagctccaaagggccacgacgacgcaggcgggagccgcaggggggaacaatctaccccgggagggggtcgtacttctgggtcccgcgacaggggcccggggagcagccgccctgccgacgcccgggggaagaggaagcagggaggaacacctcccccatctcctccccgagggggcggggcggtgcgcgccagcagcaggcggccggagggggccgtgccgacatcgcagcccgagggggagcgcaagaagaagcggttccgcaagatgggggagacagaaccatctcggggaaacctcatttcccctccaaagtggtcgtttaaccgaccccctcgcaggttcgtctctcacccatcgtggctgtattcattctctcaacgcgagttttcactcacccatcttgttcgtcttctggtcttttcttttgtttcagcgagatcccgtcgcgtccctcccgccattccaagcccggccagtctgaggccgaggatccggcggccgcagaggcccggaggcgggaatctgaccggcgagaggccgcggatcgcctacgggaagccgaggaggccgcccaggaggccgcccgggctcgccaggccgaggaaaccgctcgggaggaggccgcccgggcccgccaggccgaggaagccgttcgggaggaggccgcccgggcccgccaggccgaggaagccgttcgggaggaggccgcccgagcccgccaggccgaggaagccgctcgggagaaagccggatttcgccaggacgaggcgttggcgacttccgaggcagctcgcgacgaggccgcgggcgcgtcgcttgggcccactccctcgggcgacgctcaggcgacagcttccggggcagctggcgacgaggctgcgggcgcgtcgcttgggcccactccctcgggcgacgctcaggaccaaccgggtccgggggacatccccgagtccggcacttccatcggtggcccgagccgcatggcatcctctccaaggcggctcttccccacgccttctatcgccccactgaacgcagagccccttctgcaggccttggccgccgcaaacaccacggtgttggatgggttaagtgcccaggtggaggccctgcaggcagagcgggcggagctcgatgccgcgtgggcgcatgtcgaagaggggcgacgctcggtggaggccatggtggaggtgggccgtaaggctcaccgccggcacgtctcggagcttgaaacccgtaagaaggtgctggcggagatcgccaaggaagtggaggaggagcggggggctgccctcattgccaccaccgtcatgaacgaggcgcaggacaccctccgccttcaatacgggagctgggaggcggagctagggaagaagctcgacgccgcccagggggtgcttgacgctgccgctgcccgagaacagcgggcggcggagaccgaagcggcgtcccggcggcgcgaagaggcccttgaggcgcgcgccatggcgctggaagagcgcgcctgcgtcgtggagagggatctggcggaccgcgaggccgccgtcaccatccgggaagcaacgctggcggcgcacgaggctgcctgcgctgaagaagagctcgcgctccgcctccgcgaggacgcgctcaccgagcgggagcgagctctcgagggggccgaggccgcggcgcaacagctggcggacagcctgtccctccgcgaggcagcgcagaaggagcaggcgcgccgtaatctagaaggtgcccgcgccgagagggccgcactgaaccaacgggccgctgagctcgaggcgcgggcgaaggagctggacgcgagggcgcgcagcggcggggcggccgcgggcgaaagtgacttagccgcccgcctcgcagctgccgaacacaccatcgccgatctacagggcgcgctggactcgtccgccggggaggtcgaagccctccgcttggcaggcgaggttgggcccggcatgctttgggacgccgtctcccgcctagattgcgccggtcggcaagtgggcctctggagagggcggaccgtaaagtacgccgccaaccagggaggtctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggaccacgcgcgcgcgcaggtccgggatgccgccgaccatatcgtcgacagcttcgagggctcggcccctcggctcgcgttcgcccccaactccgacgaggagggcaatgccggtggtgcagacgacagtgacgacgaggccggcgacccgggcgcatcggattgagcccccagacccccgccattcttcagttttttcttcttttctttcttctaaggccttcgggcctcttttttgtatagatcaacttaatctgtaatcaaaaatgaagaaatttttgtgtcaatttcatcttgctgtgtgtataagatgaggatgatctgtgccgtggtccttttgtgtcttagcttgattaagggttcatgcccaggtcccagtcctcaaaaggcgcgggtcggggctagtgcctggggagatccacatgtcgagactggccaggccgggaacgtggtgaccgagggttatgggtgacccgattgtgggtttttgccgattcccccccggagttcaccacgccccggggcacggctcggttctgggccccgtttggcgattttagccgacccgagcccccgagggcaggattgagcacgagtgacctatttcaagtcaagattcttcaaaaggaaaaaacagcacagatacagcctttaggaaattgaaactgcttttattgaaatactgaaataagagaaataagaatgtgcatgtgtggcagcccccggccaaccctgcacgcccgagggggtgcggggttggcccgagcccgaaacctgacacccgaccccccctcaggggtagaagcgacgaaggttatccacgggttaggcagctcagtgccgtcgcccgtggccagccgtatggagcccggccgggggacgccgaccactcgatacggactctcccacattggtgaaagcttgctcaatccagcacgcgtttggacgcggcgtaggacgaggtcgtcgacgcagagtgatcgggcccggacgtgacgctgatggtagcgccgcaggctctgctggtagcgcgcggctcggagggccgcgcgccgccttcgctcttccaagtagtcgaggtcatctctgcgaagctgatcttgatcagcctcgcagtacatggtggccctgaggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcgccggaccaggtcgaccgcatcattgagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagctgggagcactcccctcgggtcccgaggcctggactccgacgggcctcgggggccggtcaggcgcatccgtctcccctaaggggtcgggtcgcgccgacggctgggcaagcctttcttcaaaggcgcccggtggggtctgggctcgcgaggacgcgagccgtgagagttcgtcggccatcatgttatcccgtctgggcacatgccgaagctcaatcccgtcaaaatggcactccatacgccgtacttggcgcacgtaggcgtccatctgcgggtcagagcaccggtactccttacagacttggttaacgaccagctgggagtcgcctaacaccaggaggcggcggatccccagtccagctgccactctgagtccggcaaggagtccctcgtactctgccatattattggtcgctcgaaagtcgaggcggaccaagtatctgaggacgtctccactcggagaggtcaacgtgacccccgcaccggcgccctgaagagacaaggagccgtcgaactgcattacccagtgggcggtgtgaggcagctgcgaggggtccgtgctggcctcggggatcgagacgggctcgggagccggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcgcacttgtcttctgtgctgatgacttcggggtcggaggataacaggggcggccttcccacagtggcttcggggccgtcctgggggtcgggggctcctggcatcgtcggacaagcgggcaaagggccaactccggtcgtcaggagccttagacctccgttcggctcgggggcctcttctccctgctctttcccgggtcgagtcagcacagggttagcctcggggtcaaagggcgataggtgcggccttcccacagtggcctcagggccttcctgggggtcgggggctcctagcaccgtctgacaagcgggcagagggccaactccggtcgtcgggggccttgggccaccgttcggctcgggggcctctcctccctgctctctcccgggccaagtctgcacaaggtgggggtgcgcggaatgaggtttgtcctcatcgcgctccacgaccaacgccgcactaaccacttgcggggtcgccgctaagtagagtagtaagggttcatttggctccggggcgaccagaaccggggagagctgagatacgccttcaactgagtgagggcacgctcagcttcctccgtccaagtaaacggcccggagcgtttgaggagcttaaataagggtagcgccttctcccccagcctcgatatgaaccgacttagggcggccatgcaaccggcgacgcattgcacatccctaagcttgctgggggggcgcattcgctctatagctcgtatcttctcggggttggcttcgatgcctcgggcagagaccaagaacccgagaagcttgcccgcaggtacaccgaacacgcacttatcggggttcagtcttatgcgggcggagcggaggctttcaaaagtttccgctagatccgagagtaaggtttcttggttgcgcgtctttacaaccaagtcatcgacataagcctcaacattacgtcctatttggctacccaaagaaattcgagtagtacgttgaaaagtaggacctgcattttttaacccgaagggcattgttgtataacaataagttcctatgggggtaatgaacgcagttttttcctcatcctccctagccatgcgaatctgatggtaaccagagtatgcatctagaaaacacaaaaggtcgcaccccgctgtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcagataaaggcttgacgttccggggcctgccgccgcactttctgccggaccggccttgcgcccggccgtacggcgagacggtgctcaatcacctccctggggaccccgggcatatccgccggtctccatgcgaagacgtcagcatttgcccgcgggaaggagacgagcgtgtcttcctatttgccgtccagaagaccaccgatccgtgtggtcttggacgggccgtcgcccagggcaacctccttgaccgggacctcgtcgcatgtgatcatccgctgcctcggggtggcgggggcggaggcgccaagcctctcgtcgccaccctcgggcttggacgcagcggcgaggcggtccgcgcgttgctccagacaagcgagcgtgactttgaggtcgccatggacagagatggggccaccggggcccggcatcttcatctgtaggtaggcgtagtggaccgccgccatgaacttcaccaacgcgggcctccccaggaccgcgttgtagggcagactgaggttcgccacatcgaagttcacccgctccgtgcggaagttggcggatccaccgaaggtgaccggtaggtcgatgtggcctaacggccacgtgtgccccggcgtcacaccgataatcggctgggacggccggagcaccatccccggggccttgctggcgtcaaaggccgcaggggaaaggatgttgagggccgctcccccatcaatgaggacacgccccaactttacgttgcagatggtgggagaaaccaccatcgcaatctgccctccccgggcaacgcacggtgggtggtcggtctggtcgaaggtgagagcaacccccgaccatcgcgcccgacgcgtcgcctcatgagtaggggccgcggccagaagctctcgcttcatggccttgaggctccggcgagaaacgtgagcacacgctcccccatcgacggtggcaatggtggccccaggctcttggaaacctaggtcatcatcgccatcatcgatgtcctcggcgggggccttctgcttggcctcacttcgccgattaccggaaggaaccgccggggacttgccctctcggcgctcctgcctcctctcctcctcccacttcctcgtccgctcagccaaacttttgaccgcacggcagtccatgaggtcgtggagggaggtgttgtggacggtgcaccacttgccggctgggcgctccctgctgggagcgccggcctttttctttttgtcgctcgcaggcctccccttttgggtggctcgcgaagcgccctcgacggcgaggacatgaccctcgtcgtcggaatggactgacctcttcttcctcctcctgtcacgccgccctgtctgagcggcggatccgggggcggccgaagctgccacaccggaaccggaggggttccaagtccaggcctcctccttgcgagccactcggtccgcgagctgaaaaagctccgcggtagtctggggctccttggaggcgatcttttcgagcatgcggttgtgccgcacgccccccctgaacgcgtagattaccgcatgtgcagggatgcatggtatggtgttgcggacttgacagaaccgctgaatgtacgagcgaagtgactcatcatcccttcgctgtactgcgtgtaagtccgcttcttcacctgggcgcggatatgtgccctgaaagttcatggtgaactgttggcacaaatcctcccaggagtggactgacgcgggtggcaagttcattagccaaccccgcgcctgccccttcagggccatgggaaagaaattcgccatgaccctgtcgtcacccctggcggcctcaatcccggtcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctgattcccgtgtccgtgttgaggtgacactctggacgaggaagcgccctccgttgcgtgggtagcacgtcggtcattacgccgccgctcgatgctggtgcgggcgtccggccccccacgcagatcttcccgggtcgaaggagtcgacgaaggagtggtggccgaatggcgaacagcggctgccgctcgccgcgcccttcgtcttgacgacgcggagccggtggtagcagcaccagaggccttggtggcggaggaccgcccaccagcatctagacactgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcaccatagacgaggaggcgacgctccccatctcgccgccctttttcacctccagtggatgtcgaagtcgcggatccttcggccctctcgagcgcctccccccgcttaggactttggcgtggagggggcggtggagtacgagctcgacggcgtgggttcggctccccgtcgtcgccactcacactcggagagaggtcgtgcgcctttgcttgctcagccatgaggctgaacaggaaaagcttggcgcacacgaaagagtgcaagagctcagaagatcactcgcagagtcccctacctggcgcgccagatgacggagcgtggggctcctcaccgggagaccgcactggcccccctttgccggttcggccggggaccctgggtgagactctaagctcccaatctgtggaaggttcgcgagacaggaagcacacaagacgtcggcgatgtatacaggttcgggccgctgagaagcgtaataccctactcctgtgttttggtggattcgtgtatgaaggaactacaaagtatgagccagcctctccctcgttctgggttcccaatctggaaaaatccaaaatcccctctctaagtgggcaaggtcctccttttatatcttaaggggataccacatgcaccatctccccctctctttcttccaatttgacttctcttcattaacagacggagatttgcatcgtcgccatccgaatgaccttctgatgggacggcccatacctacctccacttccgccggaggcaggcgcgacgtgggaagatggctgtctgctgatgacttgaccattgtcagactggtcacaaatcggtcattcttgtccaccacgtgtcagtttaacaatctgcatgttcgcccttcttcatacaatatcttgcctgtaatggttaggatgaagcctggcatatatctgaccggaaccaacgtgccatctccaggagctaacacgccggctccagctagggacgagtgcttggaggctctcgtcctgacgggatggggcgaggcgtgcgtcagaccgcctgtcgccacctaacccatgatctgaccggtctgtgactggtcacagaccggataaacgagcgtgctgtactgcgatacatgcggcgtgacgcgctcgtcaaaactgcaataaatgtggttaggtgagccccgccatgctcacctaccccatatacgtggcgcaaaacccacaaggggtcggggcgcttcggccctcggggccgagacgggagcggcccaaccccttggggagacaaagagaagggcggccgtatcaccctcgggcccgaccccccctcccccgagggagttaggccacgtgggtgatcgtgtctgcctcaagtctctaagtcatgatactcccggtaaagaggagggcgaacacatcaccctcgggcccgacgccccctgacggtgccaggccacgtgggcgattgtgtctgcctcaagcctctagtcatgatactcccggtcccatgtcaccgacaactatgatggaggacattaggatccaggtgactagaagaatccaagaaaataggagtaacagtgagaggtggactatgacagtgtgtcctaacattatcaggaaattcaacaagattaggcataggacacagttttgtcatgtcttgtagaatggtgatgctggatttgaagtgagagacaaaaaatggaggttcacagtagacctgacaagcaagacatgctcctgtaggtactggcaagtctctgggattccatgccaacatgcttgtgctgccctattcaaaatggcacaagagcctaacaattgcatacatgagtgcttctcacttgagagatataagaagacataccaacatgtactacagccagtggaacatgagtcggcttggcctgtgtctccgaatcccaaaccattgcctcctagagtaaaaaagatgccaggccgaccaaagaaaaataggagaaaagacccttcagagccagtgaaatctggaaccaagtcatcaaaagttggtactaaaattagatgtcgtcgctgtggaaattatggtcacaactcgaggacatgctgtgtgaaaatggtgtttactgaatttaatttttccccttgctgcactatattcattccttactcattttactaacttggtatgtactgtacagcagcaagaacacgctgagtcatataatcctcccgccaccaatgcaagtcactcaagcccattgcaaattgaacctgcacagtcgaagcaaactaaaggaaaatccatagcgacatcatcaagtaagagtaagatgcctgagggttcatcatttatacaggttagtaataattacgacatgtccatgctatagcctaagtaatttgtatatttgcctaaattggctttgttgtttacagtctggccataagagaagactggtatcttttggaaagagtgctcaagcatctgcgaagtcaagtgctcaagcatcggcgaaggcatctgctggagggagtgcttctgttgtcattgaaaccaatgctgggactgctagctcatttgcaaaggcaacaatcaatgtaaaaggtgggcatgcctttgcaaaaatccattcaacttcacttggtcgtggatcagtatctgcccaaagcagctcatcacagaaaaatgggctgctgaattccaagaacaagatgatgtagcttgccaaatatagtcccaaagcaataatgcttttgtatcagttagtcatgatgtcatgaacgcttgcatttgttatgtcaaaaccatgagcataagacatgttaaatttgtttctggacaagagcataagacatgttaaaattgtttttcaattcattccacattgcctcaaatagtggttacacaatgagccatataccacaagcaattacaatgctaaaacaaattaagattacaatgcactctctttgttctctaatagtacattttagttcatgaatttgttgttttactctctgtcgatcagcatacatatcatcccattgtctagatgaatgttcgtacagctccgacatgctgtgcctcatggaaactaggtcctgaatcacccttttcgctctaccttcaaattgttcatcgatccaatacttgaaatcacagggctgctcaacttgggagcatgccaggaaccttcttccagtgtctggaccagaccaacaacaacacaaaattgggaagaatccatgccgacatgtaagccctgtcctcaccagcatcccctctgaatgttcttcaagcaatgtttcaagctgcaccaaatcgacgaatttttatcaaaaaacaaatcaatctccaattcaaatcaaccctagccccagcgccaacagctctgtactcacctccaccgcgcgcgcagctccatgagcgccagaactcgatgctccgggattcggcgctactcccattcttggcatcgaccttctcactctcccctccctggacccatgctccatggggatacaggcacaacggatgccgcctccacaatggagcgaccagatcggggaggaaacgaggagcgagtagatgggggagatggacgagatggaatggatgaagcagatgaggcaaagagaactggggaccggcggctagtgggtcttcctccccggcggcgacgacgacgaacagaagccgcaccaacacagaagacgaggacgacgccgtcagccatccaacatgtaaagaattgagcgaggggcaggacggacatttcgcatgtctagctagccacgtggcgtgctatcaaggggaacggacgagattgagttcgaaatcaattgttgaaggacgaaattggacaatttgatagttcagggaccaaactgagcctcgggcgatagtttagggacgaaaatggctattttgccgatttgtattgtaggagtaagatatttataaacggataaaaataagtcgtgttatgaaattgcttgggagacgaatttgtgcatatgatctgcgtgctaaggaaagtataaacatgaagtgaacagtttgaaatcggacttctaaaactcaaacaaccgagtagatgtgatcaacttccatgtacccctctcaaaatttaaaactaaataaggcttggcaaccaaatttgaatccaaatatatacacgtcagacatggtcacctaaattcaaaatcgtaacctttctttagaagattcagagtgctgactggtggttgggcttaaagatctgtactccatacccttcaacttatagggaaaatatgtggtggaaaccacaaatagagcaaacctggaaactatagttggagcgaaaaatggacgtccgagattcgtccacgtcatcacgagtataaattttactcacagatttactcatgaatactcatgatgacgtgcacgaatttcggacgtcatttttcaatccaacggtagttaccacgtttccactacatatatggttttcacaacatatttttcccagcttataagccacaattaaaatttaatttcaaagttctttcaatcacagtttatttttgagtatttgtgttttaaatgattaagaatataaatataaaataatatttacaaattattctctccgtcccataaaaaaccaacctaatactggatatatatgatatattctagtacattgtatctgtacatatctctattacgtctagttctagttttaatttttttttggacggaaggagtatgctgtagtggccaataaaccgtacaagcccatccttcttttctttttattttttcttgttcctttcctttcctttttcactgggctgtccctctctgctatagcccagttaatacagtccatcacttatctccttcagcccaactaaccagccacctacccacgctagcttgcatcgaagagagatatacacacaagcaggtaagtaccagggttcaccttttcaattgagtttcagatcgtgacatacgtatccctggtggcacgatggttttcactgaatcttaattaaattttggtcaaattcacaattctatatttgaattctcaaaaacaatttgaagttttactaaaaatctactttcactctatgttgaaacctcgaagttactccctccatacttacaaaggaagtcgtttaggataatgtttaagtcaaaccttgggaatataaatcatgaataactctcaagttgttgagtttgaaaatgtaaaacttatatgaatatatttgtcttgaaaaatactttcataaaagtatacatataccacttttcaataaatatttttatagaaacaagaagttaaagttgtgttttggagaccatatcgctgtcctaaacgacttccttaacaaatatggacggagtacattgctttcagtcagtttacatcgaaaacgtgaacctggtaagtactcctttcgtcttaaaatttgcctcagatcaatatatcaacttcctaactagctctctcatctcaaccaatcacaattgtctctaatctaattctcctctaactacttctacatctcaactaattacaactataatttatcccttatttttttaattcattctactttcaatcacaatacaaaactctaaaatatccttgcaaatttttgggagaaggagatggtagaaacagggtagcaaacaaaatgtcaaaataatatactccatatatcccagaacagaactgaatatgctactctcttcatttcaaaatatatatagcgatatttaattggacggagcctattactatcaatctaaatagagggttgtctaatctaatatttccttcgtcccaaaatataacaacttctagcctttataatttatcccaaaatataacgacttatccaccaacattcttttctcaaccaatcacaacccttcaccattcaattttcccacttaccttcacttctccttcaatcacaacactcccccatttaatcctaccaactttcttaataaccgtatccaaccctaaaaatcactatattctagaatgtaaggagtactagattactatagtttataatattttatgacgatggagcattaacctagatctaactcaaccctactagtacttataaccaatgattgccatgtaaacccttcacatggatcaattaaccctgttcccaggtggatcagacaaaaccaaggctccataccctactaatataatcatttgttcttttttttatttagagcatgtagaataataaaagttaacttttagctatggatcaataaagttcatatcacctgcagctaatttagctacgtttgtacaataattatctgatagtgccaccttagttctaaaaagagtttacttttctatacgaatttgagcagtcatttgtccagactccatagaagaattaagtctttatctattacctatccaaaagccacaaaatattgtagctcatcgtgtgctctataattcggcgacaaatctatattctctctttgttccttcgtcacttcttcaagtattccttcgatatgaatctctctatagagcatgttgttccctcgttgatctgctcttatcatttgggccactaacacaatcttcaatgcttgtgctttatcactgtcttttctaatcatacatttacaaaatctacataaaaaccttttaatgataaatctagtaaatcattctcagcacatcaaatcttaacattttcatatgagtaaattttacaaaactaaatatattttcaacaaactatcgtaaaattacagatttaagatgttgtattataaaattacggatttagaaccaaaattatcgcaaaaccatctatttaagggcaagtatcaccatactatatttaatatcgaagttatcacaaaactaaatatttttacagtttaaatccctagcactacccttatgttggagctataaagattgtaattttgtgattgaattagcgctaaacttatagtttttttgggtgacattgaacctgcagttttctaatacaatactttaaatctagattttttcgatatattttgatactccatccgtcccataatataagggat

SEQ ID NO: 62099 - DNA, 8934 bp, Oryza sativa
caagaaatggaggttccatatagtgaatagcgatgcactaccagtggttgagctagggtccccatcgttcttaggcaattaagtagctctttactaatgaatatgaatttgcctcaattaatgtttatttttagcaaagttgcttattcgagggttgaccactatgacaataaaaaatatttccttagagaagggctgggcttgagttaacctatgatccttatatgaccccttttttataaacgcatacaagagtcaaagatgatagacttgtacctgctctattgctcataacctttttttctcccatcctttcgtcaaaacaagcaggtcgagtttcgagtgcaaagcctatcgcctctaacttttagtatgtcgatgggctatacccaacaatggtatttctatagtattggggatattagggggtgtttggttgattgcttcactttgccacgccacacttcagtcatgccacagttttttagacgtgtgtttgtttcaatgcgacagttgtgtcatgccacactttcctacccttaggtcccacatgtcatactcagataactagagctaacattgccacacttgtgactaactatttcttggccatacttttaccacatgccacaacttgcctaagcttagttatggcaagcttaggcatcaaccaaacaacccctaagactataggtatacatgagattgtagtaaagagatggaagacaaggattattatatagattcgagctctctactaatgggtaacagctttactcttgttggctgaagccggtcgtattgctattatatatcacaatctctcacaagtgcaatagagaggagaacctaatctagtatgatagtatagcagcgtaaatcgaacaggtggtcgacggctaagctgttgttggctacacaagtactcttgtatagtgtatcccgtatttaagacactgaaataatcatattttcgtcgagaagaacgtgcaaggaacgaatcgtacattgagttcactaggcaaaatggcatccatgccaacgactaaggagaagagtgtttgaccaatggctatgcagattgatgtccaataagctagagagccttgtcggagcgattgcatgccaaactagctagcctaggaactggctgatttgccactgtgcaccaggccaccaaaggtggaggagctagctagagaatattaattaatatataatatcatatgtgataaaatatgcaagtaccacctcatcagttgtagagctagtaaagctactatctttgggaacctatggaagctgtagattgtagaatgtgctccataaatcctccacatgcatgcattacgattatcacaatggggagaatggctctgacatcccaaaataatactcatgatctcagcatcagagtagtacataaatgtcaccagagttaaacaacaacacaatgtatttctctttctcatgagcacgattaattcataagatactttttaagctagacacagataaaacacatgaagaatttaaactagcccctccaattccacttccattgtatcccggccgagatcgattatacatgtgtacacccatacatatatctatcaccccattgtgcactgaaaggtttagtactagtaaaaacctctcaaagcacccaacacatatgcaacaaaattaagtaacatccaaacaaataaaaacatatatatatatatatatatatatatataagggatacataaaactctccctctaccttggaaatcccatgtttcaaattttctccttcctttaattttgatttccctcatgcacacaccataacaccaaaaagaagatccaaactctaagttttttttaagtcggctatatatagctttataactatactaatataagttgagttgcataagcaagagcatggatatttcatgctacttctgatgaggctgcaggaattaatggatggatcgatgatcgacttgagtttttaccagccactagaattgaaggaaccttgctgatcatgtgcactgatcatccgctgcctcttgatgctcccaccgccgccgccggcgccggaagaggaggtgtcgctgctcgccgctttgcggttcatgacgccgcgcagcgcctcgtggatcgacgcgacgagctcgtgcctccggtgcgaggcggcaacgccgtagccgtgttcgccgtcgtcgtcgttcccggcctcgtctggatcttcctcctcgacggcggcgatgaggaggacgctgcggacgcggccgccgagcgtggcgatctcggcgcggcgggcgcgcagccggagcgcggcgagcgcgcgggcgatgcccgggatgaggtcggcgcggtcctcgcagcacagcgaggccctcgccacgagcctccctccctcgtccgccgccgcgtccacctccagctcgtcgtcctccgtcggcagcagcaccaccggcgccgccgccgcctcccctcccgcggcgccgtcctccatcatcgccgacgtctgccgcttcagctccttgacgtgctcgatcacctccgccagcagcgacgccttgtccgtctgcaaacaccacaaaacacacaaacaccaatcagtgctcgatccgtcagctcagctcgcgccatcattagagaggtctcaagctttgggcgcatgctgcagaacacagcgtgcagtggctggcactagctaagtgtagtggaggtagctaggtaggaaggagaggagggagaagagacggggaagctgagtagtagtagtggaggaggtgcatgcgaggatggaggaaaagctacaaaaatcgcgggggccgtggcgcggcgtggcgtggcgtggcgtggcgcagcctttgcatgcgcgcgcgcacggcgcggcgctctggatcgccttttggggagcgcgctctggcacgggcgtgcgcgcttgtcgcgccgcgccgcgcgcggcgagagcgagagcactctccccgacgaatccaaaggcttctctgctgcatctgcatgcgccaaactgatctctgcacaaattccttcctttattttttcttcttgtccatgtcagtgtatcagcatgcaaatgctctatatctatactactgggtgatctctacattggagcttagcttttggctttggtactcctatgcccaccacaccttgtctcttgccccccttaggttttggcttaggttacttaccattatgaaaatatggacattgtttgattggaacgcatgaattttacggaactaaatataatataattgaaattgtcgtgttttctgtacaatgattaatctttgatctaactttacacgattatttacaattaaaattgttgtgttttttatgatgattaatctttgatctaaaacgcatggattttacaaaattatgtaccatgaaaacaaggttgttttatgtatgatgatcaatattgagttcctttgaaaagagagagtgaataggtagcttaagttttgtgtttgtgagagggtcatcatatatggtgtgacaatataattgccttggggaaaataattgaacacagtacatgagatggatcaaaaggcaaattaagataggaaagaacatgcatggttcctttgattcaagcatgtaatcatgctatgtgggttagttttgttgcaagacctaagtaagtacatgtagagttgcctccccaagaagctacctaagctaataggcagctactaagctactagatctgacttctcctttgctcgtaccacttctcaattaagtttttaattggtctgtttaattacttcgatcatcgattgtatatttttgacttggttataatcagtagtatatatatctagatcttctgataatctgaatcgattgtgcatcaaaaccatgcatcccagtttggttagggtttggacatgagcatgtcgaactgatgatcatcatccataggggaagaaggaaggtttggttagttaattaattaattcgattagtgcactgtgagattgtgagaagctgcacatgtagtaatatgtgagaaataatcatgtattcatggaggagatcgcctgaccttggtggtgttggggaggaggctgcggagcctggcgaggtggccgttgatgcgctggcggcggcggcgctcggcctcgctgtggctgcgcgacgccgccagcgccttggcgtccatgatctccttcgccgtcatcctcccgagctccgcctgcagcgtcccgagcagcccggacaccaccatcctcgacgacgacgaacccccgccgcccatctgcatcatcgtcatcggcggcggcgcctccatcccgtactgatgatgatgaggatggtgattatgccccgccacgcctccgcctccgtcgaagtagaagggctgctccaccggcagctgctcgccggcggcgaagggcgccgctgccgctgctgccgggggcatgtagagcggcgcggccgcggccgagccgggccacggcaggagagccgtgccgtcgccgccgcctacagcttcccacatctccaccacaacaaccaaaccaaccaatcagctgatcaattaccttcttggatcgatcgagttcttggctcttcttgctgatgcttcttctttcgttgagctaattaataaactcgatcgtgcgcatcgatggatcgatctatgcaacaaccttttcttgctttttcttcttctactactactacaactcgcagcagcagctgttctagcttttcatcagtcaaagggaagaagggggggttttaaactgatgggtgtgtcgagtcgacctgcgcactgcgcaacatggaatggatagcttttttctttcttccccaagtgtggccttttcgcattcgcaccggttgtcgggtactagtggtagtggtggtcgagagagaaagagagagtgagagacggctaagctaagcatgagctagctagggctcctcaactcagatcgtgtacggcactggagctcctctctgtctgcctcatctttgtgctagcttgcagttgcagcttgggacagatagtataatgacgcttgattacgctgtaatgtaaagggagccacgtaagagaaaccagtccggtttagggatgtaaaaagtgtactggacggtttcgagagttcaggccatggagcatccagtttggaagcttatagggtctgtttgatactcaggttgtgttacagctctatctcttctcaggttgtgttcttctcaactttcccaacctctctttctacagctctatcttctttttttaaaaaaaaaactagtaatgtaacccgcgcgaacgcacgggaatgtgtatttgtttgttctaaaattaaacatacctagcaaattaatttcaaatttgtaattaagtcagatgtttctgaaaacgggcttatagaccttttcgtcttatgaaatcttataagaatttattaataaatgtattatgtgtatcatcaagctacccttcccctctagttcagatgtgtaggcatctgtctaaatttttaattataggtgacttttaattacctaaaatattatttgacaaccgatattggtaatcctttaaaaaatgtttatttataaaattatcaagatcaattctacaatgtatgcattagagagaaattaagttgcttagatatctaatagtgtgttatagcgggtgtaaaataaggtgtatttttaattatgttgcttgaaaggattatggtgtgtaccttaactatcttagagaaaaaaataagggaagatagggcaatagttgcgtgcggagaaccagaggcaggcacgtgtccattatgagaggaggggatggattagagatttcttgaaacttaaatctaatggctccaaataatggatacacctatttagtgaaaaatcaaaagtgagatattttcttttttctcatattttttctaatttattagagtgccacgtgacagtttaagaacgcttttaggtgctacgtgttaacgtaggatcgttcataggaagtttaaaatacttttagtatataatagaattaatgaagtattggattcgatacatcaccaaaatttaggcataatatattttatcaagtttccattagggaaacaaactaaactaacccaaaataatcatgttttcatgtgtgcagtagtgacattcatagctccttatcttatataccatttcagggttacagccctacctttttattgggccacgtggcaccacaattagaactaagtttggattctaggatcgagaagcagccacgtatttgcagcccttccgtagccgtccgattataatcaatgatggtggtgcagcgagcatgattggcttccgtagccgtccgattggaaatcaatgatggtggtgaaaatccattgcaccgacgactcgtacaaaggggatcgaggataagattattattattattattattattattattttgacattttcacatcggtgatttctagatgagctctttgagctttgctggcatgggaaaaaacgaagtgggtcaaaagcccaaagtgaggtagggatagatgtggcatttatttacttgatttgaaatttaatattttcaataaataatcataatcgtgactctatatgtgctttaaaaatatatatatggttaaaacgtaatttttgatttatgagcctactgaacgttttacatgcatggtttaacacaggcttgtcaaacctgttctttataagctcgtattatcgaacatgcaaccaaaattatttaatctataatcctataaatcttcgcataaatatcacaccctctattttctaaatagacgacgccgttaaattttgacataatatctaaccacacatgtattgtaaaaaattatgtgttatttgttgtgactttatttttattattgaaaaactataagcatgacatatagcaccaaaatcgggaattaaaatatcgttcaaatgcacagaggctaactagcatgctcgccactttttttaggagtatattatatttctcagtcaaaagtaaaagaagattaacttaaaaaaaagagcaagggaaatataccacaactactattgaataccgaaaaatgagaattaaaacattgttaaaatgcatcatactacatatccaaatagtaggtgcgaggtgcgcggtgcgccaataggcgcaccaattttcttgtgcatgtcactagggtccgacagctggcactgccatgctctccatttgggaccatttccctcctccattccctaccattgagttatttttcagatcatttggcttccaaaatttctcatagtttttaagttggtccccctctcctctctctctaccttatagactgtgttcggatgttgaagttgggaactaatccctcacgcacgtaaaacagaacaactcattagcatataattcattaggtactggctaacttttttaaagaaatggattaacatattttttaaagcaactttcatatagaattttttttaaaaaaaaacacacctgccgtttaataatttgggaagcgtgtgcatggaatacaaagatgtgagttgggaacctcaagcaaagaactcagccagaaatccttggttacaatcagaggtattaacagctcacaaataatttcatttctcataccatgaattaaaattgatatcctctactaaccaattttacaagtatgtacttaagccgtacgtcggcaattccattctttgtgtattatgaaaaagtttatggtactaataataatgaatgatgtgttcaaatgggtattacagtatcatatccaattaccagcttggtgatgacaaaacagtcctattatatatgcagattaatttaagtccaaatccaatagaaacttagggacattataaaaacccacaggttgcgaatgcccatatatatctttttagcaaatctatctcttctccattactctttactcaacactcttctataattccttgattttgttttagcttataatcttgaatttgacttatctaaaaaaaatttattgagttatcttcaccattaagtaaaacctaaaaacttaattaattactaatcaggaaatgcatagtcctagcatgaggcttcctcttgggccttaacatgaaagtgagctgcaattttttttcatttcatagtatgtggttatttggcattccatatttaaacttgaggcctatgactataatatcgtaatgactgttacatacaccaattaatttgagacagacgacgagcactttgcttatattccaaaaagaaattcctgtgttcttccacgtatatatttttctctagccaatcaaggagtaattaaaagatttgacaatgatatatatcctatgtcggccggtgacccggtcggccggccggccggagtagcagcagctgcatgctgccgaccacgctgcctgcctgcctttccaatccgcgtaccgtaaaaagtgtatatttttggtttttcattttaacctttgactcttcgtattttttaaatcttttaagattattatttctattgttattaaattataaaacataaatattacttaatgtgcgactaatcttttttttataaaattttaaaataaaataaacagtcaaatgtattttctgtgagatggagagaggaggacacggagagaggaggacgtagctcttgaaaagctactgctgcattcgcttaccctagttctcaactccctcctctcgtttttcgcgcgcatgcttttcaaactgctaagcggtgtgttttttaaaaaaagtttcatattgatccattttttttaaaaaaaagtttatacttaattaatcacgtgttaatgcaccgctcagttttctgtgcacaggatatgggttcc

SEQ ID NO: 62100 - DNA, 5477 bp, Oryza sativa
ctacacccaccgaacccatggataccccctgagccccccttcaattttttttaccaaggttgataaaatagggggtgttaatagcattttagtatagtttaatactgatattatgtgtttataccggtgtactcgatatgtttagtctctcaactttttattgctggatccgcccatgcctccatagaaagtgcaacgtacgttttgatcgatggagaggcaaattttgagacgtactggttcgtactgatcatccacgcctctccggctatggttcgtcctcgtcggcgaggcgtcgccgtcgcatgcatgcgtgcgttcgtgcctccacgcggtagctataggaggtggagtaggccggtttgatgcggtagagcgctggagaaagataaaaaggattttcgcagatggccaaaattgctctgtgcaggtggacacaagcgtcgtctacaagtagagatttacgaaaatcatcgattttcacacgaggttttcgcaggtagacggtcggtccgtctggaaagatggattttcacgggccgatgtttgagggcaaaaatttgactcatatgtttggtgaaatggacatatcagtttataaaaattgtttatctagtagttgtcgaagtaatccatggcgccatcggctatttgctgctctagttatccactaagcgcttgattccgagtttgttggatcatggcgcatgtatagctcagacgcatgctgtgttcatgcgggagtttgtttcttttttccgttttcttgggagtgcgtgtgccctgcatgttcttcgatcgtaggatggcgcgatcacctcgggagacatggctagggcgccgggttagtaggaacgcatggtgcacacctcggtcgtgggatggcacgatccagtcagaggtgggagacgtgtgtatgtttgttatttaagttccctaatgcatctgaaaatcgttgccaagttcatcacaacacaaaacctcgctttctcgcttgctctgttttgatcggcatttcatcgaacaccttcgggagtttgccaacaactggtatcagagcctcgttggctcgctggtgccatggcggagcgttcactgccacatcattctcgcacacctccgcacgtttcgacgccaccaggctcgcgctctcctctttctcgcccattgtgtaccccgccacgccgttgtcctgctaagtccccgccgcgccgtgggcgcgggcgtggcgagcgacagcccttggctgctcagccgcgggtcgtcagggagtcgagcgttgccgttcactactcggttctgacgaggaccaactacgaggaaagggcgctcctcatgaccgtgaatttgcatgctcaggggctctggcatgccatggaaccgtacgaagacgaggagaccgagtaccgcgatgatcggctggtgctggccgtgatcctgcgtgcggtgccggcggagatgctccgcttcctctccaccaagcgcacggcgtagtctgcgtgggaggggatcaagacagtctgcgtcggcactcggcgcgtgcgtgaggcgaatgagcagctacttcgccaggagtttgccgatgcacggttcaaggatgacgagaacattgacgacttctccatgcgcctcaccggaatcacaaacagcattcgcactctcggaggcgatctccccgaggtagatgttgtcaacaagctgctaaacgttgtccctaagcatctctcacagatagccatctcgatcgagacgctcctcgacatcagcgacctgtccatagaggaggtcaccggccgactccgcgccgccgagaaacgcaaggccaagccaaaggagatcgtcgacagcggcggccatctcatgctcacagaggagcagtggctggcacggctcaagcaccgcgagcagagtggtgagagcagcggcactgcacccggcgcggccacgaacaacggcggcaagaaacgcgggaatcggcgcggttgcgtgcgcggccaggaacaccctggcgacaagtgtcgcaattgcggcaaaatgggccactaggccaaggattaccgctcaaaggccaagaaggctgaggcccacattgtagcggaggacgacgacgagccgacgctgctcatggcgcgcacgtgtctggttgagcggcgacgctcgccagccgaacccgcaccggaaatcacaacggtgttcctggaggaggcaaaggtgctggcgcatctcgatgacgaccctgatcccactaatctcgatgacgaccctgatcccgctgatttgtggtacctttacaccggcgccacgaaccacatgaccggagtccgctccgtcttctccgagctcgacacggcggtgaccggcttcgtcaagttcggtgacggctctgtcgtcacgatcgcaggctgcagcacgatcctcttcacctacaagaacggcgaacatcgcaggctgactggggtctacttcatcccacgcctcaccgccaacctcatcagcgtcggccagctcaacaagaacgactgcgagtccctagtgcacgacggcttcatgcgcatccgcgaccaggatcggcggttgctggcgaggatcccacgctcaaggaatcggcatcgtgccatcacacgaccgaggtgtgcgccatgcgttcctactaacccggcgccccagccatgtctcctgaggtgattgcgccatcccacgatcaaagaacatgcagggcacacgcactccctagaaaacaaaaaaacgaaacaaactccctcatgaacacaacatgcgtcagagctatacatgcgccatgagaccatgatccaacaaactcagaatcaagcgcttagtggataactagagcagcaaatagccgatggcgccatggattacttcgacattctcccccctaattcttgccgccgtcgccactgagctcagcaatgccaataccgttgcatagctcctggaatcaaacacggctgagtggcttcgtcagtacgtccttcagttgctcctccgtgcgaacgtagttgatgacgatcttcccgttctccacgcactcccggatgaaatggtatcgagtgtcaatgtgcttgctccggtcatggaaaacggggttcttggtcattgcaatgctggacttgttgtccaccttgatctccggcgctccgatctctgagtcgagcaagtcactcaagagtcgagcaagccagacagcttggcaggcggcggccgtggtagcgatgtactctgcctcgcacgatgacagcgccaccaccttctgtttcgtcgattgccaagtgatcagacttgttgtgaggaagaagagaatgccgctcgtgctccggcgtgtgtccagatcaccggccatgtcgctgtcgctgaagccatgcagcttcagcaatcctccttttcccctggcgtagtgcgcaccatggtgtcgtgttctggcaatataccgcaacacatgcttcaccgccgctagatgatcctcgtgtggctcctccatgaaccggctaaggtagccggcggcgtgagcaatgtccgggctcgtgttcaccagataacgcagcccaccgatggtgctgtagtagctcgtcaagttcaccggcggacttgaactagctttactcaatttttttgaggcagagtacatcgccgccacggccgccgcctaccaagctgtctggctctcttgactcttgagtgacttgctcgactcggagatcggagcgccggagatcaatgtggacaacaagtccatcattgcaatgaccaagaaccccgttttccatgaccggagcaagcacattgacacccgataccatttcatccgggagtgcgtggagaacgggaatatcgtcatcaactacgttcgcacggaggagcagctgacggacatactgacgaagccactcggccgtgtttgattccaggagctgtgcaacggtatcgacattgctgagctcagtggcgatggcggcaagaattaggggggagaatgtcgaagtaatccatggcgccatcggctatttgttgctctagttatccactaagcggttgattccgagtttgttggatcatggcgcatgtatagctctgacgcatgctgtgttcatgcgggagtttgtttcgtttttccgttttctagggagtgtgtgtgccctgcatgttcttcgatcgtgggatggtgcgatcacctcgggagatatggctggggtgcctggttagtaggaacgcatggcgcacacctcagtcttgggatgccacgatctagtcagaggtgggagacgtgtgtatgtttgttatttaagttccctaatgcatcagaaaatcgctgccaagttcattgcaacataaaacctcgctttctcgcttgctctgttttctcgcttgctctgttttgatcggcatttcgtcgaaccccttcggaagttcgccaacagtagtgatatatgagatgtgtagtgcattccacgagatccatatgtgcattttatcacgagatcgacgaccacgcggcggccgggggccttggctcgatctcgccgtcgtcgtccactccgagaacgaccgaatgattgcgtccgtcctgctcagctcgcgctccaatcttcttttgtctcagctttgtctggcccttcttttttttttcttttgcctttttgaactgatgtttgtcttactcttaaccctctgcatgcgctaggcgattatacgattgatccatccaaattatgcaacagatcacagcaatgtaactagaaaggttttaagcgcgctcaaataaaggtgtaaggttgtgtaatggattaaccattcgtgtttgtctataagtgggttggtgagtcagcccatttacacctctatacttaaatctaattgtatgacacgtatatttgttataaaaaaatattttcaatcattacaataacattgaaattatattgcgcgagtggccgtctagggttattgggtggtggctccgttattgcaaacaccaaacagagatgtatatatttagaagaagctttattttcaagttggatgaactatttttaactctcaagagctcatgtccttatatctttttcccatagtccaagcagtcataaataaatatgaaaaagaattgatgtgtcttaatatgagtattaacaagaatttttttgccagaaaaaaaatgtattacctattaactaaatttagccaagtcatttaaaaaaaataatagtttttgaatttctcttatgtatgctttgattataaccgtctacaccataagtcctaagaagaataccctaagtcctaagaagaaaaaaaaatgtattacctattaactaaatttagccaatcatttaaaaaaaataatagtttttgaatttctcttatgtatgctttgattataaccgtctacaccataagtcctaagaagaataccctaagtcctaagaagaataaactttcgttcccagaagttagttttt

SEQ ID NO: 62101 - DNA, 876 bp, Oryza sativa
acttcaatgttacttgttatgacagcagaaaaaaatattgacacaacgtcctttcaacatgatattttcacagtattcttaaggtatatagttctatcttgccttccgtccattcttatattggatatacaatgaaaacacaggttagaagcagaacaaaggagactagaagaaatagggccaatagcatactattcggaatgggttgaagcgtataaaaacaaagacacttcacgagaagctgtacagaaacactttgaggagactggcgaagatgagaatactcaacttataacaatgtttcaacaccaaactgctggggaattccgtatcatgatgggcactgatgttcgcatacaacgagatcctttggcaatgaggatgcgggaagaccagatcaaacagagtatatcttcttttctcaatcctgatcattttatattattgacatctacaagccgcttttgctgaatttatacatggtccatcctacaatagcttctttctttaatcgtatttattctgttaaaatatattgtatgataaatcctggaaattgagcacatattatgatcttaacttagcacagaagtagtgttggcatttacctgagaatatatttggaacatccaaactacttgttaacttctatggtttgtttttgaaataaatatgacaaaccaaactttgtttcctgtcctgcttatagactggcatgatcctggaacggaagtcactgggtttgaacacaacatgacatgttttctccagtttcacgtggcactgttgtgactgtttgtatttttatgatatctacattgtttctgtataaatgcacctaaaatggtctattagaaatgtttacaactagtatat

SEQ ID NO: 62102 - DNA, 6062 bp, Oryza sativa
atcacaatcttgtacacctacgattgtattttcttgataactaaattagcatggttagacagcaaatactaaatcaggtattcagttatacttggagtatcctgaaatctattgttttgtgaactaaaccagtgcttgtcaatagaaacaaagtgattatcgcattgcctgccaagataataatataaggatcaagttgctgatgaggcgatagtacaataaaggacaaatttaccttgagcccaaaaagtttgaggatcacttctgcagctaaatgagtgaataccacttctaatgagctcttcttcctatcaacaaccttctttgctttccgaacgtagtctagtggatctttgtgcacgcctatgaagaacgggaggattatgaaaccaagtgcatttccccatttcacttcatcctctctgccagaattgatcatatctacgtatgcctggccattgaaatgggaaagaaatcacaatagattttaccagtccaaaattgctaccactacaagtatagcaacaacaatgttcggtcctgtgagcttaaattgccaatcttgaatccaagtataattattacatgcaggcttgtggttggcctcaaattgacaaggaggatcgatctcaaacgtatatcctcgtcagtgtccatgtcacctgcaaaggagaacaagcagcgtgggagtaaagaactactgtatcagccaggccgcaatttaagagctactgtatcagccaggcagcagctgctggagcatgattttattggacgcaattggtcacctgacttccggtagtaatagcgcgacagtgcagagtacgtgatcccaaccagcacatcattgaccgtctgcgagagtgcaggcaaacataaagagaggaaataaatctccccagaacttttgctgagggttctgtcctttgctacattcaatttgcaagcaggtgaagtatagaaatggagggaaaatgatagacagaaaaaaattcgtgtttaatgattatgtatactaatattttatccattttaaaataaaaaatctgataatcgatatggcataatctaggaatacgaatctaaaaaaatctattatagagacggagagagtaggtcctatgtggaagatattattacttctacagaccgacagtttataagacagcaacactagaccaaactaacgaaaaaccattagtcttaaaaattttatactctcttttttcttttttcacttgttagcaggatactttgactacatgacttctaaaagagtatatgtaaaaaaatttgtattatcaaagcattttgcatgctaaatataactatactatttaagttcataaaaacatcgtaattttatttaaaaagatactggtcaaagataatatcatactagtcaatatagtggagtacttctaatcttagatcaaggctagaaagtgacaaaaaacgaaattccgtaaatcaattctaaaattttaattttaaagttttctgcaatttatatgccgctatatactcaaacaaacaggctctctaagaactaaagaaaacatcgcttacgcagttcatggcgttcttgacgagcttgacgtcatcaaggctaagcccccggtgcacgatgcgcttccgctggaactccccgtgcttcacccgcttgaacagcgtgtgcgggtccttgaggaacatggtcgtggcgaagaagctcgcgacgtccaccacggtgtgccacgccagcgcgacgaacgaccagagccacgcagcgaacgccagcgcgcccgccgacgccggcggcctgggccgcgcgtagatcgcgccggtgcgcgtcggcagcggcggcatggcgggcagcctcgccgggtcggcggcgctgcgggtgcatgccatgaggagcgtgagcagcgacatgccgtccccgagggagtggtgcacgcggatcgccgtggtggccgccgcctccgacgtcgggaagtccagcacgtggaactcccacagcggccgcgactcgtccatgggcttggtggacagcgacgccacgtagtcctccaccgccttgtccgggtcggccgccaccgcgtccatgtccaactccgggtagatgatgtggtcgtccaggttcaccgtcgtccgcacccaccgcgggttgccgccgtcctcatccgtcacctgcacacgcacacacacgtacgtaccgttcgtcagatcagcccaagcaccagtggcgagctcctgggcgcgccgcccgcggtacggcaggtgtacggaccgacctggatgctgcggaagcgtgggtagcgcgcgagctgggcggcgatgccggcgcgggcgacggggtcgttcaccggcgtggcgatgccgatcaccacgacgatgaagaagtcctccacgagccgcgcggaggggctgacgggctccggcggcgtcgccgccgcagcccccttgctgccgccgccgccgccgtcgccgacccggaacccattgccgccgttgctgctcgtcgtgcggacggtgagttgccgcttccgaagggcggtggctgcgcctgcacccgcgtccatctcgtgtgggccgcggcttaactgcgtcgcgctagctagagaaagtgtagtgtagtgagctggttttgcatgggcaatgcgcgcgtccaccgcctagctagaccgagaaacctgttccgatatataggccagaaatgagacgagcgttgtgttggtggtagtgcagggtattcatgtggggactgggcgcgcgtcatccgtccgtgaccagggccgacgattcaaccaggggaaaaaaaaacagggctcccgtgaggaagcggcatcttgtctccgccggaaatagagctctttgttgttgtagagtagagatatacaatatacattgcgtgatccagtctgtgtttagttcacaccaaaattgaaagtttggttgaaattagaacgatgtgacagaaaagttgaaagtttgtgtgtgtaggaaagttttgatgtgattgaaaagttggaaggttgaaaaaaatatttgtaactaaacaccggcccaattgatttcttttatgcatcaaattgtgaatatgtaatatttagttgttcgaattatatgctctataatgatagactatgggcatattccgattactgctaaaatataaatattttttagaatttgccgatgttaaaattagcaagttgactatattgctaaagtttaataggataagctaaatatattgttatcaaaattctttaggcgttattaatgtttggtaacaaacttcatcatccacgtgtttgtgttttttttaaatgatatggttcaatgtcacaaatctgaataggctctagaacttcattgaaataaggatggaaatatttttctcggcgagaaataaattttattatcttattaaagcaaaaccgtagtttcatcaccgatcgaaccgatggactggtgacagagggttgactaggagaactgtgtcatgagtcgtgaccgtacagccgccaactgccaacggaatgtgttaatgctactagctttcacgacaaatcgacgtgattaattatgcacgatgagctcgccggatgcgagcttgcgggtcggattcctaaatgtgatagcgatcttacattcaggcgatggtgtccaatggcagttggtcaaaacttgcctagatggttcgagatttcttattaatgacgtgatatatactcctcaggtttcattttaattgaagttttagacaataacacggtttacaaaatatatttttgaccttattttcctattataatatacacaataaataaatacatgtttacttttattatattgctttgaaagacaatctatacgttgttctagtttctttaaactaaatatttttaaagttattgatggtcaaatttataaaagtttgatcttccaaaacatcttattatagaaccagagggagtatagaaatgacttgaatgatgtaccactgtgccgtgtgccaggtgtactcgtatttgtgaacgtactaatgttaattaacgcgtacatcgtccatatatgctcaagtctctcagactgatctatactgctaccaatcacctacatgatttaatatgtacacagttcatgccatggcaaacggagattttattatggccctctttatttaggcttaggtttattggcctagacttttaagttaacttattggcttatatgatttataagacaatggatttaatgtcctaagtttagtggttgagtcatacatctacctcacataagccaaaaaagcttctccaacctagcttttggcttaatagtgttaaagtggcttgtggcttcaaacaagccaaacggaaaagctgcttgtttgtttaggtttagacttttcgacttataaattggcttataaatctaaactaaagggcttatgtagctccgcaggcgtgaggcttcttgtgtttccttaattaattgctagtgcatctttggagtgcaaatatctgccagcttcattgtgggacacgaaaaatccatgaacggcccaacgatatataattaattcgcaggcaaacacccgtgtgcctgcggtgtgattgtgttcctttcaactagaatcaacgacaattcgtgttactacgcgcaaacgaaatacggagttactaggtactccatctggttataaatattgaatattttaattttaaattctagccatctacaatttctcaattacagcttttaaaaatagggtataagaaaatcgacaaattttgctacaagacatcagaaatatgtataatttactgatagatattgtaaaaacgtgtcatggctaaaagacatcctagaaaattagtgatttgctgaaaatgacacttctgactcgattggagagagaagttcttcaaatagacaataatatatccccctagggtcacttgcttcaaacatggtgttggagtaaaaatttagaatttatggaactctaaatctgccactaccataaatacatcactagagcatatatcatatttcatcttcaattctttctcgggtaagatatctaccaacaaattacacaatttgaagtgtcctatagcaaaatttgtcataaaaaattgtcttgaaaaatactattctaatagcataaacctattattagtttttataaatttattctagtttaaaatttatgattagaatttttaaaaacttaatcaaatattgttctgaatattaaatatttgtgactagctagagtgagtacaaggagtacagtacaagagcaaatgtgttttacagagcatactatatgcttggcctccatgcatgcttatgtctcaacgtcctagaaggaggcctcgggatttgttggaaatttgtctcccgaaatctggagctctccaaaaccacttgagtttttttaattgaatttcaaatgaaatttatcaaaatttatgaaattcgtcatatcactggcctagcactagcatcttgacccttcaatgaaagtgtgaaccttaagagacttactccctccgtctcaaaaatactcaacctaggagaagatgcgaccctcatagtacaacgaatctagacaacttctctgtcacatcatctcctaggttaagttttttttgacagagggagtataaaataagcccaaaaaaagagtcaggggttaagaactctagtgaaaaagtttgtggaataaatagactttatttcctaaattttattaaaaatactatcctaaagtactactccctccggtttcaaaactgttagacattttgagatttacttggtcaccaaagacttattagcccttgcatgtatacatacattcccagggatggcaatgcttcgatccccacatgcacaaaattcaatggtggactcaatccactagactacattagagcaaggctaataggaacaagtttaagtttaatagtatagccaactactagctccaattcatttatagtcaatctaatagctcattcgagttcgtgctacagctgactataatctgtagtccgctgctc

SEQ ID NO: 62103 - DNA, 8734 bp, Oryza sativa
tatgcaaactaccgtatttaatatgggcataatagagaataggcacccaaataaatccctccttgtatatgagatcatgtctaaaacgttaagattatttttgaactggagggagtacttctcactccaactactgtcaatttaaatttctccccatcttacttctcaaccaccctctctcttccaaagactgctttgtttaacgaggacgtatagatcatttaccttccttcccaatttgtcttataaatgctagaattgtttaacgagtctgtttctttgggttcataactgcaaagtaatgtagattacatacaagcttctccatacaaacttatgcgcatttcactgtgatgttctctacttttcaaataatacaacgaagatagtgatgatgaggatgctgacaaagttgttgcgcagcctgagtcactagaggtataatactgtactgtttacttgatggaaatgcatgcaatctgcggttctcaaattagccttgcaaatttcttcttattactggcagtgacaacagatctttcagttcatatacacatgcttattggaggctgaatgcctctcttgcagtacacatggaaatagttgatttattgatgagacagggaacttagccccgcaaacccaatctgaaattttcgctccataggagatttgaactcaagggtatttttttacccggcctctacatccaatggatatatacggccattgaaatagggaacttagccccgcaaacaacctaatctgaaattcgctccataggagatttgaactcaggactttggggtactactcaggtcactgtaaccactaggctatatgccctttcgtagttatcgatacttgtcctacttgaaagcttgtcattcctttgtattatactgctttaccaataggatgatgaagatgatggggatgatgctgaggatgctgaagggaaggtcagtcgtaattggagtgttctaaagactgccggacattctgaaaagccaaaggtaccttttcattattatcagttgtgttctaatggaaaaaagtgcagccttttggcactaacaaatgctgagcgtgtagcattcttgccagtcctattcatgagtcttgcctaatcatgtgcatatggtttagaaaattcatggaagtgtctaatgcatgcatagagtttgtaactgtatcaactcccactccaagcacgtaacgtaccctgtcgtaatggatacattcgtcagtgatcacaactcagtaactcacggaaaactcgaagaaagatcaactgtcactaaaagaagctattgcagattctgagaacttgactgattttcttatggactttgaagaagatgagtaatatctgggcatttactttactatgctacacgtacgttacacatggtaagcaaagtaaagcatagcagaccaccatttattcttattttttcagagaatatttaaccaaaagccagagcttgttctctggaaacttctgatcataaaacatctgatggtttcatttgactttagatttagttgctacagtgcatacaaatagataccacttaccagtagtattagatatttggatggtactccctccgtactcgtaaaggaagtcgtttaggacagcgacacggtctataaagcacaactttaacttcttgtttctataaaaatatttattgaaaagtgatatatgtatgcttttatgaaagtatttttcaagataattttattcaaactcaacaatttgagagttatttatatcacttttcaaactcaacaatttgagagttatttatgatttatattttcaaggtttgacttaaatattatcctaaacgacttcctttacgagtacggagggggtacaatcattcttacgaatacatgcatgtgtgcaatgattaagtagtgccttaagccttggtgtgatgctttcctaggctcaaagctgcatcctttatctgcctgagggattcggaaaaatcatccaaaagctcatgacaatctggaaattgtgcctcgtccacggcaagatttaccatcatggtgttaacgtaactttgaaaattcacggttaaggcctacacaagcaaaccaaacagttagatgtaaattaggtcttgctcatcacatctgtacccagattccatgacaaagtgaaaaaaatactttcaccatctacaacgctgaaggattattcatcactatgcacttgttatccttgttataaaagtgtcatacaagggcttaattacttcttttttcaacggatcaaagcaattagtttcagtcagattaccttattttcgcgatgacttaatgatatatggtagacagctaccaggctatatttcatgggaattttttgggtttttttttttcatactgtttttgccactaagccaaggatcatcgcatgttctgacgttcgtcattcatttgttttttagccctagtgacaaaagtgagatgctcatagcaaaaacaaggtatcatcattccttagtggcaaaaaaacccttccctgtcatagatttgaggatctgacatactaacaagttaatgcaattatttaattctagggcaaatatacatttcaggaacttacttctggaggtccatagccgctaggggcaatgaagacaactggatgcccacaaaactccacctgttcaactgggccgatcatgttggagaatgatatggtagtatgagagatcatacgatggaagatagcagctgctgcctgtttgattcacaagttgcaatgatattgggaacaaagaaatccacaggggatgttttttggcgcatgactcaaaatttggcgctgtaatgctctttctaggaaacaaggaagttaaccactgccaacaactgggactgtacacaatttctagtgaatatcacaatcttgtacacctacgattgtattttcttgataactaaattagcatggttagacagcaaatactaaatcaggtattcagttatacttggagtatcctgaaatctattgttttgtgaactaaaccagtgcttgtcaatagaaacaaagtgattatcgcattgcctgccaagataataatataaggatcaagttcctgatgaggcgatggtacgataaaggacaaatttaccttgagcccaaaaagtttgaggatcacttctgcagctaaatgagtgaataccacttctaacgagctcttcttcctatcaacaaccttcttggctttacgaacgtagtctagtggatccttgtgcatgcctatgaagaacgggaggattatgaaaccaagtgcgtttccccatttcacttcatcctctctgccagaattgatcatatctacgtatgcctgtggccatagaaatgggaaagaaatcataatagattctaccagtccaaaattgctaccactacaaatatactagcaacaacaatgtttggtcctgtgagcttaaatggccaatcttgagcccaagtgtaattattacatgcaggcttgtggttggcctcaaattgacaaggaggatcgttctcaaacgtatatcctcgtcagtgtccgtgtcacctgcaaaggagaacaagcaacgtggtgcaaaggagaacaagcaacatgggagtaaagaactagtactactgtatcagccaggccgcaatttaaggtggtgtttgatccagagatttaaatttagtctctgtatttagacactaatttagagtattaaatatagactacttacaaaactaattacaaaaatgaaagctaattcgcgagacaaaatttttaagcctaattaatctataattagagaatatttactgtaacatcatataggttaatcatggattaattaggctcaatagattcgtctcgcgaattagtccaagattatggatgggttttattaatagtctacatttaatatttataattagtgttcaaacatccgatgtgatagggacttaaaaagttatcagccaatcagcagctgctgtatcagccaaaattggtcacctgacttccgttagtaatatcgtgacagtgcagagtacgtgatcccaaccagcacatcattgactgtctgcgagagtgcaggcaaacataaagagaatgaaataagggcagctaaaattgaaagtttaattgaaattagaatgatgtgatgaaaaagttgaaagtttgtgtgtagaaaaattttgatgtgatgaaaaaattagaaatttgaaaaattattttggaactaaacacaacgtaaatctattattttggaactaaacacaacgtaaatctccccagagcttttgctgagggctctgtcctttgctacagtcaacttgcaaacaggtgaagtatagaaatggagcgaaaatgatagacagaaaaaaaattcgtgtttaatgatatttgtatactaatattttatccattttaaaataaaaaatctaataaacaatatgacatacatattctaataatacaaatataaacaaatctatttcagagacggagagagcaggtcctatgtggaagatatttttactgctaaagacctacggagtacagtttataagacagcgacactcgaccaaactaacgaaaaaacattagtctcaaatttttacattccctttgttcttttttcacttgttagcaggatactttgaccacatgacttctaaaagagtatatgtaaaaagatttgtattaccaaagcattttagatgctaaatataactatactatttacgttcatcaaaacaacgtaattttctttaaaaagatactggtcaaagataatatcatactcctagtcaatatagtggagtacctaatcttagatcaaggctacactactagaaaaatagtttttacacaggcggccaaaaaggttttcgcaggcgggggagtcatccgcggctatcccatcgcctgtgaaaataggttattttcgcatgcgggtccatggcccgcctgcgaaaataaagcgagggaacaaaaaaaatccggcgctacccgccggcgccggcatcctcctccggccgatggctctccacctccgtccggtgccgttacccgagggcgaggggagcgccgcctttgccgccgctgctggccggctcccctcttccgtccagatctgggaggggagtggccggtgctgtctgcgccgccgccgccgtcggcgtctggggggaaggaagttggtgcccagagccgccgccgctcctcttggccgccgcctcctccttgcgcgcatcgaggcgccgacggccgccggctgctcctctccttgcgcgcgccgaccaggccatcggttcctctgacgtcgtcgcggcccccttcctctcgccgccgccaacctcccgccaccgccgccgccgcactcgtggccaccgccctcaccccgccctccggccgctggccaccgccctccgccgccgcctccaatggtagacgccgcgcgccctacaccgccgtcagcgccagggagaggaggagaggtgaggggtggggagaggtgcgggagagagctgagaggtgagggaaagaggacatagaaaaaatctagggtatgtagcctctatttgtattcgctatgtattttcgcaggcggaccatatttttgcaggcggaccacttatatggtccgcctgtgaaaggcgggcagtgggtttcaccccgatttgtatttttgtaggcatctatttggctccaatggtcatacccgtctggaaaaataaaagaccaatgttgctaaaaattactccctccatttcataatataaagcacaattacttttttttaaatgttccataatataaggtatgcatacatgtaggcaattaactatggccccttctccattaaattattattttttaaaatcatgcactctcatgttccctaattctattagattcatgcattgtatttattaggatgatccaaactacaagatgataataattatttcttggtcttttagttaggggtggttatgccttatattttggaatggatggaatatttttctagtagtgctagaaagtgaccaaaaacgaaattcttaaattttaattttaaagttttctgcaatttatatgccgctatactcaaacaaacaggctcgctaagaactaaagaaaacattgcttacgcagttcatggcgttcttgacgagcttgacgtcatcaaagctaagcccccggtgcacgatgcgcttccgctggaactccccgtgcttcacccgcttgaacagcgtgtgcgggtccttgaggaacatggtcgtggcgaagaagctcgcgacgtccaccacggtgtgccacgccagcgcgacgaacgaccagagccacgcagcgaacgccagcgcgcccgccgacgccggcggcctgggccgcgcgtagatcgcgccggtgcgcgtcggctgcggcggcatggcgggcagcctcgccgggtcggcggcgctgcgggtgcatgccatgaggagcgtgagcagcgacatgccgtccccgagggagtggtgcacgcggatcgccgtggtggccgccgcctccgacgtcgggaagtccagcacgtggaactcccacagcggccgcgactcgtccatgggcttggtggacagcgacgccacgtagtcctccaccgccttgtccgggtcggccgccaccgcgtccatgtccagctccgggtagatgatgtggtcgtccacgttcagcgtcgtccgcacccaccgcgggttgccgccgtcctcatccgtcacctgcacacgcgcgcacacacacactcgtgccgttcgtcagctcaagcaccagcggcgagctcatgggcgcgccgcgcgcggcaaggcaggtgcacggaccgacctggatgctgcggaagcgtgggtagcgcgcgaactgggcggcgatgccggcgcgggcgacggggtcgttcaccggcgtggcaatgccgatcaccacgacgatgaaaaagtcctccaggagccgcgcggaggggctgacgggctccggcggcgtcgccgccgccgcccccttgccgccgccgacccggaacccattgccgccgttgctgctcgtcgtgcggacggtgagttgccgcttccgcaggacggtgtcggtgtctgcacccgccgcgttcatctcgtgtgggccgcggcttaactgcgtcgcccgtcgcgcgctagctagctagagaaagtgtagtgtagtgagctgagctggttttgcatgggcatgcgcgcgtccaccgcctagctagaccgaaacacatgttccgatatataggccagaaatgagacgagtggtgtgttggtggtagtgcagggtattcatgtgggggactgggcgttatcggtccgtctcatttctggtggtagtgcagggtattcatgtgggtactgggtgttgaaaatactggacctggccgacggttcaaccagggggaaaaaaacagggctcccatgaggaagcggcatcttgtctccgccggaaatagagctctttgttattgtagagtagaaatatacaatataccttgcgtgctccaattgatttcttttatgcatcaaattgtgaatatgtaatatttagttgtttgaattataggctttataatgatagactatgggcatattcagattactgctaaaatataaatattttttagaatttgccaatgttaaaattagcaagtcgactatacactgctaaagtttgataggataagctaaatatgttgtaccaaaattcgttaggtattattaatatttggtaacaaacatcatgcatccacgtgtttgtgattttttttttaaaaaaaatgatatggttcaatgtcacaaatctgaataggctttagaacttcattaaaataaagatggaaatatctttttaggcgagaaataaattttcggagtattatctttaagcaaaaccgtagtttgatcgccgatcgaaccgacggactggtgaacagagggtttgactaggagtactgtgtcatgagtcgtgaccgtacagccgccaactgccaacagaatgtgttaatgctactagctttcacaacaaatcgacgtgattaattatgcacgatgagctcgccgtatgagagcttgcgggtcggattcctaaatgtgatagcgatcttacgtactccactactcaaagaaagtcctatagcacaattttcaagtcaaaccttgaaaaatataaattataaataactcttaagttgttgagtaaatagatttgtcttgaaaaatactttcataaaaatatacatatattactttttaataaatgtttttttatagaagcaagaagtcaaaagttatatctttttaataaatatttttttatagaatcaagaagtcaaagttatattttgaagaccgtgtcgctgttctaagggcaagtgctatggtagatgtgactatcacctctaaatttatctattttattcactcatgaattaagaggcaacacatacaatgtatcacctctaacacacaaataccaatatctctaatactctcacacacttcttgaaatttgtgtggaggttatctcttgatttaggggtggctcatcttctctctctccacttctctcctctacctcatcacccaatctaatgtggcatttttaggggcaacatatgagatattatagtacttgctctaaacgatttcctttaaaaaacggagagg

SEQ ID NO: 62104 - DNA, 811 bp, Oryza sativa
ttaattgctagtgcatcttcggagtgcaaatagacttttatttcctaaactttattaaaaattggtatagtggcccgcgcagattgcgcggctagtatcgttacattcttttatacaatatcatatatatttttatattttattattaaaatatattaaaattatagcataacttttaattttgtaccaacttgaccaaactaaggctgtgttcgctacctccagatcccaaccggaatagtaacacacggaaaacggaacagtccattagcacgtgattaattaagtattagctatttttttaaaatgaattaatttgatttttttaaacaactttcgtatagaaactttttgcaaaacacacaccttttagcagtttgaaaagcgtgcgcgtggaaaacgaggaagaggggttgggaaaggagacatccgaacacaccttaacagatgtgtaatattcatattgtattttatatacatgatatttattaattatttaatattctaattttagttaattataaattgtattcctatataaactataaactcatattctaatatttcttatttttcaattccgaagtcatgttatttacaaattttattccaatatggactctaaaccgttatttcaatattccttagtttaaaatctctaatttcatttatttctaaattgtatttctatataaactctagactcctctttcaatatttcttattttttaattttaaattttagttatttccaaatctatctgttatatttttaaaacagctttgaaaggaggcaccacgttcgctgtgg

SEQ ID NO: 62105 - DNA, 948 bp, Oryza sativa
tttttatatttgcacaattttttttgaataagacgagtggtcaaacagtacacaactttttatttttttatatttgcacaattttttttgaataagacgagtggtcaaacagtacaagcacaatttatgtgacggatggagtaactaaaattggttaaaaagactattgaaagaaaagaccatctaaaacacatgacgaaaccatctaaaagtagggtggtggcggttgatacgacatataaaaactgttaataaaacaccaaatagaatcctaatgacgattaaaaggagggacgacaggcaagccgtgaagcaacaggcaaggccgtttccgggacttctagaaagtaaaaaatataaaccccattgataatcatatttaatttttaaaatctcaatgacaataaaaaggagaagcagcgggcggggtgtagaggagtatagttgcagagccaccaacgtttggtgggacgtctagaaaatataaaatgaattccaacaatagttatgttcgattattagaatcccaatgacaagaaagagtaggcgacggacgggccgtagaggagcgtagtggcatcgtttgatgggacttctaaaaaaatataaaaaatgaaactcaacaagacagtaaactctaaaaactacaaggtccaatttttaaatgttcggaacttctaaaaagtaaaagaaaaaacaatgataatcatgttcgattttaaaatctcaatgacaataaagaagggaggcaacggacgagccgtagaggagtataatggcaaagctgctgacggtttggcgggacttatagaaagtaaaaatgaacccaaaggataattatgttcgatttttaaaatcccaatgacaataaagagaagagacagtggatgggccgtagaggagtataatggcaacatttgactgcgcatctagaagggctgcaggaat

SEQ ID NO: 62106 - DNA, 7545 bp, Oryza sativa
tggtgtgactgttaaaaactatataatagaaacacggggatgataaggtttggtctttcaaagtcttaagacaacgagatagcttttaataaattttaagtgaaatcataaaaaaatatatgattttgtttaggtgctagccacgcaattgcgcgggccacccagctagttgtgttcatatatggactttagactctttttctagtatttcttttttttttcaattttgaactttagcttcatctaagttgtatttcatatggactctagattctttttctaatatttttttatttttaaatttctagttttagttttttctaagctgtatttctatatggactctaaattatacttttaatttttcttatttttaatttcgaaattcaattagatctaaattttatatgtttttctatatggactctaaacttatctttcaatattctttttttattttcgaatttcagttatttctaaattgtattcatatatggactctagactattttttttcaatattccttaattatttctaagctctatatggtctctctaacctcatcttttaatttttcttattttttgattccggattttagttagctccaaattgtattcgtatatggactctagtctcttcttccgatattccttattttctaattccgaatttaaactatttttaaattgtatttctatatagactttatttttctttttctctgattaatgtgagaatttctaggccgtgagagtgaacgtgaaggcccatttttctattcctttaataagttaataagttaatagatactatcctaaagtactgctccctccggtttcacaactgttgacattttgagatttacttggtcaccacagaattacttacccttgtatgtatacattccaaggatggcaatgcttcgaacccaacatgcacaaaattcaatggtggactcaatccactagactacattagaattaagtataatgtgcaaactaccgtatttaatatggcataatagagaataggcacccaaataaatcaatccttgtaaatgagatcatatctaaaacgctaagggcttattcggatcggagggtaaactcaggaaaaacataggatctgcattcctatggattcgggtactgtagcagcattcggatcaaaggaatcccctgtaggaaaatcagaggaaattcgaaggaaaatttccttggccatccattccacaggaaaacaaacaatccactccaacctctttttatttttcctgtgcatgggaacgaggcaatcaacaaactaatcttcacaagcttcactcctctgacacatgatgattttagttagtgggtaggttctttaaaaattcctatgtttttcctacgctctatccgaacgcatgtttatatagtattcctatgtttttcaattctctgttttacacgtgcattcctatcatattcctatgattttcctattcctgtgttttttcaatcctccattccgaataagccctaagatttttgaaactggagagtacttctcactccaactactgccaatttaaatctcttctccttactacttctcaaccaccctctctcttccaaacactgcttgtttaacgaggacgtacttccttcccaatttgtcttatacttttttttagataagggtatttttacccggcctctacatctaaccggatatatacggccattgaaatagggaacttagccccgcaaacaacccaatctaaaatttactccataggagatttgaactcaggaccttggggtactactcaggtcactataaccactaggctacatgccctttcgtatttgtcttataaatgttagaattgtttttataacagaggcagagcaagtatcaaccaaagatacttcagggtgagatatcagtttgagtatattttaagggcattaattgggatgaaacaagggcgcatttaggttgtgtttagttcacaccagaattggaagtttgattgaaattggaacgatgtgacggaaaagttgaaagtttatgtgtgtaggaaagttttgatgtgatggaaaagttggaagtttgaaaaaaagtttggaactaaacacggtgtcaaatgacagaatttttctgtgcatgtgagagattagactattatcgcacgtcgttaaaacatggcaggaccgcacaagaaccatacaagtacccttttttttttaagataaagagagttttattgatcttaaacaattacatcaagatgatacaatttctctaagaccactctcggcctctgcatagttaggatgtacacagcctatcaatattataaaagaaaaggaaaaaaaagcgacacaactgctacaaccgtgccgcagcgacttacatctacgagtaatcttcatctcttatctccaccaaaacaacacttagactatcaaacggactccctttaaaacaacgcctccaatgaggaaatgacgtgcgcacgcgtcatcattgtaatgttccaatcaactaagatcagaccataggttttcacctagggaaattctgtgaactctagacaatgtcttcaagaaggaagaacatccattgccaagtacaaccaactaaggacagacttagggatttaaccccggagttaaagaattagtaacaagtaccgcctgaatgaagcccactagtattgttgcccccttattccgagacagaacctccataccccaaacttaacataatcacaaaaggccacgaacataattacctgcatccttctatagatatccttcgaagataatgtcgcgagaagccaaaaaggcacacacccaaaatccataggccatagctaaataccctacgaagataatgtcgtgagaagccaaaaaggcacacgcccaaaatccattgggtagatctaaaggatgagatatagataagcgatacctttaatcgaagtcaagctgacgatggtctatggtagatctgaacgccactgccttatgatgatgaaaacatcatcgcgagaagtagccactaaaatgatgagaagaaagttggcatccgcctccttcaattgtagcctgccatattaccttatcggtcccaaaatagatccctccaccaccatccacaacgaacagctagagggtcataggaacgaaagaatctacgaatcaggctgccgggttgtggcgacgagtgtactcttcacctcgaaaccccagaacacctttagcgatctgggaagcaagatgaagaaccacaaagagaagcgtttggggagacgaggcttgccgtcgacgagtcttggtggaaccacgcgacgaggtgaaggttgccatggagtctgaacccctaccggcaccaagcgcatggtgaggagagcttggcgatgtccacctccgcactcgatcttgagcacgacgtgcctgtcgccctgttcctgatgccgccaccgacaaattcttccagaatcgctgatcagcgcatgtctgcatgatgccccaccgccgccttcactgcgccccgcacggcagcgcgctcgggcggcggcgagacggcttcacttaggtggtgtttagatccagggacttaactttagtccctgtctttagacactaatttagagtattaaatataaactacttacaaaactaattacataaataaaagctaattcacgagacaaattttttaagcctaattaatctataattagagaatgtttactgtagcatcacataggctaatcatagattaattaggctcattagattcgtctcgcaaattagtccaagattatggatgggttttattaatagtctacgtttaatatttataattaattttcaaacatccgatgtgatagggacttaaaagttttcccatctaaacaggccttagccggatcgccgatccacgctctaatcacggatcggtgcgctcgcttctgaaacggctacctgaccgaataatgacaggccccgctgtaccatacaagtacagtacagcatggagtcagtcagaccgccatcctcccttgcgcctagttcggacgattgtaatgaacgaggatatcatttgaattttgactttactgaaaccggataaggcctttgaacataatcattggggctagcaatttaggtctacgtttctgattgaccgcctgatcccggcggtttcaccgtctttgacaaattttgaaaaaaaattcctgttttcgaaatccttcccgaaaattgatttcgagccatatagtagaccctgtttagttctaaagttttttttttaaacttctaactttccatcaaaacaaacattttatacacacataacttttcagtcacatcgtttcaatttcaatcaaacttccaaacttcagtctaaactaaacacagccgtaataccaaaagatcgtgaaaatcaatcagtttttgtcggtaaagtaaaccctcagcttttcttcgtcgttttgacgttttgactaggagctgtcaagtcttttttattttttgagaactaggagctgtcaagtctactccgtccatctcaaaacaagacaaaccatgggtttccgtatccaacgtttagccgtccatcttatttaaaaaaatatgaaaaaaattaaaaagacaagtcacgcataaagtattaatcatgttttatcatctaacaacaatgaaaataataattataaaaaaaattcatataagacaaacagtcaaacgttggatacggaaacctagggtttgttttttttaagacagtgggagtactcggcaagtcggcagtagccagtagtacgactagcaagtcatgagggtgtggttagatcaagggtctaaagtttaaacgtgtcacatcggctattatataggatatcgtatagggtgttcggacactaataaaaaactaattacagactccgtcagtaaaccatgaaacaaatttattaagtctaattaatccgtctgtttactatagcatcacattatcaaatcatggagcaattaggcttaaaagatttgtttcgtaaattagtcgcaatctatgtaattagttattttttagcctatatttaatactttatgcaggtgttcaaacattcgatgtgacagggtaaaaaattttggggtgagatctaaacaaggctagttaataaataaaaaagaaaactataaagcgaccatgaagggggtgtaggatcgtaaaagtaaacaattctatgcacgtcaaccatatcggcatgttcattagatctggctgcggctgcagcttctctgcagcaacagtagctatttactgacaaagcgaacatggatatacatcgatagaacaacttgatatatgaggattaattaatttcatagtgaagaatgttttggtgtcataggtgttgatggcctttgcctatattaggggatgctcttttttttttccgagaggggatgatcaagttagaatggagaaagttcatcttttagatttgttgataatttttttaacaaatatgtgaagctgacttgatgcttgatagaatcatcctactaaaagaataattagtgatgaatatgagcatccatgttaattctaatacttaaatccagtgaacatattccaccacaagaaatctaaccaaccagttaaattacacatacttttcttatttgagccaatttcatccgtaaaaatattacagtatatttttagtgagcttatacggaaagatgggaacagttgcgattttaattcatttactaaaaaaataaaatataccgatggtattacaacttaaaaaggatgtaatttagtagtttattcttacaggttgttcaacacgaatgttacaaaacatatagcgcatggcctgtactcattgctaagctggtagattgccctaacattatacgctcgtgagcaacaggggcatgacaaatttatgtgtcgagaccagcaatgaaaatgcaaatcaactcctatattctcagtgtgttgctgctggtgtgtttttcaatcaacacatctgcatagtggttagcactaaaaagaaggttcatcttatatcagatttactatcaatagtgctagtagtaattattgcacgtaccgttggtttatttgtagcttatgcgtgtatgaccgtgttagcgaagtgatcaacgtgacgcatgtacatggaacatgttttacgttattcgcatattcggaaaagatcatttacttgtttgagtattttgctagacaagtgacaaaaatataccccttccgtcccaaaatatttaacgccgttgacttttttaaacatgttttactgttcgtcttgattatttttttaaataagtaaaactatatatatacataaaaatatatttagtaatgaatcaaatgatatgaaaataattaataattacttaaatttttttgaataagacaaacgatcaaacatattaaaaaaatcaacggcgttaaatatttaaaaaagtcaccttgtaaaattgtgatacaatcggtatattttacttatttataaattattctataattctttttttaaataatgcaacacaattaatctctctactaatttagtcaagagattaagtgaagaatataatacgcagcaggattattttgccgtgtcaatccgaaaagcatagtttatcaatctgcttggagaaaaccatgcttaatttggatcaaacctaccgagatgttttagccacgtttacgaaggattgacgtggcccgctcctggacaaccttccacgcttcgcggacatggcgctcctcggtgagcgtgctcccgatggcgcacctgagcatgtacacgccacccaccatggcggagctcatgtacggccccgagctcgccgcgttcacctcctccaggagcctcctgttgagctcgtttgccgccttctcgcctccgacgccgacgccgacgccgagtctctccggcggcgaccggaggcggaagcacaccagcgcgaaccgcctcggcgccaccacctcgaacctcgcgtcgcccctcaccatggcctcgaacgccgcggccatggcgacgtgggagcggacgtgggagcggaggccctccacgccgtagcagcggagcacgagccacaccttgagcgcgcggaaccgccgcgtcagcgtggtgccccagtccttgtagtcgacgacgtcgtggccctccgccgccgcgtccctgaggatgtactcctgctccgtgcccagcgccgccaccagcgccgacggcgccgccacccacaccgcgcagcagtcgttgttggcgaggagccacttgtgggcgttcatgctgagcgagtcgacggcctcggcgccggcgatcacgtcgcggaactccgggcacaccagcgccgacccggcgtacgccgcgtccacgtgcacccacacgccgccgtggcgcgccgcgacggcgcagagctcgcggacggggtccacggcggtcgtctgggtggtgcccaccgtggcgcacaggaacaaggggaccagcccggcgtcga

SEQ ID NO: 62107 - DNA, 15040 bp, Oryza sativa
cgtcgcggcacgtcggtatctcgcggcagtgctcccgcggtatcccggcgatgcgcgcggccttgcggaacgcgaagtgggtctgatcggagcagtagacgacgaggtcgccgatcctcctcgcgccgatctccgccagcttccggtccctcgcggcgacgagcgcgcagaggacggcctcgcacgacgtgcccaggatcgtgccgccgcctccgccggcgaacagaaggctctccggcaggtgcagcgccctgccgagccagtccacgaccaccatctcgagctcggtggcggccggcgaggccgcccacgtgaaaggcacgacgttgatgccggccgcgagcgcctcgccgagggcgccgacggtgctgctcgacgccgggaagtgcgcgaagtggcgagggctctgccagtgcgtcacgccaggcaggatgaggtcgcggacatcccgcagcgccgccgcaaacgcctcgggctccgggcgggacggcgcgtcggcggggagctggcggcgcaggaagccgggagtgacgcttgggtggacggggtagtcgcccaggccggcgtagtagtcggcgatgaagtcgacgacctggtggccgagccgccggaactcgtcagcgtcgagcagtagcgcggtatctgacgccgccggcgtcgacgtcgtcgtctccacctccgggatggcaccattccgtggggcaccgccattgatggtgtggcagtgcgagggtggtgccatctgcgggaacgggcgtcggtacgtggcggaataggcggtattagctaccaaatttattgggctcgctagctaatgctctggtcaataatgttagcaatagctacaccagcgtcgatctacccgtataactgtatctctctatctatctctatacttaatgagcaatgtgtgccacattaattgggaaaaaaagtcagattatcgatttaggtcctattttttatccctctctcaaatagccaaatagccaaaaaaaaaatctaaaaggtgagctatttgagaactatttgaaaataacccatctaaaaaaatatcccacccaaggagtgctaatttaaactattttgggtggggcccactaaaaaaatgccttttatctctatctcttttcatgggaaggtatattaaaagccaaatagctctcaaaataaccctttgatccgaacaacttagggctattttttttggatggctattttcttgtgctaaaaaatagctctcaaaataactcgtgactagttctccaaacatgatcttagttgggtcacatacattgtattgccataaatgcacgttaattacttccttcgtcctagagtaccataatagaagatgcggtatctataacttagaacggtatctaaaattcattttttaattttttattatatttatactttgtagcaataaaattataaccattcttgataaaaaaaaaaagatcataaccatgtggaaatcaaatgccaattatgcgatgctatttttttttatcaaatgtgtctccaattatagcaatcagctgaaaaatatgtcaaaaaattatagcaaaaccgttaaaaaaaatgagattaaaagaagcttaggtataagtgtgacctactactacctccgtccagggttcacaattccgatgaaaaccgacgaatttgcggaaaaccgaggttttgacgtggctcaaaagtagaagccatttggaatttcgatgggtttcatccaaattaaaatttaaattgataaaaaaggaaaaaaatcaaatcaattcctataaatgatatgatattcatagaacctatatgggtataaattttccaaaaaaattagtgtattccgtgtattcttgaactttactgtagaaaagagaataataacaatatttttaaaaaaatgaatacactttcttggaccgaattccatgtattaggcctacttagtacatagcccagataatgatgtataatagagagaggatgtggtcttgcacctgatttcgctcggaatttcgcccaagccaaccggttttcgtgagcatatcgataaactcagggaatttgtattcaaattttggtttatgaaatttgttcgaaatctaccggcttttcaccggatttcgcgaaaaacgtcatactaccagagcccggaacggaatgtcatctcggaattgtaaaccctgcctctatcccagcaagtcacaaacaaaataaataattattcgataactttttttaataagacgaatgatcaaaggttacaaacaaaaactcaaggcggcaagtattttgggatggaggtagtaactaatagttcccattttttactattaatcatgaaaaatataatggctctaaaccgggtaaaacattgtcgacgttttaggtctcgactacggtatttgtatggtatgagaatcgtcggtaccaaggtatatgcgagattgaggtaaaagagacagagataaggattttatataggttcgggccccgtatgtgataggtaatagccctactcctgttggccgaagccggtgttgctctttattcatctgaatcacacaagtacaatatgtgagataacctatctatccaccgtcaacttggtggtatggataaccaacatgtagtcgacgacagggtaatcttcctcctcgagtattagcccatcgtaatcaaagatggcgctagatccctcttgttggcctccgcaggcaccataaggggtctgtttaggtttatccctgatgttaatgtctagtgacgtgtgttggcttgtgtattgtgtgtctatctattgttgtgtactctctccccctatggggtcttgtatttatacccatagatgtccctttgtccaagtagaactaggcagaccaatatggatacaatctgagttgtccttatcatttccatatagaactctacttatccttccttatccggaactccttctatatacgaggtatgatttcatataggacttagtatatggtgggcgtcgccgtgtttactcaactactattagatatgcggtatctataaccgtcacaaacatgatgtttgctaattcaaaattttgggataattaaatgtttgggaaaagtactactccactctaaaactcagaccccaaaaggagaacaataattggtagtactaattaattctcgagttttgaaatataactaaatcacgaagcatattaaggtagtttttcaaaagattattcaccagattattactgcagatattacacttgtttgttagattaacttaaatattttgagaaataaactttataaatagcatagaacaagtggcataataagcattaaggtggaagaatgtttttttagaagtcatatgtttagaaacatggagtaaataaatcaggacaatagtccggtcaaaaagctggaaacaacgagtccaacacaaatacaaccagagacttattagttgcaaattttataaatattaattaaaaattataatggagggcgcagtatagtgaactttttttccagagaaaggtattttttttacccggcctctatatccaaccggatatatgcagccattttaatttagtaacttagtctatcaaatagggaacttagccctcaaataacccaatctaaaattcgctcctaggaagatttgaactcataaccttacggtatagtgatctgtttgggggaagttattatctatagttagtttttatggtagaacccgttggacaggcttgagaggtagtggttttattttgtggaggatatcataacaccaaaatttgcaaatttgaagtctacgtgtaattttgtactctgtcactgaaaaatataaggcatgcatgtatttgaaaagttggtagttttaaatttgaaagttccttaatatgatgttaacttaatagtcattgattattacaaaagaaattaacaaccaaagtttaaagttgggactattttacacactaatatgtcttatatttctcgttggagagtaatcattaaatttataattattgataaaataaaattgtgcctagcacttcaagaaagtagatacatatacaactttcaatataacttagataaaaagtggaagaaaataactgtacgaatgcacagagtacctacccgccaggtgatggtagtagtaattcaatagaagtgtttgtttttccgtacgtacacccatttaatatatgcaaagttcacgacaaagatctgaaacattttactagtaagataaatcaacatatatatgacatatcaatttacaaatatgtaaattcaaattcaacttatagaaatagataataaaaataacaaatatcaattgccaatagtatgcactttttatagttgtatttattattttgcggagtaatatattatattttttagtaatatattatatattaatttatgttatacttttttaaaaaataatgactttttgggtggcacatataaccgagtgtacgctttgtcggctgaaaaaaataagtttcattcattggttatttccatatatgagcatgcattgtaccaccgcgactggtatgagacatgatcaactctgaaaacccatttttttatacatatggagtgccactagagtctggaccatgcaccgatgcacaggaccggaagcgggtagtggttatctgcctaggcatcgagcatgaattatactctctccatctaaatattactttttggttttttctttcaaaagtttaagatctatttgtaatatttatgagctaaattaaatcaaaatccaagaagttattttagtacttattggtttttatcacatggtaaatgagttaattatattttagttttggtgacaaaagaataaatagattttagacatttggatggagtaataaataaatgttctcctcctaactagacgatgaaaagcggtcgagtggagtggcattgagttgcatgcgcagagagccagatcaggagatcgagctagctacttcctctatcttataaggaatttaggtgaaattgacacatcataatactacgaatatggacatcaagcctctttcagtggcccgaaaggtctcgagaatagtatgtaaagtactccaataaaattacgggtgccatgcagtgtctccagcaggtgcaagtgcacaagataaaagagagaagtgaatagggtggcgcacgatcttgctagaatagcaatgagtactaggtctaatgctgagtggaggctatgtgccccagcacaaatcctaaacttattaaaccaagaatgcaaccctttattccgtcattaataaagctctctctttaatgtaaaaaaaaatgtaaagtactccaatggaatgcccagtccccgatcgaaatgtagttatcgcgtggttgtgcctgtgtcccgccggcagagcacgagcgacaccggaacgaaacgagaggcagcgcgtgtgaacagttgttcgtacgtgccgtcatgcgcaggtcatacctggcgtgatcacttcaacgttactttgggaggtttttgctaattaaccatcgttcggcgcccaaaaaggtttttaccaaagataatcgaattttactgagttatactgcggctacctagctacgcctcgttcggagtagaagtaaaacgcatggcccgcaggccatagccaggttgggcaaattatctatcgccaggtcaagtgcccaggtcatcactcctcaggtggtgcactggtgctcgatgcctcgatccaatgccagtacgggtatactgctcagtgcttgcctgtagttgagcatgcagccggccgctctgccaggctcattcaattgggtccggccggcgtgtcggctgacaagtctgcagcactgtacatctgggccagcttcaattcggtcaagagttgctgaactagatccgtcctgcgtttcggcctttaggcctgtcttgcacagacagaaaacccgtcccgatggcacaggatttatttggttatctccgactagatggcacagaacggcaacaacgatgtcagattagttttcgcacgacccgtttcacgagtgctggatctgttgcaagagtgaacgctataaatgtgctattgacgtactagaactagaagaactgcgtagtagcatactcataccattaccagtgacattctgggtcacccggagctaccccactcatcatttcatcaacaaatccgtaaatcttgatacggcacttgctcgattcaagaaatcaggagttcagcgcacaaggcacgtaggtttctatactgtagtcacgcactcccttttatccaataaaagaaaaagtcagtcgggaagtaactttgtagtctgatacacaaaaggttacaaggtcacatgaggcagcacggctcaaacttttctggaaagcagagcatgttttgtccataatttgatacagagctaacagcacagtgcgggcaactaaaagcaaaaaatgacactattaaatctaataatcgatggggcctcctcgtagaagagacaatcaacagatgcgttgtctgcatgaccgggcactccaacctcatgtgtagatgtatttcatggcatttcttcagggtgcttttgctgcagataacacattccattccaactctatgccaaacagcccaacataaacaggtgtatatacttacagatgcctgatgtccaccatgactcctagatacgtctcaatagcatcccatcatatcctggaagtaatggtgaaaatgagttcagtaaaacattccaatggagcaaactaacaatcacaaaattttgcactagcagaatataacaaggcctgtaaaaaataatgtatcgtcttcaccaagaaacaccccagtcgttctataatctggtaaaggacaccctgacacgcataagcatgaaatgcagtaggaaacgaaattatcaattgcaaacgtgcaccggcaatatctaggaacagatccttgcttgatgtcaataatgatgaagaaccttagtctgactggcatactaacaagatgaaggcattgctagccatgttcaaaatgaaggattttagaatagtcataatgaaggacttcagaatatcgaggcacaacagattagggttctgattttaggatatcgacccacaacatagttggcttctgacttcaagtcaccaagcactatctcgctaccccaatgagaacacaacctcctagcactcacaagtaatccccagtttagtcctacaaggtaacaattcaaaaatcttcgaatacttggtaaaagtgtcctgctcatgatatcaaggaaaatgaaagtaaaatggcatatcagaatatctggagaccacatgaacaatcctccatatgataaccctcctatatcttgttacttttttttctttttggcatcaaccatgccaagttgccaacagggttacagggcaacgtcaagcacatggtgtttactgcaaattaattaggaccagctcagtacataatccaggcaagcctgccttaacagaagtaaagctctgccctattgtgctgttctaacataagtatgtactagactactttacgaaaatgttttccatcctggtcaatccaaattgcctcatctcttatatcacaaactactgaaactactctgttcataaaccaaatagagtcaaaacaccagaaaacaattaaacttgacaagttaaatatagggaaccggtcagttggcctcaatgcctgaaaacagaataggagaattcataattagctattttgttggcacatttcatttgtagaatattaaatccccaatgttgtttccgttgatcaagaattcatgcatgttgcagttacatcatcgaggactggttaggctatacccatggatcaacaagccactactcatggttatatctataagacttcattgattaaaactaattggttatagtcatcattgatcatgtataataggacctcacaatacttttcacatcaaaaactgaatactggatatctttttgcaaaatttagtgccaactagaatataggttttcaagaattagagtatgattcaaagtaattggtcagaatgagcacaaaaaattaatacaacatgttgtttgatcagtcaaaggaatttaacagaatcacttgtatagcttgtaaaacagaattatgatcctttatctctgaaactaatccagaaacccataaatagagacataaacttaatataatgacaactgactctcacttcaaaattttctttagataaataaagtagccaactagtcatgcattagataaaacagagtagtttctggaatattgcgcatcacctatatgttggtagcaattctattccataatcacatcaagtggtttaagtggtaatttacctccccaaagtgtagagctctctgaagctgcctctctgatggtcagaatgagttcatttcaagactatatgtccgccgcttgagaagcacctgtgccgctgttcgatatggctcctcaaaggcatctaaaatccagctagctcctgtcgggccagcaacctcaattcctcccccttcccttagaacatcctcgcttggtctgattgctaccagtgtagcacccttaagcagttggcccccaggaagctcaatatgcggagcgtaccatagccgcatactaagtgctggcatgagtgtgcggtgcgagttcccagaagctgacacaggccgcacacgcagctcctgcagctgcctcttgtccatagtgaggacgccctgcccatcagcatccgtcaggtccaagctctcgagtgttgagtgatctgcgatgattggctgcagcaagtaatgccgtgccgaagcagcgatgagtgagctgatcgtccagacaacacggagcttaagccctccattcgtatagagtgactctgggatgttccctaattcatcgggctctctgctggaatcgggagaggcagccgagctgtctgcagcagttgggggcggcgcggccggtggtgggggtggcttcgacgttacagatgacgcgccgagtatgacacagctgccgagggtggaaccaaagtcagccttccacttgaggagcacgccgtcctcgatgccgagctcgccggtgggcagctcgatgtggaggcggcgcagctccttgaaggagcggaggacctcagacggcgaatggtgggagacgtccgcggcggcaggagccggtgcggcgggcggggcagcggagcgacgggagacggtcgccgcggccggggagaggatctgcccgagtgcctggatgggcctgacgatgccgccgagcaccaggcgcgcgagatgcgcgagcgcgccgcgcccccgcgcggcgggaggtcccccctccgccgccgcagcggcctgcgcggagcccgccgacgaggggggcgggtcgtcggatatgacgcagtcgacgcggacgaacaccgagtcgacgagggggacgagcgcgtggaaccgccgcgagacgagcgcgcatcgccccagcgccttcacgtcgccgatgcggccgaacacgtcgaggagcacctcgtcgggcagccgctcgaactggtcccccaacccctcctcctccccaccctcgtgcccttccatcctaaacaccggcaacagcagcagcggcggcggcagctcgcagatcgggatccggaggcttcggcgctgggcttgggggggggggggggggggcgtggcgagtgtgtgagcctgagccagtcgcgagagagctggagaggggaatttttttggtggaatcgagcgagggtgaggaggagttagccacgcacgcacaccacacgcacggcacaccaccggcccaccgcacggcacggcggctgagcgtgaggcgaggtgggggtttggctttggctcgtgtggtgtggtgtggtgggcgtgggcgacgtgtccgcctcacccgctgtgggctcacggccttttttcccccccggtgcgcgcgtactacgggagcacggcacacggtgacacagggcaccgcgtctcgtgggacgatgcgaggtttccaccgggaggaaagatctactagtggctacgtcacgtcgccttcggccgaaaattccgacggcaactgctccgtccgtccgacccaccgcgaccaattggggttgggtgttggatccgtagccggtgttccgtcgtgggctgtgcgcgcttcacatcgtcgacgtcgagccgcgcgaggggagcaagcaacgggtgatctcgcttctgtcgctcgctgtgtgtgttgttttgtggtggcgtgcaaggaagtacaactcgcggcaaacctgataaagcgatggagaccggactggacggggtgtggtcggtagatccccacggagccgtctgatctccacaccgacggggcggatgtacctctctctctgtgagaaaacaatttgtctgatgcatctcatcctcaggtgcttggactttcttcgcctggattggtgggaggagggattcttactcttaacagcgaagacctgattaaattaatccatgttgttgtcggaaggaaccatcagcttaatcatcggaagcgactagtggccagcttgcgagcatctccacagttgacgctgcagctcatcgctcgagtcgacctggcaacgtgctgccgatctctgcatccgtgcaaagccgattcatgcgagggaacagccgtcaaaaatgcttaccgctgcggggtaccggattaggcatgatttgggcgcacgagatgtgtaatcatgcgtaaatgtaatcgatggaggcttcggcgtcaagcgacctatagtaaaatggagtggatcttctttcttttcccttgtttttttttcttttttggcttcaggggtcaatcgtgtgcgtcagctcgagtgtgattggagcatgcgtccagagaatgaatgaatgagtgaatacttgattagatttgcctttggctgtgttgtgtcatctgtgtgacgcaacgcaatggcgaccacgccagataacttcccggacttatcacacacgtctctagtaccctactacagtatttctcaattttgcgaaagaaaaaaggtagaataggtgccagctttaattttgccaaacaaaaaggtagcaccttccaagcctctagcttatttctcaattttgccaaccaaaaaggtagaacaacttctcaattttgccaaagaaaaaggttggccaatttctcaattttgccaatgaaaaaggtagaacaggtggtagcttcttagtttggccaccgtgctacgtgagcagctattgtgccggtcctcatttgtaattgtaccttgggttggatctctcagccgggaagaacaaaattggctcaggtattctgctgcttcagtgtgaagtgaagtggcacgtcaacatgacacacaccacctcactggggtcatgtatgtaacacaggaaaactgctgcttaggcaattcccaaattttccaggcttaacatactcaaacgtgaattgtgaaacccagagctgtggcagaatttgaacatctaggccctacatgacaactcaaaatgcccaaatcgacattgctataagtaaagagcaagagagtagaatacagcttggaattgaggtaagaaatttgcggggaaatagcctaaaaaaataaactgattttcaacaatatgatgtgtacaggagtaggcaaatttccccatagcttcatattcattccaagtatcaaagctcaaagtgaccgaagtagcgggcttgctttttctttatatatttggatattgtagacacatcaccttgaataattgtctggccatcttccatataaatagcaccatcagcatatctgagttcttccagtcgatgggtcacccacaatgctgaaacctccccaccagcacctacagatttccttaccgccttgataacacccatctacaatttgatgaaagaaagagtagaacgctcattttagtcacagtgtcattaccagagcggagtaatacatgctactaaagagtacatattagaaacagaaaaatatgaatcgagatttcaacaaggggtaaagttgtgtttagccatagcttttgaggtatgatggccactcaacaaatgtgaataaagaaaagaaaattgcatttgtagaagcaaagctacacaattgtttagttgtttaaataataaatcgatctggggtttttcagtgatgtggttaatcattgttctcctcagcataatatttagttacctcgtgatcaattactacctctgttttttaatatatgacgttgttgactttttgacaagcgtttgatcattagttttattgaaaatttttgtgcaaatatataacaaattaagtcattcttaaagaacatttgacgataaatcaagtcataataaaatataattacataattttttgaataagatgaatgttcaaacgtttctcaaaaaatcaacaacgtcgtatattaaaaagtggagggagtatttgagtacaactgattagaaacaagaacatgcattatatttatacctggtcgtattcatccaagaatgtggtcagctcatccagtagtagtactttggatgcttcagctaaagcaccggcaattgcaactctctgcttctgcccgccactcagagtttggattggcctctgtgttggatgaaggatgtttgtgaaccttgtgcagacaatagattataatccaaaaggagcatgtcagctgcctacttgagagtagcttaacattcccacagcatccagtgattgtgatactcttgacctaacctcatccaacgaaaggttgagcttaccaagaccaaatgcaacatctgattccactgtcggcatcacaacctgcattcaaagaacgtaacttaatatgtaccagaaagcttgatctaatttgacatgaatgtgtcattaagcaatcttcctccaatgcatcaagagtcaaaaaaataacattctatagttgctagtaatatgatgcaaatacagtctagcaatatcttaatgaacatttatatgttcaaatttagttcaggggaaactcagcaaacagcacaactgtatagttttcaaaggaactaaaatatcaacaccttatgtatccaattagctataaaattcttagtccaaagagtttactaagttctgagttaggaattactttcacacccaagtttgtgaatgaagattaatgaggaacacagaactagattcattaagacaatcatgtagcacaaaatttcttgcttggtgaaactaaatctattatgggcaacagttaagagtgaactcatcagattacagtacaatttacgaattagtatgtctatgtatgtcgtttcttttcaaagacttatataatgttgtcgaacttagtaggatagttaactaagctctcaaatactccctccatcccaatataagtgcaacctagtacagatgtgacatatcctagtacaaatgtctgtccagatttgtagtcgtgggatatatcacatttgtactaggttacacttatattgggatggagggagtatgagtattaccttaaaatacataaagctggatgagttatattggtcggtgaagtaaagcctaaatattgcagaagtacttataaagaaaaactggaccttggtactttaaccgatgaatagttattcaacagggttactaagactatggccaacatgcttatacagtccaaaacgaatatgcaagcaaggaacattggaaccgagacacttcaatttgctgcagagtatcaataaataccagatagaaaagaacaaagattttcatgaattccattttctaactagcataatacacgttatgtgaatgcaattttaacattgttgtattccatttgagaacggagtgaaatttcagataaacactaaagcagaatataagtgacaacctggtgatcgggattttggaagacatagctgcatggcctgttaatatacactgtaccagaagaaggatttaaaaatcctgccaaaacctagagaaaacattcggttaacatcccattaaggagctgtactaagaaattcagaccaattttgatagtccggtagcctaattaggcaagtaaatattgtacagcattataataaaatttatagaacttctcctctgtcttttttactttctcatccagtcatcctatatcattctattctgggtgagcatatcacaaaaagttgctaatctgattgtgccatctggtccattcatccaaatagtcaaatgtgcttgatgctccactcctgagattctatacaatgctcactcactggttagcccaagatacatactagtggttctcgaattaaaacatccatcggctcctgacggtatacgaaaatttcctggagcaagatatcaaagaatgtggtccatgggcacaatctaatactacaactaaacttttgcctactccatgagcaaaaacgctcagggcacgaacaaaatacacatgaaaagcacaaggacgacgccctcttcagttcaggggggtaaagaagatgaagaaccttgagaagggtggacttgccgcagccgttggggccgaggagcatccagagctgacccggagggacgcggagggagcagtccttgagcaccggcagcacccgcccccgccgagtcgtcaccgacaactcgacgccctggccctcgatggccggcgtgggtagggacgacgcgaggacacggaggcggtggcgagggcgggatacgagggcggctcggccggggtcgtgggggcagcggcagatggcggaggtgccgccggcgaaggcgtgcgccatctctgcgagagaagtgagagcggtagatggaggcttgtggccttgggggcccggttctccagaagaccagaaggctataaggccagatgcccacaagtccattggttgatgggccgatttggggctttgggggcagagagtgcggataccatc

SEQ ID NO: 62108 - DNA, 3285 bp, Oryza sativa
ggtttaggcagctccacaactccactccagactcaactcctggagcaatatttaggagttagagctgtaccaaacaggcccttagtttacagttgtgccacttatatgtgggctccactttgttatgatccacatctcagtagtacaactacaaactgtacaaagttagaggagtcttttctctagtttgtgtatttgcggttcctcttacaagaaaaacacagccacagagaccatgtggtacattttccattcacaaaaaagaaagagaataaaccataaaaaaagaacgggctttttattacctgaaacaaatatgtgaaagatttccaatcatgtaatctctccgtctcaaaatataacaacttttagctcttatgatttgatgtgaccatggctactacggatacatccgttgctcacctcatggatggacaacaagatatcaagttcgagtcctccaagtctcaaaatccaattcggccacctactaccctgctgacttcaaacggccgccgaagctccatacgacctccgttttcggcccgtgagtacttgatggaaagctctcggagtcctctttccaatgcatcaagcctcattgccaaattccatctcagtcggcagcaactgaagaaacaaggtgctgcgacacctgtaatgggactatgggcttgtaacttcatttgggaccccggcccaggtggggcccatgtggggtgcaccccaagctagtggagcacgaccctaggcactcctaggtcatcctcccacccctatatatagctagttaccccttcagggtttctagggttttgttagattaaagtttagccattgctacttgcttgcagcgcgcgtgtcggctagaccgtccgtctgcttgttcttcggaaccccaacttatcatttgtattgaattcctatttgcaatatcagattgcttttatcttgttcttgcttgtttcttcgatttgcttgcaggaatagggttgatctgcaccggcaagatcaacaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcaggtggtatcagagctttcgttgctcggtgaatttttatcttcctaaccagaaaatagccatacaaaaaaatcgtatcatttacctagccatattgtgccattgcattgttcttttcagtttttgctttgttgaattttgtgttgcattgtcacatcgtgttgctggtcttagcgtctagtttgtttagagtttcaagttctggtcacgttttgtaccacaatcgtcgctgccaccgtgtctctgttgttgtcgggacctacgaaaacggaatcggcccgctgccacggttttgtttttgtagttttcagaattttttatcggtcagttttggagttgcctttaggatttgcttgagtttctggtttgcccgtgaatagatcggcctgcgcttgttgccggtgtagagaggaggaagaagaatttccaaatctgtttttggaagtatgagagtttaatctggaaagaaatagtagatcagattgattgaaatcagtttccctttttctctcaccataaccggactcctaggtagtgccgcatccttcctttcctcacccaccaccaccccgggtccgcgaccaggccgagtccgagtgtctcctctcggtcacggtttcaatctataccgtgatcttgcatactgcttggtgaaaatttttcgagtatcggattgaaaatccttttgcaaaaacggaacctacaggacgagaggattccattattgtatagttctaattttgggttttaacttttacatttgagtccctataaattttgtatttatgtttgagtccctgtaatcttacattgaggtccttgaatctgtttttgtaaaataaaatcaaaaaaaaagaaagaaaaaaaaaaggcagaaaggtgcataaaaaaagaagaaaagaaaagccgcacccaaaaaaaaaagaaaaggaaacaaaaaaaaagaaagaagaaagaaagaaaagagaaaatattgttatgtttgagctgaacttcatatatcagagttgtgcatgagttgttcctagtgctatcttgtggtatcatttgtgtctaggctcgcgtctctagtacgttctagcctaggaccagcacggtgcttgactttgaacaattattcaattttgcattctctgatttgagcatttgctattcctttgctacatatttaagcctacccagagctccacagatttgattgcagccgtacaacaagtgttcgccaaggcatcgatacatccaacctccattggggtgcttggttgagtcggtgtatgtcaccattccgcttgcattggtaagatcttgtaagagcttggttaaaagcttgagtgtgtgtgatttttgagctgccactacctagtagttaataggaacgcgcatatttttgtgtatgtttcttgttttctactaacaatggcagggatacgcaagataattggggatagctgtgctcaccatcgacatcttcgtcgagacatgaggagtgatcaacatgacctttatgaggtaagtgacgatgttctaggtaagatcaaatctgcactgccttatttcgagggaaactataatcctcatgcttacattaattgggagctagcggttgatagtgaatttcaaaagcatgtcttgtctgagaaacaaaaggttatgtgtgcctctagtgttttagttaaacatgcttctaatgattggaaacatctttgtaggcataacaaaataccacaatcttggaaagacctgaaatgatattttagagatgtttatgttcccatgtattatgctgatattctgctcaacaaactgcaatgtttaaaacaagataccaaaagtgttacttcatattatcatgatatgcatgcttgtttattacgttgtggcttagatgaatgtgaagaagctacagaattgaggtttttatgtggacttaacaaagaaattcaggacatgcttgcttgtgaaaagtatagatctctttctcatttgttacaatttgcttgcaatgctgaaagtaaaatagaggaggatatgaaaaagaaacacgctatgtctttgcctccaattactaactatttgtaggaagtgcgtaatcacgaagggctgcaggaattc

SEQ ID NO: 62109 - DNA, 8003 bp, Oryza sativa
aagaaacaaggtgctgcgacacctgtaatgggactatgggcttgtaacttcatttgggaccccggcccaggtggggcccatgtggggtgcaccccaagctagtggagcacgaccctaggcactcttaggtcgtcctcccacccctatatatagctagttaccccttcagggtttctagggttttgttagattaaagtttagccattgctacttgcttgcagcgcgcgtgtcggctagaccgtccgtctgcttgttcttcggaaccccaacttatcatttgtattgaattcctatttgcaatatcagattacttttatcttgttcttgcttgtttcttcgatttgcttgcaggaatagggttgatctgcaccggcaagatcaacaacccacggagaggtgtatcgatcgctaaggcgcaacacaacgtctcgtacggttgtagtcggatcgtcaacgtttctcccaaatcgtagttatcacaactcaccgaaagatcgggccaacaacagtcttgagtgtcgagaggaactcagggttcatcatgatttgtcctaaaatataacaacttctctaccaacattctctttccaaccaatcacaacccttaaccgttcacttttcacacatatcttcactactcatccaatcataactttccaccattcacctctacctactttcttaataaccgtacccaactctataacttcttatattctggaacggagggagtataagaagaatgtaagatgttactctctcgattctaaaatatagtaacgtagaacaatggttttattcataatactattatatatctaatctaatcttaaattactatatatttgggactgagggggtattacatttttatggctcttatatcacctagtaaaactaaaatgagcggataacaataaggtaagtatagtttaactgattaggttttttttttttaaatctgtttaccctagttcaagttttaaacttgatatgagtgttcatatatatttatgtctaattaaattatcctgtttcggaggtgattaactagaacccgtgtagagcacattatttttcctataaaaagggaacagaatagtatcaggtacatttttgctagagcgatgttcaaaatttccaacgtttatgttgaaagtgcacgttcgtcgaaagtgcgaaattgtcatttgcaaaccgcaaaattcttcgacacggtgcaaagaagtccatatggcttacataagattatgtgacgacgccgttttgcaagtatagatcatatcgcacgcttgcttaagtcaatgtacatccttccattttgatgaagagagacgatgcattaacagttccaaatatagttcagttagttatcccctcagctgagaagcaaaggtcaactctttcctaattaaaagatcttctctcgatcggttctcgccattcatcccagatcggagattccgtggctatcatcccactgtaccactggctgcttattaatcggcaagagaggctcgcagcggctcaatgcacctggtccacccagcctagccacaaccggtccaatccaaactctctaaacacaggagtagcggcgtgtacatgcgccaactgcccacgcggccgctgtcaagttgttggccgccaactcttcgcctcgctcccgtgtgtagtacggtaaacggtgtactaccacttgccctgacgtacgtactacacgcgccccggtgagccggtccaatatatacacgtcgtactcccgagaggccgagacgcgccggcagagagcaagcagatcaattgccaaatatctcgctatcagctatggacatgggagggcacgacatgggcggcatgtccccgccggcggccggggcggcggcgcagggcggcatgggcgccatgaagtcgatgaggtacacgcacatgaccttcttctggggcaagaactcggaggtgctcttcaccatgtggcccggcacgagggggggcatgtacgcgctggcgctcatcttcgtcttcgcgctggccgtcatcgtcgagttcctcggcagccgcagggcggacgcctgcctcgccgcactggcgcggcgcgccccggcggcgggcgggctcgcgcgcgcggccgtgcacacggtgcgcgtaggcgtggcgtacctgctcatgctcgcgctcatgtcgttcaacggcggggtgttcctcgtggccgttgccggccacgccgcggggttcctggcgttccgcgccggcctgtgcggcggccccgcgcaggtggaggaggaccgcaagaacgacccggcctgctgctagtagccgcctcgtcgacgttggtgtgtactgcgagcgatcgattcggttcggtggacgttggtttgatgcttgcatgtgtttgtgtaattgtgtatattgttcgcggtcggttggatgagttgtttggctggttttctttcgtctgtatcattgtatggctcaaaaacgtgacatgaaaaaggctcctgatggtccatctctcaagttgaaatctgaaaagttccggtgccgtgaaactgtaatcgtgcaatccgctatctatcacttgtttcattgatgattcaccctggctgtaatttcaattctaataaattgattatggtgcgcttatgtaaatgtccttgtctttaaaaagaaatgtaaatgtccttcaaacaattcttgttttgttttgcatctgtatgtgctagttggcacaaaactgttctgcattggtttgtttctaccttcctcttttgtgttgctgacccaaaattgctcctctgcatgcaccggagttcatgttgctgaatttctcatgccactgtattgtccattttttgctggtaaaaagcactgaactactgactggattggcaattccatgaatgatgattagctctaccgaaacagtatgctaccctgaaagtactgtcttactgcctctataagtttgctttgctccatcgatttgacgctctatgggttatccttcacgttctcccatcttctttcctgctgcaccatgggccaccgccagtggtaaattctctgagacgcaaaacagagcgcatatgcagcaaacatttcaaaaggttaccggtagatagattggtactccatccaaaagacagcacccttagtgctttaagtctttttgtttgctccgctcgcgtcaccacttttagtagtacaagaacacactttacttcctatgtagtactaccatctcctttttctccttttgaagatcttcatgtttctatggctgctgttgaaaagcacaggtgttcttccacatgtggaagaacaaaaatctctcaaagttgagctgctaaaaaaaaattaaatcaaaatatatcaaaccggagtctgtacaatactattacatactcgagtccagttgattcttaagctgcgtcagagattggctgtcaacctgctgctgtttaatttgttacattatccaccgctatattttagagataatgcactgctaaacaacccaaataatggttttttatgcacccaactgaacaaaagttaatcaatttcaccacataattgtactactaaatcgggctgaacacttcgcggaggggcaattataattggtcagttgtgtgtggttcagacttaaaatctggccacttgtaaattctacaatttcgtcttgacagtggaagcctccgaaggaaacctttttccgcccatgccgtacgatggattttcctcgttgacattctgcgcccaacgcacagcatggcatgtcgttctccataaacgtacacacaaaaaaaagcaccaaattggcttcaagataaggtcgtggaagcgtgctacgggggatgatttgtctggtggaatctaaggcctccataaatgatctgttaccagaatacctgccgtacataggatgattagagcaggtacaatagtagcctataagtcagctataaacatattttaaagtgataaagaaaaagagagaagagcagcgggctacatatctgtagccagctgcagcacgggctccaagatgtaatgcgtgtataacaggtgggaccaagtattaatagtatagtaagcaactattgtatgaattagctattatattggctatagatgatttagagctattagtgggctgctatattgaccttgctcttattccttcattcaattgatccatccataagaccatgattattatccatctcaagagggaaaatggccagtaagctgtaagcccaatcaagtccaagcccgatcatctgttgggcctaatttgatctcacttttttttttcatctctaatggtcctgtgacaatagccagattctgcaactcatgaaaacctcgaattgcgaggtcctcgatttgcgcacctgttcagttatactaatccatacttataaaggaaatcatttaggacaatgtttaagtcaaaccttagaaatataaatcatgaataactctcaaattgttgagtttgaaaatataaaaattatatatatagatttatcttgaaaaatactttcataaaagtttacatatagcacttttcaataaatatttttatagaaataagaagtcaaagttgtattttgtagaccgtgtcactgtcctaaacgacttccattacgaacatagagagagtactacgtaccagtacgtacctgtactacacgctcgccgccgcatatatctatacttgcacggcgtgtggatgacggatcaaaccaaacacacccgtgcacgcggagatcaggagcatctgcaatggcggacatgggaaggcacggcatggccatggccatggcgcctgcggcggctggcggcgcgggcaggaggaagcggtacatgcacatgacgttttactggggcaagaactcggagatcctcttcaccgggtggccgggcgccagcggcggcatgtacgcgctggcgctcgccgccgtcttcgctctggccgtgctcctcgagttcctcggctccccccgcgtgcaggagtcctcctccctcggcagcaggcggcggcgcgcgacggcggcggcggtgcacgcggtgcgcgtcgggctggcgtacctgctcatgctcgcgctcatgtcgttcaacgtcggcgtgctcctcgcggccgtcgccgggcacgcggcggggttcttggcgttcagggcgggcctgtgcggcggcgggtacaagaagggagagctcgcgcctgcggcgtgctgctagatgtggttgccatggcgcaagacaaaagcgaatatatttgttttcgaaaatttagataaggattttgagtgcggatctgctcttgaatctacgctaaaatctatatttgttatcctcacaatggaaaagaaaattcaatgttagggtagggatgtactcgatcacgtcgatcgtgaactgatagcccccgttgttggattcggtgtttgcatgtgtaccttcgatcctatttgaagaatccataaccctaactgttaaacccccaagcagtgcttctttcatatttcccattatctgcagaattaaaccacagtggtagcccaagaggccgagaggcccgagaaggcaaataagtggaggcccgtaataagtcgaatttctgatatgttgtcccgacgaactcatgacgacatgaaagctaactactggagtaattagttgcattgctgcaaggtactttggttagccaggcccacaatctgagtcacatgtcaccttcttttagctctttattaatacttttcatgcatttgtgtttgtacttttctttataatgaaatatataccggtcttagtttcaaagaaactatagctaattgttaatttgttatagaatttgtaagacgaatgacttcgcttgataaaatcgtagcttaactaaaaaaattacttattagaataccaccttaaagacataggttatctctatttatagatggtaagatctgcataaccattgttttcccaaacggtttactcaaaccaggaacataatctatgaaatcaatgatcgattattgtgtcgactgaatacctctaagaaggtcacaacaactacgatattgctatcgccattctaagcatctaaaactatatttttttactcggacagttcaccccaaggcattaaggtaacggagaggatgttagcaacattgcccatagacattgtcaatgttggtgctcccaatattgacggccttggtcccatatctacgacgatctgaactcaacctcctcccctacgtttagtggcatcatcaactttcctaagcacaatgacggcgatgatggtcgaacctgaattggaggggctagtgatgacgtgcatgggcaaatgttgtccagatccatatggtgccagtggcaaaggagacctgcagtggtagagatgatcacctagatgatgttggaagcctgacaggcaactcaggcgcaaaggagtcgcaacctcccccatctcctccctgccttcaacgcgctagacaaaaaggggtcgtgttgccttcggatcatcgatggccttatatatgtacatgtatttgtatgaattagaacttaaattttttaaaaccggtttacaattatcattatgttgaatgttgatccctttgtattttatatgttttaaacttttcggttttctcataattttggttcgtcatgataggaacatggcttttatatttattttaagctggtaccaagcatatgcaaaaccgtttgggtcacctaataccaatctccaacggtttcgttgataaatgttcatttggtactgcccaaaaccggtataattcagataagattttactgaaaatttggattttggtttgatgacatttaaacttggtttgtttatcgagcggttcttgaatctcgatttaagtcgagtactcgcgataactgagtaattacagcctcaaggctcacaggctcacagtcctcaccgtactagcactagtagatataagtttctcatatatctattatctatctatctatctatctatttctatctatctatctattatatactaaaagtccattaaacttcctacaaatactctcaagctgccacgtggcactactataaacgatcctagaccgccatgtggcaatgtctaatctcgccgtcgattccattagattagattagatgtattttatttaaaaagaaactaataccttactgttggcagggaaaaaaacataaatactccataagtacgtacgtactatatagaaaacaataaaacttaacttctcttcatcggttcgcttggaaaagagcggcttacttacgaatctacgatttgtgagggaggaaaaaaaacgtaccagcgtatttacgataaaataaataaagccaaaaaccacgtgacactgctacaaacgttcctagaccgccatgtggcaatatctaatctcgccgtcgattttcacttaaattggtggacccgataatttagaccattagattagattagatgtattttatttaaaaagaaactaatagcttactgttggcagggaaaaaacataaatactccatgagtacgtacgtactatgtagaaaacaataaagcttaacttctcttcatcggttcgcttggaaaagagcggcttacttacgaatctacgattcgtgagggaggaaaaaaacgtaccagcgtatttacgataaaaaaaataaagccaaaaaatatacgtatatagtaccatcgaaaaaatcaaaaatagaattttctacatataaaaataaaatatattattccacaaatatgcatcaactagacccgtcataaaaaatataaaatatcaaatctaaccgtcgattttcacttaaattggtggctcctataccgtcacatgccactctaataaatttataattctaaaataaatttaacaatcagttttcttttaatctggtggacccattattttttaccatttaatttataataaaaata

SEQ ID NO: 62110 - DNA, 7929 bp, Oryza sativa
agtcgttacgttcgccctctccccacgtatgcccctctctctctccctcccctctatgtataattcatttttcctgtattagctaacggggggaatttgattaaaaattttttaacattcgtaacacctaaatcatatacctaaaaaataaacatctaaccttaaattttttttattaaaattagtggacataacacttcaagccattagattagatttaatttttctcatccttaaaaaaaagacgtccatcctcccctccgttttcttttaggaaatcctctacgtttttttccttccattctctctctatgaaagattttgcaacaataaattttaaataagtatacttctaaatacatattatttgcaacagtaaattttaaataatactaactttttaactttaaaattatacgttcaatttttgatctatttgtaccattgtgttatttatgattaaaatcacaattagaatttaagacacatgttgactatattttaacttgtaaaattatattcatttaagttttgttgagaccctttacatgttattcaaacatatatgaacaattattaaaagaaagtgacattatatattatttcatcatatatcacttcactggcatgcataactaaaacagatttatgaacttcaaaaagttctaaaaattctgaattatgagaaaaacaaaatatagattataccataatttgatgcatcacaaaacatgcataactaaataagatttacttaaaaaataatcagtcagatcctagctgtttgtccacctatatacattccgagcttaagatagaaatgacctattatgtaccaaattctacttgataaggaaatagaaattatatggaagtaaacataaagctaaattttctttctgtataacatgataatataacggtaatgttcaacttcggaacaagcaagcaaaagctgcatgtgtatttgtcctgtgtatctatatattatatatgaaaaatccattaaacttcctagaaaactctcaagccaccacgtgagactcctaccaatgctcctaagctgccacgtggcactataataaattagataaaaccttacaaattttgagaaaaaagaaaaaaaaatccaaccctcgattttcatttaattcggcagacccactatttttaaatcattagattagatttatttaaaatgcatctcattctcacatgtacaatacgtactactatccaccggattgagaaaaaaaatctcccgagcatgtacatactacgcatcgtccacccgtccctaataaacttatcaataactaataaacttatcaataatgttggattatttcttgagaaacaaagtgcgctcacaacgcacgcacactcacccctacgaacgcacacatgcacactctaccccctatgagtacctctgagagattgtgccgacatattttgagatgacaaagtcaccatgattgtctcgctgtcgatgggtacgttgtctaccactgaaagaatttatcaagtctgggatttgaagacaagtgggcaatttccaccacaaggaacctaaccagttaagctatgttcaattcaaaataatgttggatattaaaacaaccatgatttttaagctacacttttagaatactcctatgccttttaaaccagtgaaactattatttttaatcattagatctatcttatataagaaaaacaagcgtgtattcatggtacatcacatttcaaaaatattattgtgcaattgtattcacgttagattgcgtagaacctcttacccactctacatgaaatgtttatagatggattgtctctcaaactatatcaattatattaggctatataaaatttagtggagctttatgtcccaccaaattcatcctctaataaaccaggataatatatgtgcaataaaaaaaataaaaacacacttcttttgctttacacttacttttactttcgttgaaatattttcaaaagaaaataagtctaccttcttttcaaatgatgaagaagattataaataactaatattacttaaatatgatataatataaaactaataggttaaaaattataaaagtaactaatgctaacaaaaacaatttacggagaaattggggtagatgttctccggttaatatatcgcttttagtgtctcaaacttagcgtaagacgcatgcccatgcatttgcgcgggctaccttcctagttatctataaaaaaaaaggtagagaagtttctagcaagaatcctaatgctaaatcaaaatgagagaagaaatgaaacaagcatgacactactagtttataattaggtatactgacgtagtgacagagtaattctgatcaatgcgcatgcagatcacatacacaataccagttgcttatgatctattatttatatataaaaaaaacatatcaacggtttacgtaatgcgaagtcgagaacacgtttcttctggaccacgacttggagccactttgttcctcaggtaaactcagtgtccacgtgaaagtattgacaagttgtcaagcaggaacaaaagctgcagcgtacatacgagaacaacgaaccatttccccacttttcactatctccaagcgcatcagtcccgccggcccttttcgataaagttcaagtcgttttccatcgcattttgcacccatgaatgcgttaacccaacgaaaatatggctcgtggccgtacgtgagcgcatgacctgcgtgcgcacgcatgtcactgcccgatcgatcagtcacacactcacacggtcacaccgcgcgcggccccgggccacccgcgttgccatcgaccccgccgacctgcctgcgtgcggtctacctcgagggcgcgacgccaccccacccatccgtccgtctcgcttgccacgacgcgacgcgacacaacgatctaccgatgctgccggttgcctctcgctcggacgcgcgggcggagcggcgcgttggccatatatacaccgcgattggccgggcggggggtcaccaacccacccattctcctgtacacatgcggtgcgcggcagcgaccgattaagcaggaaaagcggggtaccgcacgcgcgagcggcgcgacacaataattgagccgtgccgtggcgcgcgctggcgctggcgccgctgtgtctgtcgctggtgtgatgtgagcggtgggtgctcgtggcctcgtggggtttatccgggtccgcgcgctacaaaagctgtagcggagattgtgatgtagtacgatctacttcagtactatcacaaaaacattatcgccatgtgttagctcaaaaaagggagatcagaccgtatcatcttgtcgagagcatatgtggaaagacagagtgtacatgcatagaagatgcgaaattcgtgttttttaaacgtgggtagacgatcgatttggtcagtgcagggatttcaggcgaataatggagtgtccaagctggtcgtgcatcgtatcgactgacgtgaaaaaaaaggggtgcagaaaaaagaaattcgcgtgcacatttgcatgtgtgtataaactaatgaaagtgtgttccatatggttagtatatttgctgtattttagtgtattataggttcatcaatctgctataatggtcgttttttatgccaagattctccgcaatgcgctcccatgcatgcctgatttcagcgctacagtcgacaatgctctctgccattgtttttctttttgttgggatatggtcattgctattaaggagtaataacgtatttgttcgtcgcaacgtggctcacgaaattgagacatcatacgtgcagtctgcatcgtgcatttttcctaccgtgggatccatttggacctgctcgagcaatctctgccacgaaaaatattctctgtcggaaaaaatccatgtcatcctaaactttgaagagaagtttgtttagtatcttaaactgtaaaactaggtatatatgaccctttaaaccttacaatattaataatattgttcatatagccagacggtattattttgttttctaagtgtcatagatgttgtaaaatttttactatatgacttgcacattggacatatatgttaacaatttaaagggttatgtagatggtgtattgcataatatgtagggttgtctagtttgaaggtttggggtgatggatagactttcattcgagaaaagcacagggcacgtgcggaacttttccttcttcattccacaacttgcaggctgcagctcgcaaagggtgactggcttcagttcactgccacacaatgttttctaccatgttgacttcaacggaagccttatattcttgtgctctcagcaaagctgttgaggtggatcaccaaagtggccggtgaacacaaagtccaagctagtattgaaaatgaactgtgcccagattccagaatagaaaaacgaagcagggatgcataatctgatgaacaagaaagctcgaagaatccatcaaaccctcaatgaacatcccggtcgcgcaccatcgctccattttttgctttgcctctggggctgtggaatcacaggcataggtagttttcagaaatcaagacatctgtctccgtcgtctcctgcgccgatgtaacgatgatgcaaccctctgggtagaaacggctcaagcgatctgataggattgtcgctatagcttggaaatcccgccctttaaattccgataatatgtaatggcacgccgcttgctgtgcccgatcctctatgtatgaacctttaatttgctcactttcaatggaaaatttaggtggagaatctctctcctccggtgattactccaaaaaaaaaaaaaaggcttcaagaatccacacattcatctgccattctggcgattgctatgtatacaaactaaaaacttcgaaataagttgcataacacgtattgcacattgccgttttctccggagcaaaggcgtacacaccaacacgcacaaacaaaacaaaagaggaaaattgcgatcagcaagaacgcagcgctatacacaaaaagaccaagaagcgcacggttcgttccatcaccaaatcatggcgcggttggtttcctctccggcgttgccgtcggcctcgtcgccggcgatctgatcgagcacgaggacgatcgccatggcgaacgccgcgtcgaacccggcgcccacccgcaggacgaacacgtccctgcccatgaccacccgcgccccctcgtccaccttcctcctgatctctgccaccaccgccgcctccccgcctgactcggccttgggcgccaccacgcggcagcaccgccgcgggaaggagccatcgacgcggaggagctcggcggcagcagcgtgggtagacgagaaggaggcggggagcggggcgaggagctcgacgacagcgccggccgcggcgccgccgaggatggaggagcggcgagcagagaagagaggcttctggccgtcggcgcgggcgccgaggtagccctcccagcgttggtgcagggacgggcggcggcggcgcacggtgatgagcgcctctccggcggggccgaggagcgcgagctcgccggcggaggcggctccccctccgtggccgcggccgtaggtgtcggcgcggaaggcgaggccgccggtgcggtggtcgtaggccgcgaagccgtcgccgggggagaagtgggaggtcttgcgcaccgtgagcacccgctcctccgcggagcagtactcctcgcccacgatcgccattgccgctgcgctagctagctgcttgcttgcttgcttgcgttgctctggctcgctcgcgtcgcgtgcttgtctgcgcggcgaggtttgcaggcttaagtagagagatggagtgaggagctcctgtatcgcttgatactgtaaattcgtatggaagccacttacgaaagtagtgtttcacgtgaaaacgtgaaatatccaatatatatatattaattagccctgattactttcacttcgaatgctttccaacagaaaaaaaaaaccggtgttgtctcatgcccatgcatacgtgaatgacgtgtatgcataatgcaggctagtttctccgtgccagctgttggcttggcttgagctttgagcgacgactcgctcgcgcgcttgccaagatatccaactaggcgtggccgtagagtatgggacacagagcacggaacggaacagcggcgaggtacgaggtgcatgccgtgcgtagcgatgcggtacagtgtacgtatgtacgtgcgccctgcggagaccatacccttcctccaccgactcgatcccataccgtcgagtgctcgcgacgaggtcgatcggctgccgctgactttagttttagacgaacggcaaggtcgatcaatacgttaacgggtgcgcgggggtgcatgcatcagcatcattgtgcgcgcgagcttagagatagtatagccaactactggctctaaaccatctatagctaatctaatagcctatttatataatagttagatataaaaatatactataccattaatactcggttccacatctcatatacacataatgtcttgaagtccgtattgcagccggctataaatttgtagcccgctttcttctctttcttctctttttttctcgatatgtggttatagcttactattgtacctgcttttagagcaagtttaatagtatagcccaccgctagctctaattcatttatagcctatctaataggcaattcatacaatagttgcttactatactattaacatatgatcccacctgttatacacacattgtgtcttatagttcgtgttgcagctagctacagatctgtagcccgctgctattttctcttatcttttatcttattaaaatatgtttatagctggttaatagtcttttattgtacctgctatagctccacaccgagtcaactatcaacgacatggacgtgattttatagctagcctggcctggtagaggtaggctcgatcgggtcgcccgtagcgggagtgagtgtgagttgcattgggtatggagtacagtactgtacttgtgcagtgtgtggtggtgcgtatatttaggtgatctagtggatgaagaacgaccgaaattgacgtgagtttttggcttatgtgtatggagattgaacttttgcgcgtcgaaagatgttgataggtggaatcgatgataagacgatgatgcgtatgctttgaacaaactcgatcgttctccttcggtagtagtgtcgcgctcgaattttataagagttccctagccagtttcccatagtactcataattctactctcctacaaaaaggaggtactagaattcaaggcaaaaactgattacacttcatagtaataatccaatccaatccaatatcgatgaaagcataagcatactccgtatatgacacgtgatgaatctcccaacgaagacgtgtactccctccgttttataatgtaagtcattctagcatttctcacattcatattgatgttaatgagaaatactagaatgacttagattgtgaaacggaggaaatgaatctagctagatatctcgctagattcattaacatcaatatgaatgtgagaaatgctagaatgacttaagattgtgaaacggaggaagtataaaagtcgtctcctgcatgaatgtctccagaagtcttctgcatggccaccggatacgtgtatcgtcgatccagatacacagtatggttccctgcttcggtgacactgacgcgcctatatcacgccaaagatctccgttttcaccctcacgcgcggtcccacgtcccaatcggtggctgaatcagcaacacccgatcacgtcacgtcacgtcctcatcaccggccggccgaggcttggctccctcccagccccatatcccaggggtccccatgccccccgcgcaagctcgggctgcaggaat

SEQ ID NO: 62111 - DNA, 4954 bp, Oryza sativa
ggaatttagggcctacaactacaagtaaaacgaaggaaaaatctcgatttcaattgtcaaacgtgcctgtggcagctgattacgtggtggcatggaaagcaacacttatttgaaccttttctcgaactcatctgcaactctgcaaggctgttcctggtcactgtaacctcttctcattgtttcgttcatcaagacatcaacgttcaccagtgagcaaatcctagagacgggcggatctaccagagtagactacagcatggcatatgtacgggccgaagttttggattgtgtgggctgccgggctgggtcgagaggtcgaggtaagccaggagattgccctcttttatatggcccacgctccaagaaatccaggcatccaaccaagcttcagcacggcaggttacggcttaccaaccaatcgacctccatctcctgccgtggattttgttgtttctgcctgcaaagacccagcatgatacggttcattccttctctacaccacgagtatcatcggtgcaattggaaatagtatcatcatcagtgtaattggaaatggaaccgaaaggagtcatattcatctgtaatcttgtacagttctctatacccccaactccccaagtgattgtgttgtaatcatctaatgatggcctttctataaaagttggggatgtgctctcttacaaaaattaccaatagtttccggctccttcaggctaattttgtaaccctatagccatgattataggaaggatgcataaattgttcaagtgcatggttatatcgtaatgcacaactaatggtagagcatccaatcacaggaatattgaaaactcacgctagtaatcctacacatcaagccctccagtgacgatctactccccaggggcttagttaaactaaacagaacgaagaaacccccactaatgcaatatcgtgtgccgcatttgctttattgtagcatagctccaaatcttctgggttttctcaaacaggcaagaaacattcctagtatcgcctccccgatgtgatcttcagcaagatgttattaacatctgaaaagtataaaattggagtcagatcttcacaccacatgatgcaacagtaacgactaagtttatattgagacaactatttgtttaacagaagtgctacttttcttttgtgaaaatacagataaaattccataacagcctaatatagcatatgctgtacaatcaactgcagctttccctatcgataagaaacttgtacaaagcaaaaaaacacacaagattcaacagataatgtgacgaccttactcagactttggctcactgatcagtgtacccacactcttgaaccagcgtatgagattgcggtgatccttcacatacagccaagcttgtaggaaagggaagagtttctcatttataccacgggcctcgatgtaatgatggaatgcatcacgcacattctcatccaattctctgtcaatcaaagagaagataattattcatgatcagtaaaaagcagtacatcaacatccagggctaacatatgtgtttgtactgtatcgtccaggacaagcaccatacacagcggacttagtcttatacatgtaataaacatcaaatgaattattgatacccatccatgagagaaacaaacgaccacaatccaaatagctaagcaaactttcagttattgcaagatagtaaaaggcttttaaagatgtgcttggatcactggacttatattcggggttttaatattacttttagtactttttgtgcattgtgcactgcacaactgagccaaactgtgaggcatgtgcatacatatttaaggcacatgatatcagtaacttaaccaattatgcaacatgtaagattcatattactgggtaaatgtagccactgttacatagatcaaaacattttttggtcatggtacctaagcatctatgacgtatcactagccatttgataagtgttttaaaaggatttgttttatttagctctctcaacatgtaaacatctctgtaaattatggtgatcattatttgtatgcatatatggtaaccggtgtagtgactgagaaaattgatttaactgataggagaaactaaatacccataggagtacagagttttgagcatgctagtacatctgaaattttacatgtttcaaactcaattagcactagtaaggacaacgaaaatattcttcctttatacacattaaacaataggtaatccacagcttgagataaaatatttacgaacaccacctgaaaggctgaaagactactgttatacttcatagaccttaaaagttagtacacatcataaactcccacacctcaagtgaaagtattacagaacataaaacactgggcacctgaactgccaccatccttcatgattaggctaacgcaactatttttacaaaactatggtatgcaacagctaacaaaatatgccctaaagccccattctaaccactaaattagtattaagatcgcacctgctaggcattcactcattctagatcaattgctttctgatcaggttatactagcgccaccagtcagattacccaaagccccaaaaatttactaaaatgcttgcttacaaactgaaccaaacaagtaattcacagaatgagaacgaatttcgctgatttggaagaaaaactcactggaagatacggccctggtacccgtcaccgcccttcccagccaaacccgccgtcccagactcggcagtcttcggccggaggcagacggaatggatccccacggcgtcggggtacagcccgcacaggaactgcagcgacttgctgctccctggcctggagatgtcgacgtggaggaaaagctggctaatcgactcgctcaccccacccccgccgccgtcgtcgtcgtccgagtcgtagtcggcgccggggggcatgatgttggcgagcctggcgacggagattgagatctcctcgccggcatccccgtacccgcggcggagcacggggccggatgcctggtccagggcgcccttgacgatcgtgtagggcttgggcgggctgatcttgggcgggggcgtcatcttggagacctcgaggaagtgctccttgagggagcggaggatgatggagttcacggcggaggaggaggcggccgcggcggcggcggcggcggaggaggagtatggtgaggtggagagggcatggcgaaagaaggtagacgcggcggcgcggcggaacatcgtgagaagggaggagccgaagggtttaggaggaacgggaaacggtatggaagctgaggtttttaggttacccggggtttcagatcagtttttttttcctcttgaacctactctctccccgtccaaaaaaaatcaaactcgcacaagtatctggacatccctcctaggttatttttttctttaacggagatagtacagtataaacaccagatgcagagacaagcacttaccttaaaaacgtatatatacacatcctatccttacaagcatcttaaaagaccacgggcatatttgagattaacaaagtcaccgcgggcagatctctcactgaaacacacacgagagcatccccgaaagattgggtcggcatcgcttgagagttgagattgtcgaagtcaccacggtcccctcgttgaaatgtacatgcgcacaccttaaccttatgaggtgctccggaaaactgggtcgatatattttgagatcgacgaagttatcacaggccccttgctagagcacacacgatcacccccagaagactggaccgatatatgtattgatgaagtcatcatggatcaacattgttgatgggtacgttacctaccgctgaaagaataattagctgtaaatatgatcacacatgtcaagtatagtacttaacccaggtaagttagtcccaccataagaaactaacgagttaagttcgtattttatcatatcagttcattttggtaatatcaattgcagttgttgcacgaaaattagtactacttttgtcacggttaaaatttgcaggttacactacaatgaattcggaaaaatttaactagaacaaatacttcatatgaaaaataggtcaatttctttaaaattcccatgaaattcgtccaaatcgaataggctctaaaattatatagtgcgtttcagacggtgaactcaccacacacaacatgtcatttgttctacatggatttatagccgaccgtatgctttctagagttaacaaatacttcctccgtttcacaatgtaagactttctagcattccccacatttatatagatgttactgaatctaaacatatatacgtttctaggtttattaacgtatatatgaatatgagtaatgctagaaagtcttacaatataaaacggagggaatacaatataaaatgttcgccgattttatttagacggtacgaactagtcaatgtcacactaaaataagattttatgtgtagccattgcctatttacaaattgtaatatcagatagaaacccttcggtgtgttcagcaaatgggttatgacttatgattggtgggattgagaagaaaaatagataaatgtttaggattaaatgtgttgtaaagaatagatgactaagatacagtaatattacctttagagtgtctgatattattctcctgtcctatttaccaaacaatccctttgagtgtggttttcagtaaccctacctttttttggttaaagaaaaaaaaatgaaaactaaggctgtgtttttaactggatccaaagtttggattttgattgaaattgaagatgatgtgactgaaaagttgtgtatgtatgacaagttgatgtgatggaaaaggactgaagtttggattcaaattttggatctagacacagcctaagtagtaggagaaacgtggttggtcaccatgtgcatacgcctccggccttccacatccttccaga

SEQ ID NO: 62112 - DNA, 1480 bp, Oryza sativa
agaggcgagagcccccacaccgccaaacccgacccggaaatcaactgcacacgctccgatcccctctctccagatcgattcggaccccatgggttggcgttggcacgacgacggcgatgacggcggccgcggcctgggcgacatccccgacctcgccggcggcggcggaggcggagatggggagcgctgcgccacgcgccgggtggtgcagtctcggtgccacacggaggaggtggagcccggccgcttcgtccgcaagtgcgagaagaccgagcagctcctccgcgactgcgtcggcaggtatatacatatactccatggcctcgcgcttttccctgatctgttccttcttttcctgcgaggatcccctctttgcatattactgttcgttgttttagtgatgaattggtgataacatgtcatgcgcagttgtgttactattagtcccgtgtatgattgtgagctgtgtatagccgcctctctgtggacgattttcgtgagtctgtcctcgctgatttgatacaaacacgaattcattaagaatggggaatgtgccgtgatgatcgagacgtttgagttctgtggtgaatagtatgatcaaatgtgtgtaataacttgggcttttgaattttggtagctaattagatatggaatttctatccagttttaggtgcccgtgccatcgacatgggttaaaagttattgtgggctattttgcgctcaacttgttaatcaacaaattttggacggaggcagtactttgtaggcatggggtaaatttgtatgatacacttgttgcttgaagatgttcgtgaactcatgggatttctagacacctacaaccaattacattacagtgttattatattctaacgatatgtaaagagcagctgtgttcgtgttgtctacactaaagattcaacaactagtggtcatcatcaaaccgatagcatatcctcattttgcaggattttgaaaactcacatctcgttagcatccttccttttatttcttcacatgcctcatgttaaacttttaagtgcatgaaacccaaatttctgtatttcgtagctccttgtaaccaatgtacaacactatgattagtattctggatagattttgtacttcccaaagtattttggttgttgacaagctattacaataatctgatggataacctaccatacattatttctcctaaccgatcacaataatcttcttctaggccctctgaactggtggaatcaaaaactgaaaatactgaagaagacgtcacagatgaaatgaaaagcgggtcactatctcttggttttccgaccaatgagccctttgcatttcctggacttcgcagtgacatagaagctcttgagaaaggccttttcgggagcattggtagctttctggatgatgctgagaggatgaccaatgatttcttgaagtcttttggtgtcccttccatcaatgaaaggggggcaggaat

SEQ ID NO: 62113 - DNA, 3275 bp, Oryza sativa
attctgcagcggcagtgttcggcatgagtggatccggcgtcagccagtcaacacgttgcgcggaccaagccgaaggcgctaaggcatgggggctcggttccaaatggaggtgctcctatctcctatcgtccctagtggatttgtagcctccgtccctcaaggagggaggatccgacgcaggtgacacaaggaaatgacatatcctatgttgttgttccgctaacatgaagggatgacagatatggcagcaccagggtcggacgggaccgacgttgctgtcagccacaagcgctccgatgtgaggctccacattgctctgcgtcgtgtcctcatccgtgccatccatgccgccacctaaaccgaatcgaagggaaagagatcttagccaagttggagcggcaacgctcgcagaggagggagtagaagcagcatcccaagaagaagtaacatgctagtagcatcaccatgatgcccgccagtgcaggcatccgccgacacccatctctccggtcgcgagctcctccattagctcaagcccgtcactcctcccagcttaaatcatgtcggatcaagccacaacctatccgaagtcatcatccccagccaccgctctgccgttgggccaaccccgttgctagcgcatctaccttcggtggtcggcgtcgtctctctcgctgcctccctctccctttgctgttgtcgtcaatgcggtcgttgctcatcatcacagccgccgttggtacatccagcagtgaaggaagaagagaagaagaatgggagaataagaacaggaaaaggaaaatttgttcgtgtcatcgttcacataggatgccacgtaggcaagccacagtcaaacgagactctggaccagaattaatacaataaaccaagtttatagatcttgatgccatggattagccctgcacaaaaattgcaatggtaactcatgtatactcttattttgcagtcgtcgctaaaacctatcttatgcaggcaaatgaagcccaacaacacttaatttaggaataacagcacttcataatcaattcgtagctagcacgcaaatgaagcccaacaacacttaatttaggaataacagcacttcataatcaattcgtagctagcactaccaagataggtgaaatgtggaaagacagcctactctgaataccgtactctaccacaacgttttctacttcattttgccatcagcaaaacacacactgcctacaagggcaaaacaaaatattgcttgcaaactatgcacgcacacggcgtttctgaattgtgtagactaatcacatgtgtgtttttagggtaacacatcaaactattcaccgactcttacaatcgtctactaataaaaaaaaataaaaccaagggaaccgaaaccaagatcgagatacaatttttttgaaacgctttctttcacaagtctgtgtgctaccatattcgcgacgaacccacctcagtttcacctcagtttcaaaccctagaaataaagccaggggaaccgaaacttgacccctggtcaagatacaattttttgaaacacctttttttcgcatgtctgtgtgctactatattcgccaaacccacctcagcttcaaaccctagaagtcatcaaaatggctgagatcttggatgatcaccccatggaccgaccttttaagctcactttgtttcaccatattggcaccctcccaaggagacaattttctcaaaatgtgtagtttaacgttacaaacgaaaacagattcccctttcgatttaaacctgaaatagatttcgatcatattatgtgggcatcaacagttatcccacaaaaccccatggtgaaacaaaaaccactgggatgatcagcccatgcccaatatacagctttcagaatctacctaaaaacaactaagaattccaacattaaagaaccctgtacacccaaccagatggaaaatttctttcaaccgaccacaccagactgtgcaacgccttcttgcgcagaccaaaataatgactatatgtctagaagaagacaatgaactttgccgggtgaggaataaattaaggtgctcttgatgatctcattagcttgtactacggcaggtgagagctctggatacatcacataaatgtgataatttaaccacctctagttgaaaatcttcacagccttatcgaaagaattgcggttctgtaatttattcaaattgttgtcagaaaatgcccactgttcacatgtcagttagtaggagtcataagcgtatacctgattggacaagcatgacctttttggggtgacgtctgagtgctcaagtcctaggcattgttcccatggtccataaacatctttctatattaaataaacaaggcagaaaaaaattatttgagaataatccgactcaactcttaaaagagaatttaacccacctggaatcggctcaatacgatatctgaatcttgaaagtattcaccagccaggcgattgtgagcaatataagcaaatttccactgatcaaagtagctcacgtcagatagtatccaatatatgatacagcagaaaaggtaattgaaaagatcactaaaggtttacactgtagcaccagcctcaccaacagtaaacaagcagtaataaagtaatacaaaatcgatcgtgtatgagatgaaaggttgaaataattaccttcgcaaactgctcatcagaaaccagaagtttcttctgaatacgcactttgatatctgataatgtctcaccatcacggataagaaagaagaaaggttctccgtagtaatcaatgtgctggaaagattgagacaaatgattcaataagagaaatcccaggtcgccgttgcttctctcaaatggcacgcaagaaaacaaacgtcacaaaaaacaaagaattggagcgagaatcagagatgcactctgaagaaaatacagaacatgctcaggcaaatggaacgatgcttcataatagaaccataaaccagcataggaattgagaggcactgatcattgaggtcagcttagtaagtgacgttacacctttaggcagcattcagttgtgtccattggaggactatatagtggcccattattacagataaaatgcaacgacctggttgtttacaatgaaatgaaatgacacaataaatgcttcagtcatctcttgacgagacaatgcctaagaaagtaccaaacagtttgagcttatccaggaagacagttaaaacgtggatagatatttccaacattgactgagcatgttcacgctcaa

SEQ ID NO: 62114 - DNA, 4770 bp, Oryza sativa
  unsure (1)..(4770): unsure at all n locations
gagtaccaaatgactacaagcagtattgaaacattaggttctaaatatataaatacctgtttttctatgatgaagtgacagacatgaaccaaacggtctcgcacaccagcatttttctcttcttcaggaacctgaccaacagaaaaggaatatgtggagaaaaggtagctaattatgtacactaattaacaacatgttcagtttgagtgggttattccatggatgatttattccaacatgagatgaccacattttattgtgtcatcttattacaggggatgacgtgttgatgagcccactcattttaacaaagcatgcccaactgtaggtcatttgctttgtagcctgaacttcagattgcttaaaggacagaacatctcaataaagtttccgtataagcaaatgcttacctcttcaacacataacagtccattgaattcattaactgaaattttctccgaaggttgatacacctgaaaaattaacgaggcaagtgattgatcatgcataaaagaggtattttcaaccactattaagtatacgtgtaccttgatgaaagaatagaaaatattgttttctacgatgaaagcagggatgaaactttacatggtaaaatgaaatcatgacgtgagcattatgtgtttttcttaaagagcatatgacgtgatttttggtaaaacttggaagagtcaggcaaaacctgccaggttgactacctttcgtaatcaaagtgaaagaaaaaatctatcaactcaaacagagagatctttgttattttacagcaggaactgattttctacaacaatacaaccctccagtttcagaaacgagctttgcagtattttttttttgtgtgtaatggtctctaccctaagaataagcctttaagaattacagaagaactgttgaaataccttgcgtatcttgtttttgtagacctcaaataaccggaattcagcatcactataagataactcaacctgaaaaaaaatcattaaattgccatgcacacacaacacttgaaagaaaactagcagttgattcaccttggatttcatgtcctcaatcaaatcagacatagtgctaccttttggcaaccgtataaagtgagatgacacctgataagtaagcattagcacaggacatgatcagaaatatagaagtggttacaagcacaaaacgagttcaaacaaacctcattgtttgtagcatgataaaaggcaactctcaatgttatcagatcttgcagtactggcaaagggatgtccagtatctcataatacaatatgtcagacatctgccaaaccaaaggaagcgcaagtaatttcatgtaaaaggcacaaaagaagttgctcagaatactccataaagctgccaaacctgattgccattccttagcatgtccgaaagatgatcaagacctctatacttaatgtagtgagatttgggcatctgtgaatacgggaggtgttgtgtaaggcggagtttggaaggatcatcgagtccaagttgattagcaactttttcaacaacatcatcatacgtgaaacgctttgaacttcacaaatatgaaaataggaggggaaaaaaacagtgagtcatatcacagacaaaggaggtatgtcagttattatatgtatgttcaaatattcctggcacatacagctccaaagtgaagtcatcatcttttggattctcaagtaatctgaagtggacaacctgtagataacaacaataaattccacttgtgggaaataataaatgaaatatacagaaaattcagacaggaatctgtttttttgcgaaaaggaattatttgaaagggtagttgttccatgtttcactacagataccataaaccttaatgaagcagcgcccaacaccctacagacacacatatttcttccattgcacaatgtcattgacttttcaggaagaccacatatatatttaaaatcatacagccttgccaacataattcagctttccagaaagggaaaaataactacatggttctgatattctttactctcttcttacagctccaatctagagctctacgctcaaacatgttaaacttagggatgaagtgtgactgagaatagagatccgacaggagctatcggatgtgaatacataaaacatatctatttttaagagagtattttgtaatggatggagcactggagcatgacacaagaaaactgtttgctccatataccagtatgcttacatagtgaacaaaatagacattacagtggctagtggcacaaaccacaacaaatgaattgcataaaaaaaaaggaggaataaaaaaaatcaaaggagctaaaagaaatatagcagtgtatcaagacagagaatgtattagcagaaaagagctaaaaaagagaagctatagatattagaatttgatcacatttaggaggcttgcactgaaatatggtcacaacaattctctttgttcaagtgataaagttaacataattatttgtgtgattacacatatttcattccttaaaattagctggcggttatggtgtaaagtgcctttctttctcggtttctccaagcaggccatattggttatattggcaaatggcaatgtacacaccccaaaccatgtcacccacaagcacacccaacatgcaaacaggacagcaccataccaccaacttgggcaaaggtatgttccctatggaaaaacatacaagacaaacaaagccagactactctactggtaatattctaatccatgaagaagtaaggaattccatgttcaaacgtatcaatccaaacaaagattatgctaacaatttaacagggcatagaaaaaaaatgataatacgactacccgagctaaccggctgttctgcactgttctttacttctttttctttccttttggctcggtgggtcagagtggctaggctttgccagaaggatcatcgttttggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccacacacaccataagggcaaccacgtgcgggtggccctctcagacataagtaaacaacggtaggcccaatcgacgtcatagtcgtcatcctcgtccttgacggttcattctgcctccttctcaagaaagcatgcgcaagtcaagcagctttgacgtcggcaagaacccacgtccgcctccgcccaccccgccgcggtggtcgccggttgctgccgcaagaggaggtcggcgtacaagcagctatatgcggcaaggcgagccgaggtggaggagatatggcggccagaggtagagaagaaggagaggggaggggttgacgggtggggaccaagtcgctttccacgtgggcacgccacgatggctcgttacgtagacaaaagtggcaaattgttaagaaatcacctatctccagtggtaaattactaaatacaaatcaaataggggcatttagataagtaacaaatagttaaatagcccgtggtaacgggctaatcgccgccgaatctctcttcttctcctccttcccttttttttctttagttattttccttcttctccattcccggccatgttcttcaattcctgtccggctcagtactttgtgacacggaaatctgctcttgtaaaagtttaggactgtttatcagaatctggagttttggacacaaggggtggtggtgcagttggctagcgcgtaggtctcatagctattgagtgatcctgaggtctaagttcgatcccctctcaccccacaaaccttgcccttgcgatgacgaaaagctcttcggtggcaacttgggtcgccaccttcgtctgaactcagatgatccgagcacaatccgagcttcgtttttttttctttattttttttgagtttttctttccaggtttctcgatctaacaaccatctgccacctggccatgatcagtcgcgtccgcgtccgcgtccgccgctcgccggtgggcccgtctcccgcacatgggcacgattcccttcccctcccaaccgcgtcgccgaaggaaagcaacagaaaaatcccgcgcaacccgaccccgaacaggctgccacgacggtgcgagctgtcctccataactccagccatctccccgctgtgcgctcccgtcctcccgcccccgtccccacccgtcagccaaacccatcccaccacgaggagtgaaccaaaaacgcgagcaaccgagcagagcgaggagctcgcttgctttgccgttgccgacgtcgcccccaatctcccgcataacgccgcggccgtagtagtcccgaaacctccctcccccacattgcttgtctcctccaccttgaacccgagtttctcacccacatccaccagatctgcgaggaggtaggaaagctcgatgcccgatctgtgaagcggaagcagttagctagttgtagttgagagcgggggtggccacaatgggaagctccagattcgtgc

SEQ ID NO: 62115 - DNA, 1276 bp, Oryza sativa
tcaagttctcagaatctgcaatagcttcttttagcgacagttgatctttcttcgacttttcctagaaaaacggaaagaaataagcagtcatccgtgagttactgagttgtgatcactgacgaatgtatcctttacgacagggtacgttacgtgcttggagtgggagttgatacagttacaaactctatgcatgcattagacacttccatgaatttacacaaaattaaaccatatgcacataattaggcaagatagtgaataggactgctggactggcaagaatgctactcgctcagcatttattaatgccaaaaggctgaactttttccattagaacagaactgataataatgaaaaggtacctttggattttcagcctgtccggtagtttttagaacactccaattacgactgaccttcccttcagcatcctcagcatcatcaccatcatcttcatcatcctattggtaaagcagtataatacaaaggaatgacaagctttcaagtaggacaagtatcgataactatctcatcaataaatcaactatttccatgcacagcaagagaggcattcagcttccaataagcatgtatatgaactgaaagatctgttgtcattgccagtaataagaagaaattcgcaaggctacattgagaatcgcagattgcatgcatttccatcaagtaaacagtacagtattatacctctagtgactcaggctgcgcaacaactttgtcagcatcctcctcatcgtcatcactatcttcgttgtactatttgaaaagtagaaaacatcacagtgaaatgcgcgtaagtttgtatggagaagcttttatataatctagcattactttgcagttatgaacccaaagaaacagaatttacattttttttatttctcctgtactgagaggttttggtaaaaatagaagcatttaggatggatactcacagaatgctccccaatatcaacagcagtagccatgggatctctgacttcaggaagatactgtcaagaaggtaagacaggataagtaaaagaggtatttgtgatgcctattctcaacattcaattaataccaaaccagagttacagttaaacgtataccgtaatgtcctgattgatgtcttccatctcttcatttaaacgggcatatagctttcctttgttatcattataccatgcttaaaaggggaaaggccatatatcatgttagagcttcatcagtcctattagcagcttagcgccagttgtcgcatgactggcattgttag

SEQ ID NO: 62116 - DNA, 1963 bp, Oryza sativa
aggtggtggatttagtatgggggaataggcgttcaactgagccacacagcttttaggattcgtggaatagagatgaccccagaagatccttataaatgttaccagtctaggctaatgaagaacctaattctgtctgaacccaagatatatggttaagtatttcatctcattttgaactcccagaataaaaataccagctcatcactgtgtacactactctgcttgcatcttttatacactagaagatgcatacgatgatcatgacgacattgtgtggcttctggaaatattagcactacaaacactatactttggttggatattttggcacacacaaaactacatgtactccctccgtcccaaaaatataagaacctagtaccgaatgggatgtgtccaaccaaagtatatagtatcctgcgtcccatccaatactaggttcttatattttgggacagagggagtactaccttagtgtttgtgccttgtgctatcaaaatagggtatacgaagactagcatacaaacaattgaaaccctcaaaattgtggtgtggacatgcagcaggaggagtggagaataagaaccatactgtgtacatcatattcgctactaggttatgttaacaagtgacaataggcagaaaaacttaagtaaaaaagacttataagtcatttattaagttcaaaccaatcaagaactaaccgtgtcaacatctggacgcctcctctgccatcttgaccacatttcattttcctcagacttcctcctccagttccaccacagctcttcactagattttggttcccctacagacattgccttctgcgggtcaacgaacgggtgtggccgtcccatcatcttgtccatctcatattcactcaaattttcttccttgggcatctcataaacgacgtactcatccaatgaatcctttgtctcctccagtgtctcatctgatgaggcctcaatggccacaaccgactctccctcatctccactggtctccgtgcctctccctgccgtcgctgatgctacctgctccttgtaccctttccttctactcccgggcttcttaccaaacgacggtgtcccagctgattccccgaccggtgcaggtgcacgggcagcgcgtacgcgggatgcagtgccctccggccagtactcctgcccaggtatgcttgcccgagcacccgacgccggctcgagctggcccgacgtggagtcgaagtaactggagtacggtggcgcctcgatcttagatggatcaaaatggagcgagtcgtccttgacgctcctgatcctgcctcttcgcgttctgctcgacacaccagaaaacagcacccttctccggtgaggcaatccagcaaacaccttctgcgcacgcaccaaacacaaatcaaaataaaaaaatactcagcacccatgacaactgggagcacgggaacgcggtaaaatttcagcaattttctcgggcattccgatgggggaggagttaccaaggactggagggggcgaggaacagtctgggcggtggcctgcggcgccatgcctgcggagtattggagggaggtgagttcgcttgagccgtgcgaattggcggttggaaatgaggggcgagaggtcacctgggaggagccaagtgcgggagcacgacgccatggctccgcctccgatgctgcggttggaacccgaggtggacgagagagagctaggggagggaagcggatgggttgagctccatggacgcgcaccgaagttcaggtagccggtttggtcttcggaaggggacaggataacaaggagaggttttcgaagaggaacacggggtttatccggtggacttcaaattcgaattttttttatttataattttttttattaaaagttttacaaaaataattttccattttgaaaattgacggaaatagtcgcctacagccctctgggagggcgatttttaa

SEQ ID NO: 62117 - DNA, 2591 bp, Oryza sativa
gccgcctgcaaatgggcggcgagggggcatggaattttgcaggcggcccccttcccgccctgggggagggcgatttttgcctcccccctataaagcccagcccctcccctgtgaaatttcattatattcactaaaaatccaaaaaaacgaaagagagagagaggggagggcagcagaagggaagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttgagtcaatttatagttggttgttgagaggatttagaatagaccaagaagtctacacaatgtcagtatctgttgtagtgagtcgtgcaatagaaggttatttttgggaactaatgccgatggacagcactgctgcttggagacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggtcttgttatatcagagggtgatcatgtaccctgggagtataaggagaacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagaatgtccgtgacgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgaagatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggctttcgcatttgtagagagtgagaacactgaaagctggtactggttcctagagagagtgcacattgcagtggtgcgtatgaggcccaacgtttgccttatacatgatcgtcagtagtgttctacctcttcagtccttatgtgaccgtttcttttggcttacaaacttgtaaagcagtactacttttgctattactactgcagtactacttgtgtttgtctcgtctacgtagttcttttcattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattattcactacaattttacattttggcagcaaaccaaatatgatcaaatgcaattttaccttaccaaatatttggtagtgccaaaacttgcttatattttggcattaacaaa

SEQ ID NO: 62118 - DNA, 4543 bp, Oryza sativa
ccgcccatttgcagccggccccccgcacagtagaaaatcgccctcgcggagggcggcaagggggccgcctgcaaatttcgttgacggccgtcgcccgagagcgaacggccgtctgccacgtcattttcgccgccctctgggagggcgatttttaaaaatcgccctcccagagggcggtaggcgactatttccgtcaattttcaaaatggaaaattatttttgtaaaacttttaataaaaaaaattataaataaaaaaaattccttcaaattcaggctgccggtctccacgctcctccaaaggcctcgtttagcatgggccaatttatgggctttacctgtgatgggccggacaggattcggcatatgctaatcaagccctctaagaccagtcacaacccaagacactagacatagtttccatacactccacatcatcaagaaactacactactctcccaatgcaaacactactatttcatacttaaatttaatgctacttatctcacatgatgtcttgaatgttgtgtagaaaccatgttgcatgcaagacattttccttctctttcctcatttattcacttgccatatcatttttcattctaggtggcagtttatttaatgttatagacaccatcttagttattgggttaggaatggcctaaaccggctcgttctggacgaaagtggaacagacgaaatggagtctaggatagggatacactagtaattctcaagtcctaaccgtgatcaggttcactaaaccgatcggtttgcatgaaaaccaatgatattccgtttgtggaagccgacctgtattactcggtttatgtacgacgtttactaaaagtcatcggttttattgattttcattttttattgattttcagtcggtttttcataaactgatgaaatacggttcttacttttaaaacgaaaaggtaaaccctctccgtgatattcgtttgtcaagaaaccgtgatatattcccttgtgtttccagtgcaatctctaagctctggcggttggcaaacaatcgaatgatgaagaaacgaccaaaaggtattcggtgtatttatttttctgacatcgcccaattctttttctaagcacaatttcctgcaggatgagatatagctggatgcatggagagcacgtatggtacgacaggttggcgatgaattttcaggacgtcccattcccacacaaaaagaaaaactggtacaaagtgtcaaagcttagcggttgcgaattgtgatgatatttagctggatatggctgtcaccacagccaaacagatcacaccagagtttttctcttttccgacagatgtgaacatttagccgaagtccttttgctcaccttttgctcaaaagtaggtggatgctgagaataattgtttgattctctgttcctctcaattctcattaacacagttgcaaagaaaattaatcaactaccaaacggaagagaagcatcagtaagaaaaaattgttcgccagatcaagataacacggagtggacaacaatccataaccctgaacgtctatacagcttgaagtaaaccagcataaaaaaaaagggtactacatagaataaaagttcaagattggtgttatactagatttatacttgtaaaacaacatgacatcagaaaaacatcatagtccagtatttcagtatatgcatgaaaatggcttatgcaacaaacaccatctacatagcacaccaaatcaatgatacctgtacacgagaatttttttcggaaaaaagtgatactaccaggctctctgctaactaacgctgggctctgaccaaacacatcagaaaggcaatgaaaatgaagatggtcttgcgcatagctttcgtatacagtaatagagatcaactggtggttaataccagcggtagagtacaatacaaagccaataaggtatccaagtcaccacagcatggacaatatacagcacaaaacaaaaatatctaatatggaacaactctctgacttccaggtccataaattgacagaaaatcaacatcacaaactcatgagaatacgtttaaagaataaataatgcctgcaggtgacaagcaaagactgttagctcaccgtcccttggggttcatgatctgtgagaagacagcgctaggagtaagcccgtcggagtctatgctagcaacactttggtcgcccatgcttatggacgtggttgtggttgtagtggtgcttgactcgatcgatggatcattgggatccttctttccaggcatcacaaggggagtgccctcatctgacatcccacaaccaatgcttccactatcctctgcactttcctgcatttgaagggcaaattccaagttccacagcacatctcccattgaaggacgatcgatgccttcatctgaaacacatttctcagcagtctcggcaaacttcttgaagcactgtggagcgatctttcccttcaggtggggatcaacaatctgatcaagaatacccttcttctggcagtgcagggcccactctgccaagctaacttcttccttagcaagagtggggttcaaggcagggcgagcacagaggacctcaaatagcacaacaccaaaggagtagacatcagatttctcagtgagctgctgcctgcggaagtattcagggtcaaggtagccaaaacttcccttgacaactgtgctcacatgtgtgtgatccatcgatggcccagtctttgacagaccaaaatctgaaaccttcgcgacccacttctcatccaggaggatatttgttgtcttcacatcacggtggatgattgtgtgcttcgcaccagtgtgaaggtagtgaagcccacgggcagcaccaatgcagatctccaagcgctgcctccatgtaagtggtgcattcttggtcttgtacaggtgctcacgaagagttccatgagccatgtagtcatagaccaggatcatctcattcttctcctcacagtaaccaatcagtgacacaagatgacggtggcggagcttcgacagcatctcaatctcggtttggaactcatgcacaccctgctcagacagtggattcccacgcttgatagccaccttggtcactccaccatcaatctccccacgatacactttaccgaaaccacccacaccaaggaggagggattcatcgaagttgtttgttgcagccttgatctccgcaaatgagaaatggcggcacaggttggatggcagcgatgaagcgtagctcccagtagtatgtgatttggctgagccagatgagtgtgagttgccatagagtgaaagtggcaaccatccagaatgcccatcactcatgcctgtgtccttccccactctgctccgacgcttgcagatcataaagcagcaatatccaagtgcaagaaccaccagacctccaatcactccaccaacaataggcccaacacttgacttcttcactgctccaccatccaacgatggctcaacagttggaacagggttgagcccagcaaggctcccattactaagcggcaacttgaacacctccagtccattgaggatagcatcatagtactgtggtttagcctggacatctggatagagagctacccacaaatccatagcccctgaaccaactgttgtcactacaaagtcttgatacactggactgccgatcccattgttattagtccatgcaatcacatcggcgccctgaaaagcagtctggttgttgatgtaaatgttgaacacccgctgattgatcatagtgattggatattgtatctcacagaaatgaagcctcacaaggtatgtgaacccagcatccacctgcattatccaagtgaggtggaatgccaagttcacgttcttgtccggccccatcgaccttgccgtagcatagacatccaccggcgccacatactccggcacattgctagggtaggcaatggtgacattgtcatcttttgggtaggacaccccgaacgccgcaccaaaaacgtatggcgagtcatcgtcccacgaacggtaaccgcccgtgtccttggagggggagatcgcctggccgccgacattaagtcggtacattgtctgcagagcagtgccagcgtcgatcgggaatggctgattgttgccatccccggtgaccagattcggggtggagatgtcgaagagatcgggggaggagacaacctcgatgccgttgacgaacgcgtaggcgttggggtggcccttctccggcgtgaaggtgagctccatcgtcggggtcgtgacgttgacggagaactcgcggacgatgtaggcgaagttgagggcggtggcggtctggtaggcgctgaagttggagaggagcgtgacgttggcggcggggacggagacggagaagcgcgcgtcggcggcgtcgcggctggagtagttggccgggtagaagtggagcctgaggaacttgcggccggcgccgagcgggaaggagtaggtgaagggcgccgcggagaccctcgcggtgaggtagggcacctgcggcaccgaggggtcctgccccgcggcgga

SEQ ID NO: 62119 - DNA, 13166 bp, Oryza sativa
  unsure (1)..(13166): unsure at all n locations
cactatcttacttgggcctccttatttggatcgaattggacatctatgggtcgtttgatcggaattttgccgaccacatcaagtagacaagtagaaggccagaagctagtgacgcagggccttttctcactatagaccccgcgataagtcccatacagcatttactgttactgtctaatttgcatacggccatactcctccatccaaaaaaaagagtaaatttcactttgggtcacttatattgacctcagttgcacattgggctaggggtgggtcacttttttcactttataccacttatttttaccatcctttgcaagttggaccaggtttattgattgggccactaggctgggcttcggccacgcaagtaggtgcgtttactagcagccggcaatccccgtctacgggctccggcgagggctccctcgacaacaattccgcctcccttctctggtacgagtacttccctcccaacccaaaaaagtctctgttcacacgcggttattgtgcagcggcgtgaactcaacaatcgacacacaaacgccaccgtctaggtccaccgaccaccggcgccaaggtggagcaagtctcgtcatccggccggggcgaagggcctctacctggtggacgcccatgccacctcgatcgatggcttcccgaggatggaatcactggggtcgttggctgcctcattgataggatgcttgttgggtttacgaggtagacaggtatatgcatctgctattcgatcatggatcaatctatggaggaaagttttgacccttggacttgggagagtgaaacaaagcaatgtattcagtaattcctatgagatttgggttttgtgggggtaatcaatattcctcttctgctcttcgaaaaaactagagtaattaatctgtgttcctcggttggtaaccggaaacatgtcgaattttcacaagaaaagagaagatcggatcttgattactgctaaatggaatagttggcctttgttttttttttcacatgcatgatcggaatgggatagttctggtgtggtctcagatcctgtcaacgtaatcagatgtgccgtagtattgttttgagcgtgacagggccgagcgtgatcaccctagagtccgcgtccactggacgacgacatgctcgccctcgccgatgaccaccccgacgcgtcgcgcacgctactggtatcgcgcaccactgccaccatgagcaaacaccagctgctcgcgtggattaggccgaaacgcatccctcccatgccgtaaacctggtccaacctgaaaaaggtggtaaaattaggtggtgctaactgttaagtgaaaagagaaacttagccctagcccattatgccacattggttaatataggtggttcaagatgaaatttactaaaaaaacaacttaagaggagattctagtgcaacaaatctggatagagagctgtttagattcgttgtctgaacggagggagtacgcgggatacaccgtccgatcaagactcgattcgttgtctgaacggaggaagtacgcgggatacaccgtccgatcaagactctgccgtacctgaggactgaggctctttctcaacggaacacacggcattaacacagtttactgtctgtacctttctcgagttggatctcgtactgttaccgagtgatggagctccccatgggccatggcgggggtccgccggtccgctgctggcgcccgaacttcacatggatcacagccatgctggcaggccatcgagcttcgtcggcggcttggactgataacgcgtgcaattgcttacacatcgacttcttcaagtcttcaacgacgacgatggtggtggtgtgcacacgggtaggtggcgaactggcgatggctgtgcgcatgtgcggatgtgcccccgagcatcgtcagcgcctgcaacaaagagcaggaggaaaacgctcatgaggacgacgatgaagtgccgtctcgatgtttttttgttaccctggagctcacctgccactttttaaaaaaaaaaatacgtgcaaataactgcactacaatcggggtaacaaaaaatcattgttgcatagtttgtggaaaaaaaagggaaaccaagctcagttttgctctatcatctgaaatgggcaagatgtgtgacgacccaaagtagccacgagagcttttcatcatcacttgagtttcatatggggtgagagaggctcgaactctcgacctcaggataactcaatagctatgagacctacgcgctagccaactgcgccaccacccccttgtgttcgaggtggcggccagcacggtaaaatcatattagcatggtaggccaacagcgcgctaatacgaacgtgtgctccactcgctgcatcgctggtttggttcgtgctccgctgccacgcgagcgagggcctgcactgcatctgcacgggcgaaacgttggggcaatcgtttctcgaatctcccaatgcaacgcgagcaccggccgttgcgcgcgggtactcgccggcggcgacagggcggccgacgagctcaacaggatgttcctggtggtagtgaaggccgaagagagcacgcaccggagggcgtaaatgagttcttgcgtggccagcgccaggcgtttgcaatttgcaaaaaagacaaaaagacctctccgcaccatggggagatagtaatacatgctgcgtgtcgggaacggtcgtgttttaggacctaggactttctaatcatgtttccttttctactcgtacgtacgttttgagaatcctaaatgcatggcatggccaaaatacattgttaaaataaaattgtgaaaaagaactaatcatgtttccttttctactcctagtacgttttgagaatcctaaatgcatggcatggcaaaatacattgttaaaataatattgtaaaaaggaaaaaccaagctcagttttgctctatcatctgatatcggcagacgtgtgacgacccaaagtagtcacgagagctttttcatcatcgctcggatttatggggtgagagaggctcgaactctcgacctcaggatcactcaatagctatgagacctacgcgctagccaactgcgccaccaccccgttgttgaaaccaattactccctccatcccataatgtttcaacctaagattcgtagtcctataatgagataggatgagtctaatctcattctagattgcaatattatgggacggagagagtacaataatccattaacataatatattcctcctgttctagtttgcgagctagcaggcgccatatatcatactacctccacccataatataaaagattttgagtttttatttacactgtttgaccactcgtcttattcaaaaaattttggatttattttttattttttttgacttactttgttatccaaaatactttaagcacaacttttcgttttttatatttgcacaaattttttgaataagacgagtggtcaaacagtgcaagcaaaaactcaaaatcccttatattatgggactggggggagtatgtgacatttaacttttttttaataattaaggatttgtgtctatgatacgtgggctctcatatacctataatatgcgagtctatgggtaaatcatttatcaccagtggtatgagtggcaaaaagaagttaattattcctatatgcaaagtgcattcttctacttaacatggtgacaagaaaattgagaaaaagcatgatttctcattcgtgaaaggacggagtccggtacaccattctctttacagttacagatattagccactcactcatcttgatcttacttacaccgacatgcatcaaaatgtacatcaagatcaacaaaaaatctccggtcaggttaagccccaggcagtcaaagttacccccgctgcatacgccggatcaggcagatcctttgccatattacagcgttcttccatcagtcaaatcatgaacggtgcacaaccttggagataactgagaacgggatcatcacccggtggcccttgtcgccgtagaagccgacgctgccgaagctcgcggaggtgccgttcatggtggcgttgacgacgaaggtcacctgctgcctctgcccgctggggatgaagaactgggccggcgacgcggagacggcgaccccgtaaggggcgctgtaactgaccgtgtagcgctcgtcgctcgccacgttggttacagttcttgttatcgttcttgactggttgagcactgcaatggtgatggaggggaggttcagatcagcccctgtcatggcggaggagctgcagctgttgccggtgtaattcatcactactggagcagagccgtttatgccacatagaaaggagaagaagtcgtcgtaacctgtaaagtcatgccgctgtcaggattgaataattactaaactacactgagaatttcagtctgactttatagtgagaaaaaatgttgcattgcatgtatgacattcaagctatattgctgttgctacttgctagtttgtattcatactatcaggtactccatccgttccagatagaagcatcagatacattttgaaaaatgcatagaaaaaatgcttatattttggaacggagtttgtataacataggccccagtgaactctaccaaaggtagaggtactgataatagtaaaataaacagaagaaatggcagttgaacttactggaatcaaatatgagcccaggatccaaagcagcagtagcattgacaaatccatttcccatgtcaaaaggtgtagctggagattgagttgaatttggattgccgtatgttctctgtgccatgattggattcccctccctgtcactgagacttgtagtagtcgataatgcagaacctatagctgcagggctaaaataagggaacttctgcttgactagagcagcaagcccagcaacgtgtggtgcagccatacttgtaccggaaattattgcaaaactttcacctagacagtaagtcaaaaacaacataattattcaattaatctatgtaagaaaaaaattattatataagcaaatttattaatagaagatgttataggttggattctaatgctaaacgaacatcttattaagggcttccacaataactagaacagtttttatacaaccttttctgtaaagcattatgtctagagcatgacctaaacttaggtgttaaaatgcacaattaaagagtgaaatcatgtagcgctttctgtgattacttctacataaaattttgctctatcactctatcagcgaggtaaagggaatggactaacaaaaatgcagaacaactgttggcacaaatcaatgccaaccgtaatctacaaatgattcatggtactattgaaggggaaaaaattaggctgaatcttcaattcagacataagctctctcattaacaggtattttagcacctaatagaactgttaaaaaaacagaaaatgcatgccactgttttgttttattgctattttatatgcctgatgattcaaagaataaaacttatgttctaaacaagattagaaagtaggtaaattgtcaagttaccagcaaattcagcagagtccaatccaagagaactccaagcaccccaaatggaactgccaggtgctatcagatttggcttcaggatatcagcattggccagtgagttgtcctcaggatcaggacccctggcagaataaaacattacttttggggcagaaataccataatttggattttggcctcctagtatttttgcaattgcaccaaagctgacgattttgtttgaggtctcatctctcacaagggactcattgtaataatttagaaatacctgagaatgttgcatcacatttgttaattttcttcatatcagcaagggatgagtaataacaagactcttgctttggctgtcataccttagagtcatcagatgatggtattataagtccaggcatatccattggagttggattcagctggaatccaatgacaaatggatccagatagaatataactcctgcagcactgacattctttgcagtatctaaagcttgcttcacagacgacaggccaagtacaaatcgtatggaatagctgcagaccagtatctttccccttatcagatcttcatcaaggtggcttgaatcttggcactcccctagggacatttcagtaggactggctacattgtttttcagtgcatgaggtgcagcaactagagtgaacatggaatcaccatctgttccagctgtatttgtggagtaacacaaagttagaatcaaacaacaccagccatgtgcagttgcgcacaatggaaaatactactaggaacttacgagcaaggccaactcctgtaatggtcagattgttgccaagtacaacatagttgttgtattccctgtcatgggcagatgctcctacagtaaaaatccatggactgtatgatgacatgctcttgggggaaggacctgtatttcctgcagcttgcacgacaaatatgccagcttttacagctgaaagaagagccatgtcaattggattaaagaaggtggctagtccaggaggccttctatttggggtaatggataagctgattatatcaacattatcttcagctgcctgcaatatgatgaatgacttgtcatcaataaaatgtcacaatgtgcccatatgcattgtagcattctaaaatgtggtattaatttgtgctaaatcaaaagaagatagttagcttgcaggtaaaccattacctgatctattgcagctactacatcagcagcaaaccctccaaagcttttgtacagagctttatagacagcaatgctggaaattaatttgtcattaacatttgggaataaagtggatcttatatgtctccgcagaaaaaggtaatggacttactgtgcacgaggagccattccacttgcattcccaaaatgatgcccagccacaacaacaggaattccatgattaccagctgctatggatgctgtatggctgtacgatgtacaaaaaatatatatcagaaaacagatatgctgacaaaaaaagagccacaatgacatatggagtgaaaaatgtaaatgaaatatctatgaataatttaggcagaagctgcagaactggatagtcaaacaagaaaaataagaaaactctactgtagcactatgaattctcaagaatgctactattttacttaaaatttgcaagcgtgattggacaatgtaacaaaaccagtagtagattggtaatggcttcgtattcttgctccttcaaataattttaaagggtgaatcagcagatagtacttacgtcccatgaccatcactatcagaaggtgaagcatgatcttgagaggcattgaacactcccctggttattgcagaggctgcaaaatgcctagctcccacaagttttctgttgcaggatccagatggaaaatcatttgtaacctcgcaaatgccagagtaatgagcaggaacaggataactgtcagttatcaagtcgtctgcgaagctgggatgagttggatcgattcctgtgtcgatgaggccaacaacaacaccctgaccagcacattgtgggccaccctcttgaacccatgctccttgtggcaaaccaaggaattcaggggtatgagttgttgccgtcctaactgagaagtccaacattacatttgccacttctttcgtcatagatagcctctctgccttttaaattttaatgcaaggaaaaccagttaaaaccttattgtcaatccaaatagcttcgatattttttagtgctataaaaatcagttgagatttagagaagtgaccaaatctaaacaatcatgcaataaacctgacaggttcttgagaacgatgataaaacaaccaagggtatacaaggtacaacattttaacatgctaaaacatagcaaattttagagagagatagcagtagaagcaaaatcataagtgttcagtgtatgtaacctagcagatatcaacacgccataattcatattgccatggacttttctttcgagaacattgatgcagcatctaatagtctgaagatttcagaacttctttttgaaatgcaacttaaaaaaacttgtaatgtgacgttacagaacaaaggtgcaaaagtggtggaatcaaagaaaaaaatgatacctgctgaggagtgatgacaacagcaaaaccattaatcagatagcggtagctgtagagctttatatagcgctctcctctcagtgttctcttcaagagtgaattttgaagacgaactaagtacgagccataattcataggttgggctggaccatgcctgcattacaacactggtgagcaaaaaaacgaaaacttaatttgtgacaagcaagggaaaatacttgctaaaaacttgtcagataaacagtaaagtacagaatcatcaatagcacgctagcagcacagccgcacacacattgttcatgttggtattaaattccatatcttttgtgtgttaaaaaaaccaaacatttctactgcaatagtgggttagccttcccaatattagcagcaactacaccaatgaaccgagctgtcggcagataatgacgtagcatctctaacatttcactatagaccaatcaaaatcacccaaaaactcctcccccaaaaggagagattctcacccaaactgaatcgtacatacatatttcgcataaactgtaaagatagagcaaaaccaaatcatagaggagtaataaaccatcaaaaaccttggcttcatgaggatgctagtggacggggtgtcccccccgccgccgccgccgccgccggcgactctgctgctcccaaacctctccaggtcgaggcgcttgtggaacaccggcgcctgcttcatggtcacaatgtacaccgccgtgccctcctcgaacgcgccagcggcgcccaccagcgccgccccaagaaccgccacggacagccatgcaaccgcccactgctccctccgccacgcccaacccatcgcctcaaagagagctcttcaccggtcagctcccaaagcgccgcaagaatcgccaagaaacactagctgcggcaagaatccattgggggagcaaaaagggcctcgctcgacgagacgatctcttccgagcgaggtggagctgatgaagctagtagcactactactacggcctatggggcttgctccaggctcattaatggcgatgtggaagtggccgccgcccccgccgtgccgtgtgcgctttaagccgcggcgagagtgagagagagcgagtgggttgcactgaggctgagctgcggcacaaagacgagcagcgagcacacccaataaagagcgaggcagaaagccagaaaagcgcactcctccggtcctccccttttatgcctactttgatttgattttaaaacttcggttcgtgtcaaaaataaacatgtaatacgaaattacgatccatcgtcatagtatcttatattatatttgtttattagcagagatgtaagcaactgctaaattctaatttgtttttttatcatgtagtactacttatgttttgtattataagtcgttttgattttttaaaattaattttttaagtttgatcaagtttataaaaaattatagtaatattttaacacaaaacaaagaaactattaaagtatatgtaatgttagatgtaatagaattaatttaatgttataaatgttgttatatttttttcataaaatcaaactgctaaagaggtttgttttagaaaaagaacaacttataatataaatgaaggaagtaataattattagttattctaaaagtctaaataataatctatactgtttgaaaatgctaaaaactttaagtgaaacttatggagtccaaacatgaattgacacagctgctgcgtctctcctctcagcgaaagagcaaaacacacagctcagcgttgcagagagagtgaggcagacgaggcgaggcctcggttttccattacctcgtgaactgtgtggtactccggccttctcttggaagaagccattttacagtccatttttactgccagagtacgatgaagaaaggtggtggaaaagattgatcgaacggagattgatcgaatcgctgcttgcggcacatgacaccagagttcacagtgcagtgctatgctaatatcccgatgtttcagacaacagaaattgccggtgttctgcttctgtgtacctcgcgttgcaagatcagtagtggagtactactgtcaacaacaactgctgctactgctcctttttgactaagggctgtgtttagtgcacgctaaaattaaaaatttggttgaaattggaaggatgtgatgaaaaaattgaaagtttgtgtgtagaaaagtttcgatgtgatgaaaaaattgaaagttcgaagaaaaactttaaaacaaaacacggcctaataatatttactcgtatcattttgaacaaggttattatcaaactctaaatgtcttactatataaataacttttaaaatatgtcttataaatatggtgaccatataagattttaaaaagtgcttgataaaatcatatacttattgatatttctgtatgtattgtaataaaaaatagtgatcaaaattggctttgaagatcatgtttctatccaaaatgttaagtaatattatcaggttggagggagtagtactaattcagtatatgatcatgaagtccgtgaccattgttttactcatgcacctggtcagaacgggcgtgctgtaacggaattgtatgtgcaagcgttgcatttgcactgttgcagctagagtgaacaggctgtagaacagtgctagcgctatggatttttctcttccgtttttattgatctgtactgctgtactgctatgtcacaaaaggaaaaaaaatccataccccatgatttcaatggattattaaatgggttggcccagagcgacgcatcatccgtgcacgtcatccaacggtcaattctctgggctcattagaattttctaacagttttttaatcgctctggagtactgatcttaacgtgatgctgcattgtctacccgaaaaaactgttttccagattctaactgcaggtttttcagaatcttgtctttccactatatgaaacactgttcttaccattcaagctcttattaacatgttctattagtctagtgctactcaattatcagcagctgaggtggaaagctaactgaccttaatatgctcttattaacatgtactcctacctactaatctaatattgtctctgttataaaaactggcacagaccttaataagctgaatagaaaaaatatcatagaaaagtccaaactgatgacgatctcaagacacaatatttgttactaataaggtttaagctgaaaactgaattactggaaaacttattacgaacaccacttcttgatttaacatattacaatgtatttagatatcatgacccttgattgaccatattggcgactctaattctatttgaacatctaatataactttaaattttaaactgtaatcgtttttatatacatgtttaacacaaaactcttaagagtttcaactgaaacatgcaaagcctgaatttccagttggaattctccaaccgcaaaggatcttggccacgttcagcgccggtcccagtttatcttttataacccagcactttgagctttgaagcacaataccaggcatgtccaattgataatgctgctcggtgtgcactttgactgcactttgtcgatgaccgattataaaaaccgtggtgtgcttcagtagtcgccggcagctcatgatttcgttgatcatctattccaaaggtgcacatctccaataatcatcaccaaaagtttcatggatccaaagcacaaaaccgagagaccctaaattcaaggccgtcccacccctgttgctaatccacctctgaaaatggggataagacatagcaaaggcatttgcagaaaaaaaaaacgaagtttgagcctccccaaaccaaaatgactttgatcatgtactaccacgagacaatccaagaacctttgtccatctctctctctctctctctttttgtcctaaagaaagagatctgagggagagtgtgaggcatgttaacatgcaaccaaagatactaaccgatggcgacagaacacaggccacaagaaattggagtacgtgatcacgtgatgagtagtagtagatcaatgagcaaactacgcatgcactcctggtcacctggggccagcattgctctcggctccctgcaaccagtcaaccagatttttttttaaaaaaaaaaaactgggaaaagcgactcaccaacactgttagagtaggtgacaatggcattgcagcagctgctagctagcttgctgcatctttactgtggtcctaattaacaacttgaaaagtgcaaacacttcatttcatggcctccattgggaggtagatgatggtagcactgaactatggtagccggtaggcgccaaggtcaccttttttttttttttttactgctgtctcctctgctttctgcttgcccggccggccaccaccactcggctgcagagaagcgtagtgcagcgctacgagctggtccattctcgtatcctgaccggctcgatcgatcgatcgatcgaaatgtgaggtgtttctgacgaagagggcagctagctactagctaagctgtgtgcagaagcagacgaggagaaaagggatggaaaagggttaaaggggctggaattattgcgcatagtgagtcggcgggctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62120 - DNA, 2712 bp, Oryza sativa
tgcagcggggctgaaacattgaacatggcgcgctcccttgccactgcccgccatgcaggagagaggcttctgagatgctggggcggtgggacaggatgggttgtggaggacacaaaggacaagatagcaaagcttctggaggagtacgagagcggaggcgatgtaggagaagcttgcaactgcatccgcgagctgcacatgccgttcttcaatcatgaggtggtcaagaaggcgcttgtcatggcaatggaaaagaagaacgacaggatcctcggtctgctgcaggagtgctttggtgaagggatcatcaccatcaaccagatgaccaaggggttctcaagggtgagggatgggcttgatgatctggctctcgatattcctgatgccagggagaagttcctgtcctatgtggagcatgccaagaagagcggatggcttctaccctcattcggcgtcgctacttcagcttgaaccaatgttatgagtgagcaggaagcatcaagctggaccggaccgatgaacaacgaagcaagaaggcacatgccgtgatatttgctgcatccactagatattccaagttgatgattttcatttgcgttttctgatgcttgtcgttgtgcttgcgcgtgtaggtagcggagcgagcccctcttacttgtggttgttgtggtggcttatgtgtctagatctttcacctctgacacacccgttgctgttgttagttgcattccatttttaccttcccccatagacccttttttacttcacaagtaaaaacagagaaaagaacccccgtcatgtaaaagttgctccctgcctcagcatttgcatctgttgcttacctcatttactgtacgttctcgcctgcagcgataagtagcttgatgtgttcttttttaaaaaaaaaatactaggagtagatgttaattgtctttctgtgatgatcaaggcgacagagcacagttgcgctttgtttagctggttttacaatggggattggattggcaccaacattgtgtcagtgaatcatatctgttgggctgttgggtcagtggtatatcaatcatcagaaagacgcaatcaacatgccagctgtactgttttgcatcttggcgcaatcaacatgccaatggtatatcacatcttcatttccaaggattttccaagcatcctaggcttctgcgagcagctaggtgacgacaaaggcatcaaggttgtagcgatgaacgagcagaaagaccctatttcttcctcagcattggtactacctccgttcaaagggaaaattggaaccatgctattataattttgtaaaatttgagatataccatccttacccacatgtcattgacttatgtgggtcctatatgtcattgagatatcaatggcatatctcaaactttaaaaaattataatggcatggttccaatttaccaaaaagaatgtactagctatctactatccaattgaatctttatagagatatcgactgttcagatttatattattaggatgtgttcaattaaatactaggcaactagtttattttaaaacagaagaagtatgtgctagtttggtttagtaccctaccaatatattggtagtgccaaactctagacaagttttggcactaccaatattttagtaggatagatctgtaaatgagtgtgtttagtttatgccaattgagagccaaattttaaattgtggcgaagaatattttagaattgtgtcaaattaagtataggtattaccaaacatttggcttcaaaccaaatcttcacatttactatttaaactaccaaaaaaattggtatggcaatattttggtattaaaccaaaacgctcctatatgttgtttgtcctgaatgctgaagccatcatgtgctagcgtatgcgtcattctggtgtgaatcatcaatcaataactcccctaaccccactgtttttctcatttttatgaatttttttttggttatctggatggtttacacgtcgctcctcattccggctcctcgcgtacgcctgcgtgaccgctcgtaagcggtcaccggtccaacgatttttttgggcgcgggttggagccggtttgactaaaaggatattttgcaaaaaagtccttgtatttccacgaaatatcgtatacgtccttggactggttcacacccgttgtgtttgttgcgaaaaagccctcctatttcacaaatatacaatgtgaagaagagaaaattccgttttaggggtagagctgtaaatattaaaaactaaggggttttttcgaaaaacaaccacttataccccaaaccctaaccacgggctgttccctactccctcaccgcgcggccgccgccccacccacgccccgtgctcggcgctggcgccggcgcgggactcccctcgcctccgtccgccctccccgagtcacctccgtcgtcgtccgccctccacccgccgccgccgacgtcgtccgtcctccccccgctctccgttgcctctccttgcaggccgtgcgacggcgcggctcgtggcctcgtctccggtgccgccgtagccagatccggccctcccacggctggatccagctccgccgccgctgtatctggcggccggaggagacggcgcgacggaggaggatggccgcgatagcttcggacgacgaagcggcggaaggccttccccgcgaggggttccgctgccgccaccgtcacccgt

SEQ ID NO: 62121 - DNA, 17095 bp, Oryza sativa
cgattgcaactcgctgtggctcaagttttgttgtcggctcttcctccttccgaaatacggacgcattggttggatgacagcagacatcagcccatgattaagcgttgcgggcggcgacgacgaccttgccgtatctgtgtaagtgatgagttttatggagtctttattcttcagactactggaagtttctttttgtccaaccaggttcttgcgatgtactggaagttcctaaacctttttttttcctgaacgtgttcctaagaacacttgaggctgttattttggtcgattgcaaagcaatttgaattaacaaatcccaaagcaaagcggtagtgacgagttttttatgtgcatgttttactgcctcggcggtgatgcaatcattcaggttttttgttcgactgcatcttacctattcaaactgcaggaaagtattgaattattgtgggttctggtggtttttatgctgacttgttcagttgttctcggtggtgttcttttttttattattggaccactgtatgtgcctcgtgttagtctgtttcttgttaaaaaaaattgcatggctcattatagtatcctactaggcttttcatgctctaggttcattgatatacaacttttctgaatgtgaatgagctccttgaacctggattttggttaggcagattatctgcattatcttttacactattgtatttggttaattgggttatctatgtgaggccagatgtagtgattggtcttacttgtgatgctaacaagcatgctttcaaaaggtagacatacttacagaattgttcttttggaaaaatggaacatgaactgtgatttaacgctcttatcagtcaatagccatccttttaattgtaattttcatatatagagcagaactacctagcatttccctgatgctatcataacacatgaaactgacagcgaaaattgaagggcctaatatttattttgtcctacaatgttgcactttgtaaaactataaataaaattataactcattgagccgcatcctttcagaacatgttaaagtctataaggctctcatgcctagcttgacagttaaagctcaattggaactgaagatctattaccatctaacgttcattgcatactgaaaattggattaggttcttttagagcttaatagggcctgtttttttataggttatggtgttttgccacacttgactttattattaaccagatctacagtccttgacaatactcctacttcaaagcattcattggatgatcgcagacccttgatcagtaagcaaccgatttatggcttgtggttgctgcttgatctcctcacctctcttgcaggggtaagaaaaagcaatgtacgaagcaccataaaaggtaattaattttctcatcataatatcgcagatagaagcttagaaaatacctacttttggttgctagggcgaattaccaaaagtggtgtacaatcaaatggtttgctgcaatccttttgcttacctacatgccctaatatattagatcgatcccaaattgctttatgtatcgtgtatcttattatatgtgcataggtcctaaaagagttgttgaaaaatacatctctgttgtcccacatagaatacatgatctctgttgttccatggcttgcatggattacctagctaatatattctactcctatcctcctttatttatttttaattatttatcttatttacttctgcaaattattcccataccaaactaattcagttgtgccttcttgcttgcaggtaaggatgtgctccatgtaaggactttggagttgctggcatagcagagaattgaatgactgcttttctaagtgcaagcaattgtgttctttgggttttatactaattctcaaacttgatgatattgggctggtcgcctctatattagctaactcaatagagcccttttccgttatagcatctttactttccaaattttttaatttgtaatttctttttatatgagcaattggtactatgaatgtacgagacatatggtcctacatcctgtatgtctggggaacgggaattggttgggaaaaaaggttaccatgtggacttatttttgttaggcccatgttgttcaactagccctgatagtttcctaaaactttgtttaatttaagaagctatgtaatgattctatttttggtgtacaagatattggcattatgttacacatagatgtgttttgaaagctaaataaaattacatagcaacatttggtcaacaatagctatatgtttaacagtagctttgcttaagctgttaatcatatccttgtgtgcgcagctgcgcgcggcgtggcgccgcgcttatacttctagtatatctggtgcttcttcctcaacctctcttgtcctccctgctgctgctccgagaacatgaatggattcataaagttgattcgtgtaattaaatgccacattctgcaactatggacggtggcacggcgcgagtgtgtgcgacattggctggtgactgatagtatttgtggcgtgtgcgcggttgatcatttatttgtctcactcttccgcaactagcctgtacttgttcttgctgagaatgctaacaattcctttacgtaaatttggcttccttgctgtatttgcttgcagtatctcagtcgtcgttgatttcgactagcagatcttctatctcgagcttgatggaggtaaaaaagaaccaaggaaaagacgcaattttgctttacagtatataaatcgtcggtgcaatttgttcggaaataaatagtggactggcacgcgcaatcacaggaagagttttctttaattttgtggcttaatggagagtgactagatgataaattgaatcaaagaagaaagaagatttcagtttgttcttttttgcaggaaaaaaaaagaatgcagtttttgtaagatcggattcagacttaaatgcggctcatactaattggcccagaatgggatttcgattccgtgaggcctatatatatgttgggacgtgaggcccataaatattgggccagaacgggatttcgatttcaagaggcccaataacgggagtaggagttacgtgcggcccatattaggcctaacgggattctgacttgtgggccacaatgattgggccgcaactggatttcgattacgtgcggcccagtcaacgggcttggagcttcgcatggctttggacttacgtgaagcccattttcgctgggcccgttgatatatggggcccaggaaagttaatccgaccgccgcgaaaaaacagcagtccagatgagtaacatggaccatctctgcaactgcagttgatttacaccatgatttgatgattgatttaactcagataaagaaaggcatagtttatcaacgaggcaaaataggatgtgaatatgtgatccaactgatggtcaatcattgagctactaccagagatgttcaaaacatttcagtcagtgatgcgcatctattgtgtcagaactcacaagagagatgcagttaacagattcacatactttcatctaaactgaggtgatcttaacccagagcccatctaaaataacagtatacaagaatggacaacttgtagtcagcttcaaccaaatgaaattcatcatcttgatcatcaacccttgtttcagtttttactgtgcccttggaacccatcagtttcttccactttcgtcttgcagtctggtctgatcttgcagaaacagcatttgaacagtcccctgcgaggcaaagctccattttgataaggagcaccagcacggcgctgtagaagcttcgagaaacagcctcggcgagctctggcttcgtcaacctttggtgtgtgccctccagctttgaaggaaccatttcctggagtggatgcttcaggtatgactgaaatcttctgatagctcaagatcctcgactcggtatccaccgcgtcgccatctgtagcatggaggcaccccagaatgtgcgacggcttctcctttggttgcaccgcgagtggagaagggcactcttttcttgatgaagctactgttctgcaacctgcggcaactggatcttctgtctcctgatcttctctggattgcatgaccaggcttactgatgaattcttggatacaactctgttgctggtggagattggggaaagattgatcctgatatccacattgcactttagcaaattctgcagagaaaccacaaatggattccaaaagctctctgttgtaggtacatcctcggggtggcagaactgcagctcagcaactgctacacctgcaatccaaaattaaacagaatgagttcgacttgaaaattctgcagtgccggcatgcaatgatgctactaacatgcagtttggattcatggccagtgctgaacggcaattactacagaactatgggaagatatgtgttaaaagcatactgacaattatctgccaccttatcaagaacactagcttatccacagatatacctgtttactatacatgacacatcatacatcagttcagacaaacatgtgctttctggaaagcaacattgatcaactggctgaataagacgtatgatggatcagcaggaaacatagtaggaagtatggaaatgttcttgttatagataagatgacaaatgaatctgcctcccaaacaaaacagaagaaaaaggatccaacacacagttacatggattaccttgagtggtgtacagggatgacaacttcccatcttttctcaacagactatgaagtggtttagacgtgcagttctcaagagccttaatccatatggtctcgagcacatctggatctcctaagttcatatctaaacaaccgattttgttctgatagcaaagatgagaactggtatctaagctttcgtctttcaagatagcagccccatcatctgcataataaatagctttcagtgagcatgagaaagtgactcagtcatcagagtttcgttccataacgatattatacaggaaacagattaacccccatgggtacaaaataactgacactaatgtaataccatatgaagtagagaatgccatttacctgtctgactctctgtgaacatgcttgaaactgcagcatcatctaggcagtacggctctctcatattaaactgtaacagcgctgctgtaagccatgtagactggttctttgtggttttcagctgcttttcagtttcagaaagtatttccagtgcatttctaagtttgtgcacatcaatttcagccgctgtaaagttaagatacaggattagatgatatgtgtatgacacattaatgtgaactgtgagcataataattatcatatataataatgctaagctaatatgtcatgtttaaaggttggaattatcttcaagataaggactccatattgcagtgttatgttcggcattaacaataacagatctgcaggtaatccgtgtgtagattgtacaattttaaagtttgtttgggagggaaggagcatacatgtatgtttaccagtaacctttctaacttcttgggaatctgactggtgcctcccagctaaaatatccatgataagatttgcaagctgagctaataactgcagggggtcaacctttgagctcaaaagctccctagccctcctgacaatggtagcagcatccgatgaaaaagccagattaagaagatcaagcaactcctcatctgagacatcgcctatctgaaaaaaaaaaacagcatagcaagttgatgtatgttcactgaatatgaaacaaggcaatttattttatggtggtaaatatttcaaggctagaaaagctgattgattaacttactaggtcatatgttactgatttgctgatcctttttcctagcagagtaagctggtcaagcatttgaactgcatctcgaatggaaccgttggccttgcgagcaataagctccagtgcttcggcctcgaactccataccttcatttatgcaaatcctactcaatcggagggcgatctctgcttcgtctaccttgcaaaacctgtagctctggcaccatccaactgaattacttggcagtttatcaatgtcagatgtgatcatcacaaagattgagctgtcagggatgccttcaaggctactgtagacagagtaccatccctccttatccatgtgttggcaatcatccacaataagaaccttgaagtgcgaagaagcaggaacttcacaggcattcctcagcaaggcagcaactctagatttgcaatccagtttagaagcatcaatctctatcacactgctactgtttcctgagaatatggccatgcattcctcacagtgcccacaaggctggttcccacctgaagagtggcaattcagtgatgcggcaaatattctagctgcagatgtctttcctatgccatgtggaccatggaagagatagattggagcaagttttcctttcaaaacagcacttgaaagagactgagcaacaacattttgtccagccagctcagagaaagccttgggccggtacttttgaagcaaacttctcgcgctttcttgaaatgtagctccctccctccgacccaattgctctccttcaatcatcaaagaggatgccctgtcctttgttgcccttgacatccccgagatcaccgaggagcaggtctggttatgaagcgccgccttgaccctcgcattggccttgatgatgttgatcggcgagttcaccagccgaccagacctcgcgctgtccccaaactcctccctcctcctctggagatgatcatacatgttgtaactaaagctgtgcctaccataattgctcccctccaggtcatcttcctcgagagaacaaccctcccagatggtcttcttcgccgagaacttggccagcgagttggtctcagggtccctcagagatctggacctcatgacggccagtagagccctcgaaatcgggatgtcaacggagtgcctcctcccctcaatcatcttgcaaggccccaatgaactatgctgcaatgcagataaataacgaggaacaattcagtcttcagtagagaaaggatgtgcaattaggcattgcacagtcaacacaatcttcaaacatggtgcacactccacaaaaaaactaatcttttttcgatcttgtatgcaaggagcagagaaaccatcaacgcaaaatctgcagaaacaatcgctacctgcggttttacctaaccagcattgccatgcaaacaacttgccgagataggcggagccaagaaaaaaattgcagattgtagatggaagtcaatcgggcgcctggatgcaaacatccatagaaaaaccttgcaacttgcaaaggagagcataataaaactcaaatgcaaaatgcatccaagaacatgaaaaaaaaagaaacaaaagaaatggagaatttcaaggcctacatagtacataccgaacgatctcgcaggcggtacaaaaacctcgcaaaagggggcaaaagaagaagagaggaaacgacgcacaattccccatagaggaattaacctcaaagaacagatagaaccaaaaaaacaaaaagaaaattggaaacattttcgcagctccagacgacgtggcacgcaggccgaagaatccaggagaaaggacaaacaaacaaacaccaccgaccgagagcagcaagaacggaagagaaagatggggattcggaaccgaagcatttacctcccccccaaacacgaacgacaaccacaacgacgacgacgcaagacaacaacgccgcggcttttccgcacctccacctccaccgccacggccgcgcgccgctccctccctcctccgttcaccaccaccaccaccacattaatagcgcgagcacggcatggagactcgaggagagagagagcgagaggagcaagtgagcgaagcagcaggaggggggactaggcgagactagactagagtggcagagacgtaaatacgcgccaaggtgaggggtagttttgccccgggaggcgcggggaggaggcgggcttaggggtggatatcaagctggctcggctcggtctagctcgttaggataacgagctagattaccggctcggctcggctcgtgtgtcagctcgagccagctcgtttagctcgtgagccacaacaaggaaaaagagtagtggcgtgtgcagtgggaggaggaagagggcaaatgctcacaaaccaacagatttcaaaggaaaatggatatgatgatatatcactagcttgcactgatcgattactgcaaaacaaatgcaattcagtggccggattaaaccgctactgcaacagaaatcaaggggcattccagaactgaaaaatgcaaatgaggaatcaataaaaatacgcaaagagataatcatcttgaaagagatgcacaaatgatggcttgggtggtctcgttcaccctcctgactcctgctccctcggggtgtagttgcactgatgccgacgaagccacggaggcgagggctggcagcggggccgattgaggcgagggttggcgtcactatggcctacgagcaatctacacgcgacctcgtcggcgggcggcgcaaggcgccgtgagacgcggggagcgagcggcgctctcgtcgcgcggcggcgtgaggagcggagagcaagcggcgctagagtagaaaggggatctgggattcacagaatcacagtgcgtagacaagtcacgtgcgtgtgtttctccatctagggctagtgctattttttttcttgatgggccagctcgaccgcttcatattatctctttggactattgggcagctgggatctttggctgttgggcttggctcgttaggctcgtgagcagctcacgagccagctcgagctggctcgttataacaaacgagctaaaaccctagctcggctcgttgacaaatttaaacgagccgagccgagctaggcacgagtcgaacgagttatcgagccacgagttttctgtccaggccgagggaggagggagaagaagaggaggccacgatggcacccacccgtaaatacgcgggggattcgaggggcgtttccgtcatttcgtggctccgtccgtggcacaaccccgaaccgtaaaacggacgggacagcgtggaacgcggtggcgcgggtacaggttgatgacaggtgggccccgggcccacctgtcagtgagagggcgacgtgggtggggggagacgttgcgaagggcgtggcggtgtcgtcagatttactgttgcggcatgcgaggccccgtgaccccaccgctgctgctttttttttttactgatttttttcatctcttgccacctgtgctgcaataatttgttttttttcttttttttattttgttgtgattctcttttatcctctgtcatagaattttggcaacaggatgactaaaaagataggactattgtcgtgtagcctgaggtgtgatttaacttttttgactcggaaaatgtttgtcattaacccatagtacaagtttgtatcagggtggtaggagtactagtacaagttattagttgatcaaattacacgtcatttgattatgtgtgagctttgaaaatctgtttcatgcttttatatgtatactaaactctaaaactggccttaatatgttcagtaatcagtcgtgtactaaaaatttgtcaggagtatggtttagaagatttgtggcttttattcaaaacatatagctagaggcaaattacttgtgtttgttgccgcatgccaacaatgctttcttgctatattagtttatcagtatgataacaacattgtcagatataattaattaatgtgttctgaattttcttatatcctttctcagttctcaccgatataaaagcagctggcaatcgatgtggttttgagcagggaaactactccaacaccataatctgtttctctcttcttttaacaaggattcggtagaaatgatccacaaggggggggggaccaagactagttggttccggcgacttgtttggtgattttctaatcattgtttagtgattgatcaatggtccaacatgcatatggcacagtcttcgaatccaatcaactcaagcatgcatttgtatttgtcgctttattaacttgtaggacagaacgatagcctcttgatctttgcatcattcaagagttgatcgatcgggttatcatcatcagaaacatggccggccctgctcatcatgcatttctccaacttaatcttttcatttgtaactgaggattaattatccactgtaaaaatgtttgtgtggctaataaacagtcaaacagcatttcgaagttattttaagtattcatactttataactttaactatgttatctgcacttggagtggatgatacgtctctaatcataatcaaatcagtagtagtagatagtatcataatgtgtagagaggtatagccgtatagggggtaagacaaacagtgtagcttgcggtgacagtaggtcgtctcgtctgaaaagattcgaccttaattagtttgactcttggtttagcagtttagcttacgctggagctaagacaacaggggcaaacagacacagctgacaaccgagcccaacgttgaaaaggctatcataaattcataattatgctagacacattagagatttgtttactcacctggttagcttattctaatcatcattcgacacccacatgggcacaatagtaaaaaaaattatactaagcaaactggtacagttgttctaattgcaaaacaatgtaaaaaaaagtacagtataaccaacactgttctctcttcttcttcctcttcatgtaaaaagagttgcacacgctgcaatcagccgtagaggagcctgtgctgtcgccagtcgcctgaattttctggaggaggcagacaagacgggctcatttccatgcttgtgttgcattgctgcacgatcttcctgtccatgagattgtgacttgtaatggcgaaatcttcagaaaaattctccattgaattgccaccgaatgtccatgaaccctaggtgaagtacgagcggcagtatcacagctctggctggctagctagatctcgtttaagctggcaatggaaggtactactgtactgtcagtgaagtgatattaacgcagatacagtgaccccatcgctgggacaggatcttcttcatggtgcaggagtaattaaacgcctcttcaacggggttcttgattttacctgtctggtgcaggacacggtactacatgtacaccaacttcttctgaaccgagagaggtttcaatgtaacggatggacccccaccacacgatctcttattgcacaaccagaatccttctttagaggacatgaactgataaaaggggaacttgaatagtagtaatatgtttttttcagtactaaaattatgtcttgaacataggcctcactcccgcgagggcggcacgggtggtgctaccgtcgccgcccatctccccctccctctgccttgccatcgctagagcgagcgggcgacaagacgtgtagcgtgctaggatagcaacggtggggctctcaactatagatataggggctttggataatagggggcggtgccgcggcgtgccatcccagctcacaaatcacgatggcggtgttaggtgcaagtgacaacttgacggtgagagcaatgcgtcgtcgaggttgtgcagtgattagcaacccattgaacgaggtgcaggtgcaaccagggaagcgaggcgacaaggtgtggccttgaaggtaaggtggccggtgcttcgtgggccctactggcaattgatggttgcagcctcctcccttcacgatggtggtgatggtgggcatccatcatccacaacgggtgcacaacaaggtacgaaggaggacaggagacaacaacgtgtcagatcccatgccagggaagggtgagtgcacccaacctttgtgatgatctagggtacaaaggtttggggcggcggcgatatgtcacgtccagaaatttagcccaaatttccagactatttttgtgtattaaatccctgtccaggaccagccagggtacacaaaacaacaagtaataaacagttccaaacgtaaataaagcgtaaaatatttacagaagaggcacttagtcctcacaccgaaagagaacgacagcagcggaaagaggcgatcctagcggggcttcaactccactcctcaggcaaaactcaactgggtctgagccttggtcttctaacttcgtcttcagctcagaagcactacacttctgaaaagggggaataatagcaaggctgagtacaaccaccgtactcagcaagccacaccaaagatgcagacgtgcaaggggatacaaggatggcttgtggctatttgcataaaggcgattgtaaagtattttattaagcaaaacggtaaaactgttgagtaattaaagtaatattaaatctccactgatcaacgctacaccacgttgaacaggcccaaccaacccacctgaactacagtgcattgggtcgatttattaagtgtgagactaatcacggtgattctggtcgatcgcccataaccgcgggcacggctattcgaatagttttactctggccagaggtgcacaactgtacccacaagacacaatccaccggcatgtcactgtgcccggccggacacgtcaccatgtcgagtgattatgacaagacccttcatataccccactctgaccaagcataccacacctcaggtttcacccccgcccctagcaggcagcgggcagtcccctctcgtgcctaggtgaatccggaagcgacagaggcagtcgcagggcccgccccgctccatcacgcccatccttgcctggatgcgtcagccagagaaaagctatacttcaagtcaggcagttaccctttcccgcttgtggcaagcgttgtatgtcttccagtgcatcccgcgaaccagtccttaattgccatgggtgcgaccagcaaaaccatgcacccacagcccaccattcagtcgcattttagttggataattacgaccatgaaacatagccaaatgtctcgagcacgcagcttgttctgatactaacaaggtctaatactgcaattatcccatcgactgagctagtggtaattaagcatggctaagcatatagttctagctagatcaacataagtgacacaagctagtcgaattatcacccacggttgacaaaggacaggtatcaagtaaacatggcacaagcgagcagataggtaattcccagatcccatgtaactagcaagacatgcattatttgcaaatggtaaaacacttgtaaattaggatcaaaatgctcaaggggaatgtgtgatttgccttgcttcttcaaacaatcttctgaactcttatcctcgcgaccgcgatcttccgaaacgacggaaactacacgctggcatgcaaaacgaggaaaaaccctaataaaaaccaagtaaacagtacaaaaaaagtaaacaaacatgtagagctacattttagatgaattttgcaagttgaacggctcaattcggagttcatatgaattagatatgaattttagaagtttttagccgtttaaatgaatttctagaattaaactcgatttattgcgcaatattaattattttctcaagggaatggttgctgctgacgtcatcaaaagggggagggcggcgctggcaagcgggccccaccggtcagcggcacaagggcaccagtccaccgtggaccgggaccaccgagtcggtccaccgtcggtccatgggatccgacggcccggatcggccctagccgatcgggcggccacggggcggcgcagccgagacacaggcactgctcaggccggcccgaccgagcgacggcgcgcggcaacgcggccaccggcgacggcgcggggggcggcggcgcatgcgggcggcggcggcgcacgctagggagcggcggcgcggcgcgatgcggcaaggtgaggcggcagccgtgtaagttcaagtgccttaatttggtttcggtgattaatgacaaatctaattatataagactaacgtttttatgagcctttctttgactagtctcatttagatatgaaagtaaaaataatgagaggtatgtattaaacttcacatattctaacttggtctctcttgtggatccaaaatataatgtgagcttcctatttgatctttattgattatgtgcatatgtgttccttcatatccatatgtatgcacatcttgagggggagcttattctatattttgtttattataatatttctatcttgatttgaaatcatttttcatctcatctctctatattgtttatatcgggttattatccatcaccaaagagagaaaagattgaaagatcttggattaaacaatttgtgtaattgttactttggtgatagatgataaaccgatgtttatgggattaacctctcttttgcataagttgtcggttatttcccgataatgagatgtggaagacatgcattcttttgtgatggaccttaatcatgacaaggatgaaatgcatggagataaaatgatatgtaccacttcttatctcctactttttgataggttcatatatatgatttccatgttattgatatataagtgtgagactaatgtttactcgaatgttatcttatttagtctcatttacattgagaacatacatatgccttctctatatgtataagataaacccccattggtcattctctaattatacatacacttgcatctcttgtatatttatttgtatgcatatatttagagggagcaaatcctatacatttattgtgcatgttctagatccatgttgttcacctattatttatactggatctttgcacttgagcttgcatacgagtatatgacacttgtgatgttaatgaatactcaacaaacatatacatatctttcatatgcaaccggttggtcatcaagtgaaggatgacaaccgatttgttgagactaatgttctcctttgaggtgtgaaaaggaataggtcccattacgatgaggctaatgaatgacaccatggtttagtggtcaccaagccaaggacatcgtcatgttggcaagaatgaagtcaagcttgtgatgagaataaagtcttgacaaaggatggacaagacctcggcataaacatggttcaaccggatggtcacaagtgttgatctcggctcaagcttgaccccaagatggatggcgcaaggcaaaggtataatgtagctaagaatgttttcttagtattttcccggtcttggtgtttggtgtagaccggatttgctagataggcgccgtactatcaagagtggtctatgaagcgagcttgtggatgatcttgtgccatattagttcatatgcatgtaggtgcattttgtgggcttgtctaaccaagtgtagaagtgggcatgtccaataggagtgagtgacatcttgtgggtatgtccggtggatatcctttggagtgtgagccatttatccttgacttaagttgtgtttcttggatggatttttcatgggttggatggccctttgaataagctttccatagagtccaagaacgccaaattctgagacccgagtcaagagatatcgccgttttactaacggtcggttgagctgaaaagtgacctgcggtctgaccgtgggccttaggccggtctgaccggccggcgtggtaaggccagtatgaccggccccactggtctgttgcactggtctagtttttggtggcgatacagagccgccagagccgcaaccggtcagaccgagccgacggcggtctgaccgagccgtggacggtctgaccaaccactacactgcggtcagaccggccaggttgagtgggctcaatgattgccctgtaacggctagaagtagtccggtctgaccggcctcacaacggtggtctgaccggcagagcacaaagttggggatttcggttccaacggctagttttggtggttgggggtatatatacccactccccagcagcaagggtaaggttttggcactccattgcattatcttgaacccttgcaagagctctcacacccttgtacacttagtttatctagtgaggtgttagagagtgagttaagccaatccaagtgcattgcttgattgttatagctagtgtggcacttgatcatcctcggcaagcatcctagacttgttactcttgtaggttgccgcctcctagacggcttgtggaggtgttgcccggtgacctctccgaggagattgtggaggaggcccggcaccgtttatgagtgatttggagttcaccaccttcggagtgaaggaagaactaccccgagtgatcgaggcttgggtagtcctctccgtgggccggctcccgccttgcccaccccttgacaaagggggcgtgcggtggcttcgtggttgagcggtggagttgggctcgcctgtcacgcccggaatttctatccaaaattccaaacgcttacatgtgtgtgaaccctcgtccaggaatcagccgaggcacacaataacaaattgataatagagtacaattattactctaattaataggcgaataaaatgtcattacagaggtagatagttcctctcaatcaataaagatctaagcaacggaaaataagataaacggcgcagacggctccactccacaggcagcttgaccaaggctacacctaatcctccacaccatcagcatcattgtagaactcttcctctgatgaatgattgcaaggtgagtatatgacatactcagcaagccacgcagcaaatatgcaagtgcacaaggataccaaaggatggcataatagggttccatttgcataaacagcatttagcaaacatttcagaatttaataaaacagttaagtaaaaattaaacaatattaatccaacgctatacaacataccctgttgtataggcccaaccattctggacaaccacacccggctgtacagatctatctccaaaccaggaatataccattccaaaccaggagctaaacaaattattaccagttatagcatcttttattatgatgagaggtttgagactaatcacgaaagacatt

SEQ ID NO: 62122 - DNA, 7331 bp, Oryza sativa
  unsure (1)..(7331): unsure at all n locations
nnnnnnnnnnnnnnnnnnnnnnnnnnnnnnnnnnnnnnnnnnnnnnnnnnnnnnnnnctatctccaaaccaggaatataccattccaaaccaggagctaaacaaattattaccagttatagcatcttttattatgatgagaggtttgagactaatcacgaaagacattgttagacccgcccataaccgcggtcacggctattcgaatagttttactctgatcagaggtgtaccactgtacccacaagacacagctccacatcatgtcaccatgtgccttaataccaccacggtacctcggaaaggagctgtgacaataccccttacataacacaatccaccgcagtgcaccattcctggatcataatcacccccttataaacaaggcatggactccccagcgacccctgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgccatgagcacgactctcaaaaccatgtgctcacaacccaccattatcaggttttagttagcacattaattaattaaccaatcatgattgtccgtcgtgaactatcattaagccatctttaaataatagtgaatcataagttatcccaatagtgtgctaatgtttctaagcatggctaagcaatcacatctaatatctagctgaaccaatatataaagcccaactagtcaagttataataacccaaggtatcaaggaataaaggaaccaataacaaaaagggctataacaaacaataggttaattccacccaatgacattcgaaaataaatgcaatagttgaatagaaacagtagctttaaacgggatcaatacgctcaaagggttgtttgggatctgggtgacttgccttgctggccttgaaactcttcaaattcttctcctgcgaaaacggactctctggaaacgtcggaatctaaacagaaaaaagcaaaaacaccaaaacagcacataaacaagcacgaacagtaatgtggatatttttaacatgtagatctcaattttagaaaaatttagagacttgaaccaactaaatccgagctaagatgaattagttatgaatttttgaagatttaatcggattaaaacacttatatggattttaattgaattatgacgcaataatgaattatttttgaaaaggaaaacggggtttattgtgtcagcggctagggtttgcggtggaccgggtgcacggcggcggttcacgggaacggacggccgagatcgatccatccaaaacggacggccgagatcgagtggtccacgaccggctcacggcaaacggccacgatgacgtcagcggtgacgtcaccaccggcggcggctcgggcggcgcaggcgcacttgctcgccggcgaacgacggcgcggcggcgcgaacggaggacacccacgggtagcggacggcacggcgaactcaccggcgaccaaagcgacggcggaagatcaacggacggcgacggcgtcgaggttgaaacggcggagaagatcgggtcgacggcggcgacgggtcttcagcgacggcgaaggggcagacgaggacggcgacgcgacagcgaccacgaaggcgacctccccgagcgacgacgacgaccggaacggcggcggcgcatggctggagcggcggcgacgacggcggctcgaggttacacggcgctagggcgcttccgacggcgagaggcgaaaacaagggtggcggcgggtagaggagacaccggggatccttttaaagggtctaggaggcggtggcaaaggcccacggcggccggcgacgagaaagaaacttcggggtttgaaggaaagagaccgatccgattcgacctcgaatccacaaatttccaaagcgagatagacgatgattccaaaagagaaaaggtagaggagatcccgaagattgtttcctctcaattgatttcaccggaaacggaaaggatcggccgaatttggaaggagacggcggcggcttgcgctagggtttcgggcggcggcggccggaggtagacgacgacctgacaagcgggcctcacctgtcagcgagcgagggcgcgcgcgcggctgcggcggactgggccgacttgggccggggagagagaaagagggttttgggccgactttcggcccaaagccaaaagagacttttaaaaacatttttctatttaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccaattaaacaacaatttatatatttaggatttttagggtgtgacatcgcctcaacggggattaggaaaccggcaagtttccgaaccttggtgaaaaattccttgtctcttgtctcatttatttgttgcatttacatttgtgctatttatattcatagagacatatttaagcccatatcacttaggtttgcaaaacttaacttagttgcttagttaaccttgcacctcaccttccctagcaacttaggttagttttgtttaagtgccattaagttttaaaaccgcctattcaccccccctctagtcggcctccttgatcctacaagccggctgcccggcacagccagcagcggcacggcgcggagcacggcggcggcgacccggtcgaacggccaccggcggcgacggcgcgtcacgggcaggcccgggaggcggccagcgaaggggaggaagagggagagggagaggagtgctcaccgagaggtcaaacagcggaaggaggcggccgacagcgagcaaggtgacggcggacgcctcgagatgacggtgggatggcgctccggcgattcccggcgaagaccacagcgtggccaagaaccggcaggagctggggaaggtatagaagggagctggagtgagggagatgacgcggaacgacggcaaaaaggcggccggaacccggcgggaaaggccgaactcaccttgagcagaggggaggtattttcggcggcgattcgcgaagacagaggggtggccgacgtgcggctcgacaccacggagacggagggggcgtcggcacggccggacgtggctccgaatgccagcggcgagcggctggtggctgaggagttgaagcggctcgggtgtggtggtgcaatggcggttccagtggtggagggggaaaatggagcggaggccagggtggagctcggcggggcgatgccggcggtggcggcggtggctagagcggcgaggaggggcggccggagctcgtcggtgagtggtggagagagggagcgcggtggggaggtggttccggcgatggaatggggaaacggagcgggggccgaggtgtggcaccgtgcggcggagcctacggcggtggctacgcggcgtggcgaccactagggcgagcggcggcgatggggtgcggcggtgtcgcggtggtttccgggcacgggagggctcgggagagaggggaaaagagagaaggaggtgcggggatcgttttatagagctcgggaggtggaaatcgtggccgggagaggcgggatcggctgacggaagcgggacgccgacgtggggtggtggcggctcggccggcgccggtttttgtgggacgagtggggggaaatggtggggaagaaggtgggcgacgaccacgtcgcacacgcgcgcgggagcggcatgggcgcgcgagaaaacgccgctatgtggggcggcaatggcggcatgggcggttgccggccagggaggccgaaggttggggatgacaggtggggcccatgggtcccacctgtcggggagggggagagagacagttggaagggggaggaaaagaagacttgagagagatgggcctacgacccgagagagggagagagggggcgcgggccgcgggaggggggaaagggacttgggccgaaaatggcccaagggggatggagggagattttatttgttttccttttattttatttgattatatgaactttgtattattataattatttcttgagctccgaaaattcacggaaaaatctggagagtatttgaaggcacaaagaatattacaaaatattcccggccaatgatttttaaaaggaaatttctaattccctcaataattcacttgattaaattgatttaacttttattaaatttctagaaaatacattatttaaacgatttttaatcccgaacgaaaatcggggcatcacacgatctgtgattggtgatggaccagatctaatgtgggtaggatgggtatgctcggccttgtaatgatctggcccatgacgagaacaacattgagggttcgtgaggtcggtggcagtaggaccaatccacgacagcgagggacatgtgtgctcgcccttttgtgacggttttggcttgtgcggcgatcctaccatgcaaaggtgagataaggctagccggtggaggggcgtttgtgcaagggttcttcacactagtggtagttggatgctggtggggtaatgcagttgcgattgcaggggtgtataggttgcaggtaaaagcgttgtccaataaattgtaggctagcaacggtaacactttcaagtgctgtgatccctctagaatacgtttgccgaggagcctcgctctccccttggtaggacactccaagtgaaaaccatgtccagatttcttaggcgggcgacaacgcattatggcgtcacatcctcgttgaaggtgtcatctagaaggttctgtttttggctttctaccttaaacagttggggcaatgcttatggatgacggtaggtttgtacgaggaatgagtactgagtagatctttcttgttgcttgccctatacctctgcaacccctctcggaccactaatttcagttgtttgaaggtgttgtcgggtggttaaaatgtggatgtggtggtggcatccgtcggtgtggcactagacatttggtttgtgtaggagctacagcatgtggtggtggttttgtttttctattttcgttattaactcccataattttagtcttatagtagtaattttgtactagtactatattaatatgaaacatcacagtggatggtgttgtttgtttcaaaaatatcaaaataaaatgtcttgaacgcaagggaccttttgttttgaattgttgaacaacaacaatttactcctaactaggaagaaagcccgcgcagatgcgcgggcagttttatgaagacaatttttaaaaaaggtaatatctcaccatttataagccgagaaatatattgcatactttaatatatttaagtaataaggttatctcctagattaaataaaatcactttgcctctggttacatacaaattttcttgttgtcacttcaacctattatcactgtttaaaagccaagtatctattcatagatgaactatgtaatgtatcaataaaataagcctaatacatcattaatacattgaaatatccactacacgtaagtgtttcgtgcctcaccaattttcaaaactatatataaatattgtaaaaataccacttgtacaaattaatagaataacatcaagttatacataaatgcttctctaatgcgtgaagccgattgtagtggcgagactttctctgtctattgccttgaaacatgggtcccatatcgatgtagttgtgcacctccagactaacctggagtacaattttaatgcctaatttactatcacatccttatcgagttgtgcatcggtaagtagtaagttgagcactattggtgactgtggtctccactgggaccgccttaactcccatatgtacgtccatgttatacttatagcaacgtagcaaactatgttattcatgcttatgcccttcatgaaaggaaaaagagaagatggatgtgatcaaaagaatgttttttttttatgttttgagagtagattcatggtatagagtagacaccacgtgcttatggtgttaaacattatgcaatttgaaaatgagcgaagttgtaattcgacggtactaaaagagaagatggagatgatcaaaagatttttttttttaagttttgagtagattcctggtatagagtagacaccatgtgtgtttatggtgttaaacatttatattttgacaaacatctatagtttagcgcttggtttattttcaatacttatgttgataatcacatgagacacctttactaattcgaagaatatatttatttttttcaaatttattaataataactaatatgtgggagtatatgggagttttttattttttttgtatgatactatatacgtatattttttttggttctatcttttttgacacgatggctttattcttttaccgtacgtatgtaggttttattgttccttttcattcttacgtacttacttttttttttggcgaacctattctctctcgtatgtataggtggaaagtattagtattagagatataaatatctaatctaatgatctaaataatggatccatcaatttaagtgaaaatcaacggtatagatatagatataatctaatggtctaaaataacgggtccaccaatttaaatgaaaatcgacggtgagattaaatagtaccacgtggcggtttaggagcgtttataagaatgccacgtatcgtcttgagagtgtttgtaggtcgttcaatagacttttagtatatgatagatagatagatagatggcgtaaggatatcaagatcgagaatggccttgtaaaatacgggcctttagtgggctaggagcttatggtggagtatagcaatatgggcttctgatacaaggccctggagctcgcttggtgcttaatcatccggctatgctatataagcaagctctttgatctaaaaaccagcttgagaaagaattatttgcattttagccggtcatgttttggtactatactagtataatttgaacaaaaatacacatttatatttgaactctctaggctattcccctattacatgtagcatgacatcagagtcaaaacagatacgcactataaatttagtttcatcatatgcaacaaatgacattatacatagcaatgacatcagagttaaaatgaagagaacagacagaaaaaaaattaaataaccttcccaaaaatcaaattcaaatcaactggctctctagaaa

SEQ ID NO: 62123 - DNA, 2989 bp, Oryza sativa
  unsure (1)..(2989): unsure at all n locations
aatgcttctctaatgcgtgaagccgattgtagtggcgagactttctctgtctattgccttgaaacatgggtcccatatcgatgtagttgtgcaccttcagactaacctggagtacaattttaatgcctaatttactatcacatccttatcgagttgtgcatcggtaagtagtaagttgagcactattggtgactgtggtctccactgggaccgccttaactcccatatgtacgtccatgttatacttatagcaacgtagcaaactatgttattcatgcttatgcccttcatgaaaggaaaaagagaagatggatgtgatcaaaagaatgttttttttttatgttttgagagtagattcatggtatagagtagacaccacgtgcttatggtgttaaacattatgcaatttgaaaatgagcgaagttgtaattcgacggtactaaaagagaagatggagatgatcaaaagatttttttttttaagttttgagtagattcctggtatagagtagacaccatgtgtgtttatggtgttaaacatttatattttgacaaacatctatagtttagcgcttggtttattttcaatacttattgttgataatcacatgagacacctttactaattcgaagaatatatttatttttttcaaatttattaataataactaatatgtgggagtatatgggagttttttattttttttgtatgatactatatacgtatattttttttggttctatcttttttgacacgatggctttattcttttaccgtacgtatgtaggttttattgttccttttcattcttacgtacttacttttttttttggcgaacctattctctctcgtatgtataggtggaaagtattagtattagagatataaatatctaatctaatgatctaaataatggatccatcaatttaagtgaaaatcaacggtatagatatagatataatctaatggtctaaaataacgggtccaccaatttaaatgaaaatcgacggtgagattaaatagtaccacgtggcggtttaggagcgtttataagaatgccacgtatcgtcttgagagtgtttgtaggtcgttcaatagacttttagtatatgatagatagatagatagatggcgtaaggatatcaagatcgagaatggccttgtaaaatacgggcctttagtgggctaggagcttatggtggagtatagcaatatgggcttctgatacaaggccctggagctcgcttggtgcttaatcatccggctatgctatataagcaagctctttgatctaaaaaccagcttgagaaagaattatttgcattttagccggtcatgttttggtactatactagtataatttgaacaaaaatacacatttatatttgaactctctaggctattcccctattacatgtagcatgacatcagagtcaaaacagatacgcactataaatttagtttcatcatatgcaacaaatgacattatacatagcaatgacatcagagttaaaatgaagagaacaaaaagaaaaaaaattcaaataacctccccaaaaatcaaatccaaatcaactggctctctagaaagcaaccctgttccttaagcaacttccctttgtcttcttcccagcggcccataagtagtccacatctccactctcttgaccacgaaacggcccaacacccaaaacccccgggcccacatgtcatcctctcccccaaccctagcgccaccggcattccgatccctcctacccctggccccacatgtcagtgacccgaaaacgcctcagggtatatatacccagctgtgcctaagccgggcacacgccctctgaccccgatagaaagggaggaaaaaaaaaagagaaggcgaaaccccaaatccgccgcgatggccgccgccgccctcctccgccgctcgccggcggcgcgcgccctcctctccccggcgctctcctcccgcctcgtcgcctccaagccccactcgtcgtcccccgcgccgccgccgccgccgtcgaaggcgggggcgaacaccaagacgttctcgatctacaggtgggatcccgactcgccgtcgacgaagccccacctcaaggactacaaggtggacctctccgactgcgggccgatggtgctcgacgtgctgctcaagatcaagaacgagcaggacccgtcgctcaccttccgccgcagctgccgcgaggggatctgcgggagctgcgcgatgaacatcgacggcgacaatggcctcgcctgcctcaccaagatctcgtcggcgtcctcggcctccacgatctcgccgctcccccacatgttcgtcatcaaggacctcgtcgtcgacatgaccaacttctacaaccagtacaagagcgtggagccgtggctcaagcgcaaggacgcgccgccgcagcccgggaaggagatcccgcagaccaaggccgaccgcgccaagctcgacggcatgtacgagtgcatcctctgcgcctgctgctccacctcctgcccctcctactggtggaaccccgaggagtacctcggccccgccgcgctcctccacgccaacaggtataccaccaccttcccaaatgctcttggtgtcgtgatgttgttcttgtttgttgattcgttggatccgtttgctagttgacttgtttgtgattcatcgggtgatgaattgtgctctggtgattgtgaaatggtttgcttgttgattgatgcgtagattgatctgacctggatgcttgtttaggcgatgcttgtgtggaaatgattttcattaggacgatagtttatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62124 - DNA, 2906 bp, Oryza sativa
atgaattgtgctctggtgattgtgaaatggtttgcttgttgattgatgcgtagattgatctgacctggatgcttgtttaggcgatgcttgtgtggaaatgattttcattaggacgatagtttatttttccgatactctgatgtggtcatgaattacgtgatcctcttatgtgacgatccaatatttgtttggtagctagtagaaacttggtaaagcggtttggatgatcataagtgaatacagtgtggtgatgaaatgtgttaaacacgtgtgtggttctatagtcataactgactaggcgcattcaaggcattcgctgccccacaagtattctgccttttgtgcctgacctactgatcagaaatttgatatccaaccaaggaatagtttgcaagcctcactgtggtaaaactcatacttggatagtggtagtgtttgattgctttccgtagtttccacctctgctagcatacagcggctgatgatttagctgatctacgacgttaaatacttttggtgtgcattcctttggcacttatttgccttaacttgaattatagttgtctaatatgattattgtttttttatgtaagctttaggatgttgctaagtccatgacacgttcaccctttttaggcttccgctgttggggacgctaatcaaaccaaaacccaacatgttcatgcacatccaagctcgaggatatcacggggtatcggagaagagaaacttgctggatcacaaacgtagattgcttgcagcaaaatatgaactgaaaggaaagctttataaggctgtttgtagggaccctgatcttccagcagatatgcaggaccagtttcgctataagctgtccaagttgccaagaaatagctccatgacacgccttagaaaccgctgtatcttcacgggccgctcgcgcgctgtttacaagaaattccgcatgtctcgtattgtgttccggtcattggctaataagggtgaattgttgggtgttaagaaagcgtcttggtagatgctaacaaccagtagatcaaagcactagctctgcagtagtccagcacaataagtttgcctccatgcagtttttcagtgtttgcaacctgaaactatatttcaatcttatgaccagcagccaatctggcactctttcaattatttagttgaaccaatgtactgtactgtttttctgcctattgagcatttatgaagttaaaagttttggaccattctttttcccctgcccctatatatatggtatttttgaattcggagatactttttttaccatcaaggtgcgctcagtcatgataaatacctttacttttgacagtttacttgtagaattagttatacttactgataactgtttcgcagtatgtagattaatttgcttagctttgggttacttgaattctgttctatatgttattgctgtgcctatgtattgttgaaagttaataatcacacattctagcgaactctggtgcatgctactggttgctcttgcaatcgcattaaacatggaattttgttaattaaggcatttgacctgttgtgccatcagttcaagatgtagtgcttcataatttcaccgttcatgggcttaatgagtggatcctcccttgttttccctagatttcagcaacaaattcctttcctgttcctgctgagttcctgtttgatgtaacttgtttgttgatgttcaagtattaaatcttctagatgaataactcagttttcactgcctgattatatttgtaaagagaactagttaacatatcaatcttttagtgtctgatttggttcaggtcccctaattttgttcatattgtgcaattttgcctgattctatgtgcagttgtgaactgggttttgtattagatcatcttacgaattgaccggtttgcagcttggataatcattatagctgctgtctatatataatgatattattgtatttgattctatagtgtaaataagctaaggcaggtttttgttttgtctgatctaattttgtcatgaagcaaaaatcttaaacatgatctgatatgactggtctgttggtttaggccgtttgtcctgccccaatttttgcaaatgcccatacccttgtgattgctctgtcctatgaacatccattccctgtttcaggtggatacaggacagccgtgaccagttcactaaggagcgcctggattccatcaacgacgagttcaagctgtaccgctgccacaccatcaagaactgcacacacgcctgccccaagggcctcaacccagcgaagcacatcgacacaatcaagaagctccagctcgaggcctgagtgagcagtatatctctcttcatgagatgaaactctgtcgaaaaattgtaatcagccagcctcttgtttctctgcctttttagtccatcgcctgacgaataattgctggaacgcaggattcccttctgggcctccgatctgatgacttccatttccatcagatggagggagcattgtagggagtgaataatttgctaccgtattttacgttttgttctgtatctaattcggtttgttgttcaccgtccattccattatgtcgtgcggtttatgcatgaagtaattcatggattttacctttgtttttgtgatgttgaacatgcccttcatatttttaacccggaaatcaacaagcattctccgtaatctctggttagtgatcgggtttagccatatagtgaatcttaaattgaagcaaaacgaatcggatttggttcctgtgcagttcttggtattactgcaacttaggcggtcatattgtggctgtaggatgcaaatccaaaggcccaaatttaataggacactgtttattcagacaatccagcacaaaattattataacaatcatagtggcaaattaa

SEQ ID NO: 62125 - DNA, 3080 bp, Oryza sativa
ggagggcggcgacaaccgcggcctgctgctgctgttcgtggtggcgccggcgatcgcctgggttctctacaacatcctgcagccggcgttgaaccagctaaaccgcatgcggtcagactgagagcttgagcttgaagattgcatccgtacatgtgtgtacgtggtgtgttttgagggtggtggagtggagtggagtggtagtgacgtggaatgtggtgtacttatgccttaattaatcctgttcctaatcctctcttcccttgaacaaaaattcagtacagctcttcttcttatttgaattcatctagttaatttatttgtcttattgatcaatgtttgtttttgtttccccagtccggtagatgagcacacatgcacaccatagtacacttactagaaaaaaaatactagtggatcgacacatcgacctgtgaacccacttaaagtacaaataagtggataatcttaacatgttagtttcccatttatatgtttcctatttatatgtactataagtgaattcacgagccgactctcttacatccttcttacttaggtttgagtggattacttatttttcatccactcgaaccttttgaaaaaaaattcctatttctatgagagcacatatatagttttatcacagttatatagtttttacacttctatagttttgccgctgacaagtataatcgttatatcctgccctagtaaaagacgcgaatagtaaggaataacctaatatcaaataattaaaaggagtgatattttgaatccaggtcatctagcccaccattttgtggggatagccggaatacctctaggtatttctcatatcctgccctagtaatcttatctcatatatttatatagttcatcccactaagtgttgttaatgctatttcttttttctctcagtaagccacatcactctaattatttctagctattggatgatagatctatggttcaaattgtcacgtctttcttctctcataacaccaagtaatctcaattatttttaggccttaaaattcataagtatctatttgttttagttttaatattcatattgcatcttatttgtatatattattgtcagggttacagataaggcataccttttatcctacgacttatggaatataccgatatggtataccttcacgtatacggattgtttccatatacgttgttggaatctgttgcaaattacataaatatctctacaagataagtgatttccaaaatcctactcggaaggaatagatattctgttataccgtaccagatcaaatatctccaggccttacttgggggtcaagatgatccacggtataaaagggacctccagggaggggtgcaaggcatcgaatttcatcgcctacacacccaccatagttcacgaggccggagttcacggcgccaagtcgtcggatcttgtccaattcatcaactacgatctcgccggtatcgtctgtttcgtttacttcctttgtaatctgtgattcctcatcatcaatctcatataaaccagactagggctattacctgacaaggggtctgaaccattataatccttgccttttgtggggtctgaaccattataatccttgccttttgtctgcttgatgtcgtactacatagatactcgtttcaacgtacccaaatactcaactcatccggtccatgagtaccactcgtcgataattatgcgacttaatttcccgcagcatcatgacggggtatttatctagttaaactaaatttcttgtgaattaaaaactgctacagagtagggggaaaagaaaaataaattacagtacctagacggtcaaggtcaaagcatcgcatgcccttgcggctttgactcttggcttggaggaagacgcctgaaagccagtgaggctgagcagcaaggctgcctggctgcgtcgtcacacgccacgatgcgtcctcgtattccccatctccctcgtcccgcgagactacggccactactcctacgagagtacgagtacggaggccgcccttgagttttcctctcactgagaggggttgaactgtaaaacatgtgttgtacagtgaaacattttgacttttacctccttgttttgtttgggtgtatttatgtcctgtttagttcagactaaacttccctcaaacctttaacttttcatcacatcacatcacatctaaaacttttctactcacataaactcctaactttttttccaaactaacaactttccctaaacttctccccaatttcagaaactaaacacagccttagttcacgccaaaattaaaagtttgattgaaattgaaacgatgtgatggaaaagttggaagtttgtgtctatagaaaagttttgatctgataaaaaagttgaaagtttaaagaaaaagtttggaagtaaactcggcctttgtttgacccttctggccatctatcggatcgccgtgcccttgccttgcctgtatggacgcattgtcgtagtactgccttcgtgcagtgcagatcacatatatgcgccgtgatgtgtcggccgggatggcccaccacgtcagcatctgcacgttttgcttcatcatactgatagtacaggattacaggcacagcttagcagctactcctactaatagagagagaaagagaaagagaaagaggaacaaattttggagctagtaaaattgaataaattttggagcaaggtgaaacaaacactggataaaaaatatagtaaatacatatatgtcagaaagaaaaaaatagctgaagtcaaattgtactatcagaacatataatagttgtgttccatgtcaagctcgaaaataatttaggatactcacaagaaaataaacgatcgtctacgagtaaacatcatttccatgtggattcacttaaaacggcgttcttctatatctatacaagttcaccaaactaaggatcgacattgaacacataacagtcaaagacacagacatgatcgactatgctaacttccattcgagatctataatttcttaaaagataatttcataacataaaacagagtaatattctagagtaaaatagg

SEQ ID NO: 62126 - DNA, 3572 bp, Oryza sativa
gtggcacggacaacgccgcggcggagctggagctcgactccgtaagcgccccactcgccccactcttcttggacacgccccgtggtgacactgacaccggcggcgcatgctcgtgcaggtgttcgtcgaggtgtcggcgtcgcctgagcccgcggcggcggcggcggcatggagcgtggcggagccggcggcgagggcggagaaggtgaggcggtacaaggagaagcggcaggggcggctgttcgcgaagcggatccggtacgaggttcgccggctcaatgccgtcaagcggccgcgcctgaaggtgaccaacttatctcaacctgaactagttgctgcatgcttcataagttcagaaaaattcttacctgaactgagctgaactggatttgctcatttattgattcttcagtaattgtctccagtcccataaactgtaaaagacttgtactttgtagtgtaaatgattcatcttgtcatcttggatttggcatggaccagcattatcattccgaatcagtttagtctaactggttggattcagtttattatcttcaggaattactgaatactgaataaggaatgtaagcatggaactttggtagggactaggaatcgaacgattaattaacttggaggcaacaggattagattctacttcttagtagatgtaagctgctgaagtgtgggtttcagaccttattgtataggctaatttatttctaatatctgaaaaaaataggttaggcatttccactatatccttttttagttagctctcatgatatatttctgtttttttgtctgaaattccttaataaagcttcagttgtctgctaattgcttatcagaagattagtacacttcaggcacactctgagcaaagccaatggatcatacatagtattgaacttctagtattaggtgataactgaactgaaaaacatgatgaattcacacatccgtggctggacatgttgatctttcactttctgaactagaaagcatcaaaatgcactttatggtttcactttctagctgatagaagaatctcttatgtaaaatttatgttcattgatataactgtgtgtccgcaaaccgacaaactaagaacttaacagtgttgattcatgaattgaaacctgctagactttgcatcctggaagtgcaagaaccatcttctacccatagtccatacatttcttttacttgatgaaactctgtcctgatgaaaccttttggcatttcttgcatcgctgcactgcagggccgtttcataaaggagaaggaaggcgccgcaatcacatagagaaagccagctccagctgcttacatagccttccctgctctctccaatgccatggtggatgcatcattatgcatctctccatcgcttcttcgcgtgtacatgatctgttagttattttgtttagttctccagtcctcatcatgtccaaatcagttcttctgccctggggctgcaagttgtgagccttcaggtgcagagatgcagtgtggattatgtctcataggatgaaaataacagcaattcagttcagttcagccatgatgtgcccaactgttcatcaacgatcagttcaacattttgtaatgtcttcaggtgctggttgtcgttgagagatttaatattggcttctccacaaaatagggcaaaatcatcttccattatttgtaaagaaccagtaatgccttatttggggaattcgagatttggacaggtaactgttgagtaccaaataatcggtgaaaatctagaaaactgggattgttatcccttgacttctagtttattttttaaaaaattttataactatatattcttaaaatttaaataggaatctatttagggagctagagattctttaaaaacctaacagaaactcttcaaacagaaccaataaactgacagaaactcttcaaacagaacgcaatcgaagggaattcatcaagggcaagagatgtcaggatcagaatcgtctaaccagtgcacagttcaactgatctgctccgtttaatcatcctggaaatggactgtattagcggagtaatagtattagttggtgtaatttttctgaagaaattactgatgatactgtagtatgcagctggagcagatgcttccggtggcggtggagccgttgcatgcaccgttctgccgccgctgcaagtccagtgtcagctcacgtgagtgactcatggccccacctgtcagcgtgcatcggtactcagtgtgttgtccttttgcttgtggctgccaggtgggccccactggcaggcggtttggccgtgcgtggggagcagcatccgtggtcaaacttatgctgttcccagtaaaactgtaaaaaggtggtgtaaccaacagctttcgacctgttcactttgacgtaaaaaaaacattaccaatttttggtatagttgttaaaaattgtcaaaattttggcagtatttcttatatagttataaaaatttgacaataaactaaatagccattttttaaacaactttatcaaaatttggtaagattgaaaatggcaccaaagtgaacaggtacttcgtgtcgggactcggggtggtaaaagaaaaaagcgtgagatcagacggtgaatatcgaacggtggggagagagccgaggagaaatggacggttctcgttagcgttgttgtacagagcctcgcgagatgggctgggcctccgtggaatagtagaaggcccaaatggactaaacaaggccgctcatgtgaatacaagcacacggccttttttttaatttatgggcttttctgagagcccatcacttttaggacttggttagttcgcgaatagaaaatttttaggtgtcacatcgaacgtttgaccggatgttggaaggggttttagacacgaatgaaaatactaattccataactcgtctaaaaactgcgagacggatttttaagcctaattaattgtaacaccctgaaaattcgaccgacaaaatcaaaactctaaaaatacggattttcaaaaactttttaaattaattgcatcatgccgatcttattcgtctattttacctggatttgatctcgaagattattaatcgtgagtaaagaatagttaattaggagtaaaccgtaaaaacaaaattggtaaaatacatacaaattaaaataaagattaggtggggatagaaataaataaaatattatcgcgactatatttggatcaattaaatttaaatacgatggaataagaattaaccctaattaaaactcaaataaattatataaaaataaaatatgagtaatattaatctagggtgaattcattagttaagataacacaaatattgagtaaaatgcatatatgcaaaattaagaattgtggaatcaaatttatatggaaaatacactaaaatcgggttaattagaaaacggtactgttcattgcacctaaggtattcgacgcggtcccctaacccagctcctcctctttccccctctccctcgtcgcctgccgccgagccaccgtcgccatcgccatctcatcgccgcggccgcgccgtcgccgtc

SEQ ID NO: 62127 - DNA, 15137 bp, Oryza sativa
atataaaagaatcgactttcgcgttcgacttccatttggatttatttggatttttatttgaattctaatcgaattcaaatcaatttttgcacgtaactatagagcccgagggagttgcggatccaagcgaaggccaagacccgcaagactttgagcaaggcaagtcatcactattccttgaacatgttgatcccaattgcgaaattgttttgtttacaaataaaattgcatgcaatgatgaacatcctacttgtgattatgccatgccttgattattgtttacccttaaatctttgtaaccatatttacgtatgagtccctagtcaactatgacaattgcttagaaatgctattctagaatcatgcatactcatatttatcaaatgctatatgcttgggcaattaccttcgggaaggtaattgagatgcggcatgtggagacatgagcgccacattaccatgatgttgatgacatgatttgtgaaaggagaaataaaattaaaacaactgttttcgactggggcggatggaggatttgggtggtatctggaaaaggctagtaccgtccccagttaattaaggaccgagccatgaagttaagcatgaaacgacccccgtacaaccgtacttctcgaatgggtatagacctaacagattagatagccgagcggaggcagtatccctgcatagatggttcacccctgagtgaggcaggtgcgttacgatgggacagccgttgaggtagggccgagaggcgtgccctacatcggtgttgccattggtaggactgccatgagtgtgtgagagagagaacttaacttgaaccataatttaatatgcgtgtgagacttctctttccccgggagcgccagaactcctctcactgctagaaacatggacgcctagagtgcatgaggatttaagttcatggagcgggtactgccaatgcgaggttatcgaaaagctttgccgtgacgcgtctcatgtgttgggatgaggctcatgtgttgggcagtcgcggagtgcgggtaaagtgtacatccactgcagtgtgagtaaaccgaatctattcgaatagccgtgctcgcggttattgagcaccgggacatgtattacacttggctagactctaaattctttaacttgtgtgggatgggatattgcatgatgatttttatgctgatggagccacttcctgagaggcgggaatgtggacgtcctcagaaaaccataacgactcaatgacgggaagctatccttgggatcacaatggatggtggacagaaccgtcattgtttaatatgaacactggtattaaaaacttgatcagtctatgctaggtcttaggcttgtgaaaagaattgcaaaacttgctttgcgcgaaagaaccatagccatcctttgaattcctctgtcatgtgcatcattgctgtgatggcttgctgagtacggttggtactcacccttgcaaatataaaattaatcagaagcgggagatgaagcctcggaggatccctatgcctactaccaggagggagatgaagacgatggcactcagtaggtcttagtatggtcgttgcctgtggcaatggcatgccgctgcctgaattccgctgccttatctatttctgcttttggatgtattccggaccgctcggtccgatgatttaagactatgcctacgggcttatgatgtaataattcgtattagacactcgtgtatgtgcacttggtatttcagctatgaattcgtgtgtaccagactacttgatccagggaaatggtactgtttacacgattgattcctgttataaaaacgggggtctacattaatccatcattagcacatgtgggttactgtagtacttatggctaatcatggacaaaataggcttaaaagtttcgtctcgtgatttacatataaactgtgtaattagttttttattttatctatatttaatactcaatgcatgtgtacaaagattcgatgtgacgtttttgagaaaaaaatttggtaactaaacaaggccttacccactctgttcgataattttttaggtagtactttgtttatatttttttctcgattatacgataaggccccctttgaatcacaggaataaaaaaacgggggaataggaaaaacataggattctgataggaatacaagtgtaaaacagaggattgcaaaacacaggaaaaacataggaatgaccgtttgattgagccgcaggaaaaacacaggaatttgaggagagagaaagactcaaaggattcttaacatgaggtagaacctcatgttaaatttccttcaaaatttgcatgggaagaggcattccataggaattttataggattccataggatttattcctttgattcaaagcgctatatagaaaaaattcctataggaattaaatcctttaaaattcctatgaatttcctttgaatcaaagggggcctaaatgaatatgcgtacacacaactacacacacaataccacgtttacacatacacgaatacgtcccataacacacacttaaagagacgaaaattagcagcacgattttaatctcactaaatttttggtgaaagttaacttgtgcgtgcatattattcatgagcgcatggtttttctaacaaatttgtgacccgtaaataaatttatgatagtaatattctggcaggagtaacactttgtaaaaatcaacgttcatttttcccccattccttttgcgcgtgaatttggagctcaaattcagtttcacgagctaagctagtggagtactctgtggcaggcatccatcagctatacaaaaatttaccgaagtttagtacaaattgttggtgtgtgtgagaggccatgtgacacattctgtgtggatcgtgtcttggtgtatgggggacaattgtctcatgcactgagctggccttgctattaattaggccgcctgatcaggtggttagttaatccccactccccatacaactactttttagttctcctaaaaaattgtcacatgcatgtgcctccttccctgcctcttgtacactgtacagttctgtgtgaacagaaaaaaaaaaccgcagtattgggatgaatgcatgtttctgaaatttcgtttagagcggtacaatagtagactataagccagctatagacatattttaaatagagaaaggaagagagataaaagcagcgggctacaaatctgtagccagctgcagcacggactccaagacgtaatgtgtgtatgacaggtgggaccagatattaatagtatagtaagcaactattgtatgaattggctattgtattggctatagatgatttagagccagtagtgagctatactattaaacttattaaacttgctcttaggcaaagatggtttctcatttcaggtcaagagagctgtcccaaataattgacttaatttgcactccatgcacagtacaggagtactaggctactatgctcttgcaagtttctagtactcttttgtcagtctctcacccaaaagagccaaaagggttgctccagctgatgcctttacctgaatacccgccgtaatttctgtgataaattttgtcattcccatcacagtaggaaagattcagaacactgaaaagatccctcttctcagagcaagtttaatattataggcaactactttctccaaatcatgtatagtcaatttagtagttaactcatacaatagttacgtataacatatactccctccattttaaaatatttgacacagttaacttgttagcacatatttgactgttcgtcctattaaaaaaatttgtgaaatatgtaaaattatatgtgtacatgaaagtttatttaacaatgaatcaaatgatatgaaaagaataaataattacttaatttttttaataagacgaatggttaaacacgtactagaaagtaaacggtgtcaaacattttgaaacggagggaatactacacaattcatacttggtcccacctgtcatacatatgtatcttagagtctgtactgcagctggctacaaatctgtagtccactgattttctctctcttcttttatctcatcgaaatgtgtttattgctgacttatagtttgctattgtatagtttgctattgtacctgctctcagttgtcactttcattgcaacttctggcactaaaacattagcatttgaataaatgcaggtgatttctaggggtaatccaagcactcacatttatgtactccatgcaatgcaagaacgttttcatggccctgttgtgctcgtgacaataatatccttgcagaaaatgaacataagatgggatttttttctctctctctttatacataaaacaaagagaatatacatgatccatacattcctgcaaaattccaagtttccaacgtactatcccccacattacaactcaacaacagctacggcatccacatcaatgtctcagctgcaaatgtcaatgacagtattattctagctgatgtgcagtgcacggacacagttatgccgccgatatactcgattagtacagctactgatcacacacccccacccaaatcaatcaaagaatctttccgtaaagtggacaaggataaaagagaaagggaagaacaattggtgaaagtgatcaagaaaagaagggaaagtgacaaccaaatcactactaatctttttaactttcttctttcacttcttttaaccgggaaattttcagtttttttagtaacttgttgcctacgatgcatgcatgtcctagtagaaaataatcgcctacctaattaactaactacacttgcagcatttgcaaagaacaaatcgaacccaaaaaaatcggagtggaaattggaagaaaatttgtgttcctttttctgtttggagagttgaattgtgtgtggagaattgagagagttgcatgtggatgtggtggtggttagggtgaagacctcttcttgcggaggatgacctcggtgtcgaggccgaaggcgtcgaccttggagatcctgaccacgtcggagcggcggaagaggccgacgaggccgtggacgtcgagcagatcgttggccgagtacttgtcgccgcggcggtgcaccgcgacgtgcaggacggcgacgccgccggggcggagcgtgcgctcgatctcggcgacgaagcggcccgggtagagcgcgtggtcgaacacgttggagaactcgaagtcgaaggtgtcgttggcgaacggctgcgcgtggaagtcgcccctgacgacgagcggcggggccggggcgaggtcgatgccgacggcgtcgcggacgccgacgaggcggagcgccgcgacctcctggccgaggcgcgcgccgacgcagagcgcgcgggaggcgttggagaggagcttccccccgccgtcgtcgcggaggagcgcggcgaaggcccgggcgaaggcgtccaccttgcggtgccagtcgcgggtggcccagacgcggcggaggcgcgggtcgagcgtcttgttgagctggtggcggaggtagtcctcgtaggagcggaaccccgcgcggcgcatgcggatgtgcggcgagggcggggtcggggagagcgggacggcgaacgcgacgggaggaggaggagggaagaagcagtaggagtagaggaggaggagggagaggaagggtatgaggagcagaagaagggagcggggaaggtggaggtggaggcggggcttggcgtcggcggcgggcatgacggagtcggcgcggcgcggcgcgtccggtgcgcggcgtgatggcgtccgttcggtggcggtggatttgtttcgtttcgtttcgtttcatttttgttgtgcggcgtgagctgttggggattaaggggtgggtcccacactcccactcccacgcggtcgcgctcatgcttggcacgcggcatccctctctcctctctgtcatcttatttggcgtgtccaaatgtaagagcatttatatagctagctttccaattgatttgtcaagctaaactcattacccacttcaacagcctctctaactacactctccgacactgggacccacacgtcagcctctgctataccttcttcctctttctctccctttttctcttttcttggcacttttcggatgcagcggcgtggcaagacagagaggagcgacgccgacgatgggagggctgcgggcggccgcgtcggatgtggccgagcgtgggggcatggccaggcgtggaggcggccgcggcggatgcggccgggcgcgggggcggcggcgctggatgcggccgggctgcagctttttcttttaggcttttggctccttgaatccgtgcaggcgcgcaagaattcaatggcggttcttggagcttcttgggctggtcactgaaggtacactgattagtgattactgagtactcatgactgtgcaagaatatacggcgaagttctttgtttgtttgtttgcaatttttgatgtttttcttcttggcaatcggctaaaacccaaaaccttctgaagaaaggcagactttaccatgttcttggctttgatctggttggaatcaatcccttcgaagacccgcatactttcgccttcgaatctgcgcatgttttacttcctgtctcaaccatcttgaatcgttcttggagcctgatgctgctctgcctcacctttgtagtagtacgcagtcttgcgatgcagtcggcgacggagaaggtgaggaggacgccctcctcctgcctgctgctgtgcatctccgacatctgcaaggatgcggctgggcatgggggcggcggcgccggatgcggccgcggcagcggcgggggcggcggtggccggctggatggaaggggagggggcatggggcccaccgtttggccagcggttgtggctggctagatttggccagctgctagcaggatttggccagtgggatggcttggccagagagttaaggtcttttttttttcatatgttggctataatttagcttggagtggcatttggccatactcttggagatgctctaatgtgaccgtttttctcttttcttttttttttccctgaagaagatttgtccgtttaaggcttgtttaattggtgaaatgaaaatttttggatgtcacatcgaacgtttgaccggatgtcggaaggggttttcggacacgaatgaaaaactgtcggtgatatggtcccgggggtatcatgtttagagggaggaggctgccccccaatgccacgtggccctctcccaagggaagtcaggcccgaggtggggtggcggccactccttcccaaagactagtcggaggaggctgcctcccaatgccacgtggccctccctaaggggagtcgtgcccgaggtagggcggcggccactccctggtcgagactagagggagaaggctgccccaaacgccacgtggccctcccccgaggggggattgggcccgaggtcgggcggcgaccgccccctcccgtgactaggggtcgggctcccccgaccccctctctaggtcaccacgtactgtgggttaggtgtccgcctacaggtgctcacctacccgcatttatagcgacctgagcggtcgcgccactccgcatttaatacggcgtgcagtgtactcaaccggtcgaatgaccgatgtgactggctagtgcacttatgcgctgctcgtgtgtcaggcggcgtgcagcctgacatgtcccatcaaataatgatggtcagaggttctcatcctcttatcccagccagagtcggtctcacgctctggtcaaagataggttcctgtttcccggtgtaataggagcctaaaagtcttcacccattaaatgatgaatgacatgggcgccccttgtgtcaggcagcattgtttggtaggccccacgaccgaggcgacgtgtatgcggcttccaagttaaggaacaagacatgcatatgcaaagatggtaataatttttgacgaagttaggttgttgggtctatgtgataaccccttgaggtataaaaggaggtccaggcctagtgagaagagggggggaggactttcgagcgaactggcgcttgagtctcgcaaccccaagcacttgtgttgtacactcaatcaatcaagcacaggagtagggtattacgcttcttagcggcccgaacctgtataaacccattttgtctcattgtctttgggggattgaaccccctcaagatgacacagcttcgctcaccaagccctcgaatctcacccgctgcccccggccgaactcacaaagggggggcctcacggttccctggtgaaggagttcattctccgacaaaaactaatttcataactcgtctggaaaccgtgagacgaatcttttgagcctaattaattcgtcattagcacttgttggttactatagcacttatgcctaatcatggactaattaggctcaaaagattcatcttgcgatttacatgtaaattgtacaattagtttctttttatctatatttatgctttatacatgtgtccaaagatttgatgtgatgtttttagaaaaagtttttggggaactaaacagccccttaatctacatgtaatctgtatttatattataaaaaaaaaattgtattatcagacccattttgtattctaatttttataatggtgtaaagtaaatttactcagaatatttaagtatatcaatgttatccgtcattattaaagaaggaggaagtattaaaagtgtcatgttaatctgggagtatagcaagggaagagtgctgtatctcataaaacatcactctagctcctagagtgtcatatggaagcttggaacgttttcctccatgttaagaatttttcatgaaaatatgacaattataatggtaacggtctaggcgaacacggggagctggccaaccacagctgtagcaacgtcggcggcgagcacgggagttctcctccggcgatgggtcggggaacgccaaatattcagaccggaaggagtatatgtaaatatttaaaaaatagcatattaaatttctcaaatcaacatcactatagctgctggagtaacatactcactctgtccttaaaactcctaactatgcatctagacatgacgcatgtccaaatacatagctagttggttttttttaggacggagggagtatggagtctaagattattttcctccattttgagattattttatatgaaaatatggtaataaatacaataatagttccatggaattataaaatcaaccttgatcatgttaatcagctgaaaattcttgtgtaccactgtgctctattacaagttcatcaccatttacagagcatttcctgaggcttagaaaggtgccctgattcctgactggcaaccaaaacaatgagctgatctcaattaccagtatataggagtatatagactatagacctataatagtgtaattgcctaatgatctgtatgtgttcttctaagttctaactacaaaataactgggactatgataatgctcttcttcacctcttgtatgggtttcctccaaggacacgaagagaaggccgccctaatcagacactcaagggcttcagatatggataatccttttgcatcctctccttcgaaagaatatcatccttgtcttgaggtgcccataaaacgtgaataccctgaacaaaattagtttgtccaattcattaggcactcaacaaacagataataatacttatcagaaaagtggtaaaagtgatatgagtaactagtaaattcaagctgcgttttccctagcttgttcaataatataccaagaagcagttgtgctagcttacgatttacgaaatacaaatggaaatattccccatacctcaagacctgtttcgggtgtagagtagagctttgtcaaagcaactttcagatctgcagcgtttgtgatcaatttggggaaatccattgttccatccgtagcaacaagaatggttaactggatgatttggagatcagaacaaatcagtcattagacatcaaacaaataagaacgccattttttttgtcaagaaagtgtccttttatcatcataatcagcagatcgatggcaaatatttcaagaagcatttcacaaagtaacaagtctaacataccactatatactcgtttttgctcccatccatctttgtagagtattctttatttctcttaacgccttccaaattagaaagcgtttcttcatcaaatttgcccctttcttccaacgaaattttcttaaaatgaccattccaagagtcgctgtcttttatatcaacctaaaataaatggttcagcaaaattatacgattcagtacgtaattgcagtgggcggaacatacaaaggctgtcaaatcgagggagagaaactagaagcgaacacaaactatgtctgtcagtctaccaaaagaatgttaaaactgtttttatttcttactgataagcttgtagagatgcagtaatccttgtggcggtgcaatgaagatatggtatctgaaataagatgagtcaccagaacataaaaaataagctaccatgatacattggacaattgatagtggtcataagtatctaagttatatgaagtgttaacagtaacattattttataaccttattataggtacattttaccatctccttcggtcatcccgacaaaaaagaatattttaccatcactttaatactaaattgagtcctatgcacaaatagattaatttctgcaaaaaatgctattacttgatagtagtacttcttgaacagatctacatccataagcacacatggaaaaacatgctcaatatatatatctctgaactttctgcaaggtgcgtgccgtgtgtggcctaagcacaaatatatatttccccttcctactcctaatgatccataaaagttgccaactaatcctatatgtggagctgattgcacacttgaaaccctcattagagggcaacctagataagagactgacgttgtgactttgtttatcttcagattcagaagccaggatattattccggtttaaaacagtaaaactaacatactactccctccgataataaatatttggcgtgaatgactttggctacaaagtttgaccatttgtcttggttcaataaatttatgtaaatattattaattttgttgctacttgtcttattattaaagacattttaagtgcgatttatatttaaagctactagctagtgtcaaatataatccatctgcaattaagtaattagcatggaaccaccaaagcagaattcgatgtgcaagaattcagaataaatagattcttttttttttgcgaggagaataaatagatttgatgtgcaagaaattcagaataggcattaccgctcagtatgaacttgtaccaacgtcggctagagccttgcaccctctcagcaatccggttcagatccttctggaacgacttcgccgcagccacaccacccaatgcaatctaaattgcgagtaacagagacgaagatagatcatccaatcagtatatatacaattttgaatcagtgatcgatcactgatcatatcaagaaacccagtctgaaactctgaattgctcatggacactctaagatcagattcagagaaattaacctgaagcttgaccacactgatggtcctcggcggggggatgcttctcttgatgaggaagatgaggccgaacactagcccaccgacgccgagcaccaccgcgacgctgatccagaacttctcccacggggtcagggccaccggaggcggcggcggcggagaagccgccgtgccgaccgattcgtgagtctccagatctgcgctctccaccaccaccaccttcttcttcttcggcggagaggaggaggaagaagacgatgacctccatgagtcgctgctcgaggaccacgaagaaaaggaatcggaggacgacgaggaggagaaggaggaggaataggaggatgaggtgtccgagcacccgcccatggatccaccggacaaggcgagcgcggcgtgcgggctggccaccgcggcagcggcggcggcggcggcggcgagcagcggagcgggatggtcaggtgggttccggttgcgcggctcgtccgagtcggggagcgcgtgccgatcatcacacgcgacggcgaggggagttaccggcggaggactcagatggatcaccgaggcggcggcgggtgaccggaggaggaggaggagcggcgcggaggggaagcggaggtagggtttggacggcggcagcggccacgacgagggcgagcggcatggcgctgtggagaggaggcgcgcggcgatcgccattgccgtggtcgagaaggagagagagacagagcgtttagggtttagggcttaacgagtgaaggctgaatacatactggattaaacgaagcctaatccattcaaatgtattaaagaaacttatcctcgtaggatcatctgttatatattcttctatgacttaatagaaataatatgttttttttttacaaatcatcatcaaaatcttatatgcattggttctggtttgggctcagatcaagctaataaataatgcacatcgcaaatttgagtcaacgatcatgcatattttcgtcaactttgggtggagatttacaactaggattcaataattgtgttttctttatcttgtgttggtgtctattttgtgctccgagtattgttaatttcggagtgtgtattgtgaactctatggtgtgtgttggttgttgaataagtttgtgtaataagtggttgtagctctttttaagtgaagcatgatttatttccattatctaaaaaattaacataaagttaagtgaatatgcatttgattaaattattgttgacgaaaaaatcgaacaccccgacctaggagatatgcttagctccagtgcaggtccaaatatgatgagatgtgggcgtgtcagtcagtttgatcctgcaactgacaagatatgcaaatagtagatcaaaacagccgatcggctgacaagccgatggagtagttctagccggtagccaataatagtcgatgctgataccagccgatagcgatagggtttaagcaatcggctatatgtccaatgtagataatgatataaaggcaatcgactgatgatgatgtaataaaataacaatataatccagtataaaccaatcagctagcaatgatatgataaataagcatcgatccgaaggttaaagcacacattgtctagaggtccgatgtcatgaaatccacaagattagattaaacagtgaaacctttgttgtcatcggcgaaatccaacttatatgtatgtgcaatccttatgagccgatgcaacgtccagataactcaccggctgaaaccccgatgaaacccttattggcatcaagaagtaggctagagattatggttctaagcatgacttagtagatcaaatttaactgatgcagcactaagtatgaaaagaaacataatatctagacaatcaagcagttgactgatttttagggtggtagatgtatgagctaatctaatctagcaacgcgatttagccgatatcggcagaaaccctaaaatgagaagcagccgatagagctaaattgatatgctaagactagattaatagagacatatgataaatatgtaggcaaatatatcatccaaactagagcaatccaagaggtcgaatgtactgatgcagccttaaataacgccgatgtagatgagacaattgcttgggccgacggaacattggacttatcccttcgccggagattgaagatgatgcagccccgcgtcgggtgccaagttccgccagaacgtaaaaaacaaaaatagaagtaaaaagggtggcgatgcgtcgaattgtattgatcatagagatagattacatagaccccgggtgtacatatttatacccatgggttgatacaagtccttgtcggacaagaaagaaactaacctaaagataaaaggaaaatataaagtccttattggacactaaacacactttcctaaagataaaaagaaactaacaaattattcctaattaatagataaattgccatgccgtattctctttaaactcggtcacttagagataagcttcctttagtagattgatttccttaaccgaatatagcaggaatccgactattggcgacttgataactcccatcggctgattccgagatgctacagccgataatgattctaagccgatgatgtctttgccgattaccaaatttcactgttaataattattgaataattaaagtttcggaaagacgcaatttaccattattgtcactgctccaaattatttagtgtgtcttaaataagatattcttgccgtgatccagaaaattcaattgtaaattcagtatgatgtgtcagaagtgtaagaagcagacaagtagcagcagtcaatctgtttgttcgtttatgtttctaaagaacaaatgtcacgaaacccatgttttatggttgaaattacacaaaactaactactgtgattagtaacacaaaacccaccgctatacatgttgagcacacactaatttaaaatttgagcaaatttcacaaaactacgggtattttgaccaaattatcacaaaactacagatttaaggcgttgtatcacaaaactaaagatttagcaccaaatttatcacaaaactacacatttatgcttaagtatcacaaaaatgcatatttaatattgaagttatcacaaaactacagcttttgaagtttaaatttatagcacaattgttatgttggagctataaacattattgctttgtgactaaattggttctaaacatgtagttttgtgataatttagttactaaacatgtagttttgtgacacttcatcttaaatttgtagttttgtgataaatttggtgttaaatgtgtagttttgtgatacactgagttaaatctgtagttttgtgataatttggtcatagtatctgtagttttgtgaaatttactcttaaaattttaaaatatagaccgtatatgaaaattttaagttgattttgtattaaggttgtttggattaagtactccctgctacttttaaaaatgttattttaggtatgatgaaattaattgagatttgaatatg

SEQ ID NO: 62128 - DNA, 2480 bp, Oryza sativa
attggtgcatatatataagataagaggacgtgtaaatgaaatgaataacatgcatgctaatataccttaatttcacttgcatgtataccgttgagcattcccagtactaatcgcagatcatcggcgcttctgatttggggaaacttcagttttccctcagcagcaagaataatggttaactgcatgatttgacaataatccccaaacaaatatcttagtaaaaaagcatgcctcaatcgatcattaattagatatagagttccaaggcaaccactgacgagaaaaaaaaaatcctgtaagcatatatgcaagcttaggaaaattttgcataccactatgtactcttttctgcagctttcaggatttttggagtattttttacttatcttgattccctccacgttaaatagagtttcttcatcagttttgctcctctcctcaatagaaatcttatcaaaatgctcctcccaagaatcgatttcgtcgactgtttttttcacatcagcctaaaattaaatgtacacccaaataacaaaacacggtgagttaattcacagggtcataaattagtggaacacaaaaacgttgcgtttgtctcgaaattaaaggttctgaaaattgtatatttttcttaccgataaggctgaagagaaccagtaatctttctgacggttcaaggaacatatcgtctctgcacaaatggggcatgaacatatataaatttctcttctactctaagtatcaaattgtgcagtgtagaatcaataatgtataacagccgactgcaagaatgaatttagggtttagagaaatcaacaaatcgcattatattacccgttaacatgaatttgtagcgacgctgttttagtagtgtccaccttggcagcaatcgtattgagatccttttgcattgtctttgccagagcctgcaacgctacctgaatattgtgacaatttacaaacccccaatgatattagtgatacacaataattgggacaaattaaatgcaattagatcactgatcaaaatggtctaaattaatacgctctacgttcttcacagttgaccggcattattcaactttgaacattaataatttttcaattggttagactacgataaacggaactttacgctagcttgtgcttacgatgcaacataatatcatgacatcatttttaagtatttactccctccattcaaaaagtctaatacctatttcttttggcaccaagaccaaggaatataatactcatccaccatgtgacaaaattaatgaacatgcaaccaataaatacaaaaatagctttttaggtttcgatcaaccatttaatttaacacatagtgataacaaatagaacttaagacttttggaaaagccatagaatggaatagatattagacttttgaatagagggagtataaaatagtaaatttcacaaaattatatataatttaatcaaaatatcaaagtatactttagatttaataaagtatcgtataataaaattacagatttagtaacgaagttatccaagtatactttagagtttatatccatatataacactattgagtttataaaagttatagttatatgataaaactgatattaaatctgtagtttactaattaatatgatatattaataaatctatagttttgtgaaaaaatattgtttaatatgtagttttctaatatacttttttaaatatgtaattttgtgatagattgatcaaagcagtggcggatgcaggattaaaataaaaatggggcgaagatgctcatctcaataagaacaactaaacgcaaaaatatcatatttatgttgtaatcatataaacatatagtataatcaataaattaaggcaaacaaaaaaacaaaaatgatattaaaataaagtaataaattttgcgccatacataaaaagatagatattaaaatcgtagacgcgtgacaaagtcagtggcatataataaaatctctcaaaaagatactagtaaacatatcaatttgtaaatatgaatcgattcataaagaatggctgatagatatcatttagaccataaatatatgagcatatatagcatatgcagaataacatgattattattttgcttagaagggatagagagcatttcattaggcacctaactatagaagccgatgggggtgatcagtgtctaaacattgcctatcaaaagcatctcatacgcaggattatgattaggcactttggctgctcattaataggaccattatgaattgtatggtgtgtcagccgccccaagaacaatatggagtgttgggcgggcacggatcgtagctgggccggcggcccaaccccgcctaatgggtggtaccgcccctggatcaaagtatttgtagttttgtgaaatttacttataaaacaatttacaaaaaaggtgaccagttcaaaatttaaatatgaatattgagggattaaggttataaacc

SEQ ID NO: 62129 - DNA, 3709 bp, Oryza sativa
  unsure (1)..(3709): unsure at all n locations
nnnnnnnnnnnnnnnnnnnnnnnnnnnnnnnnnnnnnnnnnnnnnnnnnnnnnnntccatgagatttgtttcggtccaacaaaaagtacctcaagttaccggtatctcatggtaccaaatcgtttccgatcgttgtttctaacaatgcccatcctaccgagttaaatccaaatatatatgcttcatatatgtgtccaaattatataaatgttatttaatttagatgatgaatagatatcaaaacgtcctttatatatagtatgaaacagaggaatatgcttttataatgccattaccaaactatcggacatgcatggtatatctgtggctgttgtaaatttacaaattacaactcacatattagacttagtggcgaatttccatatgcttgtgaactatttaaaaatcattctcattcacaaagaggaatgagttcgtaaaatgcttctataagtgaatgcattcaaatcattacacctgtcatttttttttcagtatttcatttctttaagaattgagatcttgctaccgtgactacaccatactccctccgtcaaaaaaaagtctacttatggctatatatgtggacataagctatatccagatacatagccagaagttgactcttttttttttactgagagtagcacctatgacataacttttcaaatccccgatgattcttcaagtagttgctgaatcttggcattcttttgtagattcttagttggactgcttagaatcttggtcttcctttgtagattcttggttagactgcttaacatcagtcacattagcaacttcaataaaatattggtcttgcattacagatccttggttagactgcatagtttcggtcacactagaaactgcaaaggaatcttggccttccgttatagatctttggttagattgctcgatttcagttacactggcaactccaagggaatcggattctttcaataagggcttaagatatggatagtcctttagtagcctctcttctggaaggatatcacctatcttttgtggagtccataaaacttgaataccctgaaacaatatgtccaatgcaaatccaattaggaatgattgagtaagcaagcatttgacaaactattactgttccctaatctcatctgtagaagcatctgctcaaacttaagaaaattatacctcaattttgtttgcatgtatagagttgagaattcccagtactgtggtcagatcagaagcgcttctgactatggggaactccaattttccctcagcagcaagaagaatggttaactgcatgatttgtccaatcatcccaagatcatatatatgttaaagaatgtaaccaacatgcctcgatcaaaagaaattcatgtgtaaatgcatttgataagccatggagagtttatatatacataccaccagatactcgttttcttttccgaggccgggtttcaaatattttttcttcatcttgattccttgcacgttgtatagagtttcttcatcaaacttgctcctctcctcgatagaaattttatcaaaatgtttctcccagcaatcaccccagaaaagcagtctcttttgcaagtcagcctaagttaaaatggcacgcccaaattacatgaggtttgtcatctcaaagggaagaattaattaggtaggaataagaatgttatatatcgccaaaagagtaataaaattgtgtaaatttcttaccgataagcttgaagagatgcagatatctttgtgacggttcaaggagcatatggtctctgtacaaatggtgagcaaggaacatacataaacaaaactaccaaggaatgataaacaagctaagctagcagtttttttaagataatggataaaatccagcctctatatccaaagtggatatacacagccaaagctaagctagcagttgatgtattagtgatacaaattgtacatatctactagagacatatatgcagattacagagataccattgttggatgattgttgaaatgttctgcacacacatgcgcatgaaaggtcaaatataaatgacctatctagctatgattgaagaaagaagaacaaaaatcgagttcagttcaagatatcgccacttcacagctgcggtctggctcttgagatacctatatgctaccccaagctaacttctgttgaagttgaattgggtatataccatttgatcagaattgcagatcaaatgtatatctaatcgcaaattgcagtatatatagaatcaaatgtataactgaaaaagaaaagaaagactgaagctgatgactttaaagctaaacaaaagacagacttcaattcaaagctaaagaaaagactggttacgaacgtaggatgcattaaccatatataggtgcaaacaagaatttagaaaccgcattaccggtcaacatgaacttgtcccaactccggttggaagtgtccaccttcctagcaatcccgttgagatccctctgtattatttttgtcagcccacgaaatgcaacctgaaaaaaaattcagacaatttaatcgcaaacccccaacgagattagtgtagcgatagatgcatacataccaattgtgtgacaaatgcaaattagactattgaaattgtgacaattacaatataagattagtgaaattgtaacagatgaaattatatttttgctagtctctataacatcaaattagttcaaatgaatccattttaaatatatccttatggtatatttatttttagatcagtaaaattgtgacaaatacaattatttttagctctactaccggaaaataactaatttttgttagcttagtactacagggaacttgaaacggcgaaatatgcaatattttgtgctagatttggggagaatatttggcacgtacgaatcaactgcaacccaacaaacttcacacacaacccatatgaagcacttcttgaatgatggagtaaggaaacacgcaagaccaatgcaatgaaaacacttcatatgctattatccttagtcactttgaattatcctaagtcaactcccttgaaatttgatcaattttacagaaaaaaatattaataatatctataacatcaaatgagttcaaattaatccatattaaatatatccttacagtatatttatttttagatcagtaaaattgtgacaaatacaatttagattagtactgatattgtgggagtggattttcatccatcgaggagatattctcttgttatttgcatgtcattcaaataattatgcaaaaatttgaaaaaaaaattgagaaaatgtattaacatgtgatatattactccacaaatatgcaagttcaaattcagcttctacatctcgcaacgaaaaaataaattaaactacaactagttaacgtatattcttagtcaaatttgtttttttcgttgcgagatatagaagctgaatttgaacttgcatgtttgtagagcgatatatcacatgttaatatatcttctcaatttttttataaccatttgaatgacatgcatacaatgaggggatatcccctcgagggatgaaaatagtttcccctcatattgtgacagatgcaattagattagcacgtgatcatcaattcaaagctaggttgggtgtgatatggtagactaactaacctggagcttaacgacggtggtcgccgacctgggccggaggaggtgagcggcgatgtaaa

SEQ ID NO: 62130 - DNA, 10671 bp, Oryza sativa
  unsure (1)..(10671): unsure at all n locations
tacccgacccgatttgcatgagcgttggtattatttgtgatgttaactgatataaaaagttatgatgtaattcaaattatcgttgataactgatctctactattataaaaattaaagatgtttttgccggtacttttgatacgtcatctgtgtttgaatcggtttttaagttcaatcgtttttggaaatacagatccgtgtttgagttggtatttaattttgttcatttttagaaatacaggagtcgtataagaagtctctttaaaaaaacttgcatgctaacttgagacgatcgaacccctaattgcggttgatgattttgtaaaaagaatatgaattcccacagtgaattttcaccttagctaaaccatacaacaataataagattaaaatatccttcacccgttgcaacgcacgtgtatttttctagtaatttgataatttttttattttatttctttttattaaattacctatcttttgagttattatttatgtgagatcccttgtatacccactgaacaggcagggaaagttttgctcgttaactttagtgggtagggttcgggtgggccaggaaagttttgctcgctaactttagtgggtagggttcgggcggacggcgttgggtatggttttactctacccgtgctatacccaaaccattgccatcctttaattgcattctaaggtgtaaatattttctatatggtagtatataaataatatagaccatcttaaggtcctaaaattgcaattaaaggtgtaaatattttctatagaccatcttaaggtagacatattttgagtgaaaatgtttatctgactgtagcaattgcatgctaacaaaagtacagaagcacacattgtgaagtcataactcataaccttcctgaggcatcatgcaaacgtgaattaatttccacgtcatcattattagtgttagcttcggccttatatgaagttcgctgcaatggccaaaccttaccccacgtgaacagcaacaacaaaaaggaaaagaactccacagaaaaatggatgaattgcagcaaaatgcatccaagaggatagctgattgaataaactaccaactgattcagtctctggttcaaaagcaccattctttaacgccagaatttacagggtttaaattttgatgggcggaatgtacggatcaaactggcaatcatgagaacaactagtttgactaatgtactacctcgagtcacataatgcagaggtcgtctcaaaaatatttgtgcggaactgagtcgaagtcatcgtaatcgaatcttccaccacgctctcttccagtctgcatcaaatccataaacttaggaaacagtgggcagtgacaacgaaaaaaaaaaagctgaaacctttctgatgaaaatctgagctaaccttcattaaatatgcaggatcgcacgagatgttctcatcaatagaagacagcttcttggacaaagccatcaacctgacatacatatgttttgagactgaatcatctgatacaactcaaaaacgattaatgtttcattcatattaatttccaactcagcttaggggtggcgcactattagaaggatatgcagttatgctgactaagttattggtagcttcttttcttttgctttattcccttctcttttctgttttactgttatgcttctttagatttatttgaaaaattaggctgtgtgcacctagtgtgccggcaatgtaaaattttccattatctaaaaaaaacagccagtacgccaccaatttaactaagagtaaactcagaaactgagtatgaaaacaaacaaggttgccctctggccatgatatacctcagtgaagttctccaaaatcataaggttgcatattgtactagatacgatttttgtaagtgaaagctacatgcaatgtgccaagagctgaagagcagcacgaagggtccttgattctcttctcttggcaccttgcgtacatgcccaagatatacgtagcagtcaagagtggtaaacagaagacacatacctttgaatagacgagtcaatatgctcaaccatctcacagcttttatattgctcaggatcttcatgaaagctgaccatcccatccttctggtttatggttgcatggatctcaccatcttcaatctggattggcaaaaagtaaaaatatgtgatagtacagataatgtgatcagactgtatggggcaaaaaacacctaccatcctaagcacatgcatctcagcctccttcggggttttaagttgaacagagctggcaatatcctcaagcgaaagagtcaagtaggtctgtgtcaacctctggatgtttcgcttgtacattgaggagagcacttgcttcacaagtccaaggttgttgtcctgaaaaagaaaaaaaaaaccattgtgccgagaggggtggttcatatcaatctacgaatgggggtgccattcagaactgttaaccaaataatgcctagcactacaagtagatagcaacttaagtacagttcctgataaggaaatagatatagtaaggagggcagctcaagcaactgacaaaggaaatactcaccgattgaaacttctcagcattcagctggatatactcctctaattcagagtagttacctttgctgtagcatgttgacaggtcaacataaacctgaaataaaagaacagcgcagagcactaatgacttcagaagcaacctaaaaagggtgtatgcagttaaacactaaaaaggatgaacttgcatcaagagcaaaatttagcctttatatctagggtggcatagacggtaacgtagaacataaaaatgtgagcattgcctctagtgagtaaaacaaatgtacttgataccgagaacaaactatgcagcaaaacaaaaaaagaaggtaaagcattgaccatgccaaaaatgaatcaaaaaccactaaatcaaaaaccaaacgatgagacaaagcatggggcatggctaacacttatagcattacattaaacagcatgcgactatcaagcatacattctttcatgggacagatgaaactaggattccctgaatatacctgagcatgatttttgaggttcctttgagcagttgaagatgtgtactttggaaatgatggaacctgtcatttaaatggcataaatctcagcttgtaatcctcctttttatataaactattgaacataacaacctattagcattgctatggaggggcaaccagtaaattggagagaataaatcttttgatgagcacatgtagaaatgtccagcttatagctcataatacaattatgaagattatataccacatcagttcaactggcagttcttataccacaggatgatctatcaacataacaaattttaggagatctgagctctcattaaagaccagaagctaaagctgagtgcacgtgtgcaaattcgacattttcgggaaaactaaatatcctgatacaagaagtgggaagagaatgcatgatcagaaatttagtagtgataaactaactagagtagtatatctctgtctatcaaggttaaaccacctgcttatggatttggatccctatgagttgggtaccatactgcttttctgctgccaatttttaacccatttacaaaaccgtagttgttttcatttgagagcccaaaatattggaccaattaaagatggcaacactaagattgtgatcacaattcagcggatgcaaacctaggcatccagcctattatcccattaacacaggaaaaaggacagtacccaattagcttggaattagaggttgactaaacttatctttcatcacctgtgtacatgttcctatcattacatgcattatactttgtttcacaagcttaccataaatatagactcacctttatctagcaatggtatctgaatttctcaaccatatatcacatatgttttaccacaaatcttatcttagccagagctggtgtatatcaattagagagcaccagatcgctggtcaaagctaaggaaaaacaagctttccctaaaagtcccacaattccacacactaaagcagcagaggacgcaaagcaggaagtggtgaacatacctgcccattctgaatgagcgaaactaggatgtatttcttgtaagcttcaacagcaatagcattcaatgatgacattgggacggtaacagcctgtaaaaatgcataacattgtaaacactgaaccattaaacatcaaacacaaaattaacatgtttaaagcctcacattgtgaagaaaatccagtgctatagtgaacttcttcagcccaatgtatatcattcccctgcaagagaaggaaaaccgttaagtaaacaaacggtacatattaaaaaaccataaaggataaagcacattcgtccatatacccatagtagcaatagaggaataagtcctttggctgatcaacttcgagtatgtcgtcttccaggacgcttaggccagccttgtactgcttcgcaagcaggcacaggagaaggtaatccgcatggatcggggtcagctcttcagacgaagtctgaatcttgcggattgccgcccgcagaggggcaatccctctaatcggcgcgttgagctgcatgacctcattcttgaacaccctacacacactcagaactgcacatacaaaatacaaatcgaagaaaaaaaaaggtggaatgtttagtccacgaataatgttctagtactagtaacgaataatcgatgcatgacagaattagatagattcgatttgatcattgaacagcacgcacacttatcaggcgccaagcgtatctgctccgccgagcaggagacgaggaaatcggccgtggtgaccaggaagtccccgccgccctgcgccctcaggttggaagccgaagacgcgaacgcctccctgcatcacggacgaaacaaccccccgcaaggtgggggaaaagtagattagcgcgacggattggattcggcgagcatacgggattagggttttcgcggacggcggcatcaaggggacgggactcacaggaggtagaggaagccgagggagtgggcgctcgggtggagctgggcgaggaaggggaggagggcggcggagtgggcgcgcaggggctcgccgtcggcctgccggagaaggttgtggaggtgggccagctcctccccgctcccggagaggccctggatgtgcgccaccagcgtctccaccgtctccatcgccgccgccgtcaccgccgccgccgccgccgggaagtgtgggggttttgcttgccgttcgcgtcgccgcggttggggtttggttttcttgtgctgcggcttcctcttcgcgtcgacctgtttggttggatgcggagagattttgatggcgagatcgatttaattgtgcggggatctggaccgtccgtttgagtgggggggtgtaatctgtgccgtttgtagcagattcagatgtgatctgacaaaatcgaatccaaatatgcttcgaaaggaagtttgattttttttttgttattcaaaacagaagtttgaatttgcagatgctcgtgtgcatttgaatcataaattcactgaactggaggtggtttcgcctgacaatatatggagaaactgtacatcaatttcctgtgtagctcttgcatgtgaatgcaagttttacaaaaactgacgaaattcctacagtccaaactggaggtcaaacagtccacaatcagaaaacaccttgagttgagatagaaacagaggttcatcatgaacagctaccaaactggaatgcagatagtcactccacaatctctgttttacaactattctcagtgcccaggtgacctagcaaaaatggatattacacaggaaactgtattcttttccaaaacttacagacgcttccaagatttcatcggcttcactgatggaatactcaagaactaagatcaaagcaggagatacgatatatcatctatgtaaacaagacagtatagaagaactgataaggaggaaaacaagctggtatacttgcactcgcaagtccagtattcttcattacaaacatataagtgcgtccgcaaaatcgcttacatttatatctatgaaaacagagagacaaaaatgacagccggctgactcctcagaagtcagaatccacaaacataggataggaatactacatatgttgcaggctaggatcacaatctagatccttagactcaagttctttgatctttctcagacaacacacaaacgatatttacatagtgagtttgtgcggcgtcggggatgcatccagatgctggagatgtagggcagcgacaagtccctgccatgtttctccagggcgagctgatgtcttcaattccataagttttctctgtttcctgtagtagtcttccagtagcttggtctgcatattgagagtttcacatttagagtttatcatgttactgtactacaagaacaaagctagagaactccataagaactagtatcatgcctcacaattcctctcagagtttaaacttcttgtttctgaaaatgcaagtttttaggggtgtgcatatagatggcaaattggcaatcttgcccatggatccaggtacccgcgggcgctgtgcccgatgggcatgggttcgattttttgcccaggggcacgctcgacccaagaccttagtgggtgccgccaggttttctattttgcccatgggtaacccatgcccgacccaagttttgtatatctatggctgatttttggccccatctctcccttggcccattcggttatgggtcgggcatgttcctgctccgtccgtgcccaacccaacccaacccattgccatccctaggtatgcaatcaggtgatacataaagcaggcctcattgggtgcatggtgcaatgcaaagctcatcagatcaatgctagtaatagacccaataagtttgggtggcctgaaaatacctgttcagcataagcacgcatcttctccattctcgagtcctccagacctaaaactgcagcatgttgcacctgagaaggccatgtacagctcccaaggctcggattacggtctgaagacgcagttttgctaaaatcaaaaagctgtccacagtgggggcagatgtcaccaccaaaccgcctcttcataaaacagttatcagcacatttgaagttcagaaccaagtcgatatccacaatctcatcgagaatctcctgaaacattcaaaaacagacagatcaatgaaattagtaactgtgttggacataactaaattcaatacatctaatgtcaatgctaattacatgataccgagaactttgttatttagttcaagcagacaaggcaaacaggaacttaccgcctgcatatgagtgcgtgggatcccatcaaggatgaatccagtttcacccttattgtatccctcctcaagacgcttcgtcagcaatccaaatataatgtcctcgggcacaagtttcccttcattcaccgaatttgcaatctgtccatgtcaaatgcagaaacaattcagcatattccaataccctgaaacacttgttgtataacatatccccaaagccacaaaatttccattcagaatatatatctttgcccacttgtgaaatggttctcaacttgtcaaactgctctacccaactagctgattaaccaagccatatatggttctcaacttggcattgtctgcgatgataacttgagaagctctaccgaatactacctgaactatcagctgttcagggaaagctacaggagagccagccaaacgaaggtacaacaaagagggcaaaatgggaagcctgcaaaagaaggcggccgcccgccacaaagattccaagatcgaaagttccaaactttacgacgtgaaaccctaattgtgtggaatccccgaattgcccccatggcatcgtgtggacgcaagcaaattacggagatgcccccgcagccattcgtgcagaggggaggacgctgaccaggacatggccgccacacgccctttctctcagcatcatgcgatccattataatttacaagcaccagagaaatcgaagaatcaaagagtaataatgctgttaaacaacgctcggaaattgtttggtttgccaatttcgtggggaataaggaaaaaataatggatttgcttgctctggtgaaaagttgtggctacggacttacggaaaaacatgaggcaaatatcgaagatttcgtaatgatccaaagatatgtgacaagaaatttccagaagcactcccaaagagtggccaggaaacgcaggaatctagcctactttatgattaattgagcaaaagcctcgcggaaaagctcaaattagagttagagattcgcctcaagaaaagtttccaaaattgctgggagaaagaaaccttccaaaatgtgtggcgcgattccgactcgaaacgacataatcaagcgaaaaaaatatgtgatcgccaaatcaatcgaggggacaaactcaaatcgcaacaaattgaagcgcagaaacatcgatcgaggaaaaaaaagagtcgtataaagaagcgggtggcttggagcgaaatgcgggcgaaccttcttgtagagagaggacgccgggctgagctcctgcctgacgagcgtccccatggagatgtacggcacggcgagcacctcggcgaggcgggcggcgtgggcgtgcttctgcggcccgggcctccccatcaccacccactgcgggccaccgccgccgccgccggtggggcacatctccgcgacgggcgcggactcccgcgccctcgccttctcctcctcctcctcccactcggtccagtacgcctcgtcctccatagccgccgccgccgacgcccccatcctccgtgcggcgggggccagcgcgcgggccagtggggaccgcgcggcgccggcgagccgcaggacgccggccattaccgcgggcggctagggtttgcaggtgtagggtttttgggcgctggtggatgcaatgcgagcgcgtggcggcgcggggaggaggaggagaacgagagggtggtggaggtgaagaggaagaggagagccatttcttcggagagaaaagcgaagatggctttcacatgggccgacatggttgtgggccttaaaacaaagggaagtaaaagggccggcgtgtcggatatggaccggcccataaataaaaactgagggcaaactacataggggcatacataacgatatactccctccatctacttttgataattatatttcatcttggcataatgaccaaggataaataattatacctatcatttatttaaacataaacaagcaattcattaatatttacatttctcgatgcctatgcagtgtggacgaatggagagtcacgcattaaattcaagaaagtcattaaaagaataggtagttggattgaaatatgtctatcaaaagtaatttcttcatatttgaaaatatctctatcaaaagtagatggagtaagtaccattctaacataataacttatgtgtggtaacggtagtgtgacgtaagcgcaatatcggtattggatctagtatcatggtaccatacacgatactcataggtaccattatgaggttagcatggttagctatttcgttggaacagtattactgttttataatgttttaatttttttatgtaagaattttaaagaatttttgggggaattgaactgattcctaaaaaaacatgtaaaattcatatgaacaagtcctaaaatgtttttcaaataagcgctgattcactcttaaaaaattaagcgctgattcggcacaccaatggctgcataattacacttacacgccactgataaatagaaaaatcctacgaattccaacgtttgccgtggatgaaagaaaccaagaacaggaacacggctagctagccattcatcgatcgatgtgctaagtcatcgtcatgagctcgtcgtgatcaacgccacgacgggcggggnggtaaggaggcgaagcggcccaagagggcggagaagtcgcgctcggagcaggggatggtgaggccgccgccgccgcagtggtcgaagccgtactcctcctccacgctcttcagcagcgccacgaacgccggctgcctcaggtacgccgtcggcaccacgaacctcgcccgagcctcgccgacgtacaccgcgaagtgtcccctcggcacgtncctcgccgcgccgacgccgccgcccttcccagccaggtgaagcctctccatgagatgctgcagcttacctcccattctagctcactctctcacagctgcagctaagcttcactggatcacagattcactgtcactatgtcagtctgaactcgtccttgcagtatttgctacagtgatagttannnnnnnnnnnnnnnnnnnnnnngcgcactatagtctctgaaactctgaattttcgatgtgaattcttctgaattttgcagcaggtcgacaagggtgatgccgtatatatagtgctcgttttagtgcagggttaagactaaatggaattaagtgtttctcaaggtttatcggggtgatgactgatgaccaagagacagtgtcacatgatggttctctgatgtgttcctttctcactagaatgagactggatttctatgaggacttttaatgattataatcccttgtatcagcatgcccacatatgc

SEQ ID NO: 62131 - DNA, 5436 bp, Oryza sativa
  unsure (1)..(5436): unsure at all n locations
nnnnnnnnnnnnnnnnnnnnnnnnnnnnnnnnnnnnnnnnnnnnnnnnnnnnnnncacgacggcggcggcggcgaggaggcgaggcggccgatgagggctgagaagtcgcgctcggagcaagggatggtgaggccgccgccgccgcagtggtcgaagccgtactcctcctccacgctcttcagcagcgccacgaacgccggctgtctcacgtacgccgtcggaaccacgaacctcgcccgagcctctccgacgtacacctcgaattgtgccctcggcacgtccctcgccgggccaccgccggctcccttcccagacaggtgaagcctctccatgagatgctgcagcttacctcccattctagctcactctctcacagctgcagctaagcttcactggatcacagattcactgtcactatgtcagtctgaactcgtccttgcagtatttgctacagtgatagttacggtgactgatacctgtctgtttgcgcactatagtctctgaaactctgaattttcgatgtgaattcttctgaattttgcagcaggtcgacaagggtgatgccgtatatatagtgctcgttttagtgcagggttaagactaaatggaattaagtgtttctcaaggtttatcgtggtgatgactgatgaccaagagacagtgtcacatgatggttctctgatgtgttcctttctcactagaatgagactggatttctatgaggacttttaatgattataatcccttgtatcagcatgcccacatatgctgctaaaatggactcttgttgagctttcatgtcatcccttgtgagaagtcctggtgctttttcaaattctgatgtttgcatttcagataacatacctaactaaccgattgtcatagtctaatttttcagtcaatcattttctgaaagaatttttttatttcagttctctgtcagtgcagggttcagtagtttgctgatttttctttttctttttgcagaaagtagaaacactagtacttttttaatgaaatccacgcaagacgcatatcccgtcgcgcgacaaacacgaaaaatatatcaatatcaatggccattccaatataaatcctgcataaaaaaaagaactggtggaggccgttcgttcacgtcacaacaaaaccggctcacttggcatgctgcatgagaaaatgcttgttgtttagccagcatgctgctgctgcaacaagtggacatgcagatggacccccaagtgtgcaaaatttcaattcaactcgtgtacaaatactcagagacatggccgtatgggtatccatcctcatgtgcttgaccaccaaatcattaggacctgaaaatggaggatcaatggagccaaatctctgaatttgaaggccaaaatgttcagatttcagactgaaaaggctataatcttcagaggtgttcagagttcaggcacagtagtacattacatcccagaggacatctgctgcatcaagatatcatccagctcggcacccacagcttcctgaccatggtaatatggtattggctcttctgtggcctagaattgcgcaatgtgcggtgcagcggcgcatgatcgatcgctggacagctaaggcgactcgtcgcgaaatgagtgacagtgtcgatcaatctatcatggctgcaactgcaagagaacatgcggcatgctgccgagatcaagtacatgatccggcacatttccctgacagacttgttcggatgtaggctcagtgatgactggggttgcataactgcataagcagatcttggatcgggaggttgtgttgcatgattgtgcagtgaattatgactttgaggttcttgctgaacaatttgttttcagtcaaagttcgattactgaagttaaagactgaggttggacaaaggaagtaaaacttccggtctttgcatcagctaaggatatatattaagatgaaatctaaattataagaacaacaacaacaacaaaatatcaggtgcaaccaaaaaaagaataaaacaatagagatgaaatataaattacaagagcaacaaaaaaaaagagcagatgcaacaaaagaaaaacagagatgaattctgaattgttggccagagattcagcttaacaaaagagagagtgtcctaagatgaaatctagattacaagcagatgtgcagtctgagttgttgtccaaagatccagcttaacaaattagaagaaatgcagagatgaaatctgagttgtttgccaaagattcagctaactaaagagagaatgtcctaagatgaaatctagattacaagcagatggcagtctgagttgttggccaaagatcgagcttaacaaattagaaaatgcagagatgaaatccaagtcgtttgccaaagattcagctaacaaaaagatgcgtttgccgggagtcgaacccgggtctattgcttggaaggcaattatcctaaccgttggactacaaacgctatgcgtacatctgaatgaaaaacaaatattcaaccagtggggcatcttaattcgttcttttttatgatgatgtaggagtagttcataaagtacacgtcttaatatgaacaataaacttagcttatgcttatgtgcaatatgcatcccatgtgtttccattaaagttcttgactctggatagggaacaatagcatcaacggcacctatgcttgtctttcgattcaagagctagctgcatatgtttcagttttaatcaaacagcaggcatgtgtttcagttcgaagttgacaatttctgtccactgtggaaaaagtcaaccgagaacaggaagcacttaatttctatgtcatggatgcaagtctgaatctgacaggcagcgatgcctattaagtactctgtatactgttaagagagcagcagcttgaaggctgccccttgaaatgtattccttttcgttcatttttttgttagtctttgacctgatttggcggtgctcaaagttgaattttggccaatatttcaaaataagttaggcatgaccgcgctgaagtttaagacgcctcttgcttgactagtttgtagtttacacatacgctggctgaaaaattgttccaatgtacacattgtacaggagcttcttcagcatctgcacaactatctcacacgatttcagaaagttcagatagtctgaaacttgaatgagaagatcgatgagttgtctgctcttaccaatttgtcatgtactcgtattttgtaagttatttttcttttcgccgggccgtattttgtaagttttgttgttcaaactcaataatagtaacactgtaacagagaaatatctggaagttgctgtatttaaaagttcattctcagttcctggtcagtacacaccgaagtcataaatttcagtaagatgaagcgatttcgtttaaattttttaaactttcagtacaaataaaagttcgaaaacctgcaagatgaagcggtttcgtttaaattttcaaacttcagtaccaaaaaagtgcgtttgctggaagttgctgtatttaaaagttcattctcagttcctggtcagtacacaccgaagtcataaatttcaataagatgaagcgatttcgtttaatttttttaaactttcagtacaaataaaagttcgaaaacctgcaagatgaagcggtttcgtttaaattttcaaacttcagtaccaaaaaagtgcgtttgccgggagtcgaacccgggtctattgcttggaaggcaattatcctaaccgttggactacaaacgcatcttatggtagatttaaaaaaactgcaatcttatcaacaaatctttaatttctggtgcatcttttttttgtcagaagaggatcaatgctgaggtactgaacctaatgcagtaatgcataattgatgggtatctttttttttagataattaaccgatgactatcttttcgtcaatgagttgtgcatgagacagaccatgtgtttcagatgagcacttaaatgggaaaaacggaagaaaaaaaaagcaacaaggcctagtactttcatatgcgattgttgctccattcttgtttgttcaggaacagcactctgacaaagtgacaatctagtgcactcggtgtctgtccttaaaaaaaatgccaagttgaagcatatataatcatttagttgcacgcggcatgatcaattagcatccggtttcatccatccgtataacagaaaatgatacggaagtctgaatccaggaaaagcacagcaaattcagtgctctgcgctgtcttgagagcactgtgatgggcaccaagtctaggactgtcccaatctgtctctctccaaaaagtttcaggccctgtttagaaggtgtttagatccaggggtgtaaagttttgggccaaaaaaacagcttgcaaaaagtatctcatatagctgataagcaatttttgctgcaacttctttttattaggataggatcaatgctgggggtaccaaacctaatacataacggatgaccatattttgttttacataattattaactgatgatgcctgttttaaatgggaaaaacggagaaaataataaggcctgctactttcatatgcaactgttgctgaattcttctttctccaggaacagcactctgaccatctagtgcacccgctgtctctccgtaacaaaaaatgacaagttgaaacacatatataatcatttagctgcacgcggcataatgaattagcatccggtttcatttcatccgtccgtataccaggaaatgatacggaagtctgaatccaggaaagcacagcaaattcagtgctctgtgcagtcttgaaagctctgtgatgggcaccaagtctaggactgtctcactctctctctatctctcccccacaattttaagctttcaaccaatgctctgaatgtacgatgcaaatctggacagtgatgtttatgaatgcatgcagctcatgtttatcaggatttcagtctcttttcctcgcagtgtccagctcggctatttgcaggttgaaatcacaacgcattggatttgtgtatcttcgtattaatagagagttaaaatcactatactccctgtctctaagactctaacgtctcttccattccatggttatttcacatagatttagctcgatcgggaaaacaaggaaactaggggttcggagtttcattttccgaacccccaccctacaggtttttttttccccaagaatcgccaaaatttaactctgaaatttgatccttctgctacgttcttgcagactagcagtttttcacacctggccctaaaaagcctctgaaaaaaatttctcataatttttcgcattgacttagtgcataaaaacgatgagaaaaggggttcgcgagaataaaactccgaaccccaccaacacttcttttcactctgaaccttctgttccgttcttgcagatccaacgatgcctgac

SEQ ID NO: 62132 - DNA, 1160 bp, Oryza sativa
cactctgaaccttctgttccgttcttgcagatccaacgatgcctgacaaaatgttcaggatggctgaaacgatgatgttcttaaacgatgagagagaaaaaaatgaaacataatcccattaatccggatttctgtgtctgtttaattctccatgtacagagaagagtccaactagattgcacgcagcctagtggtaagtgacctgagtagcataccaagcttctgagtttaaatctctgtcgaagcgaatttcagattaggttatttgagggctaagttccctattcgattatctgcatcctgaaagatgaaaattactctattcccccatcctgtaggaatgatgtatgtatccaggttaatgaccgtatcattctgtctgattgtttttttctttttttttcaccgatttagttcgggcaaacgttgaaacatggggttcggagaattggactccgaccccacattcttgaaaaattacttggacatgggtcgaaattggcaacaactttccatcaaatgatgttatcatacaagtagtacaacgaacgatctcatcagcaagaaggattccaattaatcctcagcaacaagaaaagagaacacaaaaatccgagccgtcatagctagctaattaactagaagctactaattaactaattaacagcgagctagtggtggtggtggtcgtcggaggcgatggcttcggcgacgaaggaggcgaagtcgccctcggtggcgcaggggatggtgaggccaccgcagcggtggcagtcgaagccgaattcctcctccacccgcttcagcagcagcacgaacgacgggtgcttcaggtaagccgtcgggatcacgaaccgcttccgcctctcgccgacgtacaccgcgaaatgccccctcggcacgtccgccgccgccgccgccgccgtcgccgccgacgacgacgacgaccggctcctcgccaggtgcatcctcgacatcagctggtacagcttccccgccatattatcacagtgatcgatcgagcttgtttattcttgcttgcaattaactgagctggtgatgctgctgtatgtgtttgtctgaaatctgaagagtgaaatgaagtgaagtggaaagtggtgagaggcaaagctgcttatttataggtgagccgtgagctc

SEQ ID NO: 62133 - DNA, 18593 bp, Oryza sativa
ccacctaactgcatttaaagcggtctatgcaaccgcatcatgtcacatttaatgcggcgtgctgcgcatctgaccggtctgtgaccggttgaatgaccgatgggacggcgactgtgtacccccgtcctgtcagtgtgtcaggcggtgagcggcgtgctccgtcccgtcccatcataatgatgaggggcttcacagcctcttaccccagtcagagctggtccaaccactctgaactgacccgggttcccgttttctggtgtgaacgagaacctggaagttctcatccattaaatgacgaatgacaagggcgccatgcatgatttgatgggccccgcgtagcaaccgacgtgcagatagcttctaggctaaggcagaagacatgtaattaatatagagaatattttcccttctccctaggtagcactcgcagcacatgtagtatcctcttagagtataaaaggaggaccatgcctagcgaggaggggggatcggactgaggatccctgagccaaagcttgtctaaccctagcttgcataccagggattcagggactttctaagcacagaagaatcataaacacaggagtagggtattacgcttcatagcggcccgaacctgtataaacctcttttgtctcatcgtcttggaggagcctccgagatcaagatctcacacagtttcactcaccaaatcctcgaatctcacccgctgcccccggccgaactctcaaagaggggcctcacagcctcccgctagagagggtcacccctcgacaactatagtatcccccactttatcaaatttcaatgaaattattcttctcattatccactcccaatgcatttatcttttattttcataaactccgatgcaatggtttattttgaataaatgggagggaaaaaaacaaattctagaactgatggagtgcgttcgacataagcagattgagtgaaaaaaaagtctctcatttctacatgcacgcttcctgaactattaaacggtgttttttttacaaactttttatttatgaaagttatttttaaaaaatcatactaatctcttttgaagtttaaaataaataataatcaattaatcatacactaataattcatctcgttttacatattcttttcaatcttcactaatcctcttatctcaaacactcatatgttttacccattcttttcataactcacatctctcgtttttcgcataaacttcctaaactactcaacggtgtatatatatatatatatataaaagttgcttttaaagaatcatattaatctacttttcaaaacaaaataattagtaatacttaattatttatgtgttaatgagtcgttcgttttatgtgatataattactctagtttcaacaccagaaaccaaacacagcataagcatatgccttttttttttgggttcaggtgatgaggatctgcacactgttgggcgttcaatgaatccagtagggagtccggacatggagcatggacgctgcagagacagaagacagagaggttgcttgcttgaagaaggaagaaggagtaggtgacaggtagggccccaagatgacgcccagctgtcgatccacccaacaccgaccggggtccggcccccagatcagactcatcagacacctcatctctcatcccctcacaacacacgtgttccccgcgtgccattttcagacaccattgctttcgctttgcttagcaactcggcaatgaaaaaaaaaagaaaagaagaaaagaagataaattgtactccgtatttgttttaagattacactgcacatgcgcacacacatacaccactatacacgtaacatcatactcccactcttacgaatatgttcccctaacacatgctctaaagacagaaatcaacatcgtgtccttgatctcactaaaaccctattaaaagtttacttacatatgtgtaatatttgtgagcgttatgattcgaaccctggtggtggtggtggatttatgcacccataactccaccaaaacacccgggattacaaagccgtatggttatcataattatcacgtacgttaatcttttcagttttctaaaaccaaaccatagttatacctcatgataaccgccaaatgcgggatagcggcaaccccacccaaacgatttgttaaatcctgcatcgcaccactattgctttccctctcccttcctgctgtgggccatcgccggccgggcgaccaccgtcgccgacgacggcgccggcgaggtcgttgaaatgaatgcgcgcatgcagcgcagggcgcgggtatctcgtgattcgcgctagcttccttcattgattcctcgccatgccgaccgttcgatctgttcataaatcttcgtcaagcctgcagctgcagtagcagtactcctaaaacagttaaggatggtgcgatgcagcaagctggctgccacggcaatgcatagagagagatgtacggcagggatggatccgatcgatcatctgacggcgatccgacataccagccggttgatggatgtgtgcatttattgttttggctagctgcaccgcgagttgagctgcattttatgcgaccaatgatgtccaaatcctcgcacgggccgtaccacacgtcgcgcagagcactgaattattaggaaaaataaaacaatttcaaattttcactgcattttattccgagttcttttgtttttagcaagggtttggcctccatttcttttatctgaaatgagaagagacctacaaagttctctttttttcccccgagttattacggctacatatgcatatactccatacgagttattacggtattcaaaagccggcggtggcaggcttacttcatttgtcggcaaactattccagtttggaaggttcacggataatgtcagttatcactgactgaaataaacactctcttaaatttaaaaccattactcactctagaaatttatggctactacccgcccggcaaaagaaattcggaattacttcctccattcaaaaagaaaaaaaactaaaagcatgtttagcacaactccacctctcctagaggtagagcaaagccaaacagtttcaactccaactaaaatgggaatgaagctggataaaacattctcacaaaataaaatagagagatggagctaggtttaggttgtttcacagctccaccctgaacgcaactcctttagctaaatttaggagttagagttctaccaaacatgctctaatattagctatgtgttatgtccaaatacgtagttagggttaatcttttttttaaaaaaaaaaggggacggaaggcatatccaaacacatatacctaagtttgatgtttgatttttaaaaaaacacggatggattactagtgctactgatttgaaatttctgtcggacaaaactaatactccctccattaaaaaaagagacaaaccctgggtttccgtgtccaacgtttgaccgtccgtcttatttgaaaaaattatgaaaaaaattaaaaagacaagtcatgtataaagtattaatcatgttttatcatctaacactaatgaaaatactaattataaaaaaaattcatataagacagacagtcaaacgttggacacggaaatttagggtttgtcttttttttttacggatggagtaggttacaggcatatagcagcagcatttcatttcatttcaaacagtgcacaggcacagcacacagatgtgctggccggtcagcgagaccaggccggtgaaagcgaagaaacccaaccaaaaaaaaggagagaaaaaaagaaagagacggagcggccggccgagcacgccacatgccgtcggcgtgctgcctctgctgcttctactgctgctgcttgcacacaaaccaagcagaggcagaggcacggtgatcgagtgaagctggcagtgcagctggagccggaccctccaaagaaaccgtgtgctctaggcaagctgcctcctggaatagaccatcccaacggccagccagcaaaacccttcccaatccatcctttgattcatcaatgctatccatgctcgtcgatgttgcacagcagtaaaagaacacagcgcattttgtaccatgtgctacagtgcccctctcatggatcttaggccctgtttagtttacagaaagtttttccaaaaaatatcacatcgaatctttgaacacatgtatagagtattaaatatagataaatttaaaaactaattgcgcagttaggggagaaatcacgagacgaatcttttgagtctaattagtctatgattagccataagtactacagtaacctatatgtgctaatgacagattaattaagctcaaaagattcgtctcgcggatttcaggtgagttatgaaattagtttttttattcgtgtccaaaaactcctttcaatattcggtcaaacgtccgatgtgatccccaaaatttccttttccttatgtatctgaacacattgatattagtagtagtactaacgtgaatccgcagacagacaaatggacatggcaagttggcaactgaaccacactagtcaattgacttgaatgtacgtttgactcttgcatgtaaacattgcggcaatgagtttttattccgcgaacacgcaaacaaaggcatgtttatatggcaccctaaaatttttcacatcacatcgaacatttaacacatgcataaagtattaaaaatagactaaaaaaacaattaattatacagattacgactagtttgcgagataaatctttaaagcctaattgctctatgatttgacaatttggtgctacagtaaaaatttattaatgatggattaattaggcttaataaattcgtctcgcggtttattaacggattctgtaattagtttttttattaatgctcgaacatcccatgcgacaccctatataatatccgatgtgatacgccaaaactttacacctgaatctaaacaccccctaaaagtaaaaacattgcagcaatccggcaatgagtgggtatgatccacactcgctagccactaatttgctcgctccaagcctcccaatctctccaaatatgctccttttctatttttcaaatataaacaattctaatgtttatattttatatgtacaatataagcaatttttaacaatgatttcaatgcacataaatccaattattttcagctaacctcatgtgctcaagaaagtaatccaaataattcaaaattcaatcaatggggtggctgaaaaggatttttttttctctcgatcttagtttttgttaagcaaaaaaggtatatattttaggaacataaagagtaacacattcttgggttccaataatgcacgtatcgacggattaagtcgtgcatatgaagtcaatcagcgttccgaacttctgatggcccaactcacatgatgttattattttcctctcctattctccgccttccttctatcatttcattgagcgcaagcggtggtgccgtaagaaacaaattgagtgcctcgctccctccacactcttctaatctctcgcctcttctgattccaccaccgccaatagacttagctaaagtcgaaagatgtcaacatgaaagtgtggcaccctcacttcccttcgtctcgctttgctcctggctatcaacattgtcctaccgccaagtgttaacccccatggtttcagcagcgctgccgttgccacctcaccacccgcctttgtctgtcgtctttccagttattcctcacccataatggttatctataggctctctacaagagattcatgtcagaatatttttctacatggaagatattaaatgaaaagagagagcaaaactatctactaacttagaaatagtctatagagaaaaacgaggcaatgcatgagagagctatagatacccatatagacatactattgaggtggtttactattaatctagtctattgctgagatgtacatgttttatagagagcaccttactttatcattgcgggtgctctaagctcacattgtccaccttctcctctccagcatcacccttctctcaacccaatccctaaaccctaaccttaacatagcccttcttgataaggtactatgtgctactacctccgtctcaaaataagtgcagccatgagtttccgcgcccaactttgatcgttcgtcttattcgaaattcttttataattagcatttttgttgttataagatgataaaacatgaatagtactttactcgtgacttatgtttttaatttttttcaaaaaaatttcaaataagatgaatggtcaaagttgggcgtgaaaaactatggctgcacttattttgttacagagggagtagcttactaactagcgcgtgtgtgcgaattactagcattcatgcacattttgtatttgaatttcatgttaggatggctgcgagtttccaaacggggcccgtgtttactattgtacgatcatgtgaccacagctatatatacgtacagtttcctcttctgtcttctttttgtcttgtttcttttgttggatctggagcctaccgctagtagtacgaggaggctccctgcccttttctgcaaaccttggcgccaaattctccaaggataggatggtcatagtactactcctagcactaatgtgaacgattcataggcccactttagtttatgtgccaaaattttttgaagtatacatacatacatacatatgtatgtatgtatgtatgtatgtatgtatgtatatatatatacatttaaagtattcaatataaactaataataaaataaattacagattccgcgagatgaatttattaagcctaactaatttatcattagcaaatgtttactatagcatcaccttatcaaatcatggcgtacttaagcttaaaagattcttctcgtaatttacatgcaaactagacaattgattttttttatatttaatacttagtacaagtgtccaaacatttaatctgacgaaatttttggaagttcagaggaaccaaacactgccatagttccatcacgtggaggttaggcttcgttttcccgcgccgcgcggcccctattttggcgcgaaaacacctccattcatgccgccccgatggcgcgaaaaccgctcggctgcgtgcatggtgggggcgcctctctctccttccccgcgtcgccgtcagagattcaaagattcttgtctcttctttcttcttttctacagtgtctttttcttctcccctcccttttctgttttctctccccatgaatcgtgcgtgcatgatcctgaaatccatcgatcgatcgatcctagggtttctatccaatccgatcttcaaaaagatgatgaaaggagaaaaaagaggatcaaatttcgtacaattcggatgcaaacatcttggatatcatgcggatccaggagtcgtatgatgaaacatcattacagtagtaatagtaattaagctaagatgtactccactatatatggtccaaattgggcaggatgtgcgacactgacatatatatacacgatcaaagcaaagcagcaactaactagcgtggttacgtgacgtgtcgttgtcttcatctgaatcatggccatttcgatctctttttttttcaattatgcctcgcattcatgtcgatccatgctcacctcgacatacactgtcaatggatgcatgctcgaatacaagtatggtacaaacttatctattcgttcgatcgatatccttttgcattggttaattcgaattaggacatatgtgagatgcgagataataatgagtggatttattatagtacacttatgcagtcatcaccggcatttaatttaggaaaaagtacgaattacctctgaattatcgcggtcaaccgaattacctctctaaactcaaataccgaacattttacaccataaactatacataccaaacaaacgaccccatgaacactgttctaggcggttttgatttgagctatcacacgtggcgctaacgtggcaacctagtcagcaaaaaaaaattaaaaaaaatccctaggcccacctgtcatccctttgtttaacccaacttctcccagcccccttgctctctctctctctcatgcgcgtactcggatggccagcggcggagctctttcacgcggctggggacggaggcgagccgattcccccaaatccagctatcgccgcccttttcttccctttggccgcccgtggaggaggcagccggagctcatggtgggcggcgacgcggggatggaggatagcgacggcgcggggggcgagaggtgtgcaaggtcggcgacggcgagcttcttcgcaacgccgtggttgcggagcaggaggagctcccactaggcggaggcccagccgccgccagggaggaacgaggccggaggcggaggccgcagagaggaagaccggcggcgtgtggtggcgagcgcggaaggacctgtccgcgagcgtggcacgcaccagcgcggcggcgggggaagggaggcggaagaggtcgtcgccgagcacctcgacggtgcccgtcgccggccctcgcgcgccgaccgtccacgtcgtcctgcgccaccgctacggcttgacccgcacgcgagagggaggatgagtgagagagacagagagtgagagaggagagagagtatgacaagtggaccccacaacatttttataaactaggaaggtagcccgcacattcgcgcgggcatctattgtggtctgcatgtttcaaaaacttataagaacataatattaaccggatagcaccgtcatacttcaaagtatgttttctccacaaatattcttcgtcggtatttgttattttccacaaatgtgttatctaactacttaaaagtgtttcacattgttgtaatgtaagcaacatgttgttaatcatatggtttaaaaatctttggcttttcctaaatatttatgactgaccaatagctagcctccaaaatatggtctaaagtaatttatttcttttacttgttaaatatactacatccgtcctaaaatgtaagtatttttagctatgaatctggacacacatgtgttcagattcatagctaaaaatggttacattttaggacagaggtagtagttaatttggattcgactcatgaaagtttactgcaaataatctaatgaggtgcacagataaaaaattagtttaggtggtatagttgtttagaaactgctatcacaaaatatgttttctatctaattaataagcataaaaataggacaatgggagagaaggaaaataggaggcgaggttgtgctcgtgcatgaggggggagggcgcagacatgcatatgtacggatataatgtaataggacaggaggattgggattgggccttttctctttttgtctatctattaagataaatctaatggtaaaaaaataatgattccatggtaaaaggcatatttcatataaattatgagtgcatgtgatttttttcaattatttcatattttattatgtcaattcggatgacatggaaaaaaaagcagggatgctgtctcttgacaaaacactatttaatagttgaatttctaatttttgtttgacattgtagttttaatttacatatgcatgtttccagaataatgtaagatgagaggaaggaggaggaaggggaggagacgttttttatttaaaagttttatatagatagattttatggttgaaaataataggtttatctatttaaatgaaaatcattgattaaatgtttctttcgcagcatttatagtactttttataatatattagatgtgccatgtgatgagctagaaacactataaaggatgtataataaatagatctgcatgatattttatggggatctgcttaacaaatctttattatataataagaattatatattaattatttatatactaagctgctagccagaaataaggataataaagtgagtaaggagagagagtagatcatttacgattgcataatatgtattaatatttagttattatataaaggatatgagtttatatgcaaatgatatatttcttatatatatacacacacacacactccaacacatggcataattaaaatcaaatatattataagaaattctaattatttaatattaatattttaatagaaaaatttgctacctataaataaatggaaataaagagagagaaggtggggaacgtacgtacggtatgtacgtgatggaggggatacggatgggttttgtgattttttttccttgttacaagatagatatctaatggtgtgaaacggtgggtccaccgtattaagggaaaatcgatggtcggatttttattttttccttagaatttctataatttgttagagcgccacatggcggtataggagcgtttgtagaagccacatggcggattaggagtgtttgtaggaagtttaatggacttttagtatataaagatagaatgctgattggactgccacgcgtacgccacatagaccaaaacctcagcggattgggtagagtggggtaattcgtccggtttgcatagttgggggtgaagaatatccggttttgtggttcagggggtaattcggtcgaccgcaatagttcaaggagataattcgtactttttcatttaatttatgtatctttgagtcgactaccttacctcaagaagctactgaagaaacgaatggtctttgatttgtcggttgtcacaaggcaagatcgatcaaatattcttcaaggaaaatgagtaggtttaccttaataatgaaaacaaatggcagcattggtcagctcatagaaaatgggagccgatcacacaaattaattagtgctgaatagtcgtttacataaaagaagacagatggaactgtatgatcagaggttcaacccagtaaattaagcagcattatcgtttgacttaaaattaattagtaggattgtattttagagcaccgtattaattggtcaactgtttgaatctctaatagaacggcggattattttttttaaataatgaaggattgatattggtcaacaggaacaaaaaagagataaagtcgtacacaagtttatactcctgatacagagggatacttaattttccgtggaaaaatacaacgaaccatgacaaaatccaaaattcaaaaaaattccaacccaagtcttctgattatttttaccggcattgctaaatagccatcgagagaaaattagagtaaaaaaaggtttgggtatgtggcacgaaatctcaaagctagccgtcctacgtacagtccataatgtgcaagattttagcgtcttttccttccacatcaaaagctacgtaggcctcgtttaattatttggggaaaaaaatttggatttggttttcgcatcggatatacggacacacatttaaagtattaaacgtactcgaataataaaacaaattacagattccgccagaaaactgcgagatgaatttattaagcctaattaatccgtcattaaaaaatatttactatagcaccatgttgtcaaatcatgtcacaattaggcttaaaagatccgtcttgcaatttatacacaatctatgtaattaggttttttttttctatattcaatactctatacatatattaaaacattcgatgtgacagcgtgggaactaaaccgcgcctaaacaaggccataggcatgcaattctcttacagcaacttttttttccttgaagagacaatgcgtagtgctgatttgactttgaggtctgatgctcatgtgcatgcactttggaggcgtgatttaggctaatcccaaatcgatggattacctgatcaagagggcgccgccacgcacgcacgcacgcatgttgccaacccgaccggccggtcgtgcacgcgcgcgtcggagtactgcgcagaacgtgcaacgcaatgcgaagcgcgacactcgcgtgcacaccaccgccggcggcgcgcggtgtacgtgcatgcgccgcacgtcgccggccgcgcgcggcggcggatttggcggccggatcggacgtgccgggaaacgaacgaattacagtatggccaagtttagttctaaattttctttttcaaacttaaaacattttcatcacatcaaaacttttctacacacataaacttttaacttttccgtcacatcgtttcaattttaaccaaatttccaattttaacgtaaactaaacactatatattaaatccggctgggctggccaatcgatggatgtatggtgtcccctccgtgcacgaacggctacatatatatgtcgaattgagtgtggtaaagctacatatcgaatcaaatctctcctcctagctatacatgctgtgttgactccattttatattttttatttttgggaatgaagaaaagaccatatataaatagcacgctgctagctgatcgatcgaacagccggatatactatatttttaggtcgtgcgcgtacgtgcgtgcatgcatgatctccgcacctctgcttccagcttccataattcacctagtttcatattacttccgtccaaaaatattgtaacttttggttataaatctgaacacacagttgtctaaatctattatctatctatatatctattatatactaaaagtccattaaacttcctacaaacgctcttaagccgtcacgtgtcactcctacaaacacacctaagttgtcacatgacactatctaaatctcattgttgattttcacttaaattggtggacccattattttacaccattagattagatctaatattaaaaaataatatcctcatgtacgtatgagtttgagtttgtacgttacaaatgccgctgctttctttccatacgtacaaacattgtacatgattgaaaataaaactttcctaatcttcactgaaaaaaaacatacacatgtacataaaaaagacagaaaaaacatacatacataaaaatcaacggtatttaaaatataattttctacaatataaagataaaatatattacttcacaaatataaatatatttagttaaattaagatctataataaatatccaatcaatgttcttatctattatataataaaagtacattaaactttctctcaaataaattagagaatccctagaaatctattatatactaaacatctattaaatgtcctgtaaacactcctacattgtcacgtgacactctaataaaattagagaaatcctagaaatttagagtaaaaaaagaaaaccatacaaccttcaattttcacttaaattagtggacccactattttaaacattagattagagctcttaaaattcccatgctgctaatctccatcttggaaaaaacataacttgcctacatcgtacgatcgcctccttcccgggaaaaacaaaacttaaatacctacaccatatacgatcgaaaaaagataaagccaaaaaaataaaaagaaaacatgcacacgtacatagtagtatcggaaagaaatactaattatgaaaaatcatcagcgtcagcactgatttgttatcaacaacctttaatctacaattgtattataaataatactacactatgcacagctcaacttaatcgtaaacttattatagtgataaatatatcatgacaaatgacgccaacatgtaatagttaatgcgtacataatgtttcaaataatttcatatcatattttatggtgtcaaatatcacttgacaaatatacaatgttaatttgaatctacatatgtaaaaattaaaataacaaaacctagcattgttttttgagtatatctatttaggtttatttaattttggaagagtttgggattctcgaagtatttggaatttttcaaaacttttcttatttgaggtgtgagaagcacaattaatagattgatgggaaaaaataaactaaattttagcaagtgataataaaacaatagaatttagcttcggtttttaagtggatatttttaggtttattttgggtgatattgagattctaaaggtatctgaaatttttcaaaacgtttttattgttatttgaggactgagaagcatacgtgatagatagatgtgaaaaaaataaattaataagattttagacagttattttgctagaatacaactcttgattcatcacgagaattatgtattatctttgctaagtagtattggcaaaacatgaataatccaataaaatacgcataaaactacttatgctatatttttttatagttgatagaaattctaatataccggatatatagttgacaaatgttatacaccacagaacccaactgtatgtgcactctagcgaattagttagtgtaaataagtttgtgaaaataagtacattcttttcgaatgaaaaaataagtacattcttagaattagtaaatgagtctcatataattataacaacatatggtggaaacaaatttggcgctaaagtataaatatttatcaaaatataaataatgatatggtgttttgcagatttttatggtggtacgtctctttagcttttttttaggtagtggcgaatgattaacctcactcatttaaaaaacatgatattgtatgtattccattaaaatttgataagtacttattactaacttcatatacacattttgtctattctctaccacaaatcgactcaaattttttttaaaaaaaattgttttcatcacctcctccttctttctgtcctctttgtcgttcaatgcaggatgcaatacttgctatgctatcatatatattgcatgggcatgtacatggttgagttaaggtggtgtccatgaaaggctattgtaggcaatgtaactaaagtgacatagttaccaatataatcatttgtgagtgtaccaatagtgtactaagtgttataattgtactgtatgatggtttttaggggcatggctacatcgatgcgggatctatatgttttaagacattacatatatacttcatccattagagatgcattcttatcatattaagtatggtatatttatactatttatacatgtgaaaataagtgatgaataccgggttatgtagtgtagatgaattttttagtgtattaataatgtatcatttgttttagtggtactaatacagcttcatttattaaaagttcacataactcttaaaacgatgttagtaaacaatgatagtaagtagtaatgacaaacatcccgtttatatatgatcaggataaatggatttttatttaaatctaagagacatttttatcacattagtagtatattaaaatctaccatctattttatggtaaatatatttattttttattgtaggatgatctaaattctcttacactatatatatatatatagtgatgtatgattctttttagcattttttttaataacaaataagatggctgtgcatttatgcgaaattcctttccgatttatattctgaaaatgttctatagtttatattccgttgttatagtgtttgaaacaatacatgcctgcgcgaatgcgtgggctatctttttagtttatagttaaaaatgtttatattttgagatggagtaatagagaatgttttatcctgtccagattcatctgaataatccagaattacgatgagtgaaaaataaacaccgttagtacgtatcatctccctcgtcggccgtgattcgtgcccataaatcaactacttaactttgctctttgctattagcttgaatgcgtatacgtgaccatataatcatatacggtctccctctcctctataaatacaaaaaggaaaaataaataaagctgttcatcacattgtacgcacgtacgtacggcacaatttaattgacccacaagtggtttatggttagctctaaattattactgatggggtactaccactagtggtagaagcactactacaacgagtacgccctaattaatgaagactccattgatgatggacgagacgggacggcgtcacgtgaggggcgcgcgccatctccatcccctcacgacgcatccgccattaattaatgtggttcgatcacgtacattcgcgcgcgctggatagatacgacgccatcaatatcgatcgctgtactccactctgcatgcccccactactctgctcgatcctcctcagttactaccactgctctaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaacgaacgtgccacacctgtttggcagagcttccgacacttttttttaaaaaaaaactaaaactctccgaacaatttagttttttacagattataagaaaatgtagatgtagaataaaataaataaagttagaaatttaaaagtccagtttttttaaattctcatgaaatatttcttccgtatcaaaatataattatttttagctataaatctggacaagctaaaagttattatattttaagacggagatagtagttaccaagcaaccatttctcaaaatattgtttagagagctttgcatcggatatagcttctcttataatctcccggtcatcaaacactctagattctcacatactccctccatctccaaaataatattttttctcatgtgacacatcctaggaggagcctgtcgagattcgttgtaatatgatatttcgagaaggatgaagtaactttgaaaaaaatatcattatagaattcaaaaggtgaactataattcagaagatgaattataagtcagaagctgggtgttttagtttaaacagctgtttttaagaatcctaacctctctcaaacacaaccctagacaagctctttcactacatgttatcagaccactaataggtttttgtaagctagaattcctatatcgtatattctcatgagtggtgaaatagatgtagaaacgtatgatttgcagtaaacaaaacatcgcactacgttacaacccagcagtgggcatattagcgtatactccagagtccagacacagccaaagtcggcaaagccgaccaggaatatacaccacatattcgagtaattaagaaccatattgggaccttgtcagattaactaatctcccatatcaacactactaataaccgtccaaattaatgctagttgtagcagcattgtacaaatttagagccaatgcacagctccaaatccggtaagatgctgccggcccctttgtccatctcgccgtactccatctggccatggcgaaaatacaatctccattctaaaattaaactcttcttttattcatctcacaataaaactaacagccccaccgtttggctttttccttgataaaccaaaatggcttattaggaagtaaaaataaatttgtaggtaatatatatatatatatatatatatatatatatattcttggtgacttaaaagtcaatgctgaaaaaaaactacgttgaaaatatcttaaaattaagtttgaaaatttaaaattacctttttctttggctgattagacgattcgatgggagcctaaatatcctcatttttatcaaattcgaatacaattatattattctgtttaccaaatcgaatatccacgctgggaatggagtaatttccacgtcggatcgtgtcagaggagtaactaaatactggtactcctaaataaagtggatttaaagggaaaaagcagagctgagcacgcagcattggaagctccaaaagatgtggatccgtgtttcgtgctgctgcaccgcaccgcaccggcgaggcgttgttgggcgacagcgacgcgacacggcgcgggaggcggtggagtgaccgaaatgcccctggggatcatctctgaggtggccgtggttggcgagggcagtttggtcagtttaagggtgatgggatcggtttggttcggtggagcaagatccggaccgtccgtagcgacggcagcagaaaagaaaggcagccgaacccgggtggggcccgcacgacagctggcgcggagacagacgctacgcaggcacgccccctgggggccccactcaccagctcctgttcctgctttacttgtcgttgctgttggcatattttcaaatattatttcttccatattacttggtggttttattttcctattagtagtagtaatgttgcttctggtaatagttgtgtgtgctgtttctcgactggacctctctaacaaaaaccgaaaataaaccttttcttctgctt

SEQ ID NO: 62134 - DNA, 7353 bp, Oryza sativa
cggcgtccccgacccccgccgtgtccgtccagagctgggcggagcgcgggtactcggtggtcaccgtccagtgccgcgaccgccccaagctgctcttcgacgtcgtctgcacgctcaccgacatggactacgtcgtgttccacggcaccatcgacaccaccggcgaccaagcgcaccaggagttctacatccgccacgccgacgggagccccatcagctccgaggccgagcgccacagagtgagccaatgcctccaggacgccattgaacggagatcactagaggtatatcgaagccaaatcgacccaaatttccaacaccaagatgcaattcgttaattgatttggaagatgacgctaatgtgttcgatttcttgggtgtttcagggagtgagactggagctgtgcacgccggaccggccggcgttgctgtcggatgtcacccggacattcagggagaacgggttgctggtggcgcaggcggaggtgtccaccaagggcgacatggcctccaatgtgttctatgtcaccgacgccgctggccacgccgtcgagcagagcgccattgatgccgtgaggcagagggttggcatggactgtctcgttgccagggaggagcaccggccgcagctctaccagaaagctgggccgcgcgacgccgtcgatggcaatggcggcggcggcggcattgggctgttctaccttggcaacttcgtcaagaggaacctggtcagcttgggattgatcaaatcgtgctcgtagacatgaaaacaaaatggagaatccaacaagaacacaacaaattcagtcgagacagcttgttcatcttgcttgctgctactgttgtacgtacaacattctgaaacacaacatgaaaggtgcagaagtggctgatgaaatctcaggcatgtcacattcggatcaggaaacagagattgcaagattggtgacatacatccattaatggagaatcaagatccatggtagccaagcaagagttgcccaagggaggaggaacaagatgatactagagtactagagcctagagcctagcagtagaaaagttgggagagctatgtacatagggggaatttgatgctgttagtggtactagtgtgtagtgagtgcattcatgatgttcttaggtagagacagtagacaaacaatggaattccaggacggttggttattctgtactgtgctgtttttctgcccttctttggcaaaacaaaattctttgggttcgttagctttgcttctttctttctgtctgatgcttaacagtgtgtgttaatgcttttttcagctttgctgatggattatgtgactactactactatggtaattctgatctttgcttttgagtagtgtgattaagtggtggtgttgatcattaggtgtagcttgcaagggaaacaagatgcctgacttgggcctgtgtgagatagtagtagtaactggcaatcacagcaacaacagcctgttcttgcaacattgtcttttccttttgtggtatgtctgaggttgtgattgcagtggtgcgcaccagtgaggcccagtctagtttccaaaaagtttttcccgaaaacatcatattgaatctttagacacatacacggagcattaaatgtagattaaaagaaaaactaattacacagttagggaagaaaatcgcgagacgaatcttttgagcctaattagtctataattagccataagtactacagtaactaacatgtgctaatagtggattaattaggcttaaaagattcgtctcgcggtttccatgcgagttatgaaattaatttttttcattcgtgtcctaaaaccccttccaacatccagtcaaacgtccgatgtgacactcacaaattttcatttcgtgaactaaacaggccctaaagttactactattcatgggcatatggacaatgcagaattgcagagtggtaaatgggtacaattatattgcatggaaaaggaaatggctatatatgtatacaacgtttttctttataaaacttttacgacatgctgtgagtatgagtaaatctagattttctgtaactcgcatggaaataaggtcacacatgaatttcagaagaaacaaggttttttttcccaatcatctgtaaacaaggttccaaacaagagcctaaaccatgttcctttcttgaagttctctcccaaacaagaatctggttgccatttagctttcagaatgcccagtagcaaccatggcatgatttggacataagatttgatttggtaaaccagcaaaactttagctttgcctgaaagtttcggagtttcattgcaaagattccattagtcaaatgcctgatactgcgaaaagcaagagcttgtcccttttcagatatcagcatggctcatgccatcatgcgtccttgtttagtgctctcaatgctctctgaataaataaaaattcagatcagcagccggttttgtccaatccacaaccaccaactgcaattaaacactcaactaaccaaacaaatcctgttctgtccatgttgtgatgacctaattcttggttaaagaaacaccaattgattattcctcatgaactcagctctgatctgatcagatgggagagcacatacgaacaagaacaggcatctgcatccagcagaaactccaggccgtttgcacggcttctcaagtgtggcatctccatcaaaaccggcggcagagcttggtttcatgtggttgtgcagctttctaaatttgttctgttttgttgttcttcctagcttgtccactactgttgtcttgtgctcatgctgttatcttgatcagtggctcgatcaaaatggctttcttggctctctgccatgtgtatcggtacaggaggagtcaaagatggggtcatctgatgagacatgaactgaaggacatcacttgtgacaaattggtgctgacttgtgttcatgtctgaatgctagctagcagcaactaggacaattgttagtccatttctgctttgttggacaagaactctttcatcttcagacatggcaatgcatcgtactaatccaattcactgtttgcactgtaataatcccccatgcatgttctgcatcagggtcagattgggagacatgaaaatgacagggagcagttccagtttgctacaggagattgtactagtctgaatctgaaactttggcgatgtcaatgtggtggtatccctttggtttcagacttttgagtacagacaattacggttcatacgagtaattagcggcaacaattaagcgcaacatatgttaataataagcccactaatcagtatctgactaattaaatctctgacaggcacggagaaatctaaattgacgcctgaatgttaacacccttaacgactaatccctggacatctgcatctgcatctcagacagcaaaggagaaaacaacaagagtgtgagctagggttcgtcgcatgcaagcattcgtcgtcgtcgtcgtcgtctacctcgatcttgacccatctccggagctttcgcttgctgctgctgcttttggatccttgctgctgttcctcttgcggctgcctgtactttcctggctagctaggtagagtagctggctatctttaggctttagctgtgaccagccaatatcatcagatagctagattagttaaaagattattattagtagttaattaagcatgatactagtactagtagtatatgcattggggatgcagattaattagttgattagtgatcgtagctcccactccccaatgtctccaattccaaggaccaagaaacagacatgtctgcgagttcgaggttgctgaaccttcaatcccggcagcgtttttctgtcgtctcggctaatacgaatttaacacaaacagcgccttcgcttccactccaaactgcctcctgcaactgcaactcatcctgtagctgtagcagtacagaaaattcagaaagaccctgcaaacatctgtctcaagctcaaagacttttaacgaatatatacgaccaaccgatcaaaagaagatttttaaccagttcttcaaaccagcaattcaaatgttacttgcaaaataacctcaggcatgaaggtcattaaaatcgtgatcttaaatcaaaatcgcaggtctctaaataggatcgcaatcacataaccttatacataataatcgtagattctacttattagaatcataggattaggtctcttaattaggatggtaaagtcgaatcgtatgacaaaacctagtagtatattttaacaactatcaactactcctgtagttagttagtatgctgattaaagattaagcatgacagaaactagcacagattaaagctagttcttcaggacttcaggagtgtctgaaccatgattaacgagggtgtgttacttattgtacggctctgatcatggctaattacttaactaattacttgactagaccactaatcacgtggccgcatgagccgctgattggtcagcctcttgcatgcatgcatgcatgggctgtctggttggcgccttttcatgcacgcagccttgtctctctcacatggtcgcccttaagaccgggaagctgtctgaattctcatgtctctcttcactgacattgcttctgcttaaaccttttcttgttgcagctgctaatttaatccatccatccatccatcccagcttttgttgctaagcacgcacttgatggctttattagcgctaactctagcttaattagctttcttccaccgtgggctaatcatcttcacaacgactctggctctggcctctctttttgaccggtggtgatgatctggagaagaacatgtgcgtgccaatgcagtgcgaatcttggcgtgaagtttcgtcagctgtcactgacatgtgggccccgagtatcagcattgtgtttggatgtttcacctgaagattacccggtcctagctgctgaacttctgaagattaagattcagtagcccaaagctagcttcttcagtagaacttcagtgaagttgggcccactgtcagtcagagaagaaaagaagagagcattcccatatgtacgaagattaacaacatgtgtacagtttagacaacagttaattagagtgaaaaaaaattctaatgctaatttaataaggggtacaccaggagcaaattaagtggagtaatccaacaaaatgaaaaagaagcctagagacacacacacacacacacagaactaatagtacaattctgcaggtcgactatagaggatccccatctccaataagaccgacatggtgttacaaggaagcagggtagcctgatgcttaaacagtgactaatatcgggacagctacagcaattgcagttagactcttctgcctgaagatggaaaacctactggaactcagatacatcttttacaagtcagaaagaaatgaagccatctttggccgccaccggcgatcatggtgtgcggctgcagcagtgacagaccaggaatttcatggatcctggtcagttcatctcagtttcaggctccagaggcggtgaccttcacatcgcccgatggtgttctcgcgctgtcaggtatcgactgagcaggagatgcccagctctggtctgggttgtatgctgaggttacgatgtttgttgttcttggggcgacggagctgtgctgcccttgctcgctgctgtgcgtatcggtactagagattggaacagcaggaggagtctgtgcaagggcgggtgccgcttccaccctaggcttcttattcttctgttccatttgatagcttggtaggaagcttccgacaacaatctggaatccaaatgtatattagatggcatttcaatcacctcaacacagataaatagtacaacaaatggaccgtgtttgctcgatttatcagacaaaacatggaatgcgtttctgccaaaaatgggatccattcagatctcaattgaaggtaagaaaaagcacctgaacaggacttgctgccaccagaaggccagcaactccaccaccgacaacacggccatctgggctggcaagagaaacgctcatcccacctgaccgactccgtgttccgctgttttcagtaggcataaacgatccagacaaagatagcaactcaaaacgtccctacaataaaaataggggagatcagctgggaaccataaggccaatcagaaaattttcatctttagacaaatatacgaaatcatgtcatggtagatctgaaacaaaaacaaaaaggcatgtaaagcatcgctgtgtatgtcaagagtaggtctacaaacctcgtaagttaatgtgccacccgaggaatcaggttgacgcagtgtaacgtttgatatcacaccattagcagatagaatacagatagctcgtggtccttgttgagaaaatgatatgaccttcatagtcacatcctgaattacatgcaacaaacatcagtaccacatattattaagactttcaaaaagaagaattttagaaaataaggagcatagctataactatgcaaatatttgcaagaatagaagcattttaacaggcttgaaggccaaaacataatacatagagaagcatatccagtctgataaacaaaattcgagcatatccaaaattcatatcaaggtttgcagcccacctaatctaagcaaagcagtaaaaactaaaacgcctttcatctgtttatgtataaaacatgatatagcataaaatgtttcaaaatacataaaatgatgcaagtaatcacactatgttgcagaaaagcctgaaaccatatgattcacaaccataaaaccttcaacaaaacagtctgaaaattttacttgctctgtagtacagtattattcaatcaaattcaagtaaagaacacattcaatcattgtcaacaagaactcatacatcttgatcaattgaacccaatgtaagatgccagtgaagacacaagaaaacgttgatttttacatacctctccaggagcaacagtgatgatgtgaggagtaaaattcgcaccagcagaacaagccaccatttcacctgccagtacacacaatggttaacaaactgacggcaggtaatttcgaaacgaggtaaaaatgctcaagagattgcaacaagcgcaacgcgactacagcagcccgcggacatttccatgacactgaaatttcagtactttatgcattcatgatgcttgacaacgctagcatgctccaatccaaccattccagctcgtacaacctgccagaaagaccagattcgccaggacatcgcggccttttcgtgttgccatcagcaacggcagaagcacaacagagacagggatgatgattgatcgaaaggtaccgg

SEQ ID NO: 62135 - DNA, 1022 bp, Oryza sativa
cgatgacgacgacgacgacgtcctcctgcagtaagatgatggggacgacgagcggcggccgcccatgacgccgccggacgccgcgtgcgcgtctcgcggggtggccgccgcggcgactgccgcgccggcggcggcggtgagcagcagggagagctcgagagggcttctccttccgccggcctcatggtgggagctgctgctcccggaggaggaggaggccccctcgcgcgccgccatggccgccgccgcacggctgggccagaacaggaggcgggatccgggcggcggccgcggcagcgacggcgtcaatggcggcggcggaggcgtgctgatgcatggcgttctcgcgaggggatggagcggcggagggcggcgcataccggcggcgatcgccgtcgagaagcgggcggtgagccgaggccacgtcatggttgggtttagctagctagctagggtttgggagcgatttgccgtttgcgcgtaatcaccgtaactttgccctaataatctaatctactgcaaaaattacttgtgggtcacgccattaatttgctttgagatcggtgatgacttatgacttatgagtgcacattcgtgatgactttataacagaagatgaaagggatggcaactttgccgcggatacccgacccgatttgcatgagcgttggtattatttgtgatgttaactgatataaaaagttatgatgtaattcaaattatcgttgataactgatctctactattataaaaattaaagatgtttttgccggtacttttgatacgtcatctgtgtttgaatcggtttttaagttcaatcgtttttggaaatacagatccgtgtttgagttggtatttaattttgttcatttttagaaatacaggagtcgtataagaagtctctttaaaaaaacttgcatgctaacttgagacgatcgaacccctaattgcggttgatgattttgtaaaaagaatatgaattcccacagtgaattttcaccttagcttaaccatacaacaat

SEQ ID NO: 62136 - DNA, 747 bp, Oryza sativa
tatagggcgaattcgagctcggtacccggcgttttagtttttactgctttgcttagattaggtgggctgcaaaccttgatatgaattttggatatgctcgaattttgtttatcagactggatatgcttctctatgtattatgttttggccttcaagcctgttaaaatgcttctattcttgcaaatatttgcatagttatagctatgctccttattttctaaaattcttctttttgaaagtcttaataatatgtggtactgatgtttgttgcatgtaattcaggatgtgactatgaaggtcatatcattttctcaacaaggaccacgagctatctgtattctatctgctaatggtgtgatatcaaacgttacactgcgtcaacctgattcctcgggtggcacattaacttacgaggtttgtagacctactcttgacatacacagcgatgctttacatgcctttttgtttttgtttcagatctaccatgacatgatttcgtatatttgtctaaagatgaaaattttctgattggccttatggttcccagctgatctcccctatttttattgtagggacgttttgagttgctatctttgactggatcgtttatgcctactgaaaacagcggaacacggagtcggtcaagtgggatgagcgtttctcttgccagcccagatggccgtgttgtccgtggtggagttgcttgccttctggtggcaacaagttctggacaagtgctttttctta

SEQ ID NO: 62137 - DNA, 905 bp, Oryza sativa
aaataggaagacgcgcttgtctttttcctgcgggtaaacgctgacgtcttcgcatggagaccggcggatatgcccggggtccccagggaggtgattgagcaccgtctcgccgtgcggtcgggcgcaaggccggtccggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccctctgcctcgcatagatcagattgttgactccacagcggggtgcgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactactcgaaattctttgggtagccgaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagct

SEQ ID NO: 62138 - DNA, 1183 bp, Oryza sativa
caagaaaagagaacacaaaaatccgagccgtcatagctagctaattaactagaagctactaattaactaattaacagcgagctagtggtggtggtggtcgtcggaggcgatggcttcggcgacgaaggaggcgaagtcgccctcggtggcgcaggggatggtgaggccaccgcagcggtggcagtcgaagccgaattcctcctccacccgcttcagcagcagcacgaacgacgggtgcttcaggtaagccgtcgggatcacgaaccgcttccgcctctcgccgacgtacaccgcgaaatgccccctcggcacgtccgccgccgccgccgccgccgtcgccgccgacgacgacgacgaccggctcctcgccaggtgcatcctcgacatcagctggtacagcttccccgccatattatcacagtgatcgatcgagcttgtttattcttgcttgcaattaactgagctggtgatgctgctgtatgtgtttgtctgaaatctgaagagtgaagtgaagtgaagtggagagtggtgagaggcaaagctgcttatttataggtgagccgtgagctcgatgatcactcgatcagcatcactgcagtagcctagcttctttgttggcaagctggacatgtcacatggacgcatgcatggtcatgcaatataaaaagagagagagaactttacggtatatactgcctctatatactagtagtatatagatgtgcaaaaaggatagaaaattaaaaagcactttcgagtaatttcgtggttgagagttaatccgatttaattgggacatgctcatgccgtcactggatctcatttatgcgcatgagagacgcattgcagtcgaacgattgctgctcaattctaatcattatttaaaaaaatctatgtactttggttatgaccaattaccagttaaataatataagttacatagcaggtgtgtgtaaaaaaacttataaattttaagtgaaaaaataaagtagtttatactattaaatcatttgtactcaatatattggaccatacaagttcttatgtagttgtgcctacatatgtggcatggtcgtgaatataatgcagctgcatccatatagatgatcgaacctggaccagctgccaatgtctgggttcagcaactatgacacagtacagtgcattgtacatggggatcctc

SEQ ID NO: 62139 - DNA, 1367 bp, Oryza sativa
aaaagcccatctcaaaattcgattccaattccagttcgtctcgctcgccgccaaatcgccccctcgctgcctccgtctcgcctcgccggcggcaatggagtggctggacgagtacgagaagctggtgatcaggatgaacacgccgagggtggtgatcgacaatgctgtgtgctcgacggcgacgctcgtccaggtatgtacggtggcgcggcgcggcgtggcgtggcgtgggtttggttcttgggtcaatctggtgcgtgttcttgcggcgagggttgctgatttggggatgtgcaggtggacagcgcgaggaagacgggggtgctgctcgaggcggtgcaggtgctcgccgacctcgacttgtccatcaacaaggcctacatctcgtcggatgggaggtggttcatggatgtcttccatgtgaccgaccgcctcggttgcaagctcaccgacgacagcgtcatcacctacatcgagcaggttggtgggtgttcttggtggtttctttgattctggcgcgggtgttcgacggagttggggggttttctgatggcgtagtacatggcttcgttgcagtctctggggacgtggaacgggccggcgcggccggcggcgctcgaggggttgacggcgctggagctgacgggggctgaccggacggggctcatctcggaggtgttcgccgtgctcgccgacatggactgcgccgtcgtggaggcccgctcgtggacgcaccgcggccgcctcggctgcctcgtcttcctccgcgacgaggaggccgacaccgagaggatggcgcgcatcgaggcccgcctcggtcacctcctccgcggcgactccaccggcgccggcggcgccgtggccgccgtccccgccgccgccgtcgcgcacgccgagcgccgcctccaccagctcatgtcggccgaccgcgaccaggaggagcgcgcggcggcggcggcggcggcgtccccgacccccgccgtgtccgtccagagctgggcggagcgcgggtactcggtggtcaccgtccagtgccgcgaccgccccaagctgctcttcgacgtcgtctgcacgctcaccgacatggactacgtcgtgttccacggcaccatcgacaccaccggcgaccaagcgcaccaggagttctacatccgccacgccgacgggagccccatcagctccgaggccgagcgccacagagtgagccaatgcctccaggacgccattgaacggagatcactagaggtatatcgaagccaaatcgacccaaatttccaacaccaagatgcaattcgttaattgatttggaagatgacgctaatgtgttcgatttcttgggtgtttcagggagtgagactgaagctgtg

SEQ ID NO: 62140 - DNA, 16867 bp, Oryza sativa
  unsure (1)..(16867): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacattggacctcaggaataacaccctttcaggaagtgttccttctggtaattatcattaatcattaaacaaaaacagttttaatagaaaatgaagagtttaaccatggtgtcatcagtaattgtaattagttagttttgtgtttcatctgagtagaatccattgattattgtaggcctgaagaaactgaacgaggggtttcacttcgataacaattcagagctctgtggagctcactttgattctctgaaaccatgcgcaaacggcgatgaagacgataatgaagaaggcagtaaaatggctcgtaaacctgaatcaaccaatgtcaagccactgcaagctccacagactatgaatgtgaacagagactgcgacaatggcggctgctcaaggtcatcgtcgtcgtcgacgacgctctcttcaggggctattcttgctggaacaatcatcatcatcggcggagcggcggcgtgcgggatatcggtgatctcgtggcggcgccggcagaagcagaaggtcggcggcggcggcacggtggagagcttggaaggacgagctagtagtagcaatgcgtcgtcgtcgttgatcaacgtggagtactcgagcggctgggacacctcgtcggaggggtcgcagcaggggctccggctatcgccggagtggtcgccgagcgtgaggtacaacatggaggaggtggagtgcgcgacgcagtacttcgccggcgcgaacctgctcgggaggagcggcttcgcggcgacgtacaggggggccatgcgcgacggcgcggcggtcgccgtgaagagcatcggcaagagcagctgcaaggcggaggaggccgacttcctccgggggctccgggcgatcacgtcgctccgccatgacaacctcgtcgcgctccgcgggttctgccgctcccgcgcccgaggcgagtgcttcctcgtctacgagttcatggccaatggctccctctcccgctacctcgacgtcaaggacggcgacgtcgtgctcgactgggccacgcgtgtctccatcatcaaaggcatcgccaaaggtacactgtacttcaccgtgctccgtttggtctgaaatatttaacgtttaggaaaaaatttggttaaattgttgagatttaatcatgaattttatatttttagaatttgtagacaagattcgattgaaatgttaaaatttggtcatcattctcatattaaaaaaattataactaagatccggttaaaccgttaaaatttggtatgaatttattttaatatgaaattgatgaccaaattttaacggtttaacggatcttatttatattttttgcttttgaactaagaaaataagatgttatttttgtttttaatctaagcaattgagaatttagttatagtcagaattttaaatgtttgacggaatgtacattgttctgaacgctagtaagagtttctcttttctgtttgaactacaaatttgaagtttttgtttcgtttgttcggcgttgagattgactgatttaaatttgaaatggcgaatttgttcaggaatcgagtatctgcacagcagcaaggcgaacaaggcggcgctggtgcaccagaacatctgcgcggacaagatcctgatggaccacctcttcgtcccccacctctccggcgccggcgagcacaagctgctcgccgacgacgtggtgttctcgacgctcaaggacagcgccgccatgggctacctggcgccggagtacacgacgacggggcggttcaccgaccggagcgacgtctacgccttcggggtggtggtgttccaggtgctgacggggaggaaggcggtgtcgtcggagctccgcctcctcngcggcggtggcggcgcggagtactccggcaagctggacgacctcgtcgacccgcgccttcgcggccggttctccaggcccgaggccgccaagctcgcgggcatcgcgctgctctgcacaagcgagtcgcgggggcagcgccccgccatggccgccggtctgcagcagcttggcgccacccagtagtgacagcgtcaagctgccattgtcactgtaggttcaccttgtattattagctaggtgcctaggtgttgtaggagctagctagctgccattgtcgttcttccaagctccaccttcggttcctttctcaggaactcgatcgtttgcaagttagccattgttacatttgccagaattgaagaggttactgcatgattaacactacaataaaattttccatatatgttttctttttccaaacacaaacatacaagttcaaattcaaactatacaattaatactattgactcataattttattttcggaattgctagaaatatggcgccatatgctacaatcgatttttttttcagccacttagttacacctcatttacaccccacttacatatgtaattagtatgtaattttcgaatttacatatgtaattttagtacttacatatgtaattctgagacttacattgtaaatacactaaaattacatatgtaatttagggacttacaatgtaaatacatgccgactattttttgataaaaaatatgacgccataaatatagctacaccctttatttttttaacttatatatttgtgaaatgatatactccctccgtcccaaaataagtgcatttttgtactatattcatgtccaacgtttgaccgttcgtcttatttgaaatatttttatgattaccatttttactgttattagatgataaaacatgaatagtactttatatgtgactattttttttagttttttcataaaattttcaaataagacggacggtcaaacgtcggatacggattttcatgactgcacttattttgggacggatgtagtattacatattgatctatcttgttgaagatttttttagtgatactcaaaaacgaatggacgtactttcccaaataataaagctacaagtaatgtactcattttgatggagtaactttgaatctggcggttagttcgatcttcgtttgatgaaacttgagagccaattgtgcgtgctgacgagggcgacgagaggaagccgagatctttgtttttttttcttttttgcagtgtgccggtaaatcagggcaatgtgcttggtttgaattggttttgaatgcgctcatgcggcgtgcatgtaggatgttgatttcggccatgatttgaatgccaccgtgacgaggcattgaagccagtggcccagggatttgattactcttcttgcaggttgacgatctactgtgccacactgccgctgcaggggtagagggtagtgtgtttgatgatgagagaattgagaggtcagaggaggcgcttcagctctggcattaaactctgacgaacatgcatgttcagattcagagtgcagagtccactagtatttcggaatgtaaaaaacattaagcccagtttagtttcaaactttttcttcaaactttcaactttttcatcacatcaaaactttcctacacatacaaacttttaacttttccgtcacatcgttccaattttaaccaaacttttaattttagcgtgaactaaacacaccctaaatcccctcgaaattttggtgaaaacttttggattttgaacacattattgacaaattcaggggaagaaaagtaggaacttatctagctggaaacacattgttagcaactttttgtgacaagtcaacgagcacgattgtagcacctaacgctttgcggtgatcttaaagtcgccaaacacctcaatctagcaaaagctaaatcaagatgggttttgataaactaaactggctagcaaagccgatttagatgaaactatggataactacctgtctcgtgagcaaaatggaaggtttttaggacaaatctacaaagaggtgtcgcactctcgcagcgacagcggatgatttacagcgcaaatcgacaaagatggatagactaaactataactagaagtaaaagaacgattcgattgattgatagttgattgtgtgtttacaattgaaccggccttttcccttacatagggggtggtcttgtcctctacaggctctcctccaatccaactcaggatagaatccaaaggaaacccgaaacatgccttctcgagtaaagaaacctcgagacccgacgaaacggattcggacttggactctgccgatcagaccggccaccagtctgaccggcctactggtggcggtcagaccggcctacccaaaggaaaaccggcagaactccaaactttggcaattttccctattctattcctaggtgtcaaatttaggtgtaaacacacatcctacccaaacccacgtatatataaacccaaaattttgggaatttcgattggacggagagcgttcagtagttgatgaactgggaatttccacatgttctgaattgaacccatgacgccacatcaaattttgatttaaatttcaatggcaaattgttagcccttgattgagtggctggtgctccacgtttcccgccaaaacgtgcaacgcggcgcgcgccatcatgcacggatcgcgtggccaatgggaaatttttccccgtttccttcggatcgcgcgcggccactccaccggactccccgagctcgctagctcctccggccacccatgtcgctggcgccgccggccgccagggtgcacctgcaggaggtggcggtcaatgtcaacaagagcctcttctgcttcgaccacgactccggcgccacctcctccggcgtcttcgccggcgacgaccccctcaagttctacttccccctcttcctctaccacgtctgcaccgtcttcgccctctcccgcgccatcaacgccctcctccgccgcgccaacgtccccctcgtcatctcccagatcctcgtacgttcgcgcagcgtcgtcttcttctccgtctccggcaaagctcgccggcgtttttgattggttgatttctttttcaatgtgtaggccggcacgcttcttggcccgtcgttcctcggccacatcgcgccgcgcgtcggcgagctgttcgcgacgccggaggggtgggtgctcatcaacacgatcggcggctacgccttcacgctccacatcttcgtcatcggcgtcaagacggacctgggcatgatccgcaagtccggcaataaggcgatcgccatcgccgtgctcggcaccgcctcgccgcacctcgccatgtacatcaccggcctcgcgctcaaggcgcgggtgccggcggcgtgggcggcgtcgttcctcctcacaaacctcaactcgtggtggtcgctctcggcgttcatcgtcgtgtgctgcacgctgcacgacctcaacctgctgtcgtccaagctcggccgcctcgccatgtccgcggcgctcatcggcgacttcgccaacaccttcgccatcgccggcgtcacctcctacctcctcgcggcgagcccttcggagaagctgcagcggatcggcatcgcctccgtgatcgccttcacgacgttcatcgcgttcatggcgctcgtggcgcggccggcgatcctgcggctgatccgcgacgtgccggagggcgccctcctcaccgaggcgcgcctcatcgccgtgctgctcatctgcctcacctgcagcttcaccggcgagctcctcggcctgcacgccacgtacggcccgttcatgctcggcctgatgctccccggcggcgcgccgctcggggtgaccatggcggagcggctggaccggctcgtcgccggcgtgctgatgccgctgctgttcgcgcagggggggatgcggctgaacgtgaaaaagatcaccgacgcctcgacgtgcgccctcctcgagacgttcctcgtcgtcggcgtcgtctccaagttcgtcgcctccatcatgccgtgcctctacttccggatgcccgtccgcgacgccgtcgtcgtggggctcatgatgaacttcaagggcatcacggaggtggtgtacgcgtcggcgttcgaggacgcccaggtgctcgacgagcaggtgtacgcggcgttcatgatcaacgtgctgctgatcggcgccgcgtcggcgtcggcggtgaagtacatgtaccacccggaggagaagtacgtggcgtaccggcggcggacggtggagcacaagaagctcggcgaggagctgcgcgtggtggcgtgcatccactcgcaggacgacgtcgggccgatgctggcgctactcgacgcgtcgtcgccgacgccgatgtcgccgctctccgtctatctcctccacctcatgccgctcgccggcctgaccagctccgtgctccggcacttcaagcacggcaagcgcaactgcgtgccgtcggggaccaccgactcggagcgcgtcgtgaacgcgttccagttcttcgtgcagcagcggccgccgggcgcggcgtcgctggtcccctacgtgtgcatcgcgccgtacgccaccatgcacgacgacgtgtgcgccgtggcgctcgagaagcgcgccatgctcatcgtcgtgcccttccacaagcgcctcgccatcgacgggtccgtcgagccgacgtcgcacaacgccggcgcgatccagccggccaacaccaacatcctcaactactccccctgctccgtcgccatcctcgtcgaccgcggcagcctctccaccgtcgccgccgccgccgccgcggccgacgggttcccgcaccgcgtcgcgctctacttcctcggcggcccggacgaccgggaggcgctggcgctggcggcgaccatggccgaggacgcgacgatcgggctcaccgtgttccggttcatgctgccagcggacaggcagagccgcggcggcgagggcgacggcgaggaggaccgccgcgacgaggcggagctgcaggagttcgtccggcggtgggtcgacgaccaccgcgtcgcctacagcgagaacatggtcggtggctccgacgagatggtggacgtcatccggaagacgagcccggcgttcaacctgctggtcgtcggccggcgatcggagagcccggagtcgccgctgacggccggcatatcggactggagcgagcacctggagctcggcgtcctcggcgacctcctgacgtcgacagacttcggatgcagggtgtccacgctggtggtgcagcagcagaccatggcggcggccggagaatcctgccggttgccggagttgcctgcaaagcacaaatcagatgaacctgtctgacaaatcatgacactctttatctctagttgtaagcatattttactgtgttgtaccactaacatcttggcagctagaatgcaatctgtagcaaccatgccttcctagtcttttctatgaacacgctaatatgtttataatctcatgattggatcaacagactaaacagctcagatagcaacaaaaacagatctactagtagagtagtaagtctccaaagagagttaagagcaagtaccattgcttagtccagcaagtgacagactgacagttttggtcacaaagagaccaacctgggtaaagtgcaggttttcttttcttacatttcccgtgtagctctgcatgcaagctgagcatagaaacgacacaaaagtactatactaacagatcatttgccaaggtgagcacgagttacatttgttttgggtggaaacagtatgttgcatatactactggggaactaagtgcggcgggaagatgtgttctgggtgggcctcttcgtcctagaagaactggcgccacgggattgaccagggccaggtgctggaagcgtaagcatctgattcccatctcggatgccagaacgagcagttcctgcattgttgtgaaagatcaagaatttgtgagaacagagctataggaatcaagttcatttgtcaagatttgattagaaatcaagcccgaaacagaagttgccaagttccgactcaaatcacgtacataaaataaaaggcatgatttatggacacacacaaccaagatcattgaaacacgataaaaatcaccatcattccttgattcaaaaatctctggacacatccattctcctgcaattgtgttgctctgcaattttatattggtccaacctttattggtcctgaacccataatttgactcagcaaattctattaaaaaactgccctttctaatgcatattactagtaatactaggtgattcccgtgctttgctgcggaaattcctaaataatttttaattttttttaataatcaagctaaaagtagaaaattatattagttattagcaacacacaaaactaatttgtcaaactatgttaagagagaaatacatttagtatactttatatgagattgtagatgaaatatgatatcctacactttaattatatggatgaatatatatatattaaggactataaaaatggtggatatatacatgttaaaaatttttgtgaaaaataatgtgaaggaagatgattggatgttgatttgtagaattcaatgaattatagattaagcttgcataaattttgcatgtaattattgctagtggatgatgaggtggcatgtttgcatgttgagctttaaaattagtgggttataactttatagtaagataggattaggggaagtatctagacaaaccgtcctaccatggtacagtgatggactgataattacaacattcaagagtttctttcagactattgatgagcggatgcaccaaggtatgaccgatatgggttaaggccttagggtttagacattagtaagtacactttcccattttgagaaatttgatcgatagtagtagataagttagcacaaaacagacaggctgtctgtagtagataagttagcacaaaacagacaggaaccataacttctattcagtgtttccagaaacacacattacatattctactacagtattacacagtgcatatgcagcatgtccatgtctgtttgtgcatgtgagaacaagaggatgtaccagtgccaagcatgttcactctgggatcccaaccagacagattttgcactgcatttctctgccacgattcctcaaatcgagcaagctcatctgtaataaaaggaaaacaacgtcagatcaactcggctgaggatggtaaaggttccaggattagaaggggctaaaaccttcattcaagttgtgcaaagtttgcatcgtgtcaacgttcccatcagaactcagtttccttgtcaatgaatggccctgcaatgagagaataataaattttattcatggaaaaacagctgaataataactttaacaacactcccaatctaattggaaggaataaagcaggttatttatctgaattaccaagtaccttattgccaattccacgtgaaatcctgtgagtggctttaccagtggtcgtgtctgcttccttcctttcttcaaatgtaacctagagatatagaagaaacagtaaacactacaactttggaagttccaacagaacaaataaataggtgaaggaaacaaaactgctaagattacttactccatctccaccagtcctcctagtggctgaagacgtgtaacaagctccatttggaccgccatacgtaacagttgagctctgaaacataaatgtatgaggttgtggacgcgatgtgctggctctggcataccccctttcaaactgctcgtgcctagatcttttattatctgctaaaagatttttaacaacagtacatggttggcaacaagcccatactagaaaacgaccagcagcataaaataaagtaataaaccaaccttcagtatcttcgtcaggatcctccacatatggcatttgggccatccttggatgcttcctagggttatcattcctcttctcatcttctttattcacatctgcgccatcctcatcatctgaagatagctcctggattattggccctctcggcctgcttggttcaggagcttgctgaaggaagcctccagtattgctcagtccattgacatttccatgaggcccaaacatgcttgacccaaagctcccaaacatgcttggctgtaacaagctaggtcccatcatagcaccgaaagggtttgtgaagaaaggatcatcaaagggatttgccccaccaaagaaacttgacattaggctccctggttgtccaaagctacccaaacctggaaaggggtccccaaaaccgaagaaaccatccctcctgcctctccccccttgcatcttctatttttgaggtaccctgcccagttaaaagatattcattatacaaaccactatgttatatgatatattagacgaaatcattaggtcgtcaataagtaggatctataagaaaaccagacatcatacaatgtgacttttggaattagcctgcacattgtaggcatgcagctttttttcattgcaaggttatcaataagtaggatatagaagaaaacctgacaccaaacaattctgaatttttggaatttgcctgcatgcttgagcactaatctatctgttctaatacaaggttacacgcccacacgacacacatgtgaacgtgatcccttaacacatggcaaagtatacagaggactattattacttaacatcatatagtgaaataaatacacttatgaaagattggttgaactctaaagtttaaacagaaatcaactacagaatcaaacatagtgaccagccgaaaaaaggcacgctcaatgacataaagggattaaaggaaacaaaacagcaactaatttatctcatttatccattatggtccattatagcaagtatagctacaaaaatttccctggcacaccatatccatatactcctaccaaaaaagcagagaagttccctcttcatcaattttataccaatcaagcaacggaaattgctagttagccatgcattactgccatccgaccagctagtatcaactatcaagtaggagtatcaactatcatgcgtcatttcaccatgtaatattccacatgggaaaaaagaaggccctaacaatcgcggacactgctcgggctcggatcgcttcaaaatctagcaacctaaactagctaacacgatcgagagggctaccagcaacgcgatccaaaactgccgcggaacacgagtaaaccccaacactaacagcaacaggagggggggggggattcgcacgtacggactcgtggaggaacggaaccatccatccatacctggagcagcggcggcgcggcgatctgatcggagcgggaggccctagcttccgacgagctcgcgatttgggaggagagagaattgcagaagcaaaaagctgcgcgtgtggagagagagagagagagaagaggtggaagttgaacggcaactcgggggagaagagagagagagagagagagagagagagagagagaggcctcgagacttccagaagcggattcttctcaggcctcggcccattaagaattcttccgtcctatgggcccattgaaaaattttctttttcccagcccatttggtctcacgtttattcttttctttttgttttctatctagcagtgttttacccttttttggtttagggacgagcgaccgcgggataagtttaggcaaattttgctaaatttgaactaaattctactcgaatttactgtttcaaatttgaattctcaaaaactgtgttaaatatgttttcgtcctacgtcgaaaccttgaaatttcgcgtttttcgaacctgggacacgtgggtatacaaacttatatttgaggatttctccatatgaaattccagatgtccactatgtagcttgagatgctaataaccattatctactctatcagaatttttaaaatattccccctaaaaaagaattttaaaatattttcaatataataaaaacggttaatatttcccgcctctacgattagacacacaaccaatgaattctgtcgcgtaaacttctaatcagctgcactacaaagtagctggaatgttgcatctaaaggtcgacaatgatacgtaggagtatgccaaactctgaacagtagcatctgatgagcttttaagctctgaacagtagcatccctgaactctgaaactgctggctgctgcctttgctggtaggctttattaaggcttgtttttgtcggtcatcatcaatgccccaatcttagcttagcatctgccgcgcacattcctgcagccaagaaagcaccaagcatggtggtggcctccctcgtgcagcaatctccgaggctgcaggaatcaggatcctcctcctcctcatctgcaactctgaataatgcaagatatgcttgcgcttttggcatctcgcacctcatggctgcaatcatggcggcagcatactgatcacaccatagctaaagctctcaacgacgtacaaccagtggcttgggctagagctacgggagtagcttctttgttaggccatctgtctccatcttcaacatccaagcatatatcctacccagcttttcatgcgtacaagatatatatgatataatatgctcatagtattttgctactataaatcatctggtcagttcagattagctgtgtacatcagggattgaaatttcgcccccaccagcaagcacatatctcacccgaaattttcggttttattattgtattttttttaatttggtcaaattttatttaaattcattccaaattaatcaaaatttcaaataatttcggttaaaaaaataccaaaatttcagacacccccaggtaaaaaaacatattttgaaattgaaaacctggtgtacatctgttttaatgtagaggcccgggttctaatctattttctaaaaccaaatctggccggttcagacagaagttcagaatttcagatcaagcatgctgcacatgcatgaggtagctagtatgatgatatatgtgtggattagttagtttaactcacccagtagtagtcttttattgctactactaattagcagtagttagctacaaagtgttcatcaactacaggtaggatttgtggaattttttcttcggacaagagaacagctctgaaactgaaagtcctccgactccgactgacagtacttatctctctgaatcaatcacactggagcatcactgatgaactctacaagtgtcgatggccatatatttatttattggccttatttatttttccatgagactaagcttagctaggtgtaagtataattaagctaaggtagctaacaagaggtagttcgtttgtcactaaaaaaatactatcagcttccgttaattaaggagctaaaagcatgaacacatgtcagtcactggcagttcagcagatgcatgcgttctgcaactcaattagtgggcctctaatctacgctttttacgcctaaacaccagattaattaatctaattaaactatgagctttgctagctaggtcgaaaaagatggtggaatatgcccatgcgagaagagcccaataatacagacaggcgcatgcacaaagcaagtggacttggataatgataataacgtatttgggtaagcttaattagcttaatcactttggttatatggtttcttaattagggattagtgttgataattaggagcctttggaccacacatgtagtagagcatgtggtcactatagtgcgctggaagcgtgcagcaagctcctacttcgatgtgagtgtgttggcgtgcacccattagagccaagaattttaaaccagtttttctcctgtaaatttctccttggtgattaattatgatttggatataatttaaacgcccttttaatctcaccatgggcatctgccttcacttcactaaggcactaacccctgcaaatggagccttgttaatatatataagctgtgggaatcttctccaacaaatgcagatggcactactgaactgaacactgtgtttttcttttgagaggtactataatgaaccaaatatatataattattgtcccaaattagagcataaattctgtttggaatgtgattgaaacttggagcatataattgtactatgatcttttaggataataatattattgtgcttttcccccttgtttttatcctttcaggaaagcttatatttatcgatatttcttatggaaattaaaaatagcaagaataagagaagttccttatccatatctacatggacactttgaatagatgtgcaaacctacaaaatagctgatgagcttctttcttgggctgtttgtgcttttgccatttgtttcctcatgatggaccctcagtttgggttacatttagctttgcaaacaacttgtgattaagtggtgcttaatgcttaattaaccatctcttttgtataggaaaaagttaagtagggagacccacttgcccatcacatcctttaagtacaaaatgccttgcttttggttgcttgcttgtcttcccatgggttaacagggtggtggagtacccatgatctaatctcctttttcttcccctcttttatttattaattttagattagttagatagatagatggtttagggggctagaagttggagtaaagcatatgtcattggtctaatcttaatcaactaatccaatttctttgtgtgttgctttgctttcatggattgttgaatattgactccacagtgtttattaattgctaccattatatttataaatgtttccatcctaatctagcatacgaaatcttttttgttttttgtgggatactaaatccatatctttttccatgcttgtcttgcaaggaaataaaaagtttaattaatactggagaatatatttgttatcatgaaaaaagcaaattattgttgagtgttggtgagctgtccacaattgacttttttgggatgcatgcatattaatatgcgaatgtgtctaagtacatataatttgttctgattaaaaatagcccgtgttttcctccttttgttttaccgactactacctctcttcggtaatgcactgaacagcatgatagttttttaataaaaaactttctatatacaaatttcctatcaccctgttctaaattcatttaatttttttctaacatttaatttattggtttgtacccttgaaaaattatgtatctattgagcattctattccattcagcacaaaagaacaccctttgagtcaaggatgaatgtagtagtatccactatccagagaccaaatcctggaattaatccaatgcttatgagtgatgaatcatatatagtaaataaaaacctaaattgtcaggttccttttggaccaaccgacaactaaagcatatacattgtcgatctcgaattgaaatggtcgtcgatctagctaactaggttcgacatgccagatttttttttggcacaacctacaaagtgtcaaagcagaaaaaacattgtactttcatgtaatatctaaacggtcgataagatccaaatgtaattatgtgatgctaaagaaattcaagaaataatttgtaagaaatatagtttgtctcgtcttttctaaacacgtaaatataacacaacaatgggttggatttttcaaaacttgtccgatgttggggcggtttccactttttagttttgaaatttctcaaatttgtaaaaccatttggaaagaaactcatttgtaaactctgtatgttgttcttattaggccctgtttctgttccatgcatgtttggacacatgcatgtgatataactgtaaagaaaaccaaatacacagattgcatgtaaattgcgagacaaatcttttaagtttaattgtgccatgatttaacaatgtggtgatacaataaatatttgttaatgacagattaattaggcttaataaatttatctcgtggttttctgacggaacctataatttgttttgttattagactatgtttaacacttcaaatatatgtctatatatccaatgtaataaccaaacctaaaatttttccgcaactaaagaccttagtcaaagcaagggcttgttcaggatcactagctaggttgttaagtttaatctgttgaccaccatacaaacagcttaattagctttcggtatggacacaagacaaacttactagcttaattaacttaattaacctaacattaatttgactctctctcctctctttgactctctcatggaggcatattgcctaatcatatggctatgggctgtccatctcagctttcttttgctcttttgaccgccgccctcctgcactgcacaatattccagtacagtacgtactatgtaaaagccactcctgcactgcatgccaatggatttggatcacgcgtgtacgtacacatgcagcccgtgtatgcaaccatgtagtgccactaccttgcatatgctcagctttattttgacacgttccaacgcacaaaagacacaaaagctatggccacacaaacatgtactagtacacagcatgcatggagccgtagaagagggatataatggagatagagcagcggagaaaagccgtccgttgttgtgatatgatgtgtatagtcttctactgtacgcagttatgattgttgtttctggttttggtcgtaatgtgtcggtgacatgggaccggaagtatcatgacttagagacttgaggcagacacgatcacccacgtggcctaaccccctcggggggggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcg

SEQ ID NO: 62141 - DNA, 13713 bp, Oryza sativa
ctggtcatgtcgtcagcagacagccatgttcccacgtcgcgcctgcttccggcggaagtggaggtaggtatgggtcgtcccatcagaaggtcattcggacggtaaccatacaagtctccgtctgtttatgaaaagataggataagtccccacaaaaaagagagagatggtgcatgtggtatccccttgaggtataaaaggaggaccttgcccacttagaagggggatttttttttttcggatccagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgtgtttccattctcgcgaaccttccacacacagactagaagcttaggatctcacccagggcccccggctgaaccggcaaagggggacctgcacggtctcccggtgaggagccccacgctccgtcatctggcgcgccaggtagggggctctgcgggtatttttctaagctctcgcattctttcgtgtgcgccaagcttttcctgttcagcccaatggccgaacaagcaaaggcgcacaacctctctccgagtgttagcggtgacgacggggagccgaacccacgccgtcgagctcgtactccaccgccccctccacgccaaagtcctaggcaggaggaggcgctcgagagggtcgaaggatccgcgacttcgacatccacgggtgatggggaagggcggcgagatggggagcgtcgcctcctcgtctacggcgacggcagcacgccccagggcgcgctccaagctgcgggcgcgctcctacgtcacccgcccgttgtccctgacctggagtctccagcccaacgttggctggacgacgtggccaacttggtcatgacggcacggcagcgcctaggtgctggtgggcggtcctccgccaccaagacctctggcgctgctaccaccggctccgtgtcgtcaaggcggagggcgcggcgagcggcggctgttgctcgccattcggccgccactccttcgtcagcgcctccgacccaggaagatctgcgtggggggtcggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacatgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccatgaactttcaaggcacatatccgcgcccaggtgaagaagcggacttacatgcagtccaacgaagggatgatgagtcacttcgctcatacattcagcggttctgtcaagtccgcaacaccataccatgcatccctgcacacgcggtgatctacgcgttcagggggggtgtgcggcacaaccgcatgctcgaaaagatcgcctccaaagagccccagactaccgcggagctttttcagctcgcggaccgagtggctcgtaaggaagaggcatggacctagaacccctccggttccggtgtggcagctttggccgcccccggatctgttgctcggacagggcggcgtgacaagaggaagaagaagaggtcagcccattccgacgacgagggtcatgtcctcgccgtcgagggcgcttcgcgggccacccgaaaggggaggcctgcgagcgacaaaaagaaggaggccggcgctcccagtagggagcgcccaaccggcaagtggtgcatcgtccacaacacctcccttcacgacctcgcggactgccgcgcagtcaaaagtttggctgagcggacgaggaagtgggaggaggagaggaggcaggagcgccgagagggcaagtccccggcggttccttccggcaatcggtgaagtaaggccaagcagaaggcccccgccgaggacatcgatgacggcgatgatgacctaggtttccaagagcctggggccaccattgccactctcgatgggggagcgtgtgctcacgtttctcgccggagcctcaaggccatgaagcgagagcttctggccgcggcccctactcatgaggcgacgcgccgggcacggtggtcggaggttgtcctcaccttcgaccagaccgaccacccaccgtgcgttgcccggggaggacagatcgcaatggtggtttcccccactgtttgcaacgtgaagctggggcgtgtcctcattgatgggggagcagccctcaacatcctttcccccgcagcctttgacgctatcaaggccccggggatggtgctccggccgtcccagccgattatcggtgtgacgccgggtcacacttggccgctaggtcatatcgacctcccggtcaccttcggtggatccgccaacttccgcacggagcgggtgaactttgatgtggcggacctcagtctgccctacaacgcggtcctagggaggcccgcgttggtgaagttcatggcggcagtccactacgcctacctccagataaagatgccgggccccggtgggcccatctctgtccatggcgacctcaaagtcgcgcttgcttgtatggagcagcgcgcggaccacctcaccgccgcgtccaagcccgagggaggcgacgagaggcttggcacctccgcccccgccgccccgaggcagcggatagtcacatgcgacgaggtcccggtcaaggaggttgccctgggcgacggcccgtccaagaccacatggattggtggtcttctggacggcaaataggaagacgcgcttgtctttttcctgcgggtaaacgctgacgtcttcgcatggagaccggcggatatgcccggggtccccagggaggtgattgagcaccgtctcgccgtgcggtcgggcgcaaggccggtccggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccctctgcctcgcatagatcagattgttgactccacagcggggtgcgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactactcgaaattctttgggtagccgaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgcggagcgcgatgaggacaatcctcattccgcgcacccccaccctgtgctggcttggcccgggagagagcagggaggagaggcccccgagccgaacggtggcccaaggcccccgacgaccggagcaggccctctgcccgcttgttagacggtgccaggtgcccccgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcctgcttgtccgacgacgccaggagcccccgacccccaggacggccccgaggccactgtgggaaggccgcccctgtcgtcctccgaccccgaggtcgtcggcacagaagacgagtgcaccccgcgaggccgcttggacaaagagcgccccagggatgtggcccctagcgaagaggatcggccccaccgaaaggtgcagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttaccccctcggccaaatcttgcataatcgagagggtactggacgggtggtgaaatgggcaatcgaactttctgagtttgatttgcactttgaaccacgccacgctatcaagagccaggccctcgccgattttgtggcagagtggaccccagcacccgagcccgtctcagtccccgaggccagctcgggcccctcgcagctgccccacaccgcccactgggtgatgcagttcgacggctccctgtctcttcagggcgccggtgcgggggtcacgttgacctcgccgagcggagacgtcctcagatatttggttcgccttgactttcgggtgaccaataatatggcagagtacgagggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggcgtatggagcgccattttgacgggatagagcttcggcacgtgcccagacgggataacacggttgccgacgaactctcacggctcgcttcctcgcgagcccagaccccactgggcgcctttgaagaaaggcttgcccagccgtcggcgcgacccgaccccttaggggagacggacgcgcctgacaggcccccgatgcccgtcggagtccaggcctcgggacccgaggggagcgctcccagctcccttagattgattgcttggatcgctgagatcaagcatacctcacagataagactctactcgaggaccgcgaagggagtgaacgcgtccagcgcatctccaaacgctacgtgctggtagaagggaccctctatcggcgcgcggctaacggaatcctcctgaagtgcattcctcgggaacaaggcgtcgagcttcttgccgatatccatgaaggcgaatgcggagcccactccgcctcgcgcaccttggttggcaaagcctttcgacaaggtttctattggccgacagctctcaatgatgcggtcgacctggtccggcgatgcagagcgtgtcaattccacgccaagcaaatccatcagccggcccaggccctgtagatcataccactttcatggccatttgctgtctgggggctcgatattctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcgcctcacctgcccaccccagaagcaacggccaagtggagcgcgccaatgcggaaatcctcagaggccttaaaaccaagaccttcaacatcctcaagaagcacggcgattcgtggatcgaggagttgccagcggtgctctgggcgaaccgaaccacgccaagccgagcaaaccggggaaacgcctttcttcctcgtctacggcgcggaagcggttctcccatccgagctcaccctgaggtcccctcgggccaccatgtactgcgaggctgatcaagatcagcttcgcagagatgacctcgactacttggaagagcgaaggcggcgcgtggccctccgagccgcgcgctaccagcagagcctgcggcgctaccatcagcgccacgtccgggcccgatcactctgcgtcgacgacctcgtcctatgccgcgtccaaacgtgtgctggattgagcaagctctcaccaatgtgggagggtccgtatcgagtgatcggcgtcccccggccgggctccgttcggctggccacgggcgacggcacagagttgcctaacccgtggaacatcgaacaccttcgtcgcttctacccctaaagggggatcaggtgttaggttttgggctcgggccaaccccgcacccccctcgggcgtgcagggttggccgggggctaccacatatgcatattcttatttctcttatatctgtatttcaataaaagcattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggtgtggtgaactccgggggggaatcggcaaaaacccacaatcgggtcacccataaccctcggtcaccatgctcccggcctggccagtctcgacatgtggatctccccaggcgctagccccgacccgagccatttgaggactaggacctgggcacgagcccttgttcaagccaagacacaaaaggaccgcggcacaggcatcctcgtctcatacacacaacaaatagaattgacacaaaaaatttcctctttatttgattgcagattaaattagtctatacaagaagggggcccgaaggcctcggaagaagaaaagaataaactatttaaagattggtgggggcctgggggctcattccgatgcacccgggtcgccagcctcgtcgccactgtcgcccacactgccgtcatcgtcctcctcgtcggagttgagggcgaacgcgagccgaggggccgaaccctcgaagctgtggacgatatggtcggcggcgtcccggacctgcgcgcgcgcgccatcctcggtcccgggagggaactcgtccagcgccgtccatggggagaagtcgggatccctggcttggtaactcgccagtacgagctccaccgctccttgggcgagtcccggctatctccgagaagcgctgggcgtggcccccctggttggcggcgtacttcgcagtccgcccgccccagaggcccgcctgccggccggcgcggtctagacgggagacggcgtcccgaagcatgccgggccctacctcgcctgccaagcggagggcctcgacctccccggcggacgagtctagcgcgccctgcagatcggcgatggtgtgttcggcagctgcgaggcgggcggttaagtcgctgtcgcccgtggccgccccgccgctacgcgcccttgcatccagctcccttgcctgcgcctcgagttcagcggcccgctggttcagtgcggccctctcggcgcaggcactttccagattgcgacgcgcttgttcctcttgcgcagccttgcggagggacaggctgtccgccagccgttgagccgcggcctcggcctcctcgagagctcgctcccgctcggtgagcgcgtcctcgcggaggcggagcgcggactcttcttcggcataggcggcttcgtgcaccgccagtgtgactcccgaatagcaacagcggcctcgcgatccgccaggtccctctccacggcgcaggcacgctcttccagcgccatggcacgggcctcaagggcttcttcgcgccgccgggatgccacctcggtctccgccgcccgccgttctcgggcagcggcagcgtcaaggaccccccgggcggcgtcgagctttttccctagctccgcctcccagctcccgtattgaaggcggagggtgtcctgcgcctcgttcatcacggtggtggcgatgagggcagccccccgctcctcctccacctccttggcgatctcccccagcaccttccgacgggcttcgagctctgagacgtgccggcggtgtgccttgcggcccacctccaccatggcctccaccgagcgttgcccctcttcgacacgcgcccatgcggcgtcaagctccgcccgctctgcttgcagggcctccacttgggcacttaacccgtccaacaccgtggtgtttgcgacggccaaggcctgcagaaggggttctgcgctcagtgaagcaacggaaggcgtggggaagagccgcctcggtgaggatgccgcgtggctcggcccgccgatggacgtgccggactcagggatgtcccccggacctggcttgtcctgagcgtcgcccgagggagtgggcccaagcgatgcgcccgcggcctcgtcgcgagctgccttggaagtcgtcgccgcctcggcctggcgaagtctggcctcctcccgagcggcttcttcagcttggcgagctcggacggccacctgggcggcctcctcggcttcccgtaggcgatccgcggcttctcgccggtcagattcccgcctccgagcctctgtggtcgccgggtcctcggcctcagactggccggacttggaatggcgggagggacgcgacgggatctcgctgaaacagaagaaagaccagaagacaaacaagatggatgagtgaaaactcgcgttgaggaaatgaatacggccacgatgggcgtgggacgaacctgcgagggggtcggttaaacgaccaccttggaggggaaatgaggtttccccgggatggttctgtcccccccatcttgcggagccgttttttcttccgctccccctcgggctgcgacgtcggcgtagccccctccgggcgcctgctgctggcacgcgccaccccgccccctcggggaggagatgggggaggggctccttcctgcttcctcttcccccgggcgtcggcagggcggccgctccccgggcccccgtcgcggggcccagaagcacgaccccctcccggggtagattgttcccccctgcggctcccgcccgcgtcatcgtggcctcgaggagcccgctcctccgacgccccgaccgcctgcatgatggtcaggatggaggcgcggtctagatcgctgcagagggggaggactccttgaggaatgagggatgcctccacggaactgagattcagcacccgttggaccactatcttgaagtcctcaggagcccagtcccatctgaccccctggtgggtcctcatacagtcctcggacccggtgtactcccaggcgccccaggcgcgccgctggagtggcgcgatccggcgacgaagatagtcgccgaacaccatggcccctgtgagcccctgggatcgcaggcccgctaggcggtcgaggacggcgtcgtagccatctcccagatctaccggcgcccgccagttggaggcctgcgctggaggctggctcggaagtcggaggcgcgcttcgtcggcgaggggggtgtagaaccagtcgctcttccagtcatcccacttcttgcggaggacgcagggaatgtagcggttcagcaccggcccccgcggctggaagtagcaaccaccaaccaccgacggcggcgacaccggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacagaccgccccgggtagcgtggcgccgggcatccctcgcccagcgagactatctcccggccggtggcagattccggcatgaagcggcgcggcagcccggcctgtctctcgctcacgatgcgggaaggcggcagcacgctaccgtcaagcggagcggagccccatgccatgacgccgaaagaagagatgtttgagagcgagcgcgtgtggcgaaggtagggcacaggaaacaaggagttagggcgcaagcggcgaagacaaggggaataatggcgaaaggaaggaagcaaatctcttcctcggcgactttatacccttgccaatgctgtgtccggctcctcgtttctcgcgcccactatcttgccccctcgtttctcgcgcccacgcttccactaatcccattcgcccatttgcggtgcatgaggtggatatgcggctgtggcagtcgagatggaacatctcgtgcgcgcgttaattacgctcgccgaccgaagcgccatcaccatatctccaggaaaaacgaaccggcttgtcccgatttttagaccggccccacctgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaatcccctcggggggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtcagtgaccagtcacagaccgattagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggtaaccatacaagtctccgtctgtttatgaaaagataggataagtccccacaaaaaagagagagatggtgcatgtggtatccccttgaggtataaaaggaggaccttgcccacttagaagggggattttttttttcggatccagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgtgtttccattctcgcgaaccttccacacacagactaggagcttaggatctcacccagggcccccggccgaaccggcaaagggggacctgcacggtctcccggtgaggagccccacgctccgtcataatggtttcttcttttcctttccttttgttttacaagtgttcgtactaatttaaacttgtttggactctaacaaatacaacaagataaggatatcataattaagagtagttactttgtgcttgtgagtcggcttttattctctagtggagagtttggcgtattcattgtgtttctatatttttgttttgttgttttatcttgcacaacatgttgggcatttggacaaaagggtggatatgtctaatgtatgtggtttgcaaaaacttataaacataaaggtggtagctccaaccaccatattcttttcataccacctacattaggaatttcttcatggcttgaaaggatttattttttggaattctctgccaaaaaaattgtacaaaaaatattacatcaaattatactagacaaaaaaaatccttgttagatagagaaaaaattatgctgttcttataaaagatgtagcttataaatatcccctttctcagataacctctggttttggtgcacaaaatgtagggactaaaaaaaaccatcataagaagatagcaacaatacactactctaaacgatccataaaagaagctactattcggtacagctttaaaacaatacatacatcattttttctcttaacaattctcgcacgaggaaacaaacacatagttttctaatgatacttcggctaagttcttctgttagcttttccatctcgctcttattttccacgcgtacgctttctgaactatcaaactgtgtatttttttttttttgcaaaagtaactcaatacagaagttgctttaaaaaatcatattgatgtattgttaaaaaaaagataatacttaatcaatcacacactaatggatcactttgttctacgtgttcccagctcccgctaaagaacacaaccttcgtcactcgccacccatcacaagacaagttaggcatgaaatactacgacactgaactgttggaaagccggtgtgagcgtagctgctccatttcccaccggacaacccgttgaaaaaaaacccggaagattagctgcttccacacggatcggctcatctccctccctactgtcaccactcactcacactgtagtctgcgtgtctgtacgctttgacacgtttgacccgccgcaactgcaagacgacaagatgagacacgggtggcaaaacccgtaattccaacccctacccagggtcaaaccccctcgcttcaatagcttcgtggctaattacccatgagcccctcgaaattatcctatatttaatccggtattaaagtggttttcccgttttgccccccccggcaagcaaaaggcaacgggcatttttcgatttccgcattaaaaactcggccccgcttttgtacgcatcctctctctcctacgaaacaacgacaatttcggtttctttaccaaaacgcggcactaatttaataccccgataatttaattcggttttaaaattttactccgtttttttaattcgttaattaatttattaatttatgtcccctctctctcctcttccttttttgcttttagttttggctttttatttcgcccccatttccattccttcccttttgctcttgctgctcctcttctcctcgcttcgtcttcttcctcctctcgcctcttcgttgcgagtag

SEQ ID NO: 62142 - DNA, 870 bp, Oryza sativa
acccggtgtactcccaggcgccccaggcgcgccgctgaagtggcgcgatccggcgacgaagatagtcgccgaacaccatggcccctgtgagccctgggatcgcaggcccgctaggcggtcgaggacggcgtcgtagccatctcccagatctaccggcgcccgccagttggaggcctgcgctggaggctggctcggaagtcggaggcgcgcttcgtcggcgaggggggtgtagaaccagtcgctcttccagtcatcccacttcttgcggaggacgcagggaatgtagcggttcagcaccggcccccgcggctggaagtagcaaccaccaaccaccgacggcggcgacaccggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacagaccgccccgggtagcgtggcgccgggcatccctcgcccagcgagactatctcccggccggtggcagattccggcatgaagcggcgcggcagcccggcctgtctctcgctcacgatgcgggaaggcggcagcacgctaccgtcaagcggagcggagccccatgccatgacgccgaaagaagagatgtttgagagcgagcgcgtgtggcgaaggtagggcacaggaaacaaggagttagggcgcaagcggcgaagacaaggggaataatggcgaaaggaaggaagcaaatctcttcctcggcgactttataccct

SEQ ID NO: 62143 - DNA, 866 bp, Oryza sativa
  unsure (1)..(866): unsure at all n locations
nnnnnnnnnnnnnnnnnnnnnnnnnnnnnnnnnnnnnnnnnnnnnnnnnnnnnnnctaggcaactagtttattttaaaacagaagaagtatgtgctagtttggtttagtaccctaccaatatattggtagtgccaaactctagacaagttttggcactaccaatattttagtaggatagatctgtaaatgagtgtgtttagtttatgccaattgagagccaaattttaaattgtggcgaagaatattttagaattgtgtcaaattaagtataggtattaccaaacatttggcttcaaaccaaatcttcacatttactatttaaactaccaaaaaaattggtatggcaatattttggtattaaaccaaaacgctcctatatgttgtttgtcctgaatgctgaagccatcatgtgctagcgtatgcgtcattctggtgtgaatcatcaatcaataactcccctaaccccactgtttttctcatttttatgaatttttttttggttatctggatggtttacacgtcgctcctcattccggctcctcgcgtacgcctgcgtgaccgctcgtaagcggtcaccggtccaacgatttttttgggcgcgggttggagccggtttgactaaaaggatattttgcaaaaaagtccttgtatttccacgaaatatcgtatacgtccttggactggttcacacccgttgtgtttgttgcgaaaaagccctcctatttcacaaatatacaatgtgaagaagagaaaattccgttttaggggtagagctgtaaatattaaaaactaaggggttttttcgaaaaannnnnnnnnnnnnnnnnnnnnnnnnnnnnnnnnnnnnnnnnnnnnnnnnnnnnnn

SEQ ID NO: 62144 - DNA, 945 bp, Oryza sativa
ttaggggtgttggttaggcgggttgatggggccgccggcggcctcgctttcgtccgctttgagcgcccaccgccggctgctgaggccttcgccaccttgccacatccgctggccctgctcctcgccgctgaccttgctcgtcaaatccgacaccccaccgagcggggcgagagggcgagagagaggaagcggcggcattggggagatgaagagtacgggcggtgacgacggctagggaagaacgaggaggcggcggtggcgcatgaagaaggggctagggagtaccggctccgacgggcggcggtcgcgcggtcagctccgccgccacctcaagccctgatggacgcgtccgccttccgtcccgtcgacgtcaccacaaggggaggggtaaggagggaggaggcaccggcggcagatcgtggtgtgtgtgggcatgcggaggcgacgggtgacggtggcggcagcggaacccctcgcggggaaggccctccgccgcttcgtcgtccgaagctatcgcggccatcctcctccgtcgcgccgtctcctccggccgccagatacagcggcggcggagctggatccagccgtgggagggccggatctggctacggcggcaccggagacgaggccacgagccgcgccgtcgcacggcctgcaaggagaggcaacggagagcggggggaggacggacgacgtcggcggcggcgggtggagggcggacgacgacggaggtgactcggggagggcggacggaggcgaggggagtcccgcgccggcgccagcgccgagcacggggcgtgggtggggcggcggccgcgcggtgagggagtagggaacagcccgtggttagggtttggggtataagtggttgtttttcgaaaaaaccccttagtttttaatatttacagctctacccctaaaacggaattttctcttcttcacatt

SEQ ID NO: 62145 - DNA, 733 bp, Oryza sativa
gcgaattcgagctcggtaccctaaatgggagggaaaaaaacaaattctagaactgatggagtgcgttcgacataagcagattgagtgaaaaaaaagtctctcatttctacatgcacgcttcctgaactattaaacggtgttttttttacaaactttttatttatgaaagttatttttaaaaaatcatactaatctcttttgaagtttaaaataaataataatcaattaatcatacactaataattcatctcgttttacatattcttttcaatcttcactaatcctcttatctcaaacactcatatgttttacccattcttttcataactcacatctctcgtttttcgcataaacttcctaaactactcaacggggtatatatatatatatatataaaagttgcttttaaagaatcatattaatctacttttcaaaacaaaataattagtaatacttaattatttatgtgttaatgagtcgttcgttttatgtgatataattactctagtttcaacaccagaaaccaaacacagcataagcatatgccttttttttttgggttcaggtgatgaggatctgcacactgttgggcgttcaatgaatccagtagggagtccggacatggagcatggacgctgcagagacagaagacagagaggttgcttgcttggagaaggaagaaagagtacgtgacaggtagggccccaagatgacgcccaggtgtcgatccacc

SEQ ID NO: 62146 - DNA, 1422 bp, Oryza sativa
ctctatacgcactcacatgcttacccccacctataccgatatgaacacatcgagagagactagaccgtcacctagttattaaccactgaaaaaaaatagatgtgaaatacgagcaaccatcatctcgtgcttcgatgagcaatttccatcacaagaaacctaattgattaagatacgtttagttcgaaccaagagcctgtttatgattgataacattttcaaccataacattatttggtaaaattaataattatgtagtcacgtttagtttattaccaaattttggcaatatgtatataattttggcaatattataagccaatcatatcaaaattttgccaatgttgccaatttccaacatcaagtttttgatactttctctttggtgcatttttttatggaggaactttgacgcaatttatgaagagcatatatatatgagtaggttaacatctaccttcttaggcgcacacgcttcacagtattaacaaaagatatatggttgattttacatgtaagattcactaataagacaaataaatatgtagccgttgcaatactgtctaacagaaagagaaagggacatatttttcatgaaatatatgtactgggattatagaaatttcacaggaatacaacaggttcatataatcagtgaaacagaataatggcttactttcaatagaaacacaacttttaactttgaaaattccgctttcacctgacagctttcagttaaaattaaaaagataggcacctaaagtctatttatcctgaaaatgaggtgcgggcatgactatatatgacgcgctagccattgttaacatgcatggcataggtaaccgtgggcatggctaataatgtaagtgtgataaggtgcaatggtaagtatgaaaccaaaggtgcactaattccatcatgtaaacgtatgcaatctaatttccaaaggaaaaacattacgaccaaaattttctagccaatgaccaacatgaactactaatgaaattaactgaccttccttccaagcagcagcattttttaagtttgaacacaggaattgacaaagcgaaaactagcacctgggttgccaacagaataaaaacttttcacccatcacatcgaatatttggacacatacataaagtattaaatatgaaaaaaaaaccaattacacagtttgcgggtaaaatgcgagacgaatcttttaagcctaattacgccatgatttgataatgtgatgcttcagtaaacatttgctaatgacggattaattaggcttaataaattcatctcgcaattttctggtggaatatataatttgttttgttattggactacgtttaatactttaaatgtgtgtttgtaaatccgatgtgataacaaacctaaaaatttttcccaactaaacaaggcctatgttaa

SEQ ID NO: 62147 - DNA, 767 bp, Oryza sativa
tgctgcatactggggctgcatggttccaggagcttggaacgctccatggccaccgcagtcccaatcccaatcggtttcatcatcaagtgctgcttctccagtatccacaatgaccaactgcttcagattaggaaagcaccctagagatggtgatgaggaactggatagcaagggtaatggcaaggtgtgggtgccgaagacggttcggatcgacgatgtcgacgaggtggccaggagctctatctggtcgcttattgggatcaagggtgacaaggtgggagcagatcatggcagaggatgcaagcttgcaaaggtttttgagtcaaaggatgaggcaaaggcatcaactcacacagcgatcagcagcttgccattcatgcaggggaacccggctgccctaacacgctcggtgaccttccaagagggatcttgacttgaacaacgccttggaaatttttatgctgccttctgctgctataaagacatagcgtgatacagctgaaattttgtacattagaggattgtaaagtaggtatgggagatggagtgtcagggtgtataacttaacatagctacaagcaagcccagtagctgtattagataacttgtacatagctatgtgggtttgagaaagatagggagagcaagttccccttataatatgtagataaataatataatgatttgaatatttagatcaaaaggatttccttttgcagtagtatctgaataattcgtcgctgtctgattccagtgtattaaaccag

SEQ ID NO: 62148 - DNA, 7456 bp, Oryza sativa
tggtgataagagtgaatgataatatcaagtgatgcatcaggtgatagttgataccacattattaaaccaaggtaccgtttccagtcaattgatgaatctaccaacgcgccttgtacattaccagaaagcaactcatatatctttaacctgtcttcctgaatataatcaaaatccagaccatttgttttccatagatccagttgctgagaaaggtcagaacgatttagcattgacccacctgcctggcttagcaaaattgccagtcgaacatcacccctaaaggcagcaacttctgtggctgtgtctaattgccgaccagtcaaaagcagaataatatgttccagatacctggcatcatttaaggagcccgcctctccttgaacccgatgacaaacactgtcctgtaaccaattgctaaagtctgctcttctaaccaaagggagtgcttcaaggtctatggcaacagtaccttctttcttatctaaaatcatcccctcctggtcctcatcaccagtaggctctaactggttaccagttgctctttctgagaacaagacccgaataagctcccaaactgtaacctggtgcattaacagcacacgagaagacatagataaatcactgacttcaagctgcctttcaatgatgtcaatataagatctgcaaatatctggcaacacaaagcgacttgccacaaccttctgaagcttcaatttaaacaagtcagactcagtctccagatattcatgatgaagcctcctatggagatccagcgggtctgagaagcacagatcagtcagctcctccttaattttgttcttctcatcacgtacaactttgtcgcctgcaactttctctatgtgaataacagaagatagaccagttccgggtctattgacaagactgccagaatgtacaaggatgccatttggtccccaaccaacacgaaatgacctgcccataaataaagcagcatccacaacacaattggaatatacgttcccagccacaggagtttcctgatcagatggcaacttaaagccatcaccttggtcattctcactggaaatcccttgttttgcccagacataagaataccatgagaagatgggccatgttctgaagaatttacactgtattccagcagagcctgtggttctctcctaccaattacaccaggtctcctgctgactttcagagaagaaccatgcaaaggagagagagaccttagcctcaaacctttagcacttgagttcggtgaatccacattcatcttctcactgctgaagtatctctgatcagatgggaatccatcctccatatcttcatcaccttcctcattggagaacatcgtcatccgcatttcatgcatctttgcagggtcaagcccaagatgagcaggcaacgaacgtgaaagctccagctcatgaccatttgcaggtgggtctcttacttccgcaataggctgccgaacaaccacttcatccatcacaacatcctcttcttcctcgtccacaagacggaatcgactaaaatgatcaacctcgaacttccacctgccgctcgagtggttgaacgaaacgaacctagcgccttgctttctcgtttgacacttaagcaactccccaagagcgctaggctctggaagcacgctcaaattcagcatcaacgtcacttctgctggcttattaagaccttgccctaaaggcggcttgctagcctcatccttgtaaacctccacagagtgcctaccgaacttaacgatcccattcaggtccatccccctcacatcagtgtcaccggggaagtgaattcgcccatacccgaccctcccgacgacgaaatccgggaccctgctgcagtagccagggtcagccgcctccctctccaccagctcatcgatcgacggcttggtgaagtaatcgccatggcggagcacggggaacaccgggtcggaagacatggcaggccaatgaggcaaccgagacagaatcagcaagccctagcgccgccggacttcatagcttcatgcgcagccaagcccttcgctccaccaaaccactccagattcagattcttctcctcacttgggaaaccaactgctgcaaacaaaatcccccaacaaactgcagggggttcgagaggaggagagattcggattagatttgaacaaggggaatgaactgcgggtggatctccgcgcggagactgcgcagggggtcgggaggggaggagggctacgggaggagagcggttaccttcgagggcgaggaggttcgccggcggggaggacccgccgcagccgccgcgagggggaagaggaggaggcggcggcttgagcggagcggagcggcggccggcgaggaggaggagaggggggagctcgcactaaacccttcgcgaggatttctggggcatccgaattatcgtgaccgttggattgagtgatggagcatcatcctgccgttcatttcccactccagcatctcttcttacgctttcccaagtgatccgaaccaggggccaaagtgaaaagtatcagacctgtagtaccaacgggagcggtccaaataagtaataagggggtaaagcgaaaatttatggatcattgctaatggtagcgatcataatcacttaaccaggggctaaagtaaaaaaattacggagcttgatagtgtactgctttgatagcagtccaaataaaaggactaacgtgaaaaatgttgtggatcgcgtgttacaaatgcgatttagaaatggactagtttgagaacttccatgctgggggaattagcggctcaactcggcagcgccggcgagaaggtcagtctagatttattattacggttattattagtctttttgataaatttattttataaatagacctctaaaatattccatgaatataccatttttctcaacaccaaagcttattggcaccttggcgtcaatgacacttctaccgacactcttcctaccatggtagctaagttactgatgtaaataaggtttgtgtcaaagagactaacactgaaggcttatttgtaaaaggattcgaaaaaaggtttaaattttctccaacaaaagcatcggcatctttagcatcaaaggacctatatttattataaaaatattttataaataggtccttacacctctacatcttggctgctaggggagcaagggtgtcggcacccgcgcgttggcaccgatacgttggacctcgggggctagaaaattgtccattttcctagaataatttttctatggtctattgtaaaacaagttttcaaaaaaggtccacgtaaaaaatctaggtaggccgggcgttcgccaacgatccatttggcagacagcggcccatgcggaatcaagtcttggactcgggttgggagaactccagcgaggtaagaatattatgaaatgttcatcgttttcagaaatgtttaagacacattcgactgcagtctgcaaaaccatatcttggtgcacagcaagcatatatcttggtgcacaacaagcatacatttattagtttttcttttggatacacatgttgcccctaaggccaacactgcttacaatcacccatggccttctcactgttgcagaactgccacttttacaatgggaaagccacacctacatggtcctttccttccatcttattcttgggatttccacacctacatggttctgccaccgttacacaacacatcaactggaactggaagcatgtacatggaaagagttggctgggctaccggtagcatcatgacatgaatcttcttgcgttgaggatggcagacggctttggtattcagggtgcagctctcagagccctgacattgcatagtccatggcatccaccaggtaatctgcatgaaagtagaatttcctttagttactctatgggcaatgcagtaatggcaaagttttgtttgagacagttcatacgaacctgcatcatcccttgtaaagcacattggtggttttatcctgaagacattaccatgcagaccaccttttccaactaaaatgttgagatctggattacaaggatgaagaggcaaagtgttaacagggctttattagtataaactaataatgatgcgatcatggaaaagagaaaaggaataaggaaagcacccttgagtttctcaaacaataaattggtctcggccttggcaggtgtcttctccttcctatcggtaacaagctccaccccaagcatcaatcccctccctctaacatctccaatgactgacaacagaaagaccaaatgatgggattagacagattaatcaataataaatagttgagtgaaaatgttactcagatgaaaggcatcatcaactaaagcaacaatgttgaatcaagcagaatgtaaactggcgatgttgttatacaaatataaccaaagattgtagattttactttcatgcttttgctggagctcttttagacgattcaccaaatgagatccaacatcagcacaatgtgcctggcgtttctccttgtcaagaaccttgagcacagcaagtccaccaacggagcaaacagggtttccaccaaatgtgttaaattggattttttgcgccagcacatttgcaatctcgggtgttgttacaactgcccccaatggtagaccatttccaattccctacaaacaaaaaaaaaacatcagcaataaataatggcaacaaaattaaacctttgaggcttatttttccaaggtccattcaaatgtatgtgtgttgggtgaagacctttgccattgttacaatgtcaggaataacatcttgcgtctgaaatccccaatagtgacttccagttcgaccaaatccactctggacttcatcagctatacaaacaccaccagccttccggacagtgtcataagctaactttaaatatccaggagctagttcaactgcacctcccacgccctacattcatgttcatgtatcaacaagatcgccatatcagtaagttctttcagataaaaagctgaggaaagctacaatctttcgattatgtaaaaagtatcatataaaaaatcatacttggaaagtttcagcaatgaaacccgcaacccttccggaggtaccataatttatttgttcttcgacttccttggcataagctacagcatcagaaccgaaagttccacggtaaggatcagggttcatgacatgatgtatttcgccctgcaaatgttgggataagattttgcttcattttcatagataaagactagtttgctactacctccatttcaggttataagactttctagcattgcccacattcatatagatgttaatgaatctaggcacacatatatgtctagattcattaacatatatatgaatatggacaatgttagaaagtcttataatatgaaacggaggaagtactttgctatgtatagatagacagttcaaagtaaaaatcaatttgcgcaaatataaccggtggtttaaaatcagcattatgaagaacaaataaaagagggcatagatcgaaggaagttagctattcttgggtaacacaatgaactcggtaagtgtacagctgataaccatgcttattttgttatagacgtgtaacaccacctaaataaacttttttctctttaaatggatgtgtatagctcctgccattttactgcttcaaaaaaatataataacaacttaaagttaattcttttccagaaaaaataaatgaagttagcttaggtgctgtttgcttcgagagttttcttccacgatctgatcacgctattacttgtttgcttcgagtacaatgggatcaggtaccttgggaaacaatacggacctaatacaaactcattacctaccgcctgatatcaagcgttttctgaaaacattacagcgtaagtgatcttccgctcgaattcaaacaaagcatggtatcacttgctctgtttccattcacggtgtgatatttacatttgccttaccaagtttcaaccaaacagcaccttagatgacttgatgaaaaagagtaggaattgcacttatgcttcactattacttgtcggtactgtgataggaccattctcagctacagaccatcttaagctagagtgcattaattgaattgtagcagtagtactggtattattaacagaacacaaacctgagggattgggtacttccacgtctgcaaacccgtcaatcctattgttccagcactaccaccatgataagcatttctcaatgcaatcatattgagattcccactgtacagccgagccatcagcatcgccagttcattcgcttcagtcccagaattcacaaaatacaccacctgcaggcatcctcagatatgaaacaattatttccatgcaaatcaatgagttgttttacaatttacatcatgatcgacttcaaagtatctttgaccttgagatttcctggcatcttggacgcgagcgcttctgcaaactcgacgatgggttgattcaaatatatggtggtcgtgtgctggagcagcttggtctgctccaccacagcgttcacgatatccggatggcaatggccgcatgaaactgtcacgatgcctccgaagcaatcgaggtatctcttcccattctcatcgtacagatactgcatcttcccttccacaatgttcagctgtaaaatggacaaaaaaaaatgcattccattttaaaatgaaaaacagaaacacatgcctttcgccatgattcttactagtataacagttttttttttttttacgaaagagcatgtagcctagtgattgtagtgatttgagtagtacccaaggccctgagttcaaatttccatataaacaaatttcatatagggttgttttgcggggctaagttctatatttcaatagccgtatatatccagttgaatatagaggtttggtaaaaaataccctctctaaaaaaaagaacagattattttttagggcgtttaaacacattagtttattggtgaataaaaaaaaaagggggaatagatacgatcgaatcagggtttgtaccggcttctggtagtagtagaacacagacgatccaagaaactgcttcctcttcgcgaggatctcatcgccgctccacccggcgtacggcctgggccggtgctcgaacggcggcatcaccggcggcgaccgcgccggaaccttctccgccggcgccgcctccgacgacgacaccagcctccgcaacgcctcccccggaccccaccgtctcccggcgccgccggtggctccgcggcggagcagcagcgacgacgacgacaccgccatggatcaaatcacgcacggaccgattcttccaccaaaacaacaacagctcgcgatcgagagttggagccgtgcggattactgcggaattataatggattctgctactgtaggtcgggttggtgagattgagattggatgagaaggagac

SEQ ID NO: 62149 - DNA, 4782 bp, Oryza sativa
  unsure (1)..(4782): unsure at all n locations
agtagttcttgaagtaattttcaatcgaaactactcctttggatctccggtactttggagtacttcaggcaactttggagcttcacgtacagaatgcaggggttggttggccatgaatcattatcgtaaaatctcattctcatagtcagctggtttttttccctcttatgtttcacttctaccccaagggaattacagagtgatccaaggattaatccttttttttgaacgcttccaaggattaatcttgagtcaaatacaagtaattagatactacaggtaaaggagaggtaaacctgcgcactggaagccggattaaaccagggaacatatcttatgtgtataagtttgagcaattctacggtacttgaggagttaccatgagatatcaaaatttcagtgtaaaatttggtacctcatagtacctagataccaagagataccaaatttacaatagaaaaaatggtacctcctcaagaaccataaaattcgtataagttttgcatgcacacttcgtgcacattaagtagcaaatcttacgaaaatttctaaaaaaaaagacatttacttctaataatattacacattctgcaaagtcttatattcaaattcattatattttagccgtagaaaaaaaggaaaaataatttttcattttcttaaaaaaaataaaaaaaatcattttttatggctaaaatataatgaatttgaatataagatttcacacaaaagtgtaatatttttgaaagtttgtgtattttttttaaaaaaatctgtagtatttgtacgaagtgtgcacgaaaagtgtagtatttgtacgaagtgtgcacgaaaagtatgtgtgcatatgatatcttccattcaaccaaagcatgtgttcgacggcaaggtgccaaatttctgtactgccagtagctccggacgcgcatgcttgtcacctcagttgcataagctgttgccctgtcacgagatgcaacagttagctcggtcgttagctgttcaggcgctgttgggcttcgaggctgccgatgccgtgccaaagattgcagagttcgttagttaatcgatcgtccggcaagggcgcaaggcggcaacacgtccgcacgtcgtttcattttctccgaaaagtgagtgaggccacctcccggcccgtcccatcaccaaaacaaacaaaaattttggttgccgtgtttagttctaaaatattttttcaaacttttaacttttctatcgtatcaaaattttcctacacacataaatttctaactttttcgtcacatcgttccaatttcaaccaaacttttaattttgacgtgaactaaacacagtactgtacttccgaaacttttttaagcacaatttgattgccatttaaattccaatcaaaatttagtgtataattgatttgggataaaaagggtagaaagataccccaaggtagcgaggtccggctagaagccggcgacgaccatctccaggcacacgcgctgcagcaactttatcttgaagttggcggtgaaggaaaggaggtagaggtcccagagcaggtcgccgttggcattgcggcagccaaggcaccgagaccgctgactacttctgcttctactgcggtgacggagaagccattggggcgggcctaacgggaggggggggcatggagcctcagctgaacaactcccccaaatttcgttcaaagcaaactactattaagcccaaaagagaagctttcagatctaccagagaagctgagtttgaggcaaagaaaaaaaaggaacaacgaggaagaggatgctcgtacctgtgctcaccgacaacgaggcggtgggaacaacgtgcaaggacggtggcgctggtggctcgcgggaagcgggtgacgaagacctcggcgttgctcgacgcgggcagagatgaggaacttgtggggagtcgagacagagtcgaggcagagttgcctatggcagaggagagagggatacagaggtgagtgagtatgggagtggggattaattgatcccgtggcaacggaatcccgtgggttagtttttatgcacttaaatagtttaaaaaaattaagaagaagtattaatatccaatatatcattccacaaacaaacaacttaaaatttgatttctacaaataaaaacaaattaaactagagccagttaaagtatacccactcccatacacatacccgtcctggcctgtgtccaccgtgcgtgctgtgctacgagatccggccgtacgcacatctacccaacgatgcattctggccgggccaggctccctccccccctcggcgcgggccatgtcgtccgccggccgcggcaggcagcagcgcgcgggccagccgcggcgccggtgcgaggggactagatccgacaccgattagatgcccatgcccatgtccattgctcctcgccgcccacctcggtccgcccccggcaaccaacctggggcaacccaagccccggccgcgcgcgcatgcgtcgctcgctcacgcccgccgtacgccgacccacgcacgcgtcacggtcacgccgctcgttctcgtctctctctcggctgccgacttgcttggctcgtatacacgggccgtgtgtgtgccccaaagaacagcgcgtcgtactcgtacgacgtcctgcccatgtctcgcgctgccggggcagacggcagagacgaaggactgcacgacgcagcctgtcaaaaaaactcaaaaaggactcgtatcgtaagtacccctccgttccaaaataaatacattttcactgttcatgtgtaatgttaatggttcgtcttctttgaactgttactagataataaaatatgaatatgactatgttttttaaaaaatcataaaattttcaaataagacggatggtcaaatattggacacggatacccactactacatttattttagaacggaggtagtacgtgaaagatccctttctgatgatgcctgactgcatcaacccactgtacgacgaataatcttcatcagacttctgaagcagcatcgcgtaacaaaaaaaacgtaaatattaggaaatgacataatatcaaataattagaaagggtaaaactttaaacccaaatggtctagcataccatcttataaagctagaaaaaaaaacccttgagcgtttctcagcattgcctaaccatcttatcacgaagctgggactcggtacgtagttgttggttgttgccgcttcgctcggatcgaacagcgagcggctggggccttgcggcagcgaggccggccaggcccctaccaccaccactgccgttggcccagcgctgctgtcccggcaagcggatcgccggggaaccatcgatcgccatcacggatcagttgccaaaccgccggtgcagtgagcgggtagcggcaaaaaagtgaccaaactacagcgagctttcactggaacaccagggccacaccgtgcaacgcatgcaaactgcaaacagcgagactggccccccggcccccggatctgagcgcttcttactgccacgctcgattggtatcatcaaccgtgcatatatatatccactccgttgtgtcatacattcgtaggtgcaatcaaaaaattgtgagatgtacttaatagtgcagtattaatagatgtgtagtttcaatcctaaagtgttatgttcaatcccaacacatgtataatttcttcttaaaaaaatatttagagggatgtctctcagatttcgctatgtggataagttattatcggctgctccttggcttattagttgcgactaaaatttgaattttagcacttattttttaagtagatttttgaaaaaaaaatcatattatattttctagctttatttaaattataaataatattatatataaaaagttttacctataaattattttaaatgttttgttaatatttctacagcttctcacttcacctatcagacactataggtatgtttggctacctcagaggctatcaaacaactgcccacgttttaagttgagatacaatgcaaacgcacatatttatcttgcgtatttacattaacaaattctaacaaacactgatatttcgcacagttcacgaatttaatttgggcccttgttagcacagcaggggtcgttttcgctgcaccttgtaactagcagggggtagctcgtcgatcccctgcatctgttgacctgaaagagacgagacaggcgaagcacgtttctagggcgccccggacacacctccttgtaacgtgggcaccgtcctgccccttgctacctgctgcaaagcccttcacgtcgcagacagaaagtttgtttcctcctcaaatcgctcctaaactatatccatcccttgttaatccagcaggcacacatttctgacggattctagttcccagctctgctttccatagccccttccagggttttggaactcatcaatagaaacacacacacacacctctttgaagtcttgatgactgaccgggctaacaaagccggttgctttcttgatctccgtcttctcaggcccaaaacttattttcggattagaatggttttttatatttaaactgtgcacgttctccagcacagttcttggactgtgcgtgcgtgagccatttcctaagtgtgcggtttaacttttattttagtatctgccaaggtcttgataaatgcgagagttaatcctgatgatccattangataatcgccatgctggatggaggattttggatgtatctgtacagtacagcccctgagattttgactatatgtacatatatatcct

SEQ ID NO: 62150 - DNA, 1580 bp, Oryza sativa
gtcacatgagcaaatcaagcgattagatcacgagatatcagagacaagagagtgacactgttcatgtagtggcatatcagtttgctgaatattctctcctgtcatgaaattaataaaaaaacaacatgagctaggagctatagtgccattgatttggcaccatcagacgcctctaatcaagcctagcacaatccatatgtactgaaattttgtcagcttaaatatactaatgaactgaccagatgtctgctagtctagtactccattttgcattttcaacagcttggagatcttgtagcaattgacactttgcagggccccatgtctgtgactttccatggtctaatttaatttgtgaagccccagggccgagccaaaaactttgaccctctaggtattagggcctagtacatttgatcccaataacctgcttaatcaatcaacctctcttttatagaacgtgttgccccttttcggagtcctaagccacgttgcaattttactattgccgacttcgtctccttcgatatccctgctcactttacaattttacatcgatctgttcttggatgcatcgaagaactcgagctgtgtacttccactacgttatgtgcgcacgtacgcgcgcacgagaggttttaattttttaaaaaaaaaattttgcagattgctttggccttagtagcagtttgtcggtttgatcattaattaccgtgcaaatatatttccaagttgtctgaatttttctattgccagaaacgaaaaacagatcaacaacatcaaattaattaattgttcacaaagtagtgtggtgtttaattatccgaattggttgtgcgtactcgttaagattgtcctttggatcaaaggcaaaaggcaatgcaatcaatccacaaaacaagtaaacaaacacctctagatgcatctctgaagcttatcaaagcagcttaagtacagtagtagtacgtctacaagctaaattaagtagctaatctagctactaataactctactagcagctaatagaaatccacatatatcgatctctattagccctggtccagtacataccaaacaagacaaccctttttcttctcctaaacaatgcaggggccttcggtgattacctgagaaacaaacacttttcccttttcaggagagatcgaagaaagaaccaaagaagagcaaaaaattcttgtcgtctccctcctcaatcgctagctagcaagctcgtcctccatcaatcgtcgtcgtcgctgcagctactgatagagctaggatcgatcaccggagaaggctccggatgatctcggcctgcgggctgttgttgtccatcgtcgacatgagctccgacagccggtcggacaggtcgtccacctcccggtgcaggctcttgatgtagctgcacgtctccttgagcagcttcgacgccgacgactgcatcatccaatatatttctcgtcaagatcacaaccaaaattaccaaaccgaatgtctgaataatcctagtatcctgtcagactctgctagctatagctagctaatctgcattgacgaatcgtgctgcgtgtagtgtacta

SEQ ID NO: 62151 - DNA, 751 bp, Oryza sativa
cctgcagcccctactacagtagtactgctagtcaaaggtgacaagatcactgctcatttagatctcatctacactgcagagttgggacttgggaggaaaggaggaatgcttggacgatgcatggcaattgtcagctgcctcctctgtgggggctggctatggttggcctgcaaatcgaccaatctttgatgtagcgtgatcttgcggggatcaaacgaaacgaccaatttgatggcggtgtgcagcgtggtggtccttggtttccccggtgctggatctttcgtttctagcttctacttgatctttacaactagctacgaagatgacatctgtggagccctctcctactcggaggtagaagaagattcgtgtcaatttcctgtattttcgggctttaacgccaccctctcagatctgaattctgacgattcgtgtcaaatggaagtcctttatgtgagaagaagatttgttcaggacatgcctttgattctgtttgaaaaaaaaataagtttcagttttccacgtgagttgaaaaaatgttgacgttctttcaaacgaggacagagaatccaacttttcgacgagtttgttccggaaatcggaaccgattagcggtttctgctcccaatttgtttcgacgagtttaactgaactgaacccaatttatccgtggaagcagctactacccccgtcccaaaacaagtgcagccatagttttcagcgcccaactttgaccattcattttatttga

SEQ ID NO: 62152 - DNA, 4212 bp, Oryza sativa
  unsure (1)..(4212): unsure at all n locations
cttgcttgtcaaaaaaactcattaacatttatttcttttcaaaaacacataacaatcactgaagcatggtaatggcgcactcaaattagaacacgaatgcacttcaagagagctgatttgaaactgaagaacaacagtggtggttcagacgatcagacagggattgagatccatctaacgtgaaatcagactaacggggatcttaggatctacatatcaataatcacgtcaggagtaatttcacgttagaggatctttttttatcagacagagcctgcagaacggaagagaacagcatgcccaagcaaacaaaacaactgtagaaagcgaagtgagcgtatctcaattattcagattttctgtggtgaaactaattcatccgggttcaagtcttaaacttaacacgagtgctcgcatttattgctaattatttcaactgtagaaaaaaacaattaaaaaaagaaacacaaggatgggttttgtggcaagtgaagcatgcactcatgaagttgcagtaaccgcacgacagaactccgatactcatcaggctagtacaacagcgactgcactcaaattattgcgatcctgttccaaacgcaacgcacactcccgtcccgtggaaaaaaaagaagagacgctgtaagcagcccacagagccaatgggcaactcgtggaataatcactggaatggatataggaggatgagaggagcagtagcagcagctgatgctgctgctcaagaaggtcaaaagaacaaagcttcacgcaccaaaccagaaccaattcaagggaaggcgtgcatttttcaaatcgaccgatcctatgtagagtcagtttcttcctttttgttctgctccaggaacaagtcagcaatttccagctatactagaaattatggcaaaaggagttgtatcaagttggctcactttgtactataagggactgaacaatgcttttttgacctgctaacccacagggatgtgaagcacacaccactacaccaccagtcaagattcagaaacagccagcacaggttgaaagcatgcacttctctgccttgcaaggaagccatctttgttctggtcaggaaagaacgattcaaaaatatctgtaaactttacttgttaaattgtaactcccatcgataactagcttgatttcttttggatcacacacacttgctaattgctatcgctgaatcaaaacaagtaactaggataccacgaacagaatcagcgcaaacatgtcactagtatgtaatttgaaaagaacctcccagttcccacattcatatttctacattccacgttaacaacaaagatggtggtatgacagcaatcaaattaaccaaatccccagtttaaaagagcaaaccatgtatacggttttgcacagaatatgccaagtaaaatgatcgcagttgttcatgtaaatgacagaattgaagcatgccaatgttaacataacaggggaaagatgttatttgaatagaggcctgagtctaatacacatgagcggtaacttgagacaagtttgtcccttcttgttccataaatatttatgtttcataaattccatgttcatgggcatccctgatgattgctcacaagcagcaaaaaaagaatggttttttacttccaaacagcacgaaaacagaaatattttaatatcaagtgactaggatgttttccagtgaactactccagttcaattcatgcgatatttgacagttcttcaatcaacactgctattactcctaatgcgaagatcaccacatgcaccagcacatatatgcaagtcacttgacaagtaacggaagaagcttttattaaaaaaaaagttttaccaattagttaattatcacagaatttagaattactgagagttacccatccaaaataagtttgcatgcagtcacgcaaaaaagaccccaagcctttcaaaagattatgatataaaaagggcagtggtacaccactatgttttttcactatagggcatttctaataaaagcttagtaataacncaggatagagaatgatattccattagtggtttactaaaaaggaatcaatgaaatgaatccgtcagagtttctgcggatcatcagtgatacgacaaacttatgagaaacaactaaactaaaacaataccaagcaaggtcagctctcagcccagacatgtttatacaaacaaaagtcacaactaggatgaaacatatcgttgttgctagtaaaaaacttcatgaaagacaagcacatcatgaagcaagtaaagttgataaaagaaaattataccagcaaacataaggcatggtgttcataattgatgaatatctttgttgcagccacatatgaatcgagtattgcttaacaggttgttcatcaatagtgaaaagccttctgaaagctgttcctagattattaatataacactgttttgcatagtctcgtatctttcaaatcacgagcagttgatccaaatgcaaatgttgaaatggattagcgaggaaaacagaagtattagaagaactcagggggttacatgactgctgccactcagcagatgcccagttgaatctgaaactggacagaaggcagaaatcgctacggagcatcaggactgaagcaattgaacaggctgcctttgtgcataccatccttcataaataatccaccatattgaatctttattcagtggattcaacagcccatcacagcacaattatacacgaagttcccagatggccgcctggcaatcaaattccacacaggcggccgctcatccggggtccatgaattaagctcaatcgtaccaccaatagaagtccttgggccgccgatgacaatcaaccgatcaccacatgctcggaaagcaaggccccacccattcattgacacagaccgttcaggcaacttaccaagagtgatccatttattgttttgcttgtcatacttcttcacatccttttcactataatcagcagcataaagctcattgttaacaacagcaataagtggaggagcaccagtcactccgttgagaccctcagacatgttttcgatcaccctccaagatcgcctcttcaggtcatattcctcaccgcatgtcaacaccttgttgttgctggcaacaccaccaaccacatagaacttgccatccatgaacaccccggagcacatcttccttgcccgattcatgctgggaaggggtgtccaagaatgtgtctccgagtcgtacatttctgcagagctcaatatcctgccagaagaatcagtgcccccagcaacatatgcctttgccccaacacttgttgacccaaacaagcaccgtggtgagatcatcggatcagcccgtgtccatgaattggttagaatgctatatctgaacacaatgtgtgccatcgcaaacacaagaagttcagtgcccacagcaagtgattccttgtcagaacacatgaagcattcatctggtggcatcttgggcacttggatccagcgctcgcgatatgggtcgtaagcgtcccactcgaggacgttacaggagaagtagacccagtgctctgccaccccactctggcgacgcaggcggtagatctccccgttgcgcacgagcgaccggaagtccttgttcagggaggccaccgagccatagtctgaccgtgacagccggaggaggcaattgatggtaaggtcacggccaatcgcaccaatgaggctgctcccgttgccatgctcctctccgccgccagaggcggcaacatggcgactggagccatggccctcagatatgtccggcgtgtgcggctgcggcgatggcggcttgctgcgcttcccgccgccgaagtcaacctcgtccatgtcctcggcttccgcatcctccggcgccgggcgcttgccgttgagcacctcgtgggagaggtacgcccactgggactccggctcgcaggagctcggcagggagcgcgagatgaggcaggagttgccttccagcatcatgccttctccctcgctcccgatttattcctctttcctcctgctcttctgagatttttgatacaaaaaaaaataaggaaagatctttcgctccctctctaatctccttgccgtgatctgcaggaatcgaatttataaaaggaggaaaaaaagggtaagcgaggatgaaatcgaccggtacaaatggatcaagaaccggaagaaaccgctgagatct

SEQ ID NO: 62153 - DNA, 1386 bp, Oryza sativa
ccgagaaaaatccccaccaccacaccacccaatctgcccccctccctctctctctctcctcctatcgatgagcgaggaggaaggaaggaaggatttatacctgtacagatagatggctctatctactgctgcccgcttctaatgcttctgcccctgctgctggctgcccctctctcctcctcacaccctctctctctctctcctctcttgtagtgcgctctgctctcctctcccctctcgtgtacttggggaattgggattctctcctctcttgcctttctttttttttctctctctctgtcttgccctttttattcctccattttttttcttctccttctctctgctgctgctgctctccgtctgttttggctcgttgaaattagaaaccgggcagggcctcagaaatagaaaaggcaagcggccaccggccagggccagctcacctgaagcttaggtggattctgtgcagcctccgctggctgtacagacacggcgtatgcgtctccatccatcgcctcccctcctttcttttcatctgcctgccttgctgattggcatggcagccccaatttcttgtattatgaaaaatgtttccttttttcttttcttgtctgtgtataagttcatttacacaaaatttatggaaagtgtacttataccggtgtgtaagtttgaccaaataaatgtagtgtttgtgtgaaaaaatggtttggaaaagatagtcgtcaattatgggttgcatggtttttttttctataaagttagtcgctttttaatggcttatagtagttttaaaggtgtatagatcctgtgaacctatctgtcccttaattctcatgactcaacctagtttaccctttctttttttgtctatacgctattttacattgcacctatatccggtagcatgtgtcagcagaatgtgccttcttcatcttgtctaagcctctagttgtttttgtcgtaccctcatgtatttttacttaccaataatcaatccatcgtgctattgctccgtgcagagagtatggtgtcatcgttgccgatcaaatgagaaaacaacaatgtaacaatatgcattgatacgaatttgtagataacaagccaaaatatcaatggctggagcgagtgtgtttgttcggaccacacctaaatctaactcctagtattggatgtagaatagatgcacacacacgtgtatggtgcagcatgatttagttacgtgttatcacccgtacgtatgtgaaagagtatacatttctatatcaatcaaaagctaggaaattgatgttcttttaagaaatcttaagataaccgccggatggaaattccatggaaaagactaaagaggagcacattttctatagatttttcttaatttgt

SEQ ID NO: 62154 - DNA, 5984 bp, Oryza sativa
tggttttatctgaatcttgatgctgttatggtctctgtacttagggagtgtttgaagagaaggggattgaggagattgggaagatacgcaaaacgaggtaagccattagctcatgattaattgagtattaactattttaaatttcaaaaatggattaatatgattttttaaagcaactttcctattgaaattttttgcaaaaaacgcaccgtttagtagtttgaaaagcgtgcgcgcggaaaacgagggacaatctctcctatctccacctaacgaacactcccttaatcatggctctgaagatttgatcttgtgacacaatcctactactactactacctgaggatactgatatgcagatatggacggcattgaccaggagttttgagtagaaattagagacagaattgagaattactagcagctaccgagcttactgagttgggacattttggattgtaggtgatccagtagttgatgaaaatgtgctggtatccatttatttggataactgaacagatgttggaatctcaacgactgcatttgtggtagtagtatcaagtggtgatcggttttagtttctgatgttaagtaccaggagtgctactgctaacacactcccttttgttcttggtcactggggctatgatttctgttagtagtgcccactgggttttttgcgttgattatccatgttaatgagtgggattaagggatctgccctaaaaagaagtgccctcccatctatgacaccaagtgcaaccaacactttatgctattttttcctcttttccttttctctctttctgtgcatcctttcacttggccaaaaaaattctctctctctctccctccaactgtacttactttaaagaaattggaggatgacgacaacttaacccaccaatcaggaataattctaaagcctaaactttctcgctgccttggtggaatcagtgaggaaaaaaaagagaggatagttagggagggtaaaaaggaaaagagaggcaaaatgcatcagccaaccagagaaagagagacgacgaagaagaaagaatatgattctctcgtgtcaatgtgaagaaaaattgaaactgcggcttaaaaagaataagaacatggcaacagtatatgaaccgtgtcactgtcctggcttgagctagatcaactctctgattagagttttatttgaccccgtctcagcttgtgccgcacacgattccaacgtgttccttttttacacggctagctatctaccacttgaaacaagcacaatcaacattattcttttatacaaatgcatgggagtcttttataagcctccgtaagaatcatcaccaccgttttctttgaattttccacactccacccaagcccttctactgaggccacatttaaatcgattatttattgagaaattccatgttagctgtggaagggcaaagaaccggatatataagaaaggctcttacctccttgactagcttttagggtgggaaataatatttacgatcctatgataagtaccagatcgagcctgtcaagttcaatatttttagctcgatgaacactagaatgtgaaggtctaatataccgtggatttggagagagaaacactggtgatagtacgattttgcccctgccatcgtttcgtttacagtggactaggggtgtgtttgaggattggggagattggggagattggggagattgggaagatacgcaaaacgaggtgagccattagcacatgattaattgagtattaactattttaaacttcaaaaatggattaatatgattttttaaagcaactttcctattgaaattttttgcaaaaaacgcaccgtttagtagtttgaaaagcgtgcgcgcggaaaacgagggacaatctccccaaacactcacaaacgaacggtgcctaggtctggttcaaaccaagatctccagtctcactcccatgaatccccttccgctctccccaaaccctagaaattggggcggcgctgtgaagtactagcggcgatgtggtcaacgatcggcgaccagcttcggtgagggcggcaacggattgaagccgcgcatcgctgaagttgtgagcccggcgtggcctcagcaatggctgggacgttgcccgctagggtgatgtcgcccaggaagaagacactggggaagaaggtggtggcgaagaggtcggtccatgtgatgagcaccgaatccccattcaagtccttcatctgccagctcagattcgccgctaccagcttcaaaccaccacgccgcagtcgccgccactgttattcctccgcggtcaaaatctagggtttgtgatggggggattgatttatgttgtggttggtttgaaccggacccagtcgtgttgaaataagcatgcccaagggcaaacttgtctttattggcatttctctctccaaattcaccggagtgtctaagagctaattacatgtttttttatgcccgatagcaaattctcgttcttacggtgtccactaactaattacacattttttcgatgccccgtagcaaattttgtctacatgatacatgcacatttggtagtagtaggagagaggtgtaatgtacgtgaggtgaggctaggcgagagcaacccatggatggggaagaaggagccacatgcgtgatggatcgtggatgagctggtgcggctgtgcccacccatggatgcatggatcgatacccgcggcgccctaaagctatttgtgcttgcttcacatggctaactaaccgctctccccccccccccccctctctcttgctcgccgctgttgcgatgtgatatatttctttctacacaagcatgttcaaggcccacacacacactcgatccatccaccatcatccgtgtaatcacgctagctgagagataagcagtagggagaaagagggagagacgatttgctcatttgcatgctgtgttagctgctgctggagtagtactactactaccaccattgcatgcagggggtccaatgattcgttcccacgcttagacaaaggctctctctctctctctctctctctctctctctctatctcgttgcaaattaaatgtcacttcaagtgaaggctaactactgggttggttgcttttcgttgatcgatccgtgcggaattggtgaacggtgaagtacaagagggctttctaggatggcaatggctccttaccgatcccttctccttcccttccagttgaagccacactttgggactcaatttattgcatccaagacacgcggttgtactaactgtctactcctcctagtaccattcttctccaccggagcatgtagaagttggagtattagctagtactctactaccgtattagccattttaatctgttcaaattatttacacacaacattaccaggaacatatactcctattgtctcaaaataattcaacttaggatattatgtaatatatcttaggacaatgaatttggataaacttttatccagatttattattctagaatatgttacatcatcatctatgttaaattattttaggatagagatagtatatgtgtacactatccattgacaagtggagtatcaactaatctgcaaatagtagtataaggtcttgtttagtttccaaaatttttttctcaaaaacgtcacatcgaatctttggacacatgtatagagcattaaatatagataaaatgaaaaattaattgtatagtttgcatggaaatcatgagacggatcttttgagtctaattagtccatgattagtaataaaatgctacaataacccgcatatgctaatgacggattaattaggcttaataaattcgtctcgcggtttccagtggagttataaaattagtttttttttcattcgtgttcgaaaaccacttccagcattcggtcaaacatctgacgtgacacccaatttttttttcgcgaactaataatggaaaagaaatgttggcttttcagtccggccgttattgatgtcaggattcaggttcgtgacaggttgaagtagtattagtagtagtggttggagtataatgctacgggggatgggtcactcgtagcagctggcgcccagcctccagccaaggcgattttggtcgcatgctgcgccgtgctggctggccgcgtacgtgatgattttcctcttcctcccccgcgcccatgtccaatctgccgcgccgccgtcgcgccgcgaacgaccgattcgcttctgctgctgctgctgcgtcccctttgcctcctccgcgtatggaccgccgtcaacaggggggtccaaccccaacacccgccccccccccccccctcccccccggcgacgcgatcggcggcggcgacgacgcggattgctactactactagttcgtctgtgggtggggttggttggtttggctgctgcgagctttgcgaggggctcggttcacaccgcgacggatgggtggatggatggatggatggatgggatggagctgatcaatcgtgcggtcacctccgatggggacgtcgcacccaaccatacatctcacgcccagtccagcccagccgcagcaaacgtacgtactccccatagtaggccatggtgacctggtatgtacaaaaacgtcaaaaaaaacgtagaatcgcccatacaaatacgtatacctacaaggctactactccctccgtcccataatagatgacgtttttgactttttattagcaacgtttgactattcgttttatttaaaaaattagtgcaaatataaaaaataataagtcatatgtaaagtacttttgataataaagcaaatgacaaacaaaataaataataattctaaaattttttgaataagacgaatgatcaaatattgacaaacaaaaacttacaaagataagtaatatgtaatataggacggaggaagtataattcaactgctgattagttgggtcgtacagtcgtacacccgtcaagtaacgaccgtaccacaggtgaaacactcatcgaaatacttctccataccgtaatactatatactagctgaaaaattcaggggatacagctataatttaggactaaggaaatgggtggcagagttaatggggcagttgtgttggttcctgaggtctgtttagtctcaaagttttttttttccaaacttgtaactttccatcgcatcaaacctttcacacgcacgactttttagtcacatcttttcaattttaaccaaacttaaaaactttaatgtgagctaaacacagcttgaattctttgatgtgcatagcatagcagcagcgctctgtagtactactactactagcagctgatgaggcgattaggcgtggtccatgcatttgcatttgcattgcgttgcacgcacgtcctgatgaaagcgcagagaaaacgagaacacaaggcgcatggtccgtccgactgacaatcaaaaggcgtaccgctgctgctgcctgctgctaccatcgctttgctgttttagggatcgccatgtttctgcccacctggctccccttctctcgttaatatactccctactaatcgcctcgtgactgcaagggtggtggttgcaggtagcagctgtagctaagcctaatattttcttggtttgacggcgacggctgtacgagcaagactacagttagggcctgttccaacccgatgaggatgtggattaagcgaaggcacatagcactagaaagtcgttaagatatgattaaagttttaggattagttagatagaactcaaacttttaaatttaaccttagaaattgggtctaaaattaatttatgaagctgcttaaaacccagctttacctatcctgtttattttatgaaagcgcttcagccatctccacttattttttaaggtgaagttgaatccgtttggttgtgctcatcctcttgaagctgtgtcaaacaaacacttaattgttataaacctgaaaaattaattactttcatactc

SEQ ID NO: 62155 - DNA, 3143 bp, Oryza sativa
  unsure (1)..(3143): unsure at all n locations
tggtttaggaatgccttgctagcttatgcttgcgcggacggctgtcagtgcagatgttttgcaggttgcaattgcgtacttgtgttaggcttagatgattgcgctccttgttcggatgggtggagactggagaggcgaaggattttctggggatgatgcgaaggattttctgtttgtgaaatgctggtctaaatcaatgcgtatggctatccaagtgttaatatgcaaaaaaaaaaaagtaatcaggaaaaaataatatgccattgtggttttgttttttagaatacacaaggagtgcatatttgtattaagaggaataaaagttatttacaggagaaagaaaaacaagaaggggacgggatacagatggaaggaccgaaaaaaacactaaactaaacctattctcacaggattattgagcgacctagaggaagtaaggggttggacattcaacgccataatggggcttcggtggccattgccttcacaagctccggccacgatctttaactctgggaatgatgcatagtttgatcttaaactatataaaggctgtaatgcatagtttgatcttaactttccatcgttttcgttaatgaaagcgggagagatgcggcctctctttatcaaaaaataaataaataaataaaggttgtaatgcatattactgcatacatgatccattatgtaaagttcatggttgtttaagaaacctatttataagttataccatcaggtgtactgcgctnttagatgtaatgataagggtggggagtgaaggatacaggaaagcttcagactaacttcctttttcattagtaagagtgttgtgcctccagttagttgttccacgcacgtatctgatatcccacgtatttatttgatcattgaactccctgtcctcctcatactgcaacaaggattatcatttaactggaaatatagcatttgtactgttaagctataacggggactggtatacttttctatacaaatggaacttagatattctctcaagtcctatctagtaactagatccgtatatttaaaatctagaattatttttggctcttctaaatgatgaaaaagttaagcttcgaggcccatttgaaccttttgatttatgcaaaggcagttgctatctgtcttaatattggaaggatttccttgtggtgctttagatgctgcactatcaatttagttctatgctgattaataagctttaggtagacctaatttgagaaatatctattaatcttcaatctgcaatggtcttattgcattcgaaacttgttagttttgtttttgagggggaagggtaggagctctaccaatttcattaaggaggatagaaaagatacatgatcacctctcaaagggtccatcgaaacttgttagcgacctggaaatgaataaatactcctttgtcatcgttcagcaatgctgttgaacataaaagtcttgatacaggaaacatctttcccataaacaatgtaaagcttcattcactaattacccaatcattgggtatgaagcttctctgatttatgtttcgattttgtcacgggattttaccaggttctgtgtaaagttgattttgtttgcatgtcagcatccttcagtccaccatctactcataggttgcaactgttttccctgattgtttttcccgttttactgatgacaaatgtcttgcctacagagtccctttataaagtactacacttatgagtaccctgttggtagcatcttttctcttaccactgtctaattgtctataataaaaaacttcaatttttttgcacgttagtttcattgcacttttattagaggatacatgagatggtagaagcattttcttgttaaaattcttgccaattgccattattttgagtttccattacatggttacaattctcaatcagtaatcgcgcatcgggctgaaattttatgagacatcacatattgtgctacttttagtctatttacctagtaagaatcaacttaacaagatgaggctataagggtacctagctttgattgtttatgtgttcccttccctagcacgaaattctttgcaaaaccttaaattgctatgacagctttgttaaaattttaatgtagcaacgaagtgttgggtcttttgtgtctcgtcatatatttgttgaaaatctgagtttgtgctcatgttgttggagaaactatgttgtgttttataccctaaaagtccaaaaacccagggtagtttagtgcgagaagtatgttacagaagtcaattgtagtttatgtggtcaggtaacttgttgctattattaccatgaaaatagttattaacttcatttgacaatgctgattaaccattgcctgccgcttcctagatgaaacaatttgattggatgaaacatataaacaacaacatttagacgtgatatgcactcagcatgcatgaaatgttgtctgaagcttttggtgtcgacaagacgacaagtatacctccatgctttcccttaatctccactccctttccttgaattcccttcctgaagctatctcaacacattcaactcctattcagctttgctggaaacctatgtatttgctttcttgtctcacaaacactaaggcatgattatttactgcagagtgaagaaatttacaagcagtcaccttgctgccttgtaacactcgttactcttttttttctcatcattgacgcttggtcctgaatggcttcctccataagatggttactaatagctttggtctcaaataatttattttaacaactgtttaccaaccgtccaccctagtataatctagctttcaatgatgagcatgttggggttctgcagcaagatctggattcttttctttgttaattgaaataggtttattgtattccttgggctattggcaccaagaacgttgtcagaactttaattttaatattcatcagcaagtagccttggatttcccaaaagtggctgtatatttctcaaatgtgttgaactgaagacagctgaccttcagtatctccagatcagatgattcctcttgtgtcagagtaatacctgtcaattcctctgattaagatctcccgtagttatatggagagtggaagcttctttcactacagtatcgac

SEQ ID NO: 62156 - DNA, 16530 bp, Oryza sativa
tcctgcagcccacaccctaattattcctgaactggatcggtcctggggatctttgcagtatcaggcagtggggttctacactgccctgattgatctggttacaaacaaacttacaacacattattcacataaagcttttcacttacacatgaagagggttccagattaaaatagctaaagcatgtgactgccctgttagtgctgagcactatgttaagataatgcatgtgattcctagcatctgtatggcaggcaggcctacttgacctattgtttagtagataggaggtactcttgattctcttgcttgatcaagtgtgcacttaaacaagagactgatctcacttgtgtgtgtgtgatggtgtgaccttgggtggtggtgaaggggctcagcataaataaatcgcctccacgtgacaacctgtacggggtgttttctactaattggattgagctacatgtgacccatgagacatgctgcagtccaaatatgcttagatcatcgcccactagctgattttgattggtgatttgatgttttatactggttacatcgtacttaatgaggtacatagtcatttgtagagtttcttatcctgtagttggtattctatgtaagagctatgagggtaattatgcttggaacatagctagggctaattaactttgtgaaaaggtcaatgggaccattttataaacaggcagtacctaacagtttatgattattttatcagtggcagtggatcttgtgaaaaaaaatacttgagagacaaagagaatttttagcgcatgtatatgctgtgattggctggctaatcagatgtttaccaggctaatatacctattagctaaatcttgtgctcatcctacgtcattagctcgtcatttctaaattatctcttcgttattatagattttcccatcgttatcctagatatcctttaagttcataaatgttgctgcacaataattatttgaatgccatttcaattaattgtttagcagtttgccgatgaacatgttttcgtttaaatgaatacccgcttatgagctagtgcaatgtgtgcattctacagatcacttcgatctgtagcgttgcgctgcttgaaaacttcatctgcattactatgacatggtgttttgctgtgctgcactttgaatgagtcactaatgaaaaaaatggaggagatcttgcagctggaatttgctttaggagcattagagatcttgatataaaatgcaagcacacacgcatgcacatgtttctgttaaataatttattgtcatgtcaacattataataacatctcttatatgcagctgttgttaaatgaagaaagcacttggaatacacccagtagttgcactttacctgctggagagatgcattgactggtcaaattctgaatgattgctctgagttgtgcagcaactgtttcctggaatgattcatttgcttcaagatctatacataatacttaataactattaagtttgtaaacatatagggtgccatatatatatatatatatatatatatatatatatatatatatatatatatatatatatatattttgaagagaatatagggtgccatatagtcccctgcatctagccctccttgaatacagaactaaatgttgtgtaattaagatccacaaatattcagataccttacatttgttagagttgcttggaagctgagattacatgactatgatattcagaattaaatgctgaacatttgttagagttgcatatagagctaaatgttgccaagactaatttgttgcaaatcgtaacttcccaaaagccattacaggttatgttttaaagcctcaatacatggataccatagccataaaatatttatacttattctctgttcccattgtttaacatgtaactgactgaaaagcttgctcactgtattttgttatcaggtctaacttgagcaacagaacaggaatggctaagtgggggtgtcaagactcaagaagttcagaaagtaaaatacttttcatgccacatgtaagaatttacttacaatcagacaattccctagtctaactccaaattacatacccgaaagttgaagcagtgcagggacctgatgcatctgccctgatatcggttctcgttctccctgatagtttgagtaataacacctacagtgtgacccatgcctgtattgattatcaggcgccacaagacatgggctgtggatgccagatgattggagaagagaccagccagcatcgtgacactgctgagtctgatacacatcatgaggtaatcagcactttaaaattacttgatccggttacttatgttaggtcatcaactgatggtttcatcagcaagcatagtaattctatatgacacaggagcacgtttctagaggacagagactttcatgattctattttccttgtttggtatcaaaggtgtttagaaccatgtagcttagttatataaatatgaattaaactataagcaaaataactatacattgtctaggaagcaagtcctgttgactgcttcaccctgcgttgtttttcctctggacggccacgggcggctagccggggaggcgtggcagaccgcatttggccggcgcggcagcggcggtaggagtgctcggaggccagctcgacgcatagaggcgcgggctagtggcagcggaggtcggcacggcgcgaggaggcgcagctggcggtagtggaggctggcttggcgcgaggaggcgtgggcggtggcgggaggctggcttggcgcgatgaggcgtggccagcagtggaggaggccgacacggtgcgaggaggagctaccagtgggtgcggtacggtctacggcgcatgaaggctggccggcggggggtgccggtgtagtggtcccacatgtcggcagaggttggacagtgtggagcatcggggcgccagccatggactcgcaggtggtgagcggcgggtgaaaacccagcccagcctcggccgggccggcaacagtgacgctcaaagcgtcattccccttctgggggcgttatcatgccgtctcatccctcgtgtgtggacgttgggtaaaagtcgagtctcggttctctttgagaccttgacggacgacgacggcagtgttttcgtcgcttctctccttggagacgtcgtttaggtatcccttagccgaaaccccccatccaattggtgcaaactctctctagatttcttcctcctgtggcggcgccctagtctctacaaattggccacgtcggagggcctagaaggacaggagttccattcttctctctcaccctctctccctgactcctgaagacttggatagagcggggctttgtgttgattgtaagggttgggttttgggggatctcagctgtgtttctttgtttgcctagaggcggtcggtcacgcttagcggctgctggcccggtgctagccttttcttggttctgtgttggcactgttgatgtgtggatggtggtatatttttttcctttttcctggttacgaccttccagggttgtaatcttgtaatttttctcctgctctatcaatagaacctcgcacagtcttgtgtgagtcgttcaaaaaaaaaaaagagctcctagtcctgattaggaagacaagaggtgtatgcttcatgcatggctgtatactgaatcctagacatggatacaaagccatccatcaataaatgtagcctcaccattttttttcatatacatatatattattaaatatcaaatgtgggggaaaataataattaatccacacattttttgtaggccaagtaacatggtttgcgtggttctttctgacagtgtaggcctccaagtcgccttctcaccagcactttatctcctgttgttctgagcttctcccacttgcaaggggcaatacacgagtagcagaacatacactacacatcactcctcagtatggcctgtccctctcttccatctctaagagttcctcttcccaattcatgtttctggcatgtgactgccattggggccatattgtagtgtggcccctgttggtcagagccttgagctaggtgacacacttgttgtaaacgggaaggtcactctccctcttgcctgatctcatcaggttcctctatttgcagctagtagtagtctatttaacacgccagtagccacccatttctttctcccgtgcggctgtcttgtgtttctcaaactttgtcttacgccagccaaccgtaaacagacactgtctgcgcgtctctcttgcaagaacagctagctctcccatacatctctcctacgttggctgagatcgattgctgccacctacattggccgatatgtcaagccggaggtcacggtcgaggcagtcaggctcgtcgaggatcaccgacgagcaaatcagcgatcttgtatccaagttgcaggatctcctccccgaggctcgactccggagcaatgatagagtatgtaattctatgcactaaatggttaattgctccacaaattcccagtctaaataacagctcgaatttattctagttataatagattagcattattcaccgttcactctagctttgaccacattaagatgggggtagaacatgatcggttgttacacctactgccttggcaaaagaaaaatagcagcgcaagttgaatgctccttatttctaattcctaagcagaagttgaagatcatatgaactgatgttaccaatcgactaatcgactatgtcaaacaatccaagcatcgcatcattttgcattcctttttccttcaacaattgtaattaagcaccaaatctcaagagctgacagagaaatcttctcttctccaaatccaggtgccatcttcgagggttctgcaggagacttgcaactacatcaggagcttgcatcaggaggtcgacgacctgagcgagaggctgtcggagctgctggccacgtccgacatgagcagcgcgcaggcggcgatcatccgcagccttctgatgtagccgccggcggccgtcgtcgccacattgtcttttgctgctgggcaatcagcgcgcacacaccctcggaatgtttgtagcttagagagtgatcttaattagtactggaggagcagggattcctaattcactctacgttcataagtaatgtaatgttgttgtcatgtcatcttctaaaccagatcaatcttttttgtgtacttaatcaaaatccatcctgattcgtgcaaagttcatacagtaccattttttgtgtgttttttgctgctatgtgtacagtatagtaccaacctcgccggcttaggaattgccagcgagttgcctctttcggcgctggctgaatgtacacactgctgccccttttggcacaggaagattcttaggagttgtctttcagtttggcagcagggtgctttgctaatgccagattcctctctctctatttcctaagtatcttacaaatgcgagctctcaatttgtgcaagagcgacaaaagcgtcgcaattatcagtccatggccaactgattaatcatttaatcacaaacacttgctcggttgctccatattgtaccgtgtttgtcgcaaaaaaacaaaaatgccagtttgatttacactttggaagcacggtttccatatttgctaatgccaaatatctgtagtacagtactccctccgtccaaaaaaagataaaccctgggttttcgtgtccaactttaacggtccgtcttatatgaaatttttttataattcgtattttcattattgttagatgataaaacatgattaatattttatgcgtgacttgtctttttatttttttcataattttttcaaataagacggacggtcaaacgttaaacacggaaactagagtttgtttttttttggacggagggagtagtaattagtaaaccgtgccagcctagccgagcgtgtaacttaaaaattacattggccgttgaaaggatttcgttagctgcaaaaaaaaaaaacaaaaatgcctggttgatttaccctttggtcagtctgtgaagaaatatctggtagcagtaaaccgtgccagcctagccgagattgtaacttagagcagataggatagtagattattagtcaagctataaacatattttaataaaataaaagatgagagagaagagcagcgggttacagattatagcacggactccaagacacagtgtatgtatgacagataagattatatattaataatatagtaagcaactgttgtataaattgatgattagattgactatagatgaattggagccaatagtaagctatactattaaacttgctcttaaagatcacattggccgttgaaaggatatgattagctgcagagccgataagattttcaattgattctaggtgggaagaaagaaccgggagctagatgattcgttaatatcggtagcatcattttagaaacgaaccctagagattctgctatcctatcctccgtgctccccaggctcccggcgtcgtcgtcgtccctacacttcgcacccagtaggcactaccaccctatcgttgcaggtcaaatgaactaggctactaggcgctaggtagctctagtacaagtgaagtattctatcaagagaagatcaataaccctcgtgcacacatgccactagtccactactccactaccagtgttgagcaacaaaccaaccagaagcttttgctgcacgggtgcatatgccgctgtcttatcgttgggattttacggtgtttatttttggtgcagagagaggcttttcagaaagttggcaactccgcctagtgaaaaagcagcgcgtgacgcgtcgacgcacgcgactacgcgacgagagttagcggcgccggaggcggagacaagacaccgaccgcaagatgggccgtgcgttcgatctgcccgcgaggagcagacgagccggcctctatccacgcgcggtgaacggggccggcccgggagaatatctgggctacgcgctggtgtgacgcacgcgacatggagagcggaggcggagtatcgtatagaaacaagtgcaatttgaccctcggaacaatattgatagtagtatttacttacgtgaaataccagttatcaaaagaaaataaagtaaagcccacttgtcatactcccctcactctctctctctctttccttctacaccccgctttcactctacccgttttattgccaatagcaatggggtgcacgacagcgagcaccaactaggtgacagcagcagtaacccgatgcgtcgcatgccttctgtgtcaagcggtgccccgacgaggagcggttgtcttgagcacctccttgtttgcggcacaattccggcggtggagacggtgatggcatggtgggccagtggaaggcatcgaaggatgtagggagcgcgttccacacttccactccttgtccgcgctctgtgccaccactgctgcacccttccatcgacgacgtaaagcagtggcgacgaggagcggcaatgtgggaggcgagaggatggatgggccagcgcatgacttcttttcctcctccccgatagcaaccaggcgacgcccaacacccccaacactggacatcagacgacgcccgacacccctgacacctgacatggagtagaaggaggaagagggaagaatgatcgtggtgaggacaacggggcggaccggtccgacgccatccccaaccgagctagccaccaaatgctagatccgatgtggcgggacaaagcaagcttgcctctgtccctcttcttcgttgatagctcctcttctccccgagcgccgtgcatcgagataggtacgacgagaatcttggcacaaccaatcttcttcctcaacttcctctagtcgggactgcccacgcaaagccacggttgggaggccctaacgcgtgatagcggcctagcctcaagcgaagcggcgacaacttggccttgaggtggaccgatggcacggcagaagccggagcgacaacgtggcctcgaggcggagtggtggttgggtgctcctgacgcgtggtggtggcctggcctcgagtggagcagcggtggctcagcttttgaggcgaagcaacgttgcggcttggagatggagtgacgatggaccggcctagaggcgagacggcgacttgctgtgcccagacactgccgccgttgagagacgtggcacgatggagggcgttgttgaagtccccgtcgtccttggctcgccccactgcctctatcgtcagtggcttccgccgcatgccatttactcacgatcgatgccatgtaggccccatgtgctgacttagctggttggactaggttaatgagccacgttagtgaaaaccaccgaggaagtcattttgaaaatactcacactgacatgtggggctcatatgctgacttaaccggtttgactaggccaatgagccacgtcagtgaaaatcaccgaggaaatcattttaaaaatattcaacatatgggccccatatgccgactttagacagttgaactagatcaatgaatgtgaaaatcaccgaggaaatcattttataatggtttttaatagttgggaacaaagatatcttatatttatggttgagggataaattaaattggacccttatctgcccgcccgaattttttatttatagtaattaataagtcttgaattaaataagtggtaaattttaaattgaatttgtaaaaatagcatgaacgttgtttcaaagggcgtccagacttggacggtgttctaagaagtgtccagaggtggacgctgtaccgaagcacgtccaggctcggtttggggcgcccatgccgccatgcggagaggtgccattgtggactctcctctcctcgggcccaatgttggtgcagggctcgggcaaggtgctgccatgcccgccgttcacctcgactctgggagactgcaacagccgccttccggcttccgcctccacaacgtcaggaatctgccgttgcagttcacctcaactcacctcgaaggctctcgaatccggagaggacaccgccgctttctgccttcacgccgggaggtcgtagccgctatccacgttctggttgagtcatgctggaacaataacccactcgtgccggcttgtgttgcgtcgtctgtccgcccctcttggttcctaacagcaagtccaggcatcgcctcactccaggtggctggccgagcaagtatgctcagttcatagatcttggtattcaggtgtatatgttctgcaatagaaagcttacaaagaatgcaaaattacgaagggtaggacgcaaacatcctccttctatcagatcatctattgcccgatgacttccaatctctggcctgttgcaaaaggaaaaaaaaaagcatcgatcgaagacctcgcatgcagttcatctggcggccgcttctcaagattcagtcagtcgcttctcaagattcagtcagcagagagctcgatgcgtagtaaacaatggaccagaacaaaaaccaaactaatcaaatatctcaaaataaaagtggtggctgttcacatatgaccccgagtagagtgtccgtcatgcggaacagcggaagcattgaaggagggccgggggatggcgaccctgtctggcagattaggtagagagcggtgcctgctcggcaagcaagcaatcaacgagagacaatagtctgcataggagtaacgaggtagagttcgaccattgtgtgattggattcaaagtccaatcttagtccggtgaattggatggctctttgaggtcttcaactgcagcattatggacgcccttgtaagaagcgtccccatctggatgttgtctacaacagcgtccacacctggacgccctatgcaatagcgtccttcctattttcgtaaaaattgactttgttttattatatatttaatttctgcattattaattattatgaataaaaaattcggtctgcccgcactcccgagcggtacacggcccgtcacgggagaaaatctgggctccgcggttccgcgcccgcgcgaccaccgaccacgcgcgcgcccgctcccgctcccgcgtcgatcggccgaaacgccggaacggtgcgcgcgggatcacgggccggctgcccggccacgggagattttgggtcggggtgacgaagcgagcgaggccggccggtgcagtgaaagtgaagcccaccgcgcgcctacgtacccaaccggccgcgcgcggcgcgcgtacgaagaaacgtggctacgtgtggccttcctggtcggcgagtccgccgcgcgcgcgcgtccccggtcgcccgcctgcgtacgtacgtatctcgcgccgtggcaggagaggcaccagctagtaccaggcatgtcatatttgtcacacacaccgcacggtgacgacgtacgaagcgattaggagatttgcaggaataaaggccgcgcccccacacactctgcgtctgcgtacacatccatcgatcgaccatacgaatatgttcaagagaagaatggggtaacacgatcacctggcagggtatatcaatcgtggatggatctaggccagtgggatataggggcgtgtctgaagttgacaacacctaccctgtggcaggtgcatgtacacgacgcatatatatgtatatgataatatataaagtcttctgtatgattgcagcatccgatcctaagagcacttcttacagcatcctttggctttccatcaatcagtgccctcccaacatccacattccacgcggtcaaaaagcacatcaagccaacatcactgcactgtgctcataatacaggccatacaggtataggctgcctcactggttcgatatgcttcggccaaaaccaattcgatccaagggtgtatagttctcaaaggaaaaaagatccaagggtgtataggatctggacctatcagagacattcaaattaaaggactttttgatggtaagaatcgatcatacttttgcggaactctagggttacacgcttcaacacaataaacgtttcgtttcgaatttctcctgagaagacctccaacttgagatacaatgaatcttttctgttcataaagaaaaaaaaattaggttcggatccaaaggtacggttaagaccgattgtagaaagtgggtgatacgtttttgtatttctatgagaaaaaaaatacgacatccacaaatcttagtagtaagtcatcgtcgtcgtatcacgtgtatcaaattcttattaataaggaataataaactagtaaaacttcatagccctccatctctttgcggttatcgaatatttttcggttctcgtgtgtgcgacacgtgtaaacattacacgtaggtacaaaagcttctcgtagttggtgacaagaaccgaatgggttgtctcccagttatttcactgtatacctatgccctagggcttttaaagatggtcatggttgatagaaaatgatatgatatctatgccggtttggtaaaccatatagatcttgtgcaaataaggagtagggctagcttgtaaggcactacttagtactacgaggattcatacaaagttccatgtgtagataaagcgggataaacatgagaaataaacatattctcaactagataactatatggtagacgaccatcttccaatttacaatatatatctttcattgggtaggtaatgggaataatcatgcaatttatttatctcgtaagttgctttgttacacaatcgtctaaaattatgtagctagccccttaatggaaagaaataatttataaacaactcaaacacactttcccttcctcatttccccattccctatatatccatgaccccatcgcgatcgtgccacctcggccccaacaccgtcatatgtcccagcctgttgccgccaaacatcgcaacccaatctccatagccccccagtcttcgccgaccatcccaacccataatcagtggctcctcaccctcaccagcactattgtcttcgtcctctccaatgtctttggtatctccggtcatcatcgcctccactaatctttgtccacctcaattgacacgtccttggctgcgttggcatccccaagtgctcatcggattcgtccactgccaagtcctcgtcctcgtggcagcttccccatggccatgaccttattctccttaacgatgacgtatttctcaagtgttctccagatctgactatggcaccaggttttctgttgcagtggctccacgaaatgcctaccggatctgtcggtggtgggccatggtcgattgcagcatgctcgtttgtgaatttcctgagacgccacgctctttctccatctcccttttggaccacctactttaatttctttgggccttcacgtggcttgcagatattactttgacacctataaagccactctcaaacttcaatttacccgtggcactgcgcctagcttggatgaaaacacactatgaatgtaatatctactgttgctctctaaaaccaaccgcgaatgctggaggagttaacagcaaagacaagaaaggataatcgagatcctctacaatactatatgtgcagtactacttactgacatgtgaatcaactgtcagtgagtcgatatgtcgtgaacagtactgcacatgtatggcactacaagagtacttgcatcgaaggaagaagcgtcaaccccccccccggggcgcggcgagcacacgcgctagtcgcggtagcgcgccctgcgattcttccttatccattcatgcatgcatggcagaccattcctccattccatttcgatcgattttaactcctcggtattgcaaacccgatagcctcggtatgccaaatcttggtgttacggatggatgcatggatgatgtggttgaccaacccgtcgtcagttgttcattgatcatacgcatcggagaaagaaagagactttccgtctttctttaccttccaatccccgttgacttggatcatgtcatgcagctatctgagtgaattgtttaattaagcaagagacattcctcgcttgcactgcaccggccgggcacagaacaaattgtcactgtcgcggtactgaattattcagacaatctggctgcatctcctcattttacagcatcagttagacaagccaccttttttccagtagtatgggttatgtgtaggtttgctgcatactcctatataggagtatcgctttagggaatcaatgtgcaggctcccatagagttccagctgaatgcttcagaaggaattgaatgtccatactgcagatttgtagatgtagatatcgagaagcatagccttatatctgcatgcatggacttggatatttctctcttatctgatagcccatgtatagctctatatctgcacaacactttaccatgcacatatatttgcatctagctacaactccgtcagacatctagctagctaggaggtgtgtgcaacaagaacaatatcatatctcacaccttttccgaaaacttcaatgtcaaaaccgcggcatcatatctccattgacgtggttttctctttttccagagaaaaaaaaacatgcatgttcagtagtacgaattatagactctactgcaaatgccaagaaatattaattgggacaaaaacgacgaaatgaacactgtattaacccgatgcaaactgtctaaaagtagcgtttaattaagctgaccattgcgaccgaccgaccgaattgaatcgagtctccaaaagaaaaaagagaaaatgcccttctcctgcatgcatgcagtccttggtgcagcagtgacctcactgaattttgtttgttcttggctagggactgcttggaattggattttagtctagcaaaatttgactccaacatgggagcatgtgagatatacatgtcattgatcacatcactatactgctgtgtatcttttcataccaactaccataatatggtagcccaagtagtggaaattaaagaaagcacaactccatatctcgatccatctatcccttatcactatatatatctatatcattatcccgtagctattttacaatatcacaaatatataaaaagatttagtttttttaaggagtgaatatgttcgtttcagtttgactataatttcctgaacttttttcagtgaccgaccaggcgaccacccgttactaagatcagggtaaaatgtgaggccgacatgtgtattactggtcaatggcagaactgaaattcgaaaatgtattgatgtattattcctcttttttttttgttcaaattaagatgacacgtaggctccagcaaccatccacgtggcggcaggttgtgcacgtcactccatctccaacacatcagcattttcagcaaagaaagaaaaaactgtagtggactttgcagaaaacgctgacgacgagtacgtacgaattaatgccttaatcatatgatatctccaaagattaattaataagtggcttgcttaattttgctactaatcgctatctcgacgtagccagagagccatgcatgcatcacagcgagcccacggccgcacgagcactcgccaacgaattcgctaggcgtacaccgtgaatgatttgatgcgttgattacgggtattcatattcctttatgaaaggttattgtcagactttttttattccacaagatcgatcatactacaaagttattctacaatagtttagaacacttatccagttgtgttagaatataataatgatggatggatatgtatgccatattaaacaatctaaattccccacaaaacatataaaagaacactataataaactatggtttatccaacatggacatatatttaaatgaagtgcgatctccggtgctctttactggtaggatgaatgatgatagagataaaagcgtttaacaaatatggcctcaagcgtaattccgtacattaattaaatcaatgaaaacatttactggattaataaaactccatgctactccattataaatgaacgcacacctatatatagcaaaattcctatttgccagtaggtccaatacttcggatctgtttttttttcttttaaatatccaaaattgattttggataactactcgacagtacaaacgaattaaaccagctattacaacgtcgagtggatttaaaacactcctctattaaattcacctacagaaagtcgttcccgctgaaataatcgcaccgtctagaagctcggcaagcgtgtcgctaatccgatactaactccattaattccattttcatttcaataattgttgaagttattactgcactggaaataataaaggcaggggggtgtaactgggtgtgtacaaagtgttggtgagcatagcagttggcaggtgcaccaccctttattatattcctcctttctctctctctctctctctctctctctctctctctctctctccccctcttcctccctttaaatgcttcgcctctctcgctcgtctctccaaacacaaacccaccacctcctcctcctcctcccatccagcacgcgcctcctctctcgcgcggctttccatttccatctccccctcctcctcctacgtctccgccgctcctcactttctccactcgatttcctttcttggcctctcctcctctgacacaggggtgtgcaggtttgtgtttgtgcgtggcgcgtccgccatggctcgcggcagcggggccggaggagccggcggcggtggtggcggggggctggagctgtcggtcggggtcggcggcggcggcggcgcgcgtggtgggggaggcggtgaggcggcggcggcggtggagacggcggcgccgatcagcctcgggaggctcatcctctccgggatggtcgccggcggcgtgcagtacgggtgggcgctccagctctccctcctcaccccctacgtccaggtatatatatatatatactgtactcctgtgtattttgcacactctcatgcatgcatctgaaactctgaataatcctgcaaaaaatatatacaagtatctcacgtgtggatttgattttgttcgcgagtttttgctcgtgctagctgttctaatctgcaaggtttcatggtagtagattatatatgtcctggttacaatcttttcaaggttataatcttgtaatttttttctgctttgtcaatatttacttcgcactgtctggtgtgagtcgttaaaaaaatatatatcttgaaagattggggaatttttcttcatgtgtggggagagatttatttttttttgtttgaacggtagatttgactagtgtctaaaagtaccgtaataaattcaatctgcatgccttttgtaattttttttgctcatgtgtttatatacatgtggccaaatatgcatttgatgcactagctatcatttttgtcattttgtagttattccttttcctttcctttttttttcctttttctttttgttgtcactagaggattcatatcctctcgattcctctatgaaacgtcggcgttttctgcctcttttctgaagaatctgtatacctatataagaat

SEQ ID NO: 62157 - DNA, 1920 bp, Oryza sativa
ccgctcaattttgtgtaccgggagaaagggttctcaatcattacaaaagaacacagcctagtctccatgaaaaacatcacttttattttaagacagagcaagtggagcgattttataactttactatagtacaaaattaatggtcagaaatttaaaattttgaccgaattttatcgtaagcatcaaatatttattaccggagagatagagtattggttatttgcctctctgtcgtcaaatattctaaacaaagacgatcttcttagtggttaaacttaaatctcagtccttccaggcgtttatttgaaggatttatagcggagataaacagctccttttttttcggaaatacgtaaggagggcacttttgtattaaggggaataaaaagggtctgtacagggaaaaccaaaaaacagcaggggacaggaataaacagctcctcacttcctctttgtatcagtccatactaattaacaaagtgttccaaaatgttctgtactttttctgtagaacattatatgcagttcatcacccctgatggtccatgcatcaggtctagctacctactgttgtattgaagtatttctggcgaagtttatccttaccttagccttctcgagccaagtgccataaagatggttgctgtagaggcaactccaacccactttaaccgcgcacatgaaaaataaaggggtaaaacaaggaaattctaggtcagatatatatgtcctgtggactgtggcacagttgcaacagagcaattgcataggcaaatgagggcagatcatcatgtacccatagcctgttggtgctatgttagcatccaagcattgccattttaactattaagattcttcttcttatatttgacaagtgaaataaatttagtgactgaacatatatagaacgatgaacagtctttgtatgtttattcatgccatgggggaaagagaagtgtgatctgaagttattggatagatagctgttagttgtagcatgcaaggcaatgcatcctggaaccaacagaccaacagagctggggatatttcatctgctaaatttctgggaaaatttattgtgtggtaatcaatatgtgttcactctttgcaactggtacacgctctctgatgtttctgaatatcttccacagtgatgcagatcttgttgacacagcaaactcaacaaacatagtcatttttttaaggaatgaagcatgatcatctattgtcagagtagattacagtcaaagtttttttataagccaaaacaactgattttctaacctctgttatttacagacactcggactgtcgcatgctcttacttcattcatgtggctctgtggtcctattgctggcatggtggtaagtaacaataccaaattatctgctctatcgatatatacgagacaaagcttttgccctcttttaaaaaaaataaatcaaattaattcatgttatggaatctgtactttctgcaatgtaaattcaagttactttagtgtcttcactacaacaaaaacttgggtatcctgaactcctgtatctatcagagtttgaagctgcattttctgtagcttctgatatgtgtaatgtagatcatactgtcataattcataagctttcataaaaaatgtttgtgtacaagtcatattttttttaattcttgatccattatcatctcccaatcctgcaggttcaaccatgcgtgggtctatacagtgataggtgcacctcaaaatggggaagacgaaggccatatattcttacaggatgtgtgttgatatgcttggctgtaagaaccactgaaccttggaactcttattccttaagttgaagtccccaaattttctctcatattgacattgcactttatgtatgtaggtcgtagttattggattttcagctgacattggatac

SEQ ID NO: 62158 - DNA, 6382 bp, Oryza sativa
attcctgcagccctctgggcttctggtatcagtgggattttggatttgatctcctaattttcgttctgtaggacgtcatggacctggcacagctaactccatcttctgttcttggatggcaatgggaaacatcctaggatactcctctggttccacaaacaattggcacaagtaagttactcttatgtatcagtttcatacagattttctgtttagcacagtctattcagttgcattcttttctgaaagaaggcaagtgaaattcatattacattagtagagaaggtgaaatttgtttacaagtattgagttgcattctccctaattaattgcgcaggtggtttccattccttaaaacaagagcttgctgtgaagcttgtgcaaatttgaaaggtgcatttctggtggctgtggtaagttctgttattacctcataaactgcctgctgataatactttaacaatgtgctaatattagtctttgtaataagatagtactatactgaaaatattttagcgagtatgagtaatttaacttacatattgtattgctgttcctcttttttcaaccctgtcatattggttgctttttttcacagcctaacatgctcttgtttggtcattttcccctgttttcagattttcctgtccctgtgcttggttataactctgatatttgccaaggaagttccattcaaaggaaatgcagccctcccaacaaaatcaaacgagccagctgagcctgaaggcactggtccactagcagtgttgaaaggcttcaggaacttacctactgggatgccttctgtgcttattgtgactggccttacctgggtatgcaatatacatcagaaaaagaacttttcagattattgaaaaaattgctactagatcatatcttagttatatcttatagtaccttaccttttctatgatatgattgtccttgtagttgtcttggttcccattcatcctctacgacactgactggatgggccgtgagatctaccacggtgacccaaagggaactgatcctcagatcgaggctttcaaccagggtgtcagggcaggtgcatttggcctgctactgaattcggtaagatctgattggtttctgaattctgattgccacaactactgtcaaatctttaacactcaagccatgttctttggcagcaactaaccatgggcttctgatcgtgcagattgtgctaggattcagctcattcttgattgaaccaatgtgccggaaagtcgggccaagggtggtgtgggtgacgagcaatttcctcgtctgcatcgccatggctgcaactgcactgatcagcttctggtcactcaaggacttccatggaactgttcagaaagccatcactgcagacaagagcatcaaggctgtctgcctcgtcctctttgcgtttcttggagtccctctcgccgtaagaatcactgacacttcaacttaaacacattgctaaaaaaaattatttcctcaagaatgccttatcctgatgaactgtctgaaaatttgcgcgatgcaggttctgtacagtgttcccttcgcagtgacggcgcaattagcggccactagagggggtggccaaggtatgaatcccaacattcttgcagcttttcttgacataattcggtgttgtttggatgctggtctaatccatggcgatctgcagggctctgcaccggcgtcctcaacatctccatcgtcatccctcaggttaattagctgccaaattctaatccgtttcccttgaaaccgaatcagatatacttcatggattattagaatttgaatgctcatggattcatggttgcgtggtgttcttccctcaggtggtcatcgcgctgggagccgggccgtgggacgagctgttcgggaaggggaacatcccggcgttcggcctcgcctcgggattcgcgctcatcggcggcgtcgccggaatattcctgctgcccaagatctccaagcgccagttccggtcggtcagcatgggcggcggtcactgaccgccccgctctcgccgccggctgcggcggcggcggcggccggagcagcgccgccggaagtggtgagctttgtagttctcgtttgcaatggatcaaaggagccccctctttttttttacatagggtaattaattaattaaggctgttaattaggaaggggtgaggtggccctgcacctggggcccacgctttgttgccacctcggtagaagagaataagcagatcatgcagataatatggaactgtaaaactgttttgtgttgtgtgtgtgtgcagtgtgcttggtaattagtgtgtaatgaatggtcaggagaagtgcagtgaactaagtgaaagtgagcttccatcatcatcatcatcatcttgtgttgtgtaatacttttgtgtatgtagaatcaaatactacaaccaaaccaatcagagaagggtgaatggttcgaacactaaaaattaaaacttttagcaaaattaaaagattaccctcaaacttgatgaaattgcgccaatcgcaccgccatattgccaccggtctgaccgcagccttgccgccggttggaccgcctccctgctgtcggtgtgaccacccgccggttagaccgcacaatgaaccctggccaactcgtcaggatctagaaaaacacatatcgatgaaactcttgaaggtaaatcaattttgttgcatcaatatgtgtttacaaaatgtatctaaatcacctctctctctctctctctctctcaacttagaactaggattaaaacctcaaagcaaacctttttttttctcccaaaaaatcgatatccttctagcatcaatctctcttcgatttatacccacaatgtggctgtccatatccacgaatccaaccataactagactcttaaacataggaaatttaacaaaccaacgaaataacatcctcatacaactccacacttcaatctttccaaacttgaactcaaatttaaatttgactcctctttacatacacacacaacaccacgtatatgctatatggaaacattcacatgcacgtgtattgttctctagcctgagtatcccgcgtgatatcatggaccttatagaccttaacttctcgcaagtctagtcctgatccatatacgaatataaaccatctaaaagtaataaagataaagcaatctagaagttccacgaaaacaacttgaaattgactccctcctggagtctaccggtctgaccgtcgggctacccggacacctccagactgaccggcgtgcctcaccgagtgtaaacgacaacctagtaccaacatgcacggttcattgacaggaaacactattcagtattcaccgtatttttcaaaacattcacctttgacaatttattcatcactaagattaatcatcacatgattctacaggttgctctagcaaactcaaggtatgtgtaaagagctgaagatgaatggattaatagatgagctgctcaactctagccaattacattatggccatgttcttctttattatggattttggatttttgtttgcgtgcttggtaagcttctaaacggtgattttcacaaaaaaaatataaatcttttcttaaaatattttttaaagaaaacattaaactttgtagtattccctccgtcctaaaaaaagacaaaccatgggtttccgtgtccaactttgactgtccgtcttatatgaaatttttttataattcgtattttcattgttgttagatgataaaacatgattaatatttcatgcgtgacttgtctttttaattttttttatatttttttcaaataatacggacgattaaacattgagcacggaaatcagggcttgcctttttttgggacggagggagttctagttaatttcagctataaattcttctatccaaatttggagatgttgagcagtactccaatcaaaagaatgtagcactagtagtagatgagtagacgatgatgattggtctagagattagggtgggtccgttttgaaattttgattggagagccttgttttgctccaactgtcctgttcttgtggctcgctttgccatttaaaacgccgttgttgacggcgccggctttgaacgaaggctactatgctactactgtctgctgctgctagtgctagcttgctacgatgattgccaacaactctaacccgctacgcaggcaaccggttcacgcgtaaaggaagcagttcgccgccgtcgtggccggcaagatctagcccaaaaatcatctgaattctgcctctttttgaggcaaactcgtctgaattttggttctgtctcatggagaaatcacttgtgctcaggaacatcacatgaatcaccaagcattggttgcatcgatcacagccgttggctacaaacggaatttcaacaatatcatcatcgtacaccgtcgatcacacacacacgcacgcacgcacaccatcattcacaaaatcacgagcaccacacccaagtggcgccacgttgcaccgtcacgtctcagcagcagcagacggggcacctcacgatgccgttctcgttgcactccgtgcatcgccggaatcccccgccgccgccgccgtccaatgggttctcgtcgtcgtcgtcgccgtcgtctacgtacaccttgcagctgcccgagcacgcgccgcagagcacgaaccggacgtcggcgcaggcctcgcacgcgccggcggcctcgccgggcgccgcgctctcgcacccggcgagcctcgccgcgagctccccggcctcgtgcagccgcttcagctcgtcggcgttgcccacgagctcgccgtccacgaacaggctcggcagggcgggcgccgccgccggcgcccagcacttggcgagggcggcgccacggccgaggccgagcaggccgtggagctcgtcgcggaatccccggtgcatcgacacgtcgcgctcgtcgacgcgcacgccgtagcccccgaggatggcgcgcgccaggcagcagtcctcgtgcgtcgcgcgcacgccgcggagcgacgtgaagtagagcacggccttgcgcggacgcgccaccggcgacgccttcttcttctccaccagcggcagcggcgtgaccttgcgcgacgcagcggcgagctccgggggcaccgccgtgatcgggaacgagaaggagtggcgcgcgaacggcgggaccaggagcggcgagtgctcctcgaggccggccatgagcgcccacgcgtcgatggcctcgggctcgttcggcggcgtcatggtcggcgtgcgcggcaccatcctcctcatcggcggcgcctccgccgcccgcggcgcgcccttgtcgacctcgagggagccaagcgtggtcgacgtgagccgcacgacatggacgccggcgtcaccggcgcaccgggcggggaacgactggcaccggggcagcgcgagcggcgacgggcaatggcggaggtcgtgccgggcttgcctggaggtggtgcaccccatggcaatggcaatgtgaggaagctcctaagctctggactggcaatgggagtgtggttaattagctagaaacattctgtcaagtattcctaatttaagtagtggatggatgagctggatactaatctatggggattggggttcatggggtttagtatttttggggagataaaactagtgaggtgataagggtggtatgattgaatttgtcaattacttgacctaaaaagcataacaaataaatagtttttggaacattcttgttctgaaatgaatggttttggaacattcacactcacttgggagcctgggttttggagggaaaaaaatcaaatgttactagatcatcttgtaagtatgagcggctttaattagtttgagatcaaaatgctgcaaagttgcttaattcggttgcttggtaacctagtgagtagtgagaactactgtggctgaagataactccttttcagcaatgtttgtggttttcttagtcaaatatcacgcttcctttttgttgcatcttttcttcgtttgcttcacctgtcccccttgattctaggaccctgttcgcagggcactggctttggagcttcctttttgttgcacttgcacatcgatagatatacgcatgcaactttaggcacacaacagttcaacttctgtataatacagactgtaaagtgtcagcaagcagtaataatatgagttgatgggagattgggagctggtaaagtgtcaaacagaaacggtaatttcatccattgtcaagctgatatgtagcctgtagatactgcacattcagtacataataggactacgatgccattggaaatcttagagcaatgaacatcgaaactaaaactccaagatatcacataagactaaatggtgagtt

SEQ ID NO: 62159 - DNA, 1399 bp, Oryza sativa
attcctgcagccccgagaattgacggaagtgttaaaaatggaaacaaagtgaactttgggtgcaattaaagtgaaccggtatctttcggtgctataaaataaaaaagtaaacttttgatgctatataaccaattttgccaaagaaaatttactattacaggcttgttcaccacttttaaccctaacacattttgaccaaattttgggtagcgttcgacatgttcaatttaaagccttactaaaatttggaaataattagaaacaaattaacaacaaacataatttaccacaataaccctatttaataactacactacatgtgtataattcatatgtatacttgattaaaatgaaggttgaagaacatattccatatgcaaacttaattaaaaggaagattgggtcacacatttcctttgttgtgtcacatcttataaaaatatatttttgttggaaaaaatttaaatggtagaaatgtaactattataggatggatgtagtaataaatacaaacatcagagggagtacgaaagaagatgatgaatgtacacagttggcttgttgccttgttggtacggatccaattgttttgttgcgttgacacttgacaaccatctggacgacgtgagtaacaacgatagataaatagtgagttgtgcgcataattttatttatttatttaccacctgcagaaacattccaccatctgtcaccgcacacgcacacatgtatagtagcagcaacaacgttcttcacatcacacacacagctaacaaccgcgccggctatcatgggaaaaggagaagaaaaaaggagcagaggatcatggacggatccaagtggatcgcatagaaaaatggacctcgagaggaggtgaacatggttttgcaaaacggaagatgtggttggcacgtgagagtgggaggatgggaaggttccaaacggcttggtgtgtacacacccaccaccacgcaaataaaaccctcaaaaacaaattgtagagtaaggctcgtttagttcgcaaaaagaaaatttttgggtgtcacatagaatgtttgaccagatgtcggaagggcttttcagacacgaataaaaaaactaattttataactggcctggaaaccgcgagatgaatcttttgagcctaattaatccgtcattagcacatgtgggttactatagcacttatggctaatcatggtctaattagactcaaaagattcatctcgcaatttcctccctaactgtgcaattagtttttttatttatttatatttaatgcttcatgcatgtgtctaaagattcgatgtgatgtttttaggaaaaaaatttggggaactaaacggggcctaagagtaaccgatcctgtcggctacacgcacacgtctcgcacgaaaac

SEQ ID NO: 62160 - DNA, 3436 bp, Oryza sativa
ccatgtgccgggctggcctcccaacacaaaggccaactagtccccagggccaccatggttagcattagcagggggcaggggaaatggtgggccccacacaccccccaagcccacgtacattgcacgtctcgctgtgcgtggggccccgctgttttgcagccccctgcattgcacatgtgttgatatatactatggccatagcaaatgcaaagcttctcccactagtgttaattaattaacctctcccaaagataaaatttgacaaatctgtgcgtgtttgtgcgcaaaaactgagcttatgtagcgtgcaaatgctgatgctggcacggagagaaaagatcaaggagatcaccggtggggagggggccacgtagtcgcgacattgacatgggctggatccagccacatgcaacacgcggtgcagggctcgtaccgcacatctctttctctctctctctccctctctctggcatccatttctccgtgtccttttttttccttttatttttaattttttattttattttgggagtacctatacatctttcgaaagatttttatgatcgtatcacacagatttttaatctttagattaaaatccgatagatataataaaaagcaaaaagcaattaagaaacaccataatggacactaaattaccatatcctcaagaaaaagaccaaatccaatacaaaatttaaaatttatatgcgaagattcaaaaattacagtataacttacaaaagttacagtgtaagtttcataaattacactgtaacttacaagaaaatgcactgtaaatttgagtgagaaaatcgagtgagagataagaaaaaatctttcgtgtgagatatagcaaaatcgttttatttttgctaacgcaagccacaatctggccagcatcatccatatgcgactccagattggcatcatgggttgatcgatctgcaatttgcgtatgaagcgtgtggccttgttgtttcatttttcaacgttgaacttttatggtttcatttagagtatgagaaatgcatggttaataatagcatcttttgaaggaaagatcatgagtgaaaccaaaatgccattctatattttattttattttttggggggtgggggtataactgtccagaagagagttaagtactggagtttgtttggtcctttttcttgtttgtctgagtaaattaaactggagtagttgatatcctaaaaattgatggaagtgttgaagctttgaaccatgctgcatgagccaaaaccgtaaatgaatggatgtcctagttctgtaataaatgtgtctaggaaagatttcgactacacgaatagttggagtcaataattcccaagggatatattgtacttggctttctattacatatacttgctgctgctccaaacttcttctcatctcatctcatatgcatgtaaaccataattgcacctggcagcagtggctatgatgaagagtgagatacgctactgatcatttgatcatcaggttggaaatgatttgtaaattatcatggcagtcatcatcatcaatgtagctttcagattcttttgtcaacaattcccagaaccatgtcaatcctgctgctgcatttggagcctccaactcaaggggatgtaagctagttcttttttaaaaaaaaaactaggttcatttcatctgtataaacttatctaaagggatctaagaaagctaagaaaagaggtagtactagctagcaaatgtatacatgctactagctagttcataaaggaaaaataaaggaagactcgccacgctcggtgaatgacttcagacccattagtctgatccactctgtggcgaagcttatatccaaaactttggcaatgagactggcagcacggcttggtgatttggtctcgcatgcccaaagtgctttcatcaagaagatatgcatacaagataacttcctctatgtgcgcaacatggtccggtccttgcacatgcaacggaaaccatccctcttcttcaagttggacataacaaaggcatttgattcagtatcttgggaataccttgtcgaaattctgcagtggagaggctttagtcagcgctggagaaattggattgtgcttctcctatcgactgcatcatccagaattttactcaatgggatagcggaagaaccaactacacacaggcgaggcctccggcagggtgatcccctcttgccctacctcttcatcctagcaattgacccgattcaacgactactcaataaggccacgcaagaggggcttctatctccgttatcaaaccgagcagcgcggttcagaatatccttatatgctgatgatgcagcgatctttataaacccgatcaggaatgatgccaacaacttgattagcatcctcaattcttcggcgaggccacaggccttcaagtgaatctgcacaagagctcggtcgtgtccatcaaatgcgcagagcagaacctgtctgaggtgttggaaaatttcaatggacagcggggcaattttcccataacatatttgggattgccgctcaccccaggccgcatcaagagaatacacctgcaaccggtgatggacaagttgcaatcaaggttagtgggatggaaagggaagttaatccagcaatcagggcggaagacgctagtcacgtctgttctcagctccataccaacctacttccttaccgccttaaagccgcctaaacagttcctcacagacatggacaagattaggaagaaattcctctgggccggcgatcaagagattagcggggggaagtgcaaagtgaattggaaaaagtatgctccccaataaagatgggaggactaggcgtgttggaccttgataaattcgcgagagctttgagactccgttggctatggtttgagtgggagtgccctgacaaaccttgggttgggacaacaccccactacgatgagttagatgagcaaatcttcgtggccgcaacaaaggtaacaatcggtaatgggcagaaggcaaaattttggacatccaactggattggacaccagccgctgaaatacctagcgccagcgcttttcaaccactctaaaggaaagcaacgcttagttcaggatgcgttaaccaatgacaaatggattgaggatattaggcatgagctgtccatgccactgatccgagaattcttcgcagtgttccgccttatctgggataatgagacaaacctggaggaaggagttgaagacaccatcacctggagatggacaaataccggtaaatacacagcaaaatcggcttagcccaattcgccggtagagaagactcaagggccgccaccttgatttggaagacatgggcgccatccaaatgcaaaaactttgcatggcttgtcctgcaaaacaggatatggacatccgaccgcttgcaactccgacaatggccca

SEQ ID NO: 62161 - DNA, 5847 bp, Oryza sativa
ctctcctccccctgtctttccccttgtcaccattggtggcatttgtacagtgcttatcttctgaaatataaaaccagctaagctggctaaggtttcaaaaaaaaaaaaggaacagtagaagctaccatcctactcatcttgaggggttaccttttaggaagcatggtcctttgtggtactctttgctggcatatcatatatcttaagcaatattgtctgctagttattagagcaattttcttttttgatactctcaaaaataataaatttattccagattttttttttgcaaaactaaaattccccaatattattattattttttctttttgataaacaacatcttgttaaatttccattccctcatctatagccatctctctctctctctctctcacacacacacacacacacacacaacacaaagttctcactctcaaatactcgcgatgcgcctcgccttcctcgcttgatgagctaaggagatcgagttgaggacaatggccagcaatggcatggcgtcctccccttcctccttcttccctccgaacttcctcctccacatggcgcagcagcaagcggcgccgcctcacgacccgcaagaacaccaccaccaccaccaccatggccaccatggccaccaccatgagcagcagcagcagcagcagcatcaccaccacctgggtcctcctccgccgccgccaccgcacccgcacaacccgttcttgccgtcctccgctcaatgcccgtccctccaagaattccgaggcatggcgccaatgctggggaagcggccgatgtcgtacggcgacggcggcggcggcggcgacgaggtgaacggcggcggcgaggacgagctgtcggacgacgggtcgcaggccggggagaagaagcggcggctgaacgtggagcaggtgcggacgctggagaagaacttcgagctcgggaacaagctggagccggagcggaagatgcagctcgcccgcgcgctcgggctgcagccgcgtcaggtggccatctggttccagaaccgccgcgcgaggtggaagacgaagcagctggagaaggactacgacgcgctcaagcgccagctcgacgccgtcaaggccgagaacgacgcgctcctcaaccacaacaagaagctccaagccgaggtaactaactaatcaaaatcaatccaattacgcattcgagcgtttgatccatagatctgcgtgatcgtggatgatgcgtgttgtgtttaatttgtccatgattaattttcccggggctttccaagctcaatgattggttggtgatgtcgatcttccctgctgctgctgctgctgctgcctgcgttggcaggaacggagatccatgtgggtttcagtgttggcagaaaggttgttggaatcggtgcctttctcaccaccacgagtacgtcgacgacggcagcagtagctatagctttttctcgcgaaaagttcagcagaatatgcagcgtttgctcgtgctcgtcgtcgtcatcaagctggtgagatcgatgtatcgatcgatcgatgggtggattgatcgtcggaggcagtgcaggtttgggtggtagctgctggtgcttttgctgtggtggagtcaatggcctcatcacacggccagcctcgttggcaagtgtagtagtactagctagtactaccagctcttggggccgggcatgcatcgcatctctctgtgcctggtcgcagtgttgcatgtgctgctgcctttttcctgagatcacttcttcttcttctcaacaatcagatttgcaatgatgcgtgtttgtgtacccggagagaaagagaaaaaaaaagcacaattagtacttctatgattgggcatcgatagatgatcggtgcaaaaaacgtactagtagaagtatagctagctagatataccttgtaactaatagtactagttcgtgttgcttttgttaattagtactgttttactgaatgattaagaaggaaatgtgataaaatgcagatagtggcgctgaaggggagggaggcggcgtcggagctgataaacctgaacaaggagacggaggcgtcgtgcagcaaccgcagcgagaatagctccgagatcaacctcgacatctcgcgcacgccgccgcccgacgccgccgcgctcgacaccgccccgaccgcgcaccaccaccaccatggcggcggcggcggcggcggcggcggtggcggcatgatcccgttctacacctccatcgcccgccccgccagcggcggcggcgtcgacatcgaccagctcctccacagctcgtcgggcggcgccggcggacccaagatggagcaccacggcggcggcggcaatgtgcaggcggcgtccgtcgacacggccagcttcggcaacctgctctgcggcgtcgacgagccgccgccgttctggccatggcccgatcaccagcacttccactgatcgatcgatccatggatccaaccaaccaaccaaacaaccattggcaacaacaaactatcttgcagtgatgaagcgatcgacagtatgtacggggtgatgaattaacgatgatcacacaccaacgcaagcgcatgcacgtgtgtggaagattcagacgcatgcatttggattaattcttggagagatcgagcaagcttaattgggaagaacaatgagaaggttgtgtatgatgatgatgctagctacgagtattgaggtgatgaatgcattgaatttttctcttgggtttgaagaggatatcgaatcgaaggaacttgtagatgaataagcgagtgagatggaacgacgtacgtagggttagattttggagttcagtagtagtatattctgtcactttttatttattttttttatttattgggttcttattttttcccctttttctttacatacataaatttgtgaactttgtgaggcagtgtttgttgtgtataggtgcatggtgattcttctttcttcccctaatctgtgtggatcatgtccctgtgttgagaaaaatgttcattaaatttcgctctagcaatcacacaattgagttgtaccctataattaattccattgatgtttggctaggtttttgacacataagctcgtgcaaacatactgaacagtacgtacttgtgtgaaggcaagaacacatgtacatgtttctggaagaaacttttcttcttctttttttggtagaaaaggaaaagaaatggaccaaagttttcaacagttaaattaagcggtgtgtggttgatccgtgcattaatcctagctcgtgcatgcatgcaaccctacaatgcaatcaaggccatttagaaagaacagaaaagcatggacaccagcaatatttaaatttggcagctctgtctacatatcttgttggcccccttcatctttgaaattaagttttttgttacatcgccacagtttgtcacacaacaaagttaggttaatttttaccatgtctagctactatttggttcgtgactagtgactacaagattcacgcagctggcttgtgcatgtagatctagtatagttattcagaagttgtctctccgttaatgtcaaaactttgtagatttcattacttgacgagaatatggtcatgaattatctagttatagtgataattataggaataaattaaataacctaagaaataaacttaacaaatagtagctcgaaacaattggtccaagcaatgcagtagttttttttcctttagataacataatttttaggggtgtaaagtaaataatccataacaataaactggtgaatctcagttgaaaagaactaggcttagtgaacaaaaatattgaaataaggactccatatgcagcgtaaatcttaagcgtttatttttatcctacgatatatatatatatatatatattttactttttatcctacaatactttttagggtttacactgtatataaactttgcattatatattttctattgtagtgaagttatatatgggtatatattttcctcttctacctgctattggctcagtgtgtcgtacgtactggacatcagtacatctacgtcgccatctgcatcggccttatcacctcactggcagctacagttgactgaaccgggcttggctagtttgcctgtctgaaagtgattggcgagatggcagctaaggcacaaaacagtgccagtaaaaccgggagtttattcgtacctcgagggtacgttttcgatttcgttgtggatcagatctgtctctcaaatttgtcaccgtggatcatttcgtactacaaaaatttacggcatatgaggagtttagggggatcagagaccattgatgttccaactgaattgattcgccagtacattttggaattggatcacggggaatttcatatgaaacggttggcctaccaactatagcgattggggaaaaaaatgtacatatatgcttgtggcggtaaaaatatcatatcatttcagaggtgacatcgttcgtgctacggatgataaatcatgaaaaaataaatgtaattactgaataatttatgagtaaatgttttatatctgtgacgttagcggtttagcatcaattcttaaaaaataaactactaagaaataactgtagaattaaattaaatgtagttccaaaatttagttttaaaatgcaattaataagcaaacgacgagggacttaactcttttttttattacaacaaaaatttgttggattggcagggtaggtcacctcagctcagcaggtcaggtccacagctgagctagctcatggaagaacaatcgcttgtgggtggatcagcagtggaggggccgtgcacacatcgcaggcagaaaaaccaaaggaccgtgtccggtctggccccgtacgcgccccggccctatcctcccctccaaccccccttttgtggtccaccgtggcaccaaaaaccactgcctttttacgacgtcactccctcaagtacatcctcacaatctttacgtgtacatgcattgatccttttgcattatagcctcctctctcgttaattttatttaatcacgatacaaacacagacataaagacggaaccgacataacttaaaattaataagaccaccttaatcatctcgctgtcgatggtattgctgtcgaggcataccttaaaggttaagtcatcttatttgtcttactgtcgcaacagtgcatcgtttgtcattgaaagaataattaaccgtaaatacaaacactcgtatcaaatctacatcacaggatacctagctagttgagctgaactcacttcgtcttttctctcattaattaattgtcccatcgattgaaatgcattttttttcatttttatttatgaaggacaagatcatggtcatggcaacttaattacagggcagtgaatgtgtgtgcagagaaagaggagtactagtgtactctgagcagtagagatcagttcagtgcgcgcgcaaaaataactgccatggacgatctggtccagatgtgaggtggtacgcttactactatgtagccgaatatagggatgcaccagcaacaatcattattcattctctgttccatgatcaggaagagaaatggactcatctaaaactcgtctttaaagaaaagcgcatagaacattccatccattaattatcactgaatttgataacgccatgtcaatggttgctagcggtatttctttttggaacttgaccttgctaattatagtaagaccatgtacaatagcagactattagccagctataaatatatattaatgagataaaagatgagatagaagagcagcgggctacagatatgtagccagctgcagcacggacttcaagacacagtgtgtg

SEQ ID NO: 62162 - DNA, 10339 bp, Oryza sativa
tagtgggctatgctattgaacttgctctaagagaagtgcactgcttatttattcgtgggatcacattaatcagatgggttcagattatagcagtttagatggattgggtatatccgtatatgctagagcactgctaaagatgaatgagataaatatttttaaaataataaaaatggttcatatttcaggcttccgcccataaaacacacataaaaaaaagtcccaaaagataaaaagattcgatgttatgcgaaaaattctcatctccctcctaatgataatatctagctaaaaatagaaaatataaatctgtagatcctataacaaaagttaatagaaattaactaccagggatggagaaagagggacgagcagaggcccggcctccctcaatctatgtttacagtggcttttgtgaaaatttaaaatatcagtattattgttcttctccaataagtaaaatttagtgtttttagattctaagggtggaaccagctaaaaaaatatgaaaataacatgcattgggttaattagatgatctttctttttggttattggaaactttctgagaaatataattgtatttttaaaattgttaattcaggctttcaactatatacacataagagttactagtataaaattatactccctccgtcccataaaaaatcaacttctggctacgaatatggacgttgattttttatgggatagatggagtatataacaaatgttgtacgtttgagagacttaactctaatcctaggtggttgtgcggagaattatgctagtcctttctaagaccgacataccatacaagttattccaacaactcaaagtgaaaaaacaaaaaagatgagaggatgccgagtactgagtagtactgaccagtgagtaggcgtgggtctccagtgtccccatcgaaacgcagacgagatgctccccaatgagctcagcaaaaggaccgggcatgtatagtccaaaccgttgcatcggttcagtccttctgtgcccattggccctccaccttattactgctcttccatctccatgtggcagcacagtgcccaactgaccgtgcaccctctctgcaaatgtccttggggccaagtcatgagatgagaccaaggttgtcatgatcgggatattagacaatatcgttttcctcaaagtaatatcgtatcgtaggatcgtatcgattttttttaagtttaattaatatttatattaattatatatagccattatatattaaaaaatatagtaatgatatatgtcatacaaatagagacatttatcaagagaaaccatgttggtttgatatatttaactgatttttatataaatttgagcataattatttatattattttcaaaccatgttattttaaataatattttgtagtatcgtagggatcgtagaatcgggataccacctaagatttcgtaggatcgtatagtaatgaatagtagaatcgagatactatgaaaattaggatactaggtgggatcggtatcgttttggcttggtaggatcgtagtatcgtaagatactaggatacgaaccgggatattgacaaccttggatgagaccactgaaatcatgtcaacaacacatggtaagtccatttgtttgagttacggtttaaccttactccctccgttccaaaattacttaggatgagtcacatcccatattagattgtgttattttaagacggagagagtagatctttacatactcggaagacgagttacacgtggaccgatcgaatggaggagttaattattacatagccaatgtgaatgatcaccatgaaaatgaatgttcgttcctgagatagattcagcatcagagatgaggctataagctaatttaatcagatcagggacactaaattaagagtggaatcagatgagatcgcataggataatcccaaaaggatgtgtgtggtgtagcaacaagcaggcagcagtaggggtagttagccgatcggatgccgcacatgaatctgcgtctaaagtcagccccggtgcccaccaccatctcgctagaaaaaaaagaaagaagaagaagaaagtatcgcaattcggtcgcgcgagtacgagtattttaggtcgtcgcctcaggggaataatagtaggaggaggaggagattcagaagcatgtgtggccaactgtgacaactgataatactcgcagtacggcgcacgcacagcacaggccaggcaaaacaagaaagcaacgggagacatcgtggtggtgtataaatttttccatcgacttaattatcacatgcgcatgatctgatactcagatcgatcatttacggttatatatggtagtacgaggtaatgggctaatggcagattaaacaagagtcggaacagtgtctcctctgtaataactctgcatttattttttttacagcagttctgaaacttcaggtcggttattagtactagtagtaaagcagttagccatagtaccattgctgctgctgaatcatgtctctctcgcaaccttgcgttaaagaaaaaaaaatctctcttctcatcaacccaacgctgtaaacgatgcatcatcggcgcgatggcggaggaaatacgcacgaacaactaaccaagattgtcctatcaatactgctatcgtaggtgtaatactgtagaggatccgtgtccacgaacacaagtgtttccaggggatctctccggcgtcggcgtcgtcgcgttgggttggtggtgtcacaccaaacgcaacgggggagaggaggacggggagatcgacaggtgtggcgcacatgcgcgtgcagggcgatgtcgcctcacaattgtaagctgtgatgcgtctgagtcgcggatactacctggctgcagttggggcagggtttacgaaaccgcacggtcaccacacggttactatacacggtaaccttttcaatttttgaaactacggtatgtctcgtggtaatcacgcggttactgtggtaaccaccttaccgtgggggtgtggtaaccgcatcaaaaacggtaaggagactacttgagctttggtcgtcgtcgactcgtcgtcagggtccagggaaaaaaagttggtttcctttttctgcagatcgatcggtctctgacaatcttgcgatgatactgttggtgaacttttgtcagtttacgaatgatctgtgatggaaagtaagttgggggcagactagctggcttacgtctactgcttcacttcactttcacagtttcactgtatgatgataatgtgatatctggaatagtgtagatgatggtataggacggacaggccactatgtattgctatgtatgggtattgctctgtatcatgtgggtacaaacgaaactattattatctaaaaaaacaaacgaaactattataaaaagtgaaccaatattctccgaaattgttgtaatcgatctgggtcagcagttctgctttttccttgtgtgaggtgcttcctttctgaatgacaatcagttggagttggagttggagttgatgatagtagtttctcccttcattgttcatctattttgatcttttcttgggacatttcttctgctgatctttagagctacgctacattcagtttccattctgaaatctttttcgggccaaacttttggacgaaattgggagcttttatggatgaaattgaggcccaaaactgtatatagaatattgccgctagcggatgagcaaacacagcccacagaagagaactcactacgacaccaaacgaggccatgaccatgagcacatatgaagcctacgtgtagcaaatcgattctgccacgtgtctcactcctgcacacacaagtagccaccaaaaagaacgagagcctcacgctcccctccaccaccagcgagagataacgcaccggacgaacaccatgccgccgccgtcgtcgctgccgtccaccgccgccgccgccaccgcttccgctgcgtttctccggccgtcagcgagcgcgcatccagcaagcgcctccgccccgcccaacgccgccgcgtgcctcaggcgctcgccgcggcgccgcctggtcgcggcgcgtgccgcggccgacggcggcggcgccgagacggtgttcttcgacggcggcgcgcactacggcgacctggcggcgaacctggccctcgggctgacgctgctgtggctaccgctgacgctggcggcggtgtcccgcgccttcatcctccggtaccgcttcacctcccgccgcgtgagcgtcatctccgggctctccggcgccgaccgcaccgacttcccctactcgtcggtgacgtccgtggtggtggtgccacggttcatcggcgagtggggcgacatcgtcatcaccctcaaggacggcaccaaggtcgacctcaggagcgtgcccaggttccgcgaggtcgccgactactgccgctccatggccgccgccgagggctccctcgccgccagcacgtgaggtcagctgggaggcgattgctctgctcaagtgtacacttccttcttcttcttcttcttcttcttcttcttcttcttcttttttttaatcgtgatgaatctaattattgaagaactgtgaaaaaagtcgaatatattttgatttttttcccaatcttgacgaatctgatgtctagccttttggagatgttgataaagtaaagtgtgcgtgagttcgtaaagatgagtgcattgacacatcttgttactttttaaagccggaacaaacacatatgtgaacaattatatacactgttaatcactaaaaatttaaggtattataacggcgtgatccgtagttgggatcgttgggccttggatctgccactgagtgcaccttgtgagcatctgtcagctctatcgtttggttttttcatggaaacaaaaaataatttgtgaataaaaattttatatcatgtgttcttagcgatctaaagtaaagactgaaaagtaaacttgatgcaaaaccttaaaattagtttcaaatttaaaattgaaaatttaaatgttgtccgataagcataagctaaaagatgatgcatactttctgaaatgagaaaacactcgccgttccgggcatagttgttgggaacttgggccgtaagtccataacggagctgtgacttacgtgcggcccagaacggactgtcacttacgtgcggcctaattttgttgggccggaaaacggggagtgtggcttaacgtgcggccccatgatttcgtggaccgagccatacttccttttctgcgaatgtttatgggccaggccggaatatggccgcccgtaccacttgatctctcttcttttcgaggagaacacctaacagtatttgattcctgccacgatttgtaattaaaaatgtctacctttaaactttaaaccacttttaaaaggctgattcttctcgcacaatctagaaaaatgtatgtgtgtgtttgtggcaattctactggcgatggcaattggcaagtgaagatgctccagatgattgggtgtcagtcgctgccacgccggtggtagtggaacggtctaaccatgggtatagtagctcagctagatcaaagctctcgctttcttcgattccttctttttttctctgcatttttgccccttctcgtgtggtcgttcagcaatgtcaactgcatggtgcggtgtgtcgaaaagcttttggattaatgcttcctatgagctaatggctccatgtcgacttgtttaatggctgttaaattggtgagttgtttagcatatctctgacgctttgtttaatcttttccttttatggatttgactaagcaaagcaaagcacctttgggtttaattgccgttcatataaaattttctctcagcatagcaaagccatgtaagtagtgcaacgctgcctaactcaactcgatctcatccatcatccaatctggaaacagtgacagtgaaactgtaatagtagtaataatacgagttaaacaacaagaagccaactgtttatcggcaattgctgcaagaaagagagatgacaagcttaagaaagttcttgcaagcagaattctgcaacctccatcttctagaacttgacggattctcgttcgtatcctctccttcacccgtgcactcgtgcagaactgtttcttttcgttggctccgtcttgtagtggatgaggaatgggggaatttcaggctttgaattgctggctgacatatcgctcaatgaacggatcaggccgtagctgggagttggaattgattcctgctgctccccgtgactcgacatgaatcaagccaaaggctttaccaagtccatggaacgcagccaatttgttttgttcttcaggttcagtgcaatcttctgaagaaaacttctttcaagaaactgacagaccattcctgaagaacagaccaaacacgtacgtctatgtcagccacagatttcaggttttattcatgcaccaggataactgctgatgagatcatatgatcccacaataactgtactgaactgctaccatgtgacactacgagatcgagacgaaagaaggatcaaagcagcaggatctgcgtctgtttctgtcattcccttgagtgcacagcgcattgcagtctgcagaggacgggagtgttctcaggctgagtgtaataatgcttccattattttttttataaaaaatgacagagcatcacctagaagaataaaaggttggatgcagaaatagatcagtactgaatactgatttgtttgtggctgcaaacaaaagataattttgttgctctctctctctgaaaaaaagaagaagaagcatcatgtttgtgattcttgtcccttttgggtagaatcatttctactagcactctagctatgcaactttctttgtgccctgcaattttcagtgggttattaatatataatctatgcgattatgagaatggactacctgtctgtgggatctatgtttttctttgatgaaatctgtagatgcatgttcaggctgcattcagatcatcaacactaacagcaaaatctggttcatataatagcagtagattggtcttcctccaatggtggataagacgagtattagaagtacggatgcaatgcatctgtgaaaacaaaactgaggctgctgcaaccaaaaaaaggtcagtgaggtccaacaacgtgcatcagccataaatcaggtcaaccctgacaataaacaaatctatttcgagtgtaaatgctttgacgatctgtagtaaaattgaggtgaggattatctaaactgttacattgactctcctgtcagtgtcaggcggcgacagaagcaaggagttttttctgcacataagtactctaatctgacgctgactgatccggggtgcatctctgaaagtctgaacacatcgggatacagataaaaaccggtagatgccacttcaaaacagttatcaatcagtcgaataattgtagagacagatgttagctgggaagtcagcatccggatcacacgagaacagacgccgctaaatatcttgccttcacagcaaatctgatagtatcaacaaacaactgaacgacacctctgaaaagtattccaaagcaaacaagtttgctgttctttttctcagaatggaagcgttaaactcgcttacgcatttccagctaatcaagcatgtgtctgactaatgaattgatgaatggaagattgggagtatgaagcaaccaagagctgcagaaaactggggattacttgcaagacagacaaagaacaaggacaggaaactggggaaagaaaaggaaaaataaagtggcagagtcagattctcgatttcctaattagtataggagactagggctagtatttaagcgatgcgataaggttgttgaatagaaaacggtttaggaaagaataagctaaagctattgaaattcgcatacgtttgcatttctgattatttattttcaaggagggataagaaaccatgaagtccacgtctacttgctacaagtgcaggaatctgctcactggagcaacttcttatttctcttgcttaaccagctaacataggtttcagcgtgattgtttggtcattgctcatctctttcttgtgttttagtacttctagctcactaattccgagtgcaagtctgcattttaaaagtttaggatagtacaatagtaaacttttttgatgataatcatggtgaaatataatactaagagccaaggggacacatttgctgattgcttgatttcgcaaaaagagaacaccaccttgcttcggcaaccatgaaatgttcactagtaagcacccattctttttatgctaaggggtgacggattgtcacaggcacgattcttaagctcctaaataatatgatttctaaataaaacttcctttatctgtatttcttagataacatatttaaattagatttttcaattttcgcctataaattattactacatccatcccaaaatataagaagttttgggttggacacatgtattaaaaaaataagtgaaattaaatgtgtgaaggttgtgattagttgagaagagaaagtatgggaggaaattaagaggtgaaatattgtgattggttgagaagagaataatttatcatattttgggatagatattagaggctaaaaattattatattttaggacgcaagaagtattatacactcaattccatgtatcatccatcggcacattattactggaccgagccaagagaatccgctagattattaaccaagcaggagtatatataaaatatcataatacatttttttaaaaaaattcttcattagtattcctgaaaaaactttaaaattaaaatttcttttaaatctttaactaattcgtttctaccctaaaataattgttataagctcacgctagtagcgggcgcagtaaaagagtatttgatggattattgactaaatatgagtatctcttctctctactacttaaaaaaactagaagagaaagtcggccttcttcattctctccattcctcacttacatctacgccgtgtttagttttcaaaatatttctttaaactttcaacttttccatcacatcaaaactttcctacacacataaactttcaacttttccgtcacatcgttccaattttaaccaaacttacaattttaacgtgaactaaacacagccctaaaaactaactatttctatctcgttctccacttccatagaaacattttctctcccataaaaaccattcactcttaaaaaaactgattctttttaaaaagactagtataaaacccaaacagcataatcggctcaaattcttccactaaactgaataaaaagaccgttacgacgcacgggtctacagctagtatataaaataactgaatattgaatattgtgagggtttatatgtaaatcttcccaatggagagcaagaggtgtgttcaagtgagaaaggaggagaaaaaggcaccgcctctccatgcattaaggggctgtttggtttccagggacttattctaagtccctgtcaaatcggatatttggacactaattaagagtattaaacatacagtaattataaaatccatttcataagtttggactaattcgcgagacgaatcttttgagtctaattacgccatgattttgacaatgtgatgctacagtaaacttttgataattatggattaattaggcttaaaaaatccgtctcacggattagctctcatttatgaaattagtttttttattagtccatatttaatactctaaattagcgtccaaacatctgatatgacatgggcttaaaaagttttagccccatctacacatcacacgcttgccttcttttctagtactgaggtggtatggtaggtcggtctgtagccagccagccagctgattttgcttccgccgcttttctccgtctcttctcgctcccttccctccctcccatctccctgcggtctccgagccatccacctcgctgcctctgccgccttcgtgtcgtgcgtccctctcctcctcctccgcgtgcagccacggcgtggcaggcagctaccacagcagccgctattagctcaaatcctcgctggttgacctcagctgcgacgactcttcaggatgagcgagtagagtttctgtggcctcgtttctttcttgcggattgggggtgggttcgtttgtttctttccttccttcccgcgtgtgaggcagtgagccagtgacacgcgggaatcgatcgaaaggccggatctttttttagcttgggaggaggaggaggaggaggagctgcgcgtgtgcaggttcgagttgactttcggggttggttggttggggctgcagga

SEQ ID NO: 62163 - DNA, 4376 bp, Oryza sativa
gggttgtttgtcctactagatcgtggatttattgtgtgttgaattgggtttagtactttggtttgactatgttgaagataaaattttaagatcagagcatgtgttctgcaactagttatacctgttggcctagttttttttttttttttgcatgataattttttttagcctagcttgttagttgctgcttttgtgcagcttcacttttgtttttgttcctctttcttacttctatagagtaaacaaacaatagcatggatgcatggataaaatcatgttttctctagtccttgggaggcagaggtaatttttcgtgttgatcagactggattaacactatgaggtacatgtaactctcaatacctcccaaggaccaaaggaagactctgatagaacatagaaatagggttcattgaaatatcataagcttctattgttgtaaaaagggagtcggatattttctttaaatgaatggcaggaaaatctgacttggtagtcctgacgacctgaccatacatatgcagagttctgattgaatttgaacagaagcggtgcttttggatacattttgaatttcacattgctttgttaataacaagttgttcttatgcacatttcattaatttcttgttgagatagcagacccatcaaaagtgaccagcaaaacaagtttatcatctgtcccttccacgtttaagagcaattcaagtcgctcgactttgactctgccatctatgaaggacagaagtgagcttcctactcctcggacggaaggtgaaattttgtcatcttcaaatttgaaggccttctcgttcaatgatctaaggaatgcgacaaagaacttccgaccggacagtcttcttggtgaaggaggatttggacatgtctacaaaggttggattgatgaacacacgcttgctccttcaaaaccaggaagtggtatggttgttgccgtcaagaagcttaaaccagaaggtttccaaggacacaaggaatggctggtaggttcagaatgttacccaccgctgttttctgctgttctcttaagacatatttcacgataccttattcctatttttacgctgcagacagaggttaactaccttggccaacttcaccacaaaaatcttgttaagctgattggctattgctctgatggcgacaaccgacttctggtgtatgagttcatgccaaagggaagtttggagaatcatctgttcagaagtatgttctctattaaaaatatttatgccttcttgatttcctggtttctcatgtcttaaatgttcacatagttcaaataacattttttttctattcttgtaggaggtgctgatcctttgtcatgggcaataaggctcaaggtagctataggtgctgctaggggcttgtcgtttttgcatgacgctgagaaccaagttatatatcgtgatttcaaggcatcaaacattctccttgactcggtatggttgataattaatgttgactctaatcatcaagcttgtatagcttgttgagatgttctatcaacatttttccccttggttaattgcaggaatttaattccaagctctcagattttggtttagcaaaagcaggtcctactggggataagacccatgtttccacacaggtcatgggtactcacggatatgcagctccggagtacattgcgacaggttaaattttaattctttgctttgaataaatcatgggaagtcttttctgttatatagcatcggtttaaactaggatcagacatatgactgccaggtgctactgaagctttgaattatctaaaaatattgctaatgaagcttggtgtcattgctttacatttcccaagctcactggaatttatcttgctgcataaagcatcttatgcatattgccaaatgcccagatacataacagaaggcatatcactatattagttaagttagaaaaaaaattattatcatgttaccatttttcaaaggatcatattttgtatgttttttcccttaattccagcgcaggagagtcagtcatacctttccttttattttgtcttcattttctgaattcctggcacattgtcaaatgccaagtcaaactaatcttttcattgaggaaatgtaccactctgcgtagcaattaaatagatattgtatggtttatatctggagcaaccagttctcatgttacttaacctaaaactttataggtcgcctctctgcaaaggcagatgtctacagctttggtgtggtgttgcttgagttgctcacaggaagacgggccctggacaaatcgaaaccaggcatagagcagaacctagttgactgggccaaaccccacttgggcgacaagcgtaggctgtaccgtgtcatggatacaaagctgggaggccaatatccgaagaaaggcgcccacgccattgcgaacatcgccttgcaatgcatctgcaatgatgccaagatgcgcccgcggatgtctgaggtcttggaagagctggagcagctgcaggactccaaatataatatggcttcaccacaggttgacatccggagaacctcaaacgccgtccctaagtcgccgatgagaatccagccatcgccacggcgctcacttggagcagcagcatccccattgccaggatataggactgccaaagtgcactagaagtgcaacatagaagaggtcttttatctgcacggctgtatagtttgttatgtaagcagtgtttttttgtcctttttttctcgaggaactttctgtttctagtgatatttcttttatctgtgtgacacgagaatctgacgtccattataatgtaaattgtttgccgagataatgggtgccgaattctggtgcctgggttgctgctatgatactccctttgcatttcttctccttgattttgcttcacgctgctctctgccatgctgggatcatgatgcagagaaccgtactcactgtgttatacttcatccgttctaaaatataatggattttagtttgattggacatattccagtactatgaatctgaataggtttgacaaagagtttgtccagatttatagtattaggatatgtcacattcaaccagaattccttatattatttttccacggagggatatttttttatataatggaagctttattgatctcagtcaaaaggattatctcactatgaaaggtgacaaactgtgaattggatatttttccaggttttctcagcagttgatttgagatagcaagttcatgcacttctctattcacatctgacagctccctttgaacacattctgacggaactgtttttcagaaagagattgccagattacggggttgagacagacataaccagctgaaaaggactgattacccatagcgtaatgttatgatcctatcagagaatgagacccatcagatcgtttcacatccaaatggaaatttcctccttgacttaaaagttactagtactatagtatatacagatgtacatggctcgaattcaatgatgattcagatagtcccctatcataagttggtgtgaattttcactcccatgaattagcaaaagaattgtttgggaagaacaaagactggcctgctagcaggtaactgaataactgacgcagtctcatttctcaacaataaactcctgaatctctattccagtgtgacgggcaccgccctgtttcctcaccaaaacctcatcaccaactttcagtgaagtcacaggtatagcagttcttccactagatcctacataaaacaatcatatggttccagaatgagttgattgaatatgtgtactaatcacatggtgattagcatcattcaaacataactgaaatttatggcttattatagttgcagctcaaaacttacagtcctatcttcaaaagttgtccatatgggcttacctttttcaggagtgataagtgcaactgtctcggcattttgcaggaaaatgctgtaagtatcatctccaccgttctcctgcagcaagcccatacgccatgaaattgacaatccatgaatgtacagcaatcatttgaagggagatcattgttagttatgtacctttgcttctacaaggattagaggccttgattcaatcttaacacgaccaacaatcgcagtacgccacaaaccattttgatcaacaactattacttcccgacctgattgcagctctgagaggtaactagttcggccaccagggactgcaacatatgcatgaacagggccctgaatggagaacacataaattttattagtcttagtttctcttgttgtacagtgatacctgcaatagcttgctgcaacataagttgttgatatcttaccgcattgaccctgaaaggcctgcttgcaatataat

SEQ ID NO: 62164 - DNA, 11319 bp, Oryza sativa
acaaaccagaaggccttcaccaggtcgcatcatactgcaaagatccacacaaacacgatcacccataccaacaacttcaacctttgacacagtagcctttgtcaacattaactggctctttgcctcgttccttctgtcaaaataatcctgagtgattaaaggaggagagaacaaacaaacatctggtgaatcgtacaatcagacaaatgataatcagtaacaataacaggagctgtactttcacacttagatttagatatctatatatatgtatatatatacacaccacggtacttgcctctatacacaagaccattgtagtcccacagtgttttaataatttaaaaccaaagaaatttcaaagagttgtgataaacataccttgagtttgataatatcatccatgtcctctactttaagtataactccatcaagcccttgctccaaggcctgtaaagtaactaagtaactgggggaacaacttcacaaaagataattgataggaacacgatacatcattatacacaggaacttctattgtatgttgaaacatcttgacagttacctcaagaaaaacctgagcctcagttgagtttgttgaaacagccaatacagttcctctacatccctggaatgcagcaactatattttctgctggtataacctacgaaattcaggaggacaaaggaggcacctgttaacgcttgttgggttttgtcaagtgtactttgcaagttgcggctcaaatatgaaacagtacagcatgtcaagccaatgatcctaacaacacagaaaaaacgtatactggacactcattcaaaccattgatggaattcaaataagctattcacacaaacaaaaagacactcaagatgactaaacagcatagaatgcattacaaaaatgcaagtatgatgacttatctcactatgacaattgaaattaattcatatgtcatggaagtaatttgctgatagtccaatattcgaatatctaacctgccatccacctcggaagtctatcacgatgttttccacttccacattgtctggttgtatgagttccagctctcctggggaagagacttcagaaattacagcaatcttttgttttttctcatcgaatatctccaggccatcgataaaaagaggattgatgcgagcagtagctgcaatgccaaagagataacaaactgtcgatttcagaattccaagaaaatggcatgcactcactgatgcatactatcaagtatatgattatattgcattagtttaaaggagagcaatgcctagacatagttgtttcttcttatggcaaatcatcagtgaaatgtctgtcgtttcttctaaaatagctaaattgttttttttttttttgaaatctaagccagccgagctggttttgtatttagaggtaagcaaaatagctaaattgtgccttatctaccaaaaataaagaaacaattatgtaacctaacatcgctgtaagaaaaaagaaatgctctcacatgaccaatccttgccaagatctttggatccaaagaggaaagtgctccagcccctctccacggctgccgtcatcacctgccgatttgttgtccacacccagacggtcttctttgactccgacggtgaggctgaagaagcgcacatcttgatagaatgggagcaagccgaagctaatgctgcatcaaagaatccccattacagagtcaatattgcaaaaaaaaaaaaaaaaaacttcacagcaggttggggatattcactgattgtctgtcgaataaatctcaagaaatcaatcatgaattcttgggttttgggttttgggctagggttaggtaccgacaccacactcccctagcaacaaaagctgggaaatttcgaccagactgaaatccgtggatctcgattttgtaatgcaaatagtatcgcaaggactacttttaatccgaaatggagcaaggaccgaagagatggattgaggaatctagtcatctacagatgagcagcagcaagaatctatcttgtgcaaagggatagaaagatggggaagatttgggatggtttacctgttcttggagatggcgggacgaggactctagcgaaggccaaagaggagactgccattggatacggatgcctttgcgtttctattccccactcttctcttctaagaaaaaaaaaatgttcccctctatcttttcttctctgttcctagttcctgctgtattcccctttttttttctttttctaaaaaagatgctgtctaaattttcacttgcaaacaataattagaaatctatgtctatttttcagtctttcagaagcaagttttaatttttgaattactagaaaatcaacgtggctaaggcaaaggcacgctcgtgttatatcccggacagattatttcaatgtttatgatgttagtttaattttgcaaatgtttatgatgttagtttaattttcatacattttaaaaatcatcaattatcttttcgtaggtattgcttcgagtctgtttgttgtgtttaattataatcaacaaaacaaataaaacgtctagtaaaataggtgatgttatttttaaggtgttttaggttttgtttgcaaatttatgtttgatgggtggaattcataccacaaaacctaccacccgtcccaaaatatcatttttgcctacttccgtttgtcttaaaataactttattttttaaaataattattgcattgtagtttgtgaaaaacaagagaacgcattgaaaagtatataaagtaaaaatatttgtattaagatttaataaagtggggtatcctagtatttttactttttatttgtatgtgtgtgataggttaaaatatacttattttgaaggagtatttccattacattacttggatcgctccttaattcaaacacttttagctgccatggattcttctagattaatacatagtcattcctataagagggctagcacctcagaacaggagagctgcaacgcagcaacactcaagcctatttttttcctattgtttttttttctttcacataattctaggatttattttgaaagtaaaggccgtcaagtggcccaatcagaactggtaaacactgccagcattagaatattagatatatgaaaactgaaattggaattatgcaaaaaaaaaagtgagagatatgtacatggagatttggacacggccgagttgttggcttgtgctggcattcggcttggagaattggaggcccagatggattccgtcggttggagaattggacacgatttcggagcagtagcgggctggtgcgtgagagctgcgagcctgtgacaacccactgcggaataagtccgctcgacgttcctcatctttttgtcgagtttttttaaatacaaaagtagacgctcacatcacgcgtactcatctatcctataattcaccaactcgtctatctatctatctattctataattcaccaactcgttttactcatgttttactcttacactcttacattcatcattcaacggttcagatcatccgcgtaaaatccgaacggttcagatcgatcccatatccacctccctcaatcagcgcacgacccgcacggcccaccccccttcctatcgctctcccaccacacctgcgtctccgccctccgccggaattccgctcccgcacctccgccatcagcgctccgctccgtatcagccgccgcgccgtcctctgcatcgcctgtctgccaccgatccccgccgccagctcgctctccacgatcctccgcctccccgatgcacgaggtcctcccgtcaccaggtcgtcgccgccgttctgctccaccgatccccgccgcacgaggtgctcccgtcgctaggtagccaccgcgccgtcctctgcatcgccttctccaccgatcccctctgcatcgcaggggtgagctgcagctatggagttcctcgccggtgggggagcagcaggtgaatcccgtgagaggtgagtagttgaacaaaactcatcatgcagttcatcagcaggtgactagtccgaaacttggcatcgtggaggttcatccggattcatcatgcattctgaaacaaaacccatcatccagcgcttgccgcttttcctcagagtacaatgaacgcggggtgctcggcgaaatgtcccgtccggctcctcacctgcaatgcatgtgttctggagagtgtttatggattctggatcttagatcccctcaacgacttggatcgtcagtaaagcttcatcttgaaggtgcacatctgccgttgtttcgtcaaaatactatgcatgatctttaggtgataaaatattgattgaattgtctactgctatcgctcagaatccatactccatcaatcttacatatacacatatttgttgcgtcaaacacaagcttgctttccatacatccctgaacaattcagcctcacaactgctcttgacatatctcattcagaatttttttttctcaaattagttggactgatagaaaaatattgcttttcaagattgtaaaataaccaactgactgggaagttgatgtcatatgttggaagcaatctgctaaaatgttaaagaagtgcatctaacttttgtacccagtgaattgcaaatctctatctcgtttttttttgtttacagtttctttggttttaaagtaaaataggttgacatgggaactttactagcagaggaataggcttatattcttggaaaaaatacatttctccatgcagaatgtgattacaataatgatacttgctgccatgatttctatcactcatgcacgcattgcccttgatgattgtatgcagttgggatatattggtgagttcaccctctatctctctctcaaaccattatttatcttcattcactattcacttacaatttccctcgtattagtgatatgtattagtgagtttatgaaaaaaagatcagatatttaaaaacagagttagctcctttggaacgaagacaaaatgctactttgataacttgacttctcaacaccactcttatctgcacacaatttttttaatgaccagtttgaactttcatctctttacagtcatcaagcaagaaaatccttggcggttctgcttcctggaagcagtaggaacaacaagagttactgaaccagaaattgaacttgccttcttcatgcatcagatgaaccataaagggaacaacactactaccctctccaaaattgagctgctcaggacttcgtagaaatttacagcttcaggacatgtgatttatccattctcttttactgtttattctaaaatgcaaaaaaaaaaaagaaattttgttgtagcttagattaaggcagcctcagctttgtggtttgccaagccatgtaatgatatatgaatgtgatactttaattaatgttgaaacgcatgattatgtatttgaacttaattgactgaatgtgtcctggaatcggtttagaacttaatatatcaatcagacttttgttctttggttactggtttttctgtgacgtggagaaaagacgttgaagacataatacatcgtcgactgaatgggtcgaccttatggcttgttttgcaaattttgaaccttgtcctggatgtagtttatttggcttgtttatccctttcgaatatataataactgaggaacttctaataagcttcttaactgaactcgctcatctgtaagtcttaattaatgtcttgaatctatccttgatagcccaaacaatatattgtatatctttttgttgtttcaccgtagcgttagcacgggcatgtaactagtcctataaatatacacacactcaggtacgttgcctatcactaaaataatagttagccgtaaatgagagcacccgtgtcaagtctaggacttgaacccggatgagttggttctactacagaaacataaccagttgagatacgtttactttgcttcctgtcaagtttaaatcatagtaccctcaacttgcaaaaactgggttaaattagggtgccacgtcagagaaccccagctatttcatagatcgagttttgtaattcagtatgtgattcagggatacgatttaaactcgatgaaaatatgagagatgacaaagtggatttatccacccactgcttcgtatggggtgggatgaggcctttggcgatttctcacgccctcgcggggtcgcgcgcatgtggacgtacatgttgatggagagttggagatgggggagccaaccaagtaaccaacagacgcggccacgcagcagggatgtaagccgatcaacccacgagcctactaataagcaaacttagcaggtaccgtgtagattaacttgcgagttactttttaatttggtatgtaaacaggtttatgtatcaatccacttgtatctttagatacgataagtcgaaccatgatgcgaaaacttattcactatcacttattcgggctgtatttaattagttccacgtcaaaattaaaagtttaaaaaaattggaacgatgtaacgaaaaggttgaaaatttatatgtgtaaaaaatttcgatgtgatagaaaagttaaaagtttgaagaaaaaaaagttagaatataaacagagcctcgatctataagtgctcacaggccagcccgcgtgtatccctaccacgcagacagcgacaagcagccatgccgccccggcatcgcgatcccgtgtcgcgcgactcgcgccccacctttttttgattccgcctcccgttttctactgtttttccgccgtcgtcacgtcgcgcggcccggacggcgcgttggttggccggccacagctatagcggatgcggaagcttctctccgcttagccaaagccgcaccagcgcaccgcgtcaggccgtcaaccgtgtgagtaccccaagttgatcggcatcgtaatcgtcgtgcccgcctccgtgccggtgtcgcttgctgcacacatgttcctgatttgttcacctctctccgttgagctgttgtttgtttactgtccgtggtgaaactctcgggccgagtcatgtaatgttacggactcgtgagatttgcagggagcagaagaagaaggaggctcaagtgaccgggtccaccacgacgtcgctttccatcatctattgtccaggtccaacggctatcccgagacgacgcagtagcatccgatggaacgcacatcattgcaaacattttcagtaaaacccctctgtttctcactaaattacatatatccccttgatgttagctttctctccagcaagcttaatactccctccatcttaaaaaaactaaacttctagagtttaaattttgttccataaaaaactaacttataccatcctacttaatattagcacgaaaaacgagaagttttattccttcaataccctttaactatctatcactcttactaattttttaatgattaagagcattttagttattcttactctccactaattccaccttgagatgctaggattggattttttatgggatggagagagtagtattagtcttgtagtagtgggctacctatcatatacatattacgtcttatagtttgtgttgcggctgtctacaaatttgtagcatgctgctattttctgtcctcatctatcttctcaatatgtgcttatagctagcttataatctgctattataccagctctcaattctctcccttccagtatgggttatacggtaaatcatgagaagatgcaggtctgatctgcaaaaaaacacctccaacggttcattcaacctccactcccccttgttataaacgagagacttcgctccctctccactcttccttccacagtcccatccccgcgacgccgccattagagccgcaagaaaagctcatcaagagaggagagttcgttcgagatggccggctgctgcgtgttcctccggtggccgtcggcctcgccgtcccgcatcggctaccgctccctcgacgacggcgacgacggcccgtctccggcggcggtgacgacgacggtcgtcgtcgggaaggagcggcgggtgttctccgtcgaccagctggtgctcgacacctacccgttccggctgctgctgtagagggcggtgaggaaggaggagagcaaggcggcgctcttcgtagacgtcgacgccatcctcttcgagcacatactctggctcgccggccaccacgaccgctcctcctcctccctcctccacctcgacctcaaggagatcatcgacttctactcccaggacgcctgattcttgatgatgatgattctgttcatcagattcttttttgatcacttctttgttttcttctcctttttgttattacccccttaattaatcatgtgcatatataatgatgattatatcttctttacaaagacgatattggcaatggaaatagcgaattataaagcattcgtagtttgattgaattgctgtccggttctttggttgtttcttggttacgccatttttttttctgaagaagattaccagttctctgaagatgtcatggtttctccttttctcactatgcgtgtgtgcattcacgtcgctgttacaggccaaacgaagctggcatgatacaattaccaatcagtttaagaaattgttgtggtcgttttcgctaaattcggctgcgaacacgtcaattcctagttagctcaaaacgcgctgttaagatatgctaccgtctgatttttttttaatcgagaaccggttgtgtttctgaacatgacgtccaacaactcgaatacatgttgaccatttcgttggcatgatttctcgttgagctaattgttaactaccagacgaaaaactgcatactacatcccagcacgacagggtactccctatgcaagaactgcacacacacgtttcctgccatttcaactgtttattcatcaaactagacatgttttttcatcgaacttcaagattcgaacagatgctagtatgtcagagaaaccctgttttattttattttgtttgcttatcttcagctgtccatcatttgttttgtcccgcatgttcacaaatgattgcaagatcatattcctttgccaatcatcatccatctctgatatctggatgtatcattgtttcctgaaggtatgaatatgatttcacaatatagcacttgtccaggcggccaccagaattaggcccaactgaactgcctgtggtagtttaggccccaataacaacttggatgtttctattaaaaaaagcaaagatataatatttgtctatgttgtactgcaatataaaaaaaatgcgaatattagggaatgacctaatatcaaataattagaaagggtgaggctttgaacccaagtcgtctagcccaccatcttatgaagctagccgaaaaacccatgtgcgttttctcgctgtactgcaatataaatagttgatatatcaccacattgaccctgataagcctgcttgcaatataggagtgttttctctccaagcattgagaatgaacaagaagcattcctcttgcataggagccaacctgaaaacaaggtatcatgtacagtgagactggtgatgtacacatggatgcttggaagttggaacaagtaaaaatgctatgcttcaacgattgcagactgatggtgcaatacacatcatcagtttacaaaattagcattactctagataaacacatccagtactgacgacaaccacacctgaccatgatgtgcgtaaatttaccagcattcgcacgcctatctatcttccattcatgcccgctttaacatcttcagcagtgtcaacgctacagtgccacatacccttctggattgatgatggcttcgtagttcaggagcccttccgagcagtccaatgttgtactccctccgattcaaaatgtttgacaccatttactttttagtacgtgttcgaccattcgttttattcaaaaaatttaagtaattatttattcttttcatatcatttgattcattgttaaatatacttttgacggagcgtggggctcctcaccgggagaccgcgcaggcccccctttgccggttcggccgggggagctaagtgaggttcttcgccctcgatctgaggaacgtcagcgagagaggaagtgcacaagacacgggcgacgtagacaggttcgggccgctgagaagcgtaacaccctactcctgtgttctggtggatctgtgcgtgaaggaatacagagcgccccggagagggagagagagttcaggctctagaacccattccccaaagtcccaaccctccttcctctttttttcttcctctttcttttctccctctttctttttttctctcctaggcctgggcctcctttttatctggtcaggggtcaccacatgggcctctagctgtctaagaagggaaacatgctttttacaatgagggctagtctacagccggaagtgacctctgacaagcagagtacacgcctcctgccccgctcgcctgctttcccggtggacgtccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgatcggtcacacaccgcgaccggtcacggaccggataagcgtgcgctgcgccgcattaaatgcggcgtggtgcgctcgtccaatcctgctataaatgcggttatgtgagccacgctgtgctcacctaacccacacgcgtggcgccaaaaccacagggggtcggggcgccccagccctcggggccgaaacgggggcgccccagccctcggggccgaaacgggagcggtccgacccctcggggagacagagggaggggtggccacgtcatcctcgggcccgacccccccccccccgagggggtctggccatgtgggtgaccgcggctacccaagcctctagtcacgatacccccggtcccatgtcaccgacaactttcatatacacatattgttttacatatttcataattttttttgaataagacgaactgtcaaacatatgttaaaaagtcaacggtgtcaaacattttgaaacagagggagtagttctaaaatggatatgatctcccatcattggtcctgagggaagctaagaagcagtggaggaatgcatggatcacacttaactgtagttgatccaactctgtctttactat

SEQ ID NO: 62165 - DNA, 1455 bp, Oryza sativa
tgaaaacgacagtgttctctaagcatattcagttcccaacaaacaatggctgacaacctttacaaccgaattcatcaccaatatttgtgagaagaagtgtcaggactcaggacaaatgctcgaatcaaggccatctctgttgcatgattgctgaagaatattgcttacatgcatatccagcattttcagatgatggaaatctttccaatcagaacatatacactcattacgtttgctgttgacaggctatcaagatgataaataccagccattacacttttggtaattcgcttcgcagtgctctcttctcctagaattgacacaggaaaaaaccaagaatctgtctgaaacctgcacatgaatctgaaagggagaatgcattaggaaaccgatgtggacatgagcatttctttcttttgcaagctgcaaagcttgtgagttgggcaagaaaaagacgcattcgctggcgcccccaattagcaaggagttagagctgcgatccactgaattttcgcagcgtaatgccgtgtgatgtgaagagagaagaagctgtgggtaggtcacgggcccacctgacaagtgggcccatcctagtatccccagcttcactgttcacacacatcaatgcatcaccagctgtagccttcgggccttcggggacgcgtggtgtacgaagagcagtaatgcagcttctaatctcagctgttaagctgagtgattaactcttaagcaatcacttagtagtactgttagctcatgaccagctggtgagctgcgcaaacatcaatttttttttcttctcctcattcttcgtcaacatataagtacagctctatcgctttcttctctccagtcgccacacattcttcgctaccacctccaagacaagttgagcactgctcagcttggcagcttgccatccaggaggaagaagatattctagagataatctagagagatcagttgcgttttgcgaggctgcgtgagagagatcatcattatccagcaaaccaccatggagaacatcaagggggtaagaaactgccaagaacggcttccatctcaattccctgaaacgaacccttcttctcttctcgttcctgctgtttcttgtctgaatctttcgctgcgttcttgcgcgcgtgtgtgagcaggggcatggcgcggcggcggcgggcggccggaacgggtggatgacggtgccggcgttcggggactgggacatgaagaacggcgcgctgccggactactccatggatttctccaagatccgcgagatgcggaagcagaacaagaaggagctctcccgcaccagcctcggcggcgacgacgacctcctcgcccagcagaagcagcagcagccgcagccgcagcagaagcccgccaaggccaacctcggccggccggccgacgaccaccgccaccggcaactccatggccgccacggctcgccga

SEQ ID NO: 62166 - DNA, 7467 bp, Oryza sativa
ttgtctttcgatttgtgcggtctttagctgaatcatggagtgcaaagatttgatctttcttttgtttgatacgaccagtacaagattggctttaactgatagtagtacaagtcaaattgttaaaaggaaaggggataaataaaaaaataacaagtggacaaatccagttcttgaaatgtagtactactagcattgtggcatgtaaaaacaaagcacaagcagagcactttcagagggcagcaccactgtagaagcttcatttcctaacactgaaacagatttcgaagataatactgtaaataattttgcatgtttcttaatccctacgctagagaacagcaaccgcgtgaggctttgtcggtcaaactcttattccaaggcatggatcatgaattgtttttaccgtggacggtggagagcgtttgaatgtgcagactgcattactgcagtacagtagattagtagtactgctgtcctggagctgtagaatcaacatgcaaatattaatgtctagacatttttttccctggagtaacaagagaaggctaggacaggatccgaggagaggagaaggttacaagctgatgcagccattctgtaactgcatttgcctggttattttacctaggcagctctagcttgttcttgtaagatgtcaacagggagaagaatgacagacgatagaaaatttgagaagctattggacatatagtttagaaaataccatgttttaacgtctcctgaattactagaattaatcacgggtaagcagttagctgatcaactaatacatatatttaaacaatttagaggtggtgacctataaccttgtactggatcagcatgcacagtggagtcagttcaacagctataggtgggttggcgaataggagtatatatgaagtcatatcaccggccattccagctttatgcatatacatatatagtgcactgcttcgatcaaatgattggcaaggacaaatactcatattttgtaaatcaaatgcatgatatcctcatatctgtttgccttttaaaggctgtaagcctgtactgatatgcattatgcatagtccagagtacaaccaattaatatattaagcatcttggtggccgaaagatgattagaaggaactaataatgatttgaatcggttgatagataagcaactcttaacacgtaataaaaagatgcaaagtacccacgggaacacttggatttagtgactaacaactaagtaaagtctgccacaggttggtggtgtcttagaaaaaatatgtatttgattatgctattgcttgcggaactggagaaattaattgtcaataagtgtatttaataaagtatcacagttctttccatgagacaatttgacatgtaaaattctgagttgcaattcaattcttctacatactctgagatgcaggtactttcaaagcatcatttttttggaaataaaacttagcatcaagtatgaacttatgcgcaaaaactaattccgcagatatctgcattcttctgtgtaacattaactgattttagtggcctctgagtttctgactggaacttctgatgcagggaaggaggacgtttctgagctacttccagtgctgtattaaggcctgaagaaggactgtcaactactgctattggctgtactgttgtgtcacagtgcaaactactcagcttatttttagattaggcttcttgggctttgtcaagcctagcaagatgtgtaatatattcgtcgtgatgcttaatcttttggtcattcagagaacaaaactatttatgagtggcacagattgcttgcgaattgaggtgcaaagctgtaatatattgaaggataaatggcatcttgtgtttttgtacggttgcagaggcatgattgatttggatttgtttctgctatcacgaggaaagatataatgcctttttttggggcgaggaagaaagatgatataatgtttactcatcacgtttctttgtaacatctggagataacactgcaaaatctgtcatttatgtggttctttggttgatttttctttctttctttttgagtttggacaatttgacagaactgtctgacctaattattaggaagatagttcactacacattgtcttcaggcttcagtgcctacaggaagataatttgctttacatcatcttcagctctctgtgagtttcttgtccaaagaaaatctgctcatatgttagtcacgggtacaatgattgtttgggaaacatcaaagcctgggctgtcgaatgcttcagttagcagaagagtaggcatgattaggcaatactgacgagaaagctatatagccttcaggcagaacattctgcttgaatttagtgtgtgtttaagcacagaggacagcagtcaaagaactgttgttaactagagatgcccaaaatagatcatctttcttgttcaacagattccatttaatcactagaatgtacagagtaacagagaaaatgagatgaagggcttgtttggtttagtgccctactaaaacattagtagtgtcaaaatctagacatattttggcactacaataatttggtagggcagagttctaacttctaagtaatatgtttggattaataccaattggaattgaaagatcaagaacggctatagggggggtgaatatagcaattcaaatcttgcccccgaaaatactcatcaagccggatttctcaaaatccttactagaaccgcggttattagagaagccggatctagaaaagaagagagaaggaattcccgaaactataagagaaagagaaaaggaattcccgaaactagaagagaggtgaggaggagatagcaaaactcatcatcgcaaagttcaaattgcaagcggaatttaaatgaacaaggcaaaaacgaaatccttcaaatcatttcattcataggtgatgcaaaataaccgctcaactaggagcaaacatacaccttcagaggaacattaacacaaacttaaaatctctcggacaaacacactccaaactaatcctaatacaaaagcctctcgggcaaacacactccaaactcacactgaaactctctcaccgagcatctcaaaagaattacaaaaggagcaacctccacccttgcatccatctggactccgatcacctgcacacacatgaaccaaacaaccgttgtcttggcacagctgtcgcaacctgaccaatgttagttcacgcacacatttcctacacttccggtacttgtcaatttcccatcacaaagaactaaaaccacccatggtttcacatgaatccaaattttatgttatgatgcagaaaattctagaattatactaccaaattaaatatgggcattaccattcatttggtttcgaaccaaaccatcatatttactattcaaactaccaaaaaattaacatggcatatattggcatcaatccaaagtggcccgaaaacaaagaaaaatcgccatcaactcacatgatcttcgattgcctgtagcttctgaactgcaacgggagagctcctcgaagaacgcggcgaagctcacttggtagatttgagatcattggcggcggcgccgtcctggtcgagcatgcaacctgctcgacgaaatgcctccacggcgatcctatccggtgggccccacctgtaagtctcacatgaaatccaaataggagagggaaaaaaagaaaaaagaaaaaaaaccatcgaatccgaggagatagggagataatggtggggaggaagccgctgcgccggcggcggcacgacgcgccgccctcgccgccgttgttcggggccacgcctcggccgacctcccctcggtcctcctccgcctccgtggccgcggtcgcggaggagctggacggcctgctcctcacggcgccgcggccgtcggcgtcgtcgtcggagccgcggagcttcccctacgtggtgaagcagcggtgctgggagaaggcggagcgggtggccgggcgcgacccggagaggtggcgccgcgacgcgctcggcaacgtcgtcttccgcaagctcgtcggctgccccggatgcctctgccacgactacgaccacatcgtcccctactccaaggtcccaaaccccaactccaacactgatgaatgagttcgtgtaacgctgctactttcttactttgatgtctgatgaattgatgatgtgaaagccccgggagatttcagtgcttcatgttgcattttcattcgcttaattgtactgttcttagttagaacttagaacatgattttatttgacgcgttgcattactaatccttttttgaatggacagggtgggaagagcacattggagaactgccaggttttgcaggtacatgcgtctctatagttccataccctgatcgatcactccactgtacttgtgcatacacagaattgtgctaagtttattgtttgtcggagtgaggtaatggggagtgctacctggttctaactaattgatacaaacaagcttcctatgtaatgccgatggcccacctgtttgcacatttgcgcctctcttcagtcacaaagaagttactcatgattttcctgttactattgagcattgatgaaataatgaaatcgtaaattgtttacgatgaaaccttgtctgtagtgtgttatcttgttggaaaacattgctagtagtatgtgatcctatgtgaattgtgatgcacagccttctcatttgacacggtcggttctttcccacaggctactgtaaaccggtctaaagggaacaaaacagagttatccaaatctgagctcatacagaagagtgcctattgtagggtctcaggtgagtagtatggctaccttgagttttccacctttactgaagctatcattgatcataaaattaatcacccaactttctaagtaacttgtttgatatctgcaggacgtgatatggatcttcttgaactctctgcatatgggaatgttaggcgagggccagattcaggtggttgcagaatccaatgaagacgatgggtacgtctgaagagtgatgataatcagtttcaaaaggctgcctgcctacctcaaatctgataggaaaaatcccagctgatgtttgtgccaaatatgtatactcccagctttatgggcattcatcatccattttctaaggattgaccatcaggaatgttatgaattttgtcatcttagcatacttaacggatcctgatttaaggcatattttattttgtattacataccatagttccaagtgcggtcagtgtaaacatgtgtcgacgcatttgttttaaatgtgacatcacattcgtgccatctcttcccacttctgcatatatatactgcaaattttccacacaaattgattgagctaacatttatatccactcatacatgtgtggatgaggaggcatggggatatatgatcttaatttgctacacataaatgatgcaatatccagatctaagccatgatgatgccaccgaagcgaaaatgattggtaagatcttgatattttattcttctttggtactttcagaaatctttacatttttacttttgttgttcaaccttgaaaattcaaacctggttatgatgtgtcaacagtatcttaaatggagaccattgcaattaatgccatatttttctaccatttcaaatacagtactgtagaaaaacccacagtattcttgtcattttctaagtgtgaaaagatccatgcttcgtacactaagaaagtcaacaagtcgcttcgtattttctccatatgtttatgtattaatggtaaattaaattatttttcagtagtcatcattttttaatacccaccatttttgttttactgtccaataataacatgccacatatatttgactgtttagaaattaggtgtaaatctcacgtgataaattttagtttacttttaaaaagaattatcacatgatcatccccataatcattaactgttagctacagagttttgggaagaccagtggtaacggtttgggtactagccacctttaaaccagacaaggtgactaagtaatatgtaagtcacacctttttacagctgaatattgaattgtttgatatgttatttgaaaacatggggaaaccatgaaccactcgattttgtgaacaaaaaaattctgttgtagttttgggtactatcatcaaaagcctaacctagtggaaattacttggaactaactagaatcttgtgtaggtcatctgatgcctccagatccacaagaactttacgaatgattatatacaacctaatattataagatcgaaacgagctcttttttttttggttcattcatggagaaatatggaaattcactgtcttctgtttgttcagttgcaggcttgcagccaaacactcaagagggttattgtttgctcggcatactttgttttctgtttttgaggatggcgtgctcaatgctctaatcatgctcccgatggtgggtaggctgaaatctcactatcatattattttcctttttgtctttttaaaaatttcttattaagcttgacttcatacatataattgtatgcaaaagcatgcatgatgagtttttaaaatttaatctgaactagaaaataggtttctcctagtgaccatgtgtcacttcagcactctagtgcaacctttgcgttacttgcctttgatgggaaagtgcactcacaaaagtttattattaaagctattgtccttaaggtttctgttgccactggtgactggtgtgtagacaccaaaaagggaactgcttattgggtttgaccttcaaatgtcaaaaggggtcatttcatttgtttcatgccactgccgaaagtcacaagggtagagatgatacatacccaatacttgaaaaatacgattaattactttcctgtcacgttctatcatatatgagatatttctcgacatgcatagttgcatacttaacatgccctcacaccattagaaggctgctcaaataggaataaaggtcagagattaatcatcataagtatgcttagtcagaaaatctttaatcatattttttccttcaaatttttattacgtgtccccaagttttcattttgtttcttttttcccgagggagttggtgacaaaaaaaaaggtgccctggcaatatatagactagaaataaggtgcacattggaattttgatttaaggtcaaacatgctggcttagtaagttggctggccaatggtgtaggtggaagttccgttcaaaaaaccgtgtaagtggaagtggcactaccagatgtcaatgagtgaaaggcaggtcgaatggtggtaataatgcatgtattgaaaacgtttcaaagcttagatgttttctgtaatgcatgtgagactttattttaggagtatctaccagtaatatgtttcttgatatgattggtagagcttctcgtccatttccatccataatatgtttatataag

SEQ ID NO: 62167 - DNA, 1819 bp, Oryza sativa
tcctcggtgtcgacgacctctggctgcggaggtggacttgtggagtcttgaacggtgttctcttgagttttcggttcagtcgtgctgctgccactgtgttgaaggtcctgcaagcatgtgaagaaacttgatgagtttttgggtgttaaatttgcaattttgttcagttggaaactataagcccacatggacagttttgtgttcaggttattgtaccaggaagatctgtgacagagtttgttcattgtttcagtttgttcagttgatctagtaaaacactggaggatatgattatgtaactgatagcttgtaaggccacatgttctgatctctagcttaggaaatgaaaataaagttgtgcaatttgtgttggttaaatctagttacatatgcctctaaacttttgtagtactgtaggctaagaaaagaagcagctctgctttcatccaaaaaagaaaaaaaaaacatggaaggccgaggaaaaggcctaattgaaacagtctgcacagtctagaaactcatcaagaaggttccatctttcagatagctaattcctgtattattaactgatactatctaaggaaagcatggaaacgaagcaaaaacaagatacttttgaaggattctttcgctaatggaaactaaacacgcctactcacattgatatccccaaaaatgaaaagaaaaataataagaaagtcaaagaaacacaccaacctcagacttataaggcatgtatgtacactcaagattataccgttttaattaccaattaacaatttaatatacaaccttataagtcacgaccaatatatggactcccggttgatcaccattatcatgttcaaaccaaagaaatggccaaaattaatcaatcaatcaaatcactccccattatccaagcaaaacaaaccaatcgaattatcccgaactgaccgctaattccgatcgccacatcaccagatcacaacatagtactacatcgcttgaattctcaagccctcaaaacgatactacaaaacacaaaaaggatcgccagaaaacacaccaaccttatcaacatcgccggcggcgcaggcgccgggctctggcacggggatggtcttcccgaacagcttgatcaagcagtctccgcctccgcctcctcctcccaccttgcactcccccatctcgacgactcacctcaccactccgctccaaaacgaacaaactccgtttcggaattccccgccgccgcctgcactactcctcccggagacgacaggccaacgccaacgccgatgagctcatgcggaggaggaggagaggagagcgcgagatttttggttggatttcttgaaatcttttcattcgcacaagcgaggcgatgggattggggatagttttaaggagggagggaggggggtggaggtggtggggcccacggaggagggtggagagccacaagatggatttgtggccgcaggggtgcggttttttgattctctccaccatctctccctctcaacccgccttacttggcaatcaaatccttcattgctgacatgcacacctacgatatgctcctccttttcttttcttttcttttcttccttttctttttgttctttctttatttcatttttcatttttggatctgtgagtaatgagaagcaagtgtattttttttttttgctgctgtgtaaaaaacgcttggctggtagtctttttggtcatcggagtgtttgtctagcatgatcagcgattcggttatgggaattccttttagtagatgataatatgtcgtgattgggctacagtgatacgactgaaactcagc

SEQ ID NO: 62168 - DNA, 5110 bp, Oryza sativa
tgcgtatgcccaagcacgcaagtggttaatgtcatgtggtatagtgcatctctttagtaaagtatcaggcgttgacatgaacacctgacggagcaagtagctagtctccttattctgtaaaaacgactcgactgacgagccgtggacttcatcttcatgtgcaagctgtgcattttatgtaatttgtggccgggcacgttttgtcaagtgcatgcctagttagatcaacgctagtcaactggcactgggtatctaaaaaaatacacaactggatgatcataaattacacctgaagttcaaatggggtcgcagagaaaggccaaacttcattgtctcgcaaaacatctcttctatgttatgttcagttctaagcaattctcttttgaaggaaagttccaagttccaagtaggctcactacttaaaaaaaaacatttttagaattaggtgggcaggccgccctaacaaaacggccgcaaaaaatgtagccatttccacatgcaggtgtgctaaccaagcaattgtgcaaatgttttccacgggtgaccagcttaaccaaactgcttgcagccttatggggctatctgcgcaggcgaaccacttaaacgtccacatgtgaaaacatgtatatttctataggtgatcactttaggctagtgaaatgcagaaaattcagttttatgagtggtcggtgaacagacatatctcttttgtcatgttgcacagacagttgcccttatggacaacatgtatagtcaatttttttagactttttttatttttaaattttattaatagactattccaaaaggtatttctgaaaactgaaccttttggccacatcagccgagtggctggcgtgtccaaacaatattgtgtgtggcgtgacagagttatttggctagtctggcgtggccaaaagattcagatttgaaaatactttttcgaatggtctattaataaaattaaaaaaaataaataagtctaaaaaaaattgtacagtccgagggggcatcaacgaaagtttgattttttttttcttatataatgcttataaatgattgggccaattcaattttaacttaaagtgatttgaagaagtttggggacacgatcttaccgcggtgtcaataactagagtaatgaacacaacccaaattaaaagaaaaaaaaactcccggaccagtaggctgagtttaaggagaaggggataaagaagattgggaagatacataaaacgaggtgagctactagtgcatgattaattgagtattaattattttaaatttcaaagatatattaatacgattttttaaagcaactttcctataatttttttttttgcaaaaaacacaccatttaggagtttgggaagcgtgcgcgtggaaatcgaaacaaacaaactcactttcacctctcctagaatgcagcaaaagcacaacttcaaaacatcatgtagcagtagagtatatgttcaatttaatttggaattacaatgcaagttttccggtaaaccattttaagcactcgagtggacgcccacctattttttgcatatcaattcaatggttatgaaaaaattttcaaattttttttgataagatagattaaatatgaaatatatcacttcacaaacatacaagtttaaatttaaattctacaagttttttagaaaataacaaatttaattatgagtatatacgtatactagttagagtttagtttgtcatttttattacaacttgtagaaattaaacttgcatatttgttgagtggtatatcacatatgaaactatgttgtaaattattttaaaaaactttttaataactatttagtcaatatgtaagaaacaggtagacataaacaacaagaagattaaattaggccctgtttagattccaacttttctcttcgaacttttagcgttttttagatcaaaggcttcacacctggctttactgagataaagcgtaacaaggtaacttctaacttttccgtcacatcgaactttaatacacacaaacttacagcctttttatcacatcgtttcaatttcaaactttcaattttaacgtggaactaaacacaaccttaatctccaagttttccaaccatcaggaggctctggctacatcatcatagtcatagatggaaaccagaaacaagctggaaacttcttcggtcaaacaggcgctaagctatacagtatattgcttatatgcaattgacgtgacgctcctactgtttggtcaaacaattaaatagatacatagttgcatgatgcatacttctttgcttggcaaaccgtaacaagtgtgaccacgtaaaatacgtacacggtcattgctagctgttctcgtgtgctgatttttttttccctttagaaacgaagcctgtgttaatctcatcacttgaagcattgcactataaataggctgtgttgatagaactcttcctgcaaattctcaacgtgaacgtacgcagtacgctctagcctctagcataacacacacattgacacacatagcacaagctgacagcaatccactgaacgattagcaacgtagtacacatacatacacgacatgaaaccgtcgcttcttctccttgctctgctcgccacgttcgtcgttgccattgccaatgccgatgactacaccactgccgcgccagcgccaagcccagaggcagaggcaagcccgccgtctccaccgacggaggccagcccgccgccgcttgcgccgccaccgtcggttacaagctctccaccaccgccggcggccggccctctgatgcctccgccaccgccaccgccgtcggtcacaagctctccaccaccaccaccactaccaccaccaccaccaccaccggcggccagccctccgcctccgccaccatcaccgccaccgccgtcgccggttaagagctctccaccgccaccgccggcgtggtcgcccgtgacgaacgtgaacgactacacgatccagcaggtggggaagttcgcggtgcagagctactgcctcaacactggggcgaagctggtgtacgtgaacgtggtgagcgggcagacgcagccgtgcagcggcggcggtagcaactaccagctggtgatcaacgtcgccgccggcgtgaggacggcgcagtacagcgtgttcgtctggggcatcctcgggacaaccacctggaagctctggtcgttcacgcccaagaactgatcgatcgatcatggcagctaggcacacgttgagtgtggccgtacgtaaacgtgcgcgtcaaactcaacaatgtgttggctgggctacgtcgtacttagagagatatgatgactgggtgtttgtattttgccttggttgttcatttgctggagtctggagtctctgtacgttttttgttcagcgtggagttgttcgtgtttacccgtaccctgcaatgctgcaacgattgggtggcaattttgttcatcgtctcaacggcgattgatgctgttttttgcgcgttcgttaaaaaagaggcgttttttttactgacgatcgatcattcgatcgagcgtgactgcgtgactgcgtgaggccgcgagtcgtgagtcgattcgagtttttaggcctcgtttggcatgggctaaatccggcccagcccatacatctgtcgtacgggaggcctgggcacttggatgggccggacttgagggccatcaaacgaggccttgagacaaacccaagtttggcgtgggcggagatgcggatcggcgtgaccttgcgcagtttcgcgggtccgttggatcgatggaatagcgcgatgttcggtgtgtacgggtatgttagacagagatccaacttctaaacttagttcagtaagtagtttagtctggattagaattgtagagcaatctaaatctagctttacctctctaatttattttgtaagagctcgttacctaacgggccgttctcattttaggtaaagctgtgataaacaagccttatacatactccactagattcatgggatcggggtgtgtgtctcatcacacacacatggctccaatagcgcagcagtgttcctatacacgaccacattcacacacaaaagatctatatatctcaatcaacctcatgcaaaggaaaacatcttactactactattatgttttctagaacttagcagtaggtcccctccgttttagtttataagacgttttaactttggttaaagtcaaactgtttcaagtttaactgagcttatagataaatatattaatatttataatactaaattagtttcattaaatcaataattgaatatattttcatctacctccgttttaggttataagattttctagtattgccagtattcatatagatgttaatgaatctaggcacacatatatgtctagattcattaatatatatatatatatgtaggcaacgctagaaagtcttataatataaaacgaaggaagtaataaatttgtcttgggttgaaaatgttactacttttttctataaacttggttaaacttttttaccaaagtcaaaatatcttataacctgaaacggagggagtaatagagccagtggtgtatccagaaataaataacagtgggtctgagtaaacagtcccctcctcccatttatatatgctaaaaattttagtggagttttcgtggggctctcataatcttcacgctgataatgggggctcgagacccgccaccccatactggatccgtccctgagtagagctgcttggtaggctgaaaactgcggctacgactgccactaggacgcagccttgtgtgtgtggcactattggtgctggctgcagcgcatcagcagaacaatctgttgaacaaccccagtactatgttagatctgtctgacttgctgagttgggcatgtttaactcgctgctcggtcaccgcggttcggtacttggcaatggcaaattggcaatgtatatataagcatccaattaatgcgagtacgtcgggtggtgcatcaaattttatcttgggctccaacttgtgcgtttgagtcttcgccgtcggcccttacccgcgtgcggacaaatgccggaccggactgtgcgtgtcaacgggcgttaatcca

SEQ ID NO: 62169 - DNA, 1817 bp, Oryza sativa
ctctcaatgtcgaatgacagctagctagcttcgtgatcatataagttgatgcatttattctctctgtaatattgtaattcaggtcaaattaataactaatcaaaattcaaacaggtttttgaaggaaacgatgccagcacacgtagcacgtttcatgcaggaaaacattttcttctagagactgcaagaaaacagtttcttagaccgtgtgcatgcagaaaaatttcgggacttcggtacatgccaaaaaaattcatgcattattcgatttctggtcgttgatgaaccgggatcgatattggcatgtgtatattcagctatgctacatatagccgcttaatttcgtcaaaactcagtaaatttgtagaaaacataacaatattttcagaactaaacaaacgtattatttaaatatatttaatgctagatttaatcaaactaagttagatttttggatttttagatttgctaaattttttctaaatttgattaaacttaataatgtttgactagagaaaaagtgacagcgacttgcgatatgaaacgcatggagtagtattgttgtgttaatagttgaccgatactcaaattaattaagcagttaaatattaattatagttatgaacagagtgagtatatgtatattagtacgagcttccatgttgaagttctttctgtaaaagtgatgatcacgattttcttgtcgttctaagtcaaatagtgtcctaaatctgtcctaatcaaatatttttagatttgaccatcatttttttagaaatttgtgtagtttaaaatatgaattataaattataaaaatatttggtgaatctaaaaatataaatcttattatgttaaacagttgatatactatactacaactagggtacgatatagctaaaatacatctaacgtagttaactttttactgcgagagaaatcatcgtactatagcactaaaacttttactatgactactaggtaatgaaaaggtgcaggaatgaatgttcgggggtgatttttctggcattaaagattttactatgctacctcataataaaaaggtatgggaagagatatttcagcatgatatagggcttgttcggctggccgatacagccgctgcacgtagccgtagctgctgcagctgtagacacaacacattgtttgtgttggctgcacaacagtgaagttgagtaaagccgaatagagccataactcgtggtaacaattttactgtgtgaggagcgtgtcgacgtttgatgtcgcgattccggtatttacatagtatggggatcgttgggactagggtatatgcgagactgaggtaaaagagatggagacagagatttttatacaggttcgggcccctgaattgtcaggtaataaccctacatcctgttggctgaagccggtattgctcttattcaccataatcacaccagtacaatatttggggtagcctatctaactgttgttgacatggcggtctgaaggtctgactcgtagtcgacaacaaggtagtcttcctcctcgagttcgtgcccggcgagatcagagatagcgctttcgtctctcctgacagtatccggagacaccgtaggggactagccttacttatccctgaagtcgatatccagcgtcttgtcttggcatatgttggcttgtatgttgatcttgtgtcttgatctattgtttcgtgtcttctatggtggatgtgtcccctctcctcctaggggtcttgtatttatacccataggtgtccccttgtccaagtagaactagggaaaccaatatggatacaatccgagtagtacttg

SEQ ID NO: 62170 - DNA, 14183 bp, Oryza sativa
cttctttttgaatctattctcaggatttgttctcaattttgagtatgcagggcatgcttctcgaagatggcagaggagctgtgcgagctactaatgaactcccccggcgagggcttgacgccagatctctacatgggctgctttcagacgatgcttaacgctcctgtgcccgacgaccacaggtcatcctacctgcaagaggcggtctctgttttcaccgacatactttgcagggactgatgcatgattgcttgaagatccatggcattctatgatatctgcagaattgttggaagtttccctgatctatctattgggttttaacctattggttattctgatcatacacgggatctgggtgcacaagaagctcccggctgccaagtcgcaagtcagtaatacagtgaagagctccaaaagttcgtcccttgcccgagtgcagtgaggaaatgtagatcagctattgatggtgcagataactgccatgctcatcaaactcctgaagaatgtataagctgtgtgctaagctgtaccaatcaactttcagatgtgagctgtacccgtcatctttgttcgtttttgtactgtaatactgttacaacggaaagcagcaaatcgtgtacggtgtatgttgtgctgaagagctcgacgaagataaagcatccagctgggcccaattctcggcaatacatgcacgattccacccttccatggacgtgggagcaagctgcatatttctcttcttcagtcgaggtactttttcacagcttatgatgaggttatcccgaaaatactgtggtgtactttttcagagcttatgggattattccgaaaatactgaggttttacggagctgtaggcctgtaacaattgcaaggggatatttttttttctcatcacacggaaaatgcacaaagcaacaaccccacacttgcacactcgtaaattggactgtgtcagtgtggcaaagatttgagagcttaggtagaatatttcttctgtcgtgcacgcgatgtcgcgatgaaatgaaaaatcacaatgttggagtgagccaaaactgcttttgcagaaccatgtgaagctgtggtttgtctgaggagaaacatccagagtgcccaaaaccgtggacagctaacgtgggttccttgtattcttctgttttattttcccctgcttaatttttggttttctcatatatatgtaccttttattccgttatattgagcggcgttcctggttttgtaggacccctgatttcgttttctcatcgtgcttttcgtcccgtaatcattcacgcgcatgaatagcagggagacagcaacgtttcccactcgcaacatcgcaaaccatactgtatcttcactcaattattctgcaactgaaaccattattaaacgagaaaattttgattaaacatactaatgcgtctgattctgaacgcaacgatttgactccaaacttcgtccttgttgccggccggtggtgcagtagtgtgagccgcatcaagcgtaggcgactttcacgttagttgcatatacaaacgaccacttgtctcagagtttttgtagtcggctgcacatggaaatgatagcgctatacccttacacccagttgcctaagtaaaataaaaacttgggtgaaaactcgcaatcacaaatctcgtagtacaattgtacaaatcagcaggatgagggacgtacaattaacctgtctgcctcaccgaggcctgcaccactcaaacgcgcacgggaagcacaagcaggagcagagcacgatgtggtgtgtactggtgtgtgcctccatcaacggctcaacgctgggcaaagagagagaaaggaaagatatactactgctgccacgacatgtaacatgtgactgttcacggtcattttcatcccaaagactatgcgattgtgcgatggtaacgtgcgattgtgcgaacgattaaaaaaaaaaacttatctcaaccccatgaggccatggccctgtgttagcttttaattcagttggttattttttttcaaggggttaggggcttctcctaccactcgatatcaaaaactataaaaaaatattagtgtgtgtttatcggtagatgctggatatgtataatgtataccattttcattattaaaaaaaactctcttacaacttcgtgtccaatcacccaacaactcataactccgtagtgatcattgtgacaattttgaaagaaagaaaagaaaaaaaataaataggttattgaccaaattattatagtgaattatctacattatatatatatattaaatgtatcgataaatgtattaacttatgattgattaagttttaattattataaacttgaaaaatagattaatatgatattttagaataactttcgtataaaaagttttcgcacgaaacacaccatttagtagtttgaaaagtgtgccacgaaaatcttaatctccatctaactcttgttggagaaaagaacataacctacagcagcagtagtatttcactcgtcctaaaataaaataaatcttatgtctagtactacctccgttccatcccaatataagtacagtgtaggttccgtgtttagatagtccgtcttatttaaaaaaaaatattatttttttcttattacatgataaaacataaatgatactttatgtgagactattctttttaaatttttcataaattatttaaataagacgaatgatgaaacgttgagtgcggaaaaccacgacggcgcgtatattgggacaggatgtagtactactcaggcaccaacaggaggggaaaaaaaaaagaatccatttgctacagaacgtttcgcacgcaggaatgaaccatgaccgtggtgtcggtccaggaggccactgacccacccgccaacggaattgaaaagcgctagaacaaccaacgtgaacgtacggccgcacccagagccgcgtccgcaaaaacaggcaaagcgcacccagtaaacaaggaaaacccaacagcgacccatccactgatccattccaaagccacgagcccatcgacttatccgcacccatcacccagcctcctctccacgcaaacgcaacccaacccaaacccccctataaaatcccttctcccacacacagaatttcacaagccacccacagacacgtactacgacaccgagtttgagctttgagctttgaggagtgtgtctgagagtttggtcatggcggacatcgcgttgctggtgacggaggagttcgagaggaagctcaagaggggggcgccgggcgaggagggcgcggcggcggagtccaggaggaacttcggcgccgtcatcaaggtgtgcagctcgtgggtcgacgccgccgccgccgccgccgccgccggggtgacggtcaacgtcgcgctgctcaacgtcgaccccaagtccgggcccgccgtcgccgccatggacggcgccttctccgcctagtcgcttcacagttttttcttttttgttcttcttcttttttactcaaaaaaaaagataagttaattaggaggaggaactagtctattatgtatctctcctcctttgatacagctcggtcaccgtgttgatgtaaatatagccgcttaatttttgtcttttgatttgaaacaagctcatcattcatccattcgttttggtttctctgaatttgtcgatttgccatgtgttcgatcgaacccacaggaggactttgaccaaaatatccatattttttttcccgtcgcggtctcgcgcaagtggcaggatggaagagctgacaaaattctctttttttttcctttttgagaggaagggcgcacacattagtagtagtagaggctatcaagcaaacggcccagttacaagttcaatggacaagtggcccaaaccacaagcatcgtagcagtagaatcagcttgatttcctttccatttggttagattatgatgaagaaaacgaaaacaagaggaactccactctctgtggatatcaacgctttctccggttgtttgatcacatggccgatatctcggtgacaacctgggctttgtcggcctcgaactgctgatcctctgcaagaacagagcaagtgtcttagcaaaccggttttgatttatgatttatgattttatcatggaaagaagtgatcacaaaaggtacactttacctttttctattgtgaaatctgccaagaacctgaggattttgctcttgtttgtcaccagtatacccacgatctcaggtggcttcttcggattgcaagtgaacagctgaatgtacatgcaagaagatgttcagtattcgttttgcaaactgacgaatttttcgtgcgttaacacgaattgtaccttgaaaacgcgaaaagcctcaacttgaatggccctgctttgctcctggtaatgacaacacatcatatcatattaaaataaactcatattagctacgagattactgaacaaaggaaaattaaggaaccaagatgcgacagtactgttgtatttcaattttttttgaaagttgtatttcattttttaacaacaaaaagaacatagacggccttaaatatagattgagattaggacacaaaaatggtatatgagatatgagatcttacccttaaaaggttcattagtattatgaggttatcctttgagctaacatagcgcaccattgctgttgtgtttgacttatccagaagaatgtctcctagtagctgaaaaacatatcatgtgcatatcacaaatcatcaaaattcgagtcaatcatcatgtaaaatttaggtgaaatatacagctaacgcaagaaaaaatgtgtacctgagtggcttgccttcgaatgatatagttggatgatgacagcaattttgagttaaattccggaaaaaactgtcacatgaattgcaattatatgtcaatggaggtttgtcaaaggtcaaaaatagaagttgatgaatactaacatctccgttactagcaatgagaaatcttacccaatcgtaattatttgaaaagaactcagcagcacttgatctatgccttgtgaggagttcctgttaaaagttaaattgagcacaattgccattatcaacaccaaaagacatttgttcagacaacacactatgatgattgctcatattctgttaaaatcgtttacgagtcccaacaaaggcagaagggagcataaacaaacatgatctagaaaaggatgagtctctcctttggaataatcgtcattcatcaaggagaagattaaaagtacaagatggacgacataatcaccttaaaggtcttgaaggcatcagatgctatgttgaagtctggatattgtatataatcaaaaaatttcttcatatgctgagactctaatacatacctgcaaaattatgaagtttattaattgaagatcatgagaaagtgagtggtaactggtaaccatataaataattcgccaagcaaacaatgatatattggataaagaaagaagaaacatgatattaacggtgatgctttgtcctgtgaaatttacttgctatattatatatattttttaataaaatgtatatatttttttcataattaattaaaaatagtaatgtaaatcatggtcttgttaccttgcagcgacttggtgccgtatgcagtcccttagaattgcactataatgtattgcaatgtccatgttgtcatacctgtacacaggttgtgtaaatgtaaagaatgaagatcatataactgttttatgggttgaatgtgaagaatgaagtccataacatttatgtcctagggaaaaaaacatatcatagaaatgcatggttaaggaagaactaactgactacttacccagacattagaacatccaaaagatcctggttttcttccaaataatcagaggcaaccatcctataatctaccttttgcctagcaaattcgcagtaacttgagtgacatccttctgagtctgagtaaaaacgaaagaaaaaccctcttaaattataagaagttttaaattatatgtgttggtgcagataagcttcttgaggataaagtgggtcatggtcctatatgggtttcccttatctagagaatttcttaaacaataacttagattaaacaaaatgcagcatctaaattcttgaaaaatatcaaatatatatggatccctttgacatacttccaggtccatgtatggaaggcaaacaactagtagatgaagactattggtattctccttgaagaactccttcgtcaactgcgagcaagcttcatcgactgggtctgcctcgccatttccataaaggatggatttcatctccccgatgcttttggctagatctaccatctacatgttagttcaagtgcgtatttagtcacaaatgcataagatccccctatatatgatgatatgaatgattaaacgtataaattgtagtgtctaaccttaacacaattttggacaaacacaacttccccctacatatgtttattgttttgttgttatactaagttcctgctcattttgatgaaagcagagcgactaatataatcatgcctagttattctagtcaaatcttctgtttaattggcaacaggctcagctgttaattgattctacaataataaggtggtgttttaatccaaggacttaactttagtccctatatttagacactaatttagagtattaaatatagattacttataaaactaattacataaatgaaagctaattcacgagacaagatttttaagcctaattaatctataattagagaatatttactgtagcatcacataggctaatcatggattaattaggctcaatagattcgtctcgcgaattagtaagattatggatatgttttattaatagtctacgtttaatatttataattagtgtccaaacatcctatgtgatagggactaaaaagttttagtcccatctaaataggtctaatacaatctctggtttgaaattaatgtggctttcgaatatgcgcagacaaaattaaacactttaatcaataatatgttaaaaagggggttcaaaataatatgttaaagtagtttctcttttttcctacctgcagtttttttttctccttcccctggcataggcctatctggttgattgtgctgtgtaacaaaaactcttctaccttctaatatattgacgtgtaattttttttatacgttcgcgaaaaaaaagttgaaaaacatcgatgtatcgtgtgaaagcgacattggtaaattgtcatataaaaaacttccatatcgttaaaattggaaaacgttttcacgtttgtgttttctatttttttagaagtgtatttttttacctggcctctacatccaactggatatatgcaacctttaaacttttgcgttttcagatcaggctttaatttaggacatatctcgtcatctctcggttgaaacggaacggaacgagcgaacgatacatgaaaaatgtgtatcacccaccttgtgttcgcgtttgacgtcgcgcttgtcaccgcacgcgtcgtggttctcggcgaggaaggcgaggagctcccgcgcgtgccgcaccacctccacggggcccctcgccttcgaccggaacaggctccccgccccgtccgccgccgcgccgccgccggtcacgcacggccacaggcaccccgccattaattcacgcgaacgcggtcgagctcgctcgcccagcagccggtgctaggcgccgtacgtcggcagtgacgacgacgacgacccagattatcacctcctgcggcgctacaatggtgatcggtatggtggccggccttcttcctcgcacgtacgccgccgccgatgcgccggcgccggcggccgcgtgctcggccgttcgtgtgtgcgtgcgctgggtggcgagatcgcggggagatgaggaatttgccgaattggatggggagcgacgggcgcggagcgggcagcgagctcacgttgcgcgcctcctaaagttttaccgattcggcgctatttttggatccaaaccggccgcgattctgattcgatggatcaaaaccggggtcacgcgagattttcgtgtggctgggccggatcagtatgagttgggctcgtccacgttgtcgtgtccttctcggttctcctctcgcccgccggcccaattatgttcttccgctgtgctatctagtacgagttgagagaagaaaaaccgtacatatcttcttcgaattgggcaaagaaagagaacaccaatattcacgatgtgtacacatttgcgtaatgatcgaccttattatagttcaacgaaaatgagatttcctaccctctttcgtacttaatatagcaatgcagtattgaatatgatatatattaagtactacaaagttaggctcccatcggatggcctattcagccaaagaaaaagccaaaatttgaattttcaaacttaattttgatattgattttgagatattttcaacgtagtttttttttcagcattgacttttaagtcaccgagaacacatatataaaaattttactaacaaattcatttttattctctaataagccgttttggcttattacgaaaaaagccaaacgatgaggccctcaccgtattatagaatgaagggagtagctgatataagaaacaaatgacattttattctaccagagcgaaattgagaagggattgagacacacatcatcactacgatcgcttgggagtgaaggagcggaaccaccagtgggtcgtcgtcccggggatgccccacacgtcggcgtcgtacagcgtcgtcttccagttcgggccgccatacacggtgaccaccagccggtagttgtagccgccgttgtacggctgcgtctggccgctcaccacgttcacgtaccgcagaaaatacagacgtgtgatctgcctatagatccacagggcgaactgccccgcctgctggatgctcttgtcgttcacgttcgccaccgccgtccaccccgcggccgccgctggcggcgccggcggcagcgagcttgctagcgcgacgtcggcgttgttggtgatggcaaccaaggtgacagaaatgacgacagctataatgctaagacgggacgactgcctcatgtcgcgagtacgtatatacctagagcgggtagtgctaattgtgagggtacgagatgattaggacgtgttggagttgagagctagtttgtgtggtgacctagtatttatagtggtgtacgatcgtgccttgtctcagacgtacagctagaacatacacggttattaattagtagcgttgacaaattttagctttaattaattagacaacaatcatactttaatttgttcgcctgtactaaatgtaaatgcaaatgcaaatccttttaatactatctccgtcccaaaaaaaattgcatttctagctccaaagctttgtccaaaaaaattgtatttgtagccatgtgtggcccagcaaattgattgatctagataagattcctaatacgagcagcaaatttttggtgccaaatccatttggctctaaagcatgtaatttgggctgctaatgcatgtaattaagtatgctaattatatgggttaattctctcaaacttccttttaatcatttgtatatatgaaatgtgtgcatgcagtgggttcattaaataaggccattatggtcatttttcaatcctactgttttatactaaattagctggaaatgtaatttttatgggacggagggagtattaaattggtgtttggtggttttgttgaaggtttcaaacaactgatcgagcgtaccgcgcgcgaatacggtcaatatgtcagttaggatcactgcgagcactttggttcgaacatgcctaacgatttccagagcgcagacgactttattaggtataatttgatttaatttcttaagacgcgattctgcatttatgctccagttatagcccggtggtgcttaacttatctccttagtcgggatctaatcacatgctaattgattaagccctaactagaaagaaacccgcaggaaatttacaagtccatgtgtgcatgtgtacaacatctacaactaaccgacatctacagctagctattgaagttcatggccttgtgatcgaggcccgtttgttccacatttccacttccaaagtccacagcgggcctgagggcaggcccaagctggaccccagctggacatacagatcaaatctagacacggctagttatctacgaggaagcagcttgacaagccacggcagaagaggatggattcagtggtaataatcttatcttggaaaattttggaagaacagaatgggcatatttttcaggcagtggcactttgttcccgcggcgtccctgtgctagctgcgtctgtaacactttgctctcttatctaataaaatcgattggtgaccagcttcaccgaaaaaaagaagggggaaattaaaggacaaaacacaataacataacgttaacgaatttttgtttcagtacttcaaacgttcatatgcgtgatgtgctcaatgcaaacgagaatttaacaactagcactagaatatacatgaaattaacatgcacatacacagtgctctaagcctctcttaaaacaatagtctgatatgcaggggtttgcacgcacacattacacatacatgacacacatcgatcgcgatcactggattcagttggctgctagagtgaaggacaagagcttccagttggtggtgccgaggatgccccacatgagggcgtcgtagcgcgccgtggtggcgcccgggccggccacggtgaccacaggcggtagttgtagccgccgttgcacggctgcgtctggccgctcaccacgttcacgaaccgcaggtacgtcttgttcgtgctcagcccgtagatgcgcaccgccgactgccccacctgctggatgctcttgtcgttcacgttcgccaccgccgtccacgccgccggcggcggcgccgcggcggcggccgtgacgctgccgccatctgctttggcaacggcaagcaacgcagcggtgaatatgacagaaaggactacggtgctaagggatgacggcctcatgtcgtgcctttgtatgtgtatgcagcttatgcttaattatggctgcctactaatgctctattgcacttgtgacagtgagattgtgagcttaattgtgcagtactgcagtggcatatttatagtggagtgactgaacaaactactccagctaattaacgtagcagcggtatggccagcaagatgcaattgcagagaaaacaagaggttaagattgactttattagacccagtacatacgagttcatattgttaattagcgcactcgtagctgactgctcatttcgttgttaattataatacacgtactacgtacatatgcaaaacgttcaaatcaagtttcaaacaattaccgcgtacggtcaatactgtcagttaaaaacttgcatttacacggcccaacatcgtgcctaacatgtatacatttaattactaggactaagctaaggtacgccggtgatttatatttattttcgagcagaaaggtgacgagctgatctcccgagttcagacttcagttcaagccatacttgggccgtgtttagtttccttcaaactttcaaaaaatcccttcacctcaaatatttggagtattaaatatagacgaaaaattcaattggacagcttgcatgtaaattacgagacgaatcttttgagcctaattacgctaggatttgacaatgtggtgctacagtaaatatttactaacgatgtattaattagacttaataaattcgtctcgcagtttataggtagaatctgtaatttgttttattattagtctatttttaatattttaaatgtgtgtctgtatacgttaaaattttttttaggaactaaacactgaattttttcccccacccctaaaccgaaaaccccccaagacagtagccagtgcatttcaactagtcagacaggattaagctagttaatcctagttactcctccgtttcaaataattggtatttctcacttcctcctaagtttaaaacattacatttatatatttgaccattaattactataaattcatatggtttaacatggatgcactaaaatgcacttaacatgctcagtaacttgaacacgctctgtcagaattatggatactacatatctcataatagttgactaaatctcggtaggacccaccacataccatgtcctatatggaagcaaccttcagatatggagagagttccggataaggaaagacgactagagttctacatggaaacgacaagtactactcggattgtatccatattggtttacctagttctacttgacaaggggacacctttgggtataaataaaagaccccctaggagaagaggggacacatccaccatagaagacacggaacaatagatcaagacacaagatcaacatataagccaacatacgccaagacaagacgccggatatcgacttcagggataagcacggctagtctcctacggtgtctccggttactgtcaggagagacgaaagcgctatctctgatctcgctgggcatgaactcgaggaggaagactaccttgttgtcgactacgagtcagacctttagaccgccatgtcgacaacagttagataggctaccccaaatattgtactggtgtgattatggtgaataagagcaataccggcttcggccaataggatgtagggttattacctgacaattcaggggcccgaacctgtataaaaatccctgtctccatctcttttacctcagtctcgcatataccctagtcccaacgatccccatactatgcaaataccggaatcacgacatcaaacgtcgacagtggcgtgccaggtaggggcattttggtgcttcaggatttcgacgagatgggttcaagagggattctccaacaataagctactcgatgactttggctgtggggagatccaacctgtccaagtacatcttccgactagatcggaaccatcatcgtcatcgacaacttggtctatcgagatcatccaagcttcaagatacgcgacgtaccaaaggatgtcagatcatatgacgtcaaacgagtacgcaataaggtaattggtagattggtttttcaaattgatctactaatttcgtagatacatccggcatgtatctacaaaggtacgcaatattttatatgcaatttatcgtatctattcagatcatacagcattgtcagatcaataatttattatgtttacccagagcatgttttttatacaatatctgttgcgcaggtgtccccgatgttatatcgactacgatctaacgctgggagctcgctctgtcttcttctgtataaatcatgcttgtttacagtctacataatgtctgacattttctgctcgttatatcctgataatgctagaagatccatgcagttttttgagtacatactcgatattctctgctatatgtctcgtcttctagaaaatatttttcaggaacaattgagcactcgagtaggttgtggtcaagtacaccgcattatcgagaacggtctcgacaaatgtagagtcgtcgcgcccaacctaccaacgaaggccgacgacctatctcatagcaccggccatggctggactactactcgagaaaaggtcattaacggataattctcgcgaacgtcatcgacttgatcacccgacatgattgtgaacggacatccggatatgctataagttgggtgcgtgagtcatgctggccacatgagacgcacatgtaataaaccaactctagcacccccattggtgttcgagagataattctacacgttcgctggtcctcgaaccagtacgtagcaatctctcgcaccgcaacctccattggtgttcgagagataattctacacattcgctggtcctcgaaccagtacgtagcaatctctcacaccgcaacttccattggtgttcgagagatgattctacacgttcgctagtcctcgaaccagtacgtagcaatctctcgcaccgcaacctcagatggttgaggtacgactacatcaataacgcagcggtcctcacaccacgacttcaaatgatcgagagacacctactcattggttctcaaccagtcaattgtagcgatctctcgtacatttacttctagtgg

SEQ ID NO: 62171 - DNA, 765 bp, Oryza sativa
atttgtatgcaagtccacttcatgcttgccagacatgtcaattgcatccacactcaagactaaacaaaagagccaggggaaaaaggtcaaaccataatctccttgcaaaccaacgttgaaaagaaacctcatatcgaactgataaggatgcatttaatcaataactgaccttcacatggtagagagggaaatgacatatttatatgaattggcagagtttctcctcgtttcagatctacagacatctgcagacagcatcaattagatagtgatggctcatgtcatgatttcttagtaagatactccctccatccacaaaagttatacctattacttttgtcactaagaccaaggagaaattaaatcatcttagatgttacaaaatcaaggagtaaatgcaagcatgcaaccaatgagtatttaaatgactctttgggttctaatcaaacatttaatttatctcttgattcaagtcttgaatgcatataaagactacaaataggaacaacttacttggaaaaactcaaatgtgaaatatgtctaacttttgtggatggagggagtatatgagaggcccatgaaattggcattggtaaggaccgaagcaaggaatgaaaaatcatcatatccaaatagcaatcagtagatatttaaaacaattagaataatgtaattcaatgaaaatcatggttaagttctccaagatacccttctgtcatcatacagattctctggtcaattttgttaaatagaccaaaacaggat

SEQ ID NO: 62172 - DNA, 2182 bp, Oryza sativa
  unsure (1)..(2182): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatgcgaatcagctcagtgattgacctgctgtgctgttctggatgctgtttttttaacaggtgaatgagaaattaagaattcgttgttagcacataatgcagtttgaaacaactgaaattctatttgcatatgtccttcctccgtcccataatatttccttcgtcccagaatataagggatcctccgtcccaaaatatgacagagggaagatatcaaatatcatagagaatttgagatggctggtaggtattagccaaccgatgcaaaatttccagcagtttgctgcttcatgtgaaatgattcactacagatctcgttgtgatttccaaatcaatgtatctttcagtcaattatagtcggaccatatgcaatcagttttacacaccaaaccaactgaaactgaacatgtgggaaaacacacatagtgatcagatatcagtacatcagatattgttaacattgtagtgatcaacacggatttgtcaacattgtagtgctcacaatatcagaacacaatttagcacaatagatcatgcaagctcaagcatgaaattttaatgatcgtgcaaagtcaattttaatgattcgttgtagtaacttttgccggtagaaagggattatgcttgcataacaccgagaaaaattatattgatcttcatttctggtaattagaccatgatgccaagaacaccagaaacaagatcttcagttggcatcctcagagatgaaaatttttcataatctaatcatttccaagacttcatacaaatttaaatgagggacaaaaagcatcttgaaaactccagatacttgagagctgtccctagtgtgacttgacatattccgatgttaaagcattctgattccttcaccatagtcctggttagaggaaagcaaaacgaaaatgttagattttatataatcggaatgagattctcctttgtacaataacggaatcgatactttaccttcacgacgacacatgagcagccgaccacctctctagccttacacatgaatcaattttgcaaagctgcatcaaatatagcaagtggaaatttttgagaatcaagatattgcacctttacaataagatgtacacattactacactgatatgcacgctggattaactgacacaacagagaactttgctaatgtagatgtaaccaaattctcactcatgctgatatttaggacctaaaatattgggaataagaagagaagcaggtactaaacccagcccattcgccaagagttcttgtactaggaacagtgaccaagtggctttagcaagcctattaactggttggtcttgttttctccttaaaatggaacgtcttcttttttactacctccatcctaaaaaaatcgtatttctagctccaaggttttgtcccacaaaaattgtatttgtagccatgtggagcctgaacagcgctgatgaagactagaggcggggaggggggtgaataggctgttcctgaaaacttaaaaacaaatcgcggcggtaaaattcaaacagacccggaacttcctggtaaggaactccggaacttccggtgttctaagacagaaacttccgggtaacagaacagagatgaaatttaaatttcgaaacaagagactaagccaatcttcacaagatggtgcacaggtattctaagcagaggatatatcacagaatcatccacagaaacatcacaagagcgattttttcccgaagttcggatcttgtgatcctactctccgttgaggagctccaagagctgggtctcgattaactccttgcctcacttgtgcaaaaaccccagaggaaatccacagccttcaaccccaaacacccctaggcaaatttctagaattgagtgaccaccaagatccaactcaacctacttctagaaatccaccacaagtgtgggttgctctacttggaaagcctctagaatctcagcacaagaacttcactaacttacctcgttcccttttggaggagaggaaatccttcacaaacttacccgggacatccacaatatgcaacggattctcgtgggtgacacctaaccgtctaggagatcatctccaagagt

SEQ ID NO: 62173 - DNA, 5213 bp, Oryza sativa
tgttgaattgaaatatgcctatcaaaaataaaatttccagatttgaaaatatgactatcaaaagtagatggagagagtattaagctatctactaggctgtttgaaggtactcttttttctctctcgctcttccctctacataaaagttcgcaaaccccctaacatcatgccattattgatgccctaagccaaacacttagtaataatattttacaatccttactacaaaatactccatattattttgtctaaaatgtaccctctaaacaacaaaacttccctttacgtaaaagttcttacttgtgtcacctactcgtataccctaacatcatgccattgttgacaccctaagccaaacacttagtgtaacaatatttttacaatccttactacaaaatactccatattattttgtctaaaacgtacctctaaaaacaacaaaactactttagtggagggtgtagttagtaaaaaagccggctttgtctcctcgtatatacactctctcggccttgctcggttcctcctgtcctgtctcccctctccactccaccgccgccgccgcctccgcgaaatggcgaatctgccgccgtcgctctccatcggcgccgcctccttcgccgcgccctcgcccccgccgccctcgcctggcgcctcctcgtcgtcgtcggcggcggcggcggcggctccgggggccgccaaggaccggaagatggcgtccgcggagcagctcgtgctcgacctctgcgaccccgagctgcgggagaacgccctcctcgacctctccaaggtctccccttgtcgcgagaagctatgcgttttctctcctcttcctcaattttcattttttttatcctcctctctctcgatcgatcgctgtgggctccggcgagggggattttatggttggattcggggggggggggggggggaatctgtacgtgccatgtggtgcctacgaaagttgcagcctttgtgatgtaatgctctgtctaggcaaaagtaggttgggacttgatcatctgatgctagtagtctgttctgaacgcagatcggctcacatgctactcatccaggggtaaatagcttgctccatctactgtttgatcagtgtttggtatgggaaaaaccagtcctttttttttgtacggagggttcttctctgggagttcgtggtatgcagatgtggtagcttattagtttcattacattctgccttccccatatccggcaatgacgagaatctagagattttgtgcaatccttcaattaattttagttaggtgaatcatataagctttatttgtgagtgggaatttgcgttttgttttgatgtctatgctgtgatgatgcatattcagaatatttgttctgtttatctgctatacatgttcatatctcctggttgcaaaagagttaattatctccagagggcatcctcagcttgcgatttctgtttctgtgtctgtgttaggtcacttgggatttctgtttctgtgtctgtgtctgtgttaggtcacttagtttgttctacttagggttgttcttattaaaatggatagtgctgtggttgtattctacgttctgttaggattggacagcagaaggcacagcccatgatttattaagagtaccaattaatctaagaactagaagatatacatatatatatatatatatatatatatatatatatatatatatatatatatatatatatatatatatatatatatatatatatattaagtcagaatcaccatgctctgtactttttttcatttaatcttgataagttacatattcactagatattttctttgtcgctatagcatgagtgtaaagagcaaaccaatcgtaaccactaacataaacaactactttttgcttaacagaacattaatagtagcccaaattggattttaatatgtgaaattgcttattttgctttttaatgtttgaagtcataggcaacaaatatagaatacatcattcttttttaaaattttaatttgacaactgtaacaatgaaaaattgaatacctatgaatccagagttgctaagcagttaaaaatatatgacttgttgaaatttttctccatcaagtcaacttcccgccaaattgtgttcttggtggcgtgggaccttgggagttccaatagcttgggtttgcattcaaatcctgggccagcctccagatgcatggtgttagcagatctcctttgaagcccaagccccacttgcagtgttccctagtcctctttagttcatgggtttgccttccataaaaacgaaaagggtcggcctgcaggtatagtggattggacaaattgatccaggtgcccactgtttccgacatgatccacgtagatgtaaaggggccgtggcccaagtaaaatggtgaggtccaggctgcgcctggaaacccaggcccaaaactattttgccaaatcggacatcgtgtctgagtcggattccgacatggcaacacctgtctgattctgactagtaagtacctcacaagtgtgaacacccaaatctgagtcagaccccgacaaacttatccttgtctaggactgtaggtacactttgctgaattgaatccatgcagcctatgagtacgaagatttgcttgggcataggagcggtgaatgaaatttgcaatctgctccaccctagacgagacaatgaaaacagtaactcacaactcatttttcgtttatgaatttaggcgtaactttccttattttgatgctttcatagtactcctaaatgtactgtttggcatcctgtggttacacaccctgaatggtctgatacaagagttaaatgtgtgattgtgcttttgtgtgcaagtgtattggggactgtttctatctatggagtggaatcttaccaattcagtgctttatggcatatagcttcttgaagattctcctatttggtagttgattagtttttccgttttgctgttcagcaaagaaattcataaatcattgttggtttctcgtcacgcctgaccattttgggaatagagattttgttgcctaacgattttcatggacttctttttccagaagcgagagatttttcaggatcttgctccactcctgtggcactcttatggaacaattgctgcactactccaggtaggttacaattcttcatgttgtttaagtcagtgtggttgagtacgaatggtagttcttccgaaaagaaattcatttgagtctttcatggttttctcattcagtttatttgtggtttggataatgcaggagattgtgtcaatctatccatcactttcacccccaacattatctccaggggcttcaaaccgtgtctgcaatgcacttgcacttcttcaggtacacctttacatgagaaagaaagaaaccttacgacagtgagaaatctctacttatgacactggtgcctcatgatgggatgagagaaggctattttttcagcatgttgcaatgcataaaagggggattgataaaatgctactacctctatccccaaatataagggactttgcctatgtaattacataggcaaaatccttatatttgaggatggaggtagtatcagcttaggatccctaaactgatttaatacaacatgttgctttctaaacttcattgtatttttattgcagtgtgttgcctcacacagtgacacaaggattcctttcttgaatggtaataagtgctgccatttttattccaagtattaaatatttccatgatgatactcattgttcaagaatatttcccctcttgcccaatatactatgttcacactattattgtatttattaaaaaaaaccatgtaacagataatgctgattgcatctatttagtttcagctgtgagcaatatgacctacttatggactatggcagtcccaatgctgaaaatttcagataatactaatcacatctagttagttttgcgcataggaatgttcatctgtatgtggctttatgcttccagttggctattgtgagtgacctgtttcctctcttgatttttcccttcttcttttcagctcacatcccactgtatctgtaccctttcttgaatactactagcaagacaaggccttttgagtacttgaggcttaccagcttgggtgtcattggcgcacttgtgaaggtaattgcaagccagaactttatgaaaattatgagggatatgggtgtgtttcttgagtggaagcgtagatttttaaagctagaccattttctgatctactaagatccctattcagctgttcaggtgattgacatgtggttcaatttaaccttacctatgctggtggggtgggcacttcagcttctacatgttcctcttttgactcccttctacatgactttttgggaaatattttggcctgaatttataagagtatcattgtgttcacgtatatctaatatgagtctataactttccttattccaacaacttcacaattgatacacttcgggtggcaagccctcttgtataagagaagctgtgagtttgaactacttatttggtatatctagtatattatattctttgcctgttattttccttctgggtttacttctggacaagctgcttgttcaattttttctctgttcttgaatggtggtttggtccagttctcaaaactatgttgagagggagggggtgaaagaaaaaagaaaagatggtgcaaatggtatggactatgggtagaactttccctttcttcatgacagttcttgtggacactggatacttatctagtcatgctgatcaaatggcctgatttgggtttggatccccaaatatccctatgtgaactgcaaagtttgagccaaacaactcgatgatgttttttttatgggcatactaccaggtttaagccctgtagttaattttataaaataagatggtaaaaccatcaacagttttacagagtttgagccaaacaattcgatgatttattaatgatcaagttgcttttaccagactttgattttgtcaatgagcatactcaataagttaattcggttttgttttgcaatatatgcaggttgatgattctgaagtcattgggtttctgctgcaaactgaaataattcctctgtgtctccgtactatggagatgggcagtgaactttcgaaaacggtgtgtagctacctgcctcctttctctcttgtagttcttccactgtttt

SEQ ID NO: 62174 - DNA, 12472 bp, Oryza sativa
catcatagttggctttgtagtttgcttcctttttgtttggtttgatcttataaggaagtcgtagtttcttttgacaattttctaagctgctatatgtgtgagttaaaagagggaaaacaaatatttgttcgggaataatgatgcacttgtacctggtagcaataggctgtagtactgtattagatggatttggtgcttcatttttgctaatccaatcaacgtatttttgcaggttgccacctttattgttcaaaagattctgcttgatgatgttgggcttcgctacatatgtgctactgctgaacgtttctttgccgtagccagtgttctatcacagatggttcaggcacttgctgatcaaccttctccaagactgctgaagcacataattcgctgctacctcaggctgtcagaaaattccaggttcattccatcatctgtacagattacaaaatgcagaaaactggtcaatgcgtaaattcaaaatagacctggggcctcctataattcgttttttcatctcatgcagggcatgtaccgcgctgaacagctgcctccccaacgcgctgaaagatggaaccctcaacaacttcctccaggtgtgtgtctcaactctcaactcacgacattgccagttaccatcgctttaccgcaaaatatttacattataatttacacagaaaagtttcaattgattcctgattccaccttcatcttacttgcgcaggatgatcatgtcacaaggcgttggctccagcagctgctgcacaacatgactatggccggcatgggaggagctcctcatggaggccttgatcacatcatggggatgtgatcatctgaaacgaagctggctgtttgcaactcatcatatgcctgaagtcaggactcaggactagtccatctgtagttagcctaccaaaaggattatacttttagttttacctttaaaaagaaatggcgtgtgccattgaaggataagaaatgtgttggttgtagttaaaaggtactgcttgctatcctgtgatgctgtaaaaatgcaacagaattgcgcagctctctgcacaagtagttctcagcttttggtgaacagtccgaaatggagaaacaaaggtaaaaacatcagacttacatggttctcttctgtggtgttgcatgacccgattacatttgatgagcatagtaggccataaatttgctaccttttgttcttgcttttttttaattttttttgggtaaatttgcaatgtgatcagtcacatgatggctcattggtgcaagggcaaacatctagccctttgatcacaaagttttttttccccctctatccttaaaaaagttttttttttcgccaagatttgacacattttggcagtaaaatgtccaacagatacacaccggcttgtgcactacatgcacacgctgccaactcatgtactgttccaaaaaactaaaaagctaataatatacaagttgtatgtgcatctggctagctccatgggatacatgcatctcttcaggccaaaggtgacccttgatgccaccacaaagccatttttatcagcagccatctggagcactcaagctgcagccaccatttctgctagtcaagcagccaggcaacccaaccctctgctgctacctccacctaacccaaaccccctaatctaatcaacatcaaaaacgaaaaaaacaaaatctttttttttaaattatcaaaccccaaacccaaactctaaaacgaaattactaagcagctaaagcttaaatcaaccccaagagcggccgggttaatcacgcaattaagcagctaatagcttaagtcgccccttccagcacctcaagagctcacctcactcctcccccttctctgattctgtctataaaccccgcctcctcccctcccatctcatctcaactcatctcatctcccttctccagatcaaaagacccttgctttccctcaggatcggccatggcgaccgccgttgcgtcccaggtacgcgccgtcctcgcggttttttggatcccctggttgtcgcgctgcgcgcgatggtgctgagttcatgggggttcttgtggctgtttctgacacaggttgctgtctctgctccggctggctcggatcgcggcttgaggagttctgggatccaggtgcgtggtttggtgcccctgatggtagaacttgcttccttttgggtggaatcctgtgaggattccgcgggcttggattggtcaatgtgtagtaggtggatacaaatctatgggatatatctcagattggttcagtattgagcgctattgagagctaggcaacgccagatattgctgctgcttgttaattcgatgtgcagatcaattatcagggttcagggttttggtttagtaggctgtttatcctgaattcacagcgttcttgaatggtggtgctaaactatgtgctggatttcattctgtgtgattcctcagggtagcaacaatattagctttagcaacaaatcatgggttggcaccacattggcgtgggagagcaaggccacgcgaccgaggcatgcgaacaaggtgctctgcatgtcagttcagcaagcgagcgaaagcaaggttgctgtcaagcctcttgatttggagagtgctaacgagccgccgctcaacacatacaaaccaaaggagccttacaccgccacaattgtctcggttgagaggatcgtaggccccaaggctccaggagagacatgccacattgttattgatcatggtggcaatgtgccttactgggaggggcaaagctatggcattattcctccagtaagtaattcctgctttcaatcattttccttgtttaaaatagaacattatgcttatgctttgtcggtttcgttcatagtctatttatctgattggatattgaacgattgtctcgttgacactattaattaagaacttacaaagatatagtcggtagtatattaggattatttctgtagacactgtttccaatgttctattcaatggcttaaaattgtaaacctaggtgagaaaacctgctcttgataggagacttgagtatgtgcacacactattaatacagttccagtggtatctccatgggcatcaccctcttcactgttctctaaaccctgtgcatttttgcttgttagggggagaacccgaagaagcctggtgcaccacataatgtccgtctttattcaattgcatctacaaggtatggagattcattcgatggaaggaccactagtttatgtgtgcgccgtgccgtttattatgatcctgaaactggcaaggaggacccctcaaaaaatggtgtctgcagtaacttcctatgtaattcaaaaccaggggacaaggttaaagtgacaggttagttgatttctttcagcttcagatgaatgcaaaggctttgtgagtttcctatgaggttgtttaacttctaattccaagcggagcaaaattagttgttttagttgcgtttttcctgaaacccacctttggtagacaacctatttctgagttcatacataccaacaacaaataaacggttctctgcaacaaaggttccaatagcctctcctctaatatgattatgccccttctacaatatgattatcttatcttgctcttttcctttcttactaaagtttgcaatcgcatcttagtttacccttttctttgttagtcatcatgtcctttgtggcacatgatggatgccaagtatctcacagtgatttccttctgaacaccaggtccgtcaggcaaaataatgctcctgcctgaggaagatccaaatgcaactcacatcatgatagctactggcactggtgttgctccattccgtggctacctacgccgtatgttcatggaagatgtcccaaagtacagatttggtggcttggcctggctcttccttggtgtggctaacactgacagccttctctatgatgaagagttcacaagctaccttaagcagtatccagacaatttcaggttgctagacatcatctgtcttgactcttcgtattaattattagtactacatgcatacttggctgaaacagcgccacataatgaacatagatgcctctgtcaactgatgccatcatagaattattgagctttgactttgagagtaccacataaatgagctgtttttgttaagtatattcgtgcatattgctataattgaattgtgttgaatttgtaggtatgacaaagcgctaagcagggagcagaaaaacaagaacgctggcaagatgtatgtccaggacaagatcgaggagtacagcgacgagatcttcaagctcttggatggcggcgcgcacatctacttctgtggtttgaaggggatgatgcctgggattcaagacaccctcaagaaagtggcggagcagagaggggagagctgggagcagaagctatcccagctcaagaagaacaagcaatggcacgttgaggtctactaggatctaagtgtccaaggattatgattgttgcgcagtgaaaaagagaaaacaaaacgcatgatctgatgattcttgtagggtggtgtaaaatcatcattttttttctgaatatgaatcataaaatcacccatgtaattcataagcttctgcatcacatgatgaacgaaaggaagcatgtaacttttgcctgtcactattgcagctggtacctttgctatctaccatactgtaaggtgttttgtctgaagctgattttcaggtacctgtcaatctgtcattgtctatgcatataaaagtgatgggatatcgttgattcaaatcattaaaatataatccgccgaaaaaatcactaaaacgtgctcttggaggctggagtagccatcttgtggcttgtgagctgtttatgtttatcatttcaagtgttctatagcaaatttcgtcctcaaagcacaacctttttattgtcaaacttgaatttcagctgtctatccagatttttgcagtattagatggtgtctaatcaagtgctagcttgctatattttagaatgaaggaaatggcactcttatctgatctcactaaatcttcagagaaaaatgtctgagagtcatgaaatacctgcatttgttgctgagctatgctttggcccattcagagtttccgaccattggtgatcaaaattcaccagcagcagccagccacgttgtgtttggtgaatgacgttattcagatcaagctgaagcaaatctaaatcctcctgatacaaaatatacaaactctgaactacccttgcgattttatgacacccacatgctttgtcttgtatctagtagattacatgagctgtttttctgtttaatcacctaacgccaccacaaacgttaacgtgcctcagcacaatcccaacaagatctgaaatctgacgctatacagcactaaggtctcttttcaagtgaatggaatttacagagatttcacggaaattgatccaaaacctgttaaattcttgcattccaaaggagccgtaaaaaaactaaaagaacagtgttacgcaaaactagaaagcatggtaaataattcttttagtcatttatatatatatttatatcataaatgactatcatagtactcctataaaaagtaaatctaaaactagatgtgacacattttaatactataaatttagacaaatgtacgtccagatttgtttataatacgtcacattcattactatgttagttttttagggagggatggaataccatgtaagatttttcatcacaaattatgtacaagagccaaactgaatttccgtaccctctctcttttctccgtgagaatttggaagttgaaaacgctaatttaatggtcatgttctgatgctctcgcagtggcctacgtattgtcagtcattgtcagtttgccaccattcctctttggcctttggcacaggtggggcccacaacctgcggggggccccaccaccccgccgacgtcaacccgattaatccaaccgcggccacgtcagcaggccgtgaccatccacccgcgtcgcgtctccatttgctttcgcctagtactaatcactctcgaaatcgcaattactaccaccgtaataatctcgccgtcaccctccgcggcggcgtgcgctgctccgcttcactcccttccatccatccccggtcgccgtcgtctccgcccaggccagcactgacttgtccgttttatccgcctccgcttctcttccactgaccccttcttggcctttttgggtgtctctcatccatgagagtgattagttggaggttaccagctgtaagtacaccaacaagccctaataatagcgaggctcgtcagttgggaggagggagtggcgggaaggaggaggggaagttgctgggccagcgttgtggcggcggcggccggagtcgtcggacgccatggaggccgtccagccgccggtaagcgatccggcccgattccgtctctctcttctcctctcctgtgagtgctgtgatgtgatcgcggctgatacgtgcgcctcgtgcttatttatttatttttaatttttgttgttgttcttatgcttgatcatgaggatgggaactgggttcgtcggcttgcctttttatgggttgggttttttttttcggggttaaattctctgcagtgacttcgtagttcgtactgttgtatcatcccgctatatcgagatttctttagaaatattccgggtttcgcctgtgtgctttctgacgtgttcgatgatcagttatttgctagctcttcacaattcagtactcatgtgagatcgcagtatatttatattcatttaattcaatttcaaaagaagttgacccgcatcattccgatgctcaaggtttcaattctgtcatcttttatctactttaatctcaagattgaattcggtatctgcttgcatgatcaaactgagtgtgaaaatgggtgcaggtgttgagtgacagattgaacccgttgatccaccacagatcagcttttccagccagtgttgtgcagcctcaagatcatggtgacagcgttccgggctggcagtggatcttttattgacaccaggggcaggcttagcagtggatcaatgacatctgaagattcaccggcactgacgccgagatggttgtccatcaagtccaactccagctctgacaactgctttgaaggatcgaaaagagcggtatcgtggtcagaccggcatgttttcaatccaaatgggcaggtcaactatgcagaattcatggatttgatggaacaggagcttgatacccaacttgataggctcaagggggatgtaactgggctggaaaactttgcgttgccggataatgggtatataattggtacacacctgggcatgtctcttgatgtgatgctgattgagattgatgagaggttcaatgccttgaagttactgctggccacagtgtttcggaaggctagggagatggacagctcgtcggtgtctgatctgcagtgggagcatgagttgcaattggaggtcatcaacattacaataggagaattcatcagtggcttgcaagaggagatggagaggaagctgtatgagcaaatttctatgacaaactccatgagtaaaaattggcaggatgccatagctcaatttgccagcatgcgcgatgatctgggtgctctttctaagctattgttgccctcactacaagaatcacatatttctcacagcaagcatgaaacttcaagcaacaggagcaataggtggaagtacaacatctttggaaagaaaaacaaggaggatcattcatctcgcgcggaggaaaataagagtttcaggaaacagaagtccatggttgtcttggaaaaatctgacttccgtcacctgaatggtatgagtaaagaggagatcataacttattttaagtccgaaatgagcaaattgaagaggatgcatgaattggatttgcaggagaagaccgaggagctcttcaaattcaaacgggagaagggattgcttactctcaagaatgatgtggaatttgagccgttaagaaagaaaattccacagattatttctagaatggaccaaatcatttcgaagaacataaagatgccttcactttgcatgactaatgatggactggatgaaagatgcatatcagcaaaaagaatcgattctttatattagaaaatcagcatcttagaggtttgcttgcagataatatgaaggatgtcaaggaattatcatctcagctatctgaagccagtaaagaaatgtctattcagttgtcatcagaagacgatctcctgagaaaattgccaaaattaaagaagaatatgaggatctccaaaatcgaagccggtgttagggatggagcgtatcaaactattacaagaaagttgcttgatgattctatgaacagcatgcatgatgctgcaacgaattttagtacagaactgtcttgctcttgaagctatgatatctgaaaaggagaaggctttgtgtttgtcaaatgaagaaaaccgaatgttaaaagaaaaaatagcagagttagagcaatgtttgatccaagataaacaggaagatccagaagtcatcaagcaagagagtacagagatcattttgcgtgatatagaggtggcgcctcacatatcaccaagaagatcacatgagactcccaagcaagatatgcaatatgatgaacttgtcaaacttaactcaagtttagaaattgcttcagctgcattgaaggaagttgaaaataaaaatatcgattataatggtattttcaccaaaaatgagcaagaaaagcaactggagtgcattttaatatctattatgaagttgtcaaaggaatttgtggagatcgagcaaaaattatcagtagaaagaagtgcaagcaggtttgtctatcttcctttccacttgttttttctgtaattgcatcgacttactacttgaaaaatataaatccaatttggcatatcaaatatcatctacagcatatcaaacacaaggttttgttagtatctttaatacatcatataggattgatttagaagtgtatatgttgtcgcttgttgcttgtgaaaactgcagcctggctcttaccaaaacctgacctgcaacttctgctgtccttttttttttaagaatatgctccattataactcgatgcgattattgttgctttcaggtcagaggatttgagtgatcattgcaaccacatggtcagacaagccgttgtactaacaaaaataggcctttggtacaaacaaatgctagaaacaaggcgttctgagctccagaaggctgaagccaaggtaattctttgtttttgcctgtccaatttccctttggaaattacaccaaatttaaagcacaaatcaagggtatattctaactcccctttgagaacttgaagatttgtggaaataccattaaaggggcttcctctagtgagtttcttcttgacaaactgatacataaatacagcccataggcttatttagtactggtaaggactaacgacaaacacctcatatcctatcatgatccaacaactcctaatctcaacttaagtcgcacctcagtttttccttttttgggcgtaaacctcagactgttcttcacacggaatacttcattgattaattaagctttgtttgactacaactgtgatatatcgctataaattcaaagagacaacgttgaaatatttccgatgtgattcaggttgtcattttgggcgacaaggttaattcacatttaaaccttcttcagaagatatatgtaactcttgatcgctactcccctacattacagcaatatcctggggtaagtgttttatatcctgatataaatgctgcttagagcattcgatctccagtactcctagtttgcaaagagtttgcatgcttggattgatgtatcctgcaatgaccagtttaatagtggcaacaactgagtaataatatgagtgctctgtatgcagttgctagatgctttcttgaagacatgcaagcttgttgcaggtttgagaagtaatcagaacaaagatgatacgacagcataaaaagggcaactaggtgagacaacaagaaatatgtttttaattagtagtttgagtttctcaactgtgaactgcagcctttgattaatagcatttctttaaaagaaatctttgcagcacctgtcatccttgcaatcatcatcgacttcaaattttcaatatgattttccgtataggtttatattcatattatagttatgtatgaattgtggtgaattttccagtgttgggtattgaatgatgaatacaaatagtgcaggcatgctcaagagtagactcatgaggacctactgccaggagggtacaactgacacactgatatcctggctcatccgctcatgtgcataaccaattagccatgtgaagctccagttgtagatcaagtggaggattctcagactgaattatcgatatcataggatgttgattgttgatgcgtatttcgaaccagctgaagtagcactcaccttctgatatgcagctatatatatacacgttcagaaaatagctccatgtagtgtttgtaggtcatgcagttatacgtacaagccagaaactcagaacgacattctgtagagaataattatcagccagtggcctggtaatgtacagattacactgttcaggtctttgggtagacgggataggcgcatctttgtttagccagatacacgttttgtaatcatccactatgtaactgttttcatctttcaaaactcatattgccaactaactgtatagctagattacctgtataacgagaaactttggtccatgtggatgttgcaagttttagttgcatgtcgtgcttgtgtatttttgtttgcccaacaaggtttataaactcaggagttcaaggttgtaacgtaacattctgaaatatcattaacctaattctataaaccggaattaaaaatatacttgactaacaatttgtctacgaaacaaacgttcagttggtccgtgatgcaagagtatcaaagttttatatgttgattttttttctgcttttttggaattatcaggctatactgggatttgtttctccatgatcacacgacgttggcactccgatttgtgggaatcattgattacaaaactgttatgagtccgtgccagtctaacatgagtgattaatgacaaagctaacaacataagtattttaagcaatcgagccatagagcatatcaaaacatgaaaacccactggggttgaccgtatctgagacgatatgctctgactgatttgtatgaccagtgacaacacacagggttgtcacagtttgcctccacttatcatgtgatgcgcaattaccgtagtacgcttctggtctttgattttgtgacagactcaataagccggtacatccatcggtcaagcattcctgtatcgtaggatgacagaattggtatcagttttagagtgaaattgttattattactccctttttttttaaaaaaaataacactctaaaatcatgcatatgagattaccaatgaactattgctactgacgccaatccctaacaccagcatgcttttaaaacacacattcttgtaggctgtggaggcatacctgtcattgcaaaggtaccgccaagaactgcacatagtcgggtgaggaaatgcaggaagttccttctttcttctttgattgtgactgtaattggtgagagatcatacaagaagtacacagctgcagaaggaaaacatattagtcctggaaacagatgaatataccacgcttgtagtgaagggagagttacctggccacgcggacctatcagtagcgcgtttaggaacaaaatactcggtgacagaaaactgatttgttggcaacacctgctttgagaggtatctgtactcggttggaacaatctgcatatcaattacaacagatgaggacacttcttctcaaacaaataatgtgatggatttccatctgatctgatggtgaaacagctccaaagaacgatttacataggtttgtagcaaaaggacaaaaaagttggaggagggatggagttcttttccacaaggatccatagatgattttgaattatgcatatatgtgaacttctattttcatgattgcatcctctttcgcaagccttgtccatgttggaacttgcaaattgctgtctggacatgaactactaaatgaatgactactcaaactcaccttgatatagtatttgaaggtcccacttgtatcatggagtatccttgtagtctcatccagtggattatgaattccaggatattttggaccaaaggatagatcatggatgatatgactgacgttcacatggcttgacccatcaaaaatctacatacaacagatgaaaatgaaaatttacatagagagtaataacaatacaaataaaagcataaaacacttatttataggtag

SEQ ID NO: 62175 - DNA, 762 bp, Oryza sativa
ccaatcccagcttgatctggtgtgcaccaaactggtgagtattgagttgtttactggctaacttattattattattatcattaggttgtgttattttccttctctcgtaatcactagcatctgtttaccattaaaacattatcctaattgtggacagttttaggaagtcttgtacaagatgcacaaagcacttgtccaatatggcattaccaggaagtaggagctggctggtttcaatagtttctgaagggatttttagttgaataattttaaacccttgtgaacatgatctgtcataaactgaaaacctagaagcttatacaataatcctggcaacttcatacaaaaagaaattaacatatttcacagcaaaaagcatacagatggaagcacagaagtaaaaaaaatatgcagttttagatgaataaccttctcagcaacaaaaatgttcaaaccatgaaccgagatatggaagttaccagcaaccctctgcacatctagaacaccataaacctgtgaaaattgaaagcaaaatgttttaacaagtacatggtatgcctgatgataatagccttaataataccattccataaattaaaggatactggtagagaaatatcttactcggcacccttcaccattttccattgcttgtttcacactcttaaccattttttctgcatcttcattaaaggtgtgctcttgcttcttttgttcatcttcatgctcatggtcatgatctgttaaaccactagcttatta

SEQ ID NO: 62176 - DNA, 709 bp, Oryza sativa
gacataaactacgtacataaattacaaaaataatgcttcctcatggttgacacgtgcatattgaacttcatcttcttcctcctcctcttctagaggtatttcttgacctatgccgtggacgtgctggttgtaatcatcctctctgcaatattgtccaatccaacaattctccttttcccttcacgaacaacatgtactttcttgttacacgggtcaactatgtagaacacttgaacaacttgtttggcgagaacgaacggttcatccttgtacgcgttgttagccaagttgacagtggtgaaaccttcattgtcaacttttatattgcgaagatcgacccatcgacaacgaaacaacgggactttgaacttcaagtaatctagctccaatatttgctcaactctaccatagtattgatcacgacgaccaccgtcactagcagcctcgatgcgtaacccactgttctgcactgtgcatttgctgtcttgcttgaccgtgtgaaaggtgtatccatttatgtcatatccttgccaggtggtggcactccattcaggaccctgtgacaaccactgaagtgtttcactaggcaagttctgcaacctggcaattcggttcttcagccactcgttgaaagaagacatgtgcttattcctgacccaactctctgatcggcctgggttctcttgtcggataactgcaaggtgttcgt

SEQ ID NO: 62177 - DNA, 967 bp, Oryza sativa
gcgccatcgggtctctggtcctccatgactggggcttcgggagggaggaggtggaggacatgggggagcacctagcgaagttgctccgcccgtttcaccctgaaatggatcttacttcggattccgactagatcatcttcgaaaaatcttacttcgagaatcaagcatgatccatctgttgcaatttatgtggattgtagtaatactaaatctttttttttcagagggttttcagatactgaaaattcatgctcatgtggctggctgttgtagatcaagaatgagagatctgaatctatggccctgtttagatccggagggctattaaatagccctctggaatcttactatttaagagtattaaacgtagattactgacaaaacccattccataacccctaggttattttgcgagacgaatctaacgaggtatattaatccatgatttgctacagtgatgctacagtaatcagccgctaattatagattaatatacatcattaaattcgtctcgtaaaatagcctaggggttatggaatcggttttgtcgataatctacgtttaataatcttaaatagcaagattctgaagggctatttaatagaccagaggttctaaacaaggcgtatggcatggtagaccttttttgtgttctactcatgtgcatttgagcacgggtgtaggctgtgtatgccacatgctgctgccgtgacattctgcggtgtttcaggccatgtacagatcaaccgggccctggcttctgtcaagtcaagcagttccattttcgttgtgatgtgaggtcacactccgtcggtctgtgacagtttcacatgaaactggagtactcaatttctgttaaaaataactaaaattcccgcatttcaaatataaaagccgataggctgtatatatcgggttttagccacattaggaacatggaaaattttcgccattcctatggagttat

SEQ ID NO: 62178 - DNA, 705 bp, Oryza sativa
agctctgatcgaagattttaacgatctaacatgagctctgttttaattactcgattaagaagctgtacagactttatttatatatataggacatactgtcatgagcccgtatgatacatgaactcggcttcaatatatatcagatcatgcacgtcatttgccgattggcagccagcttgtgaatcaagccatgtaccacacggagatggattaatccttcgtaacaatatactactgagtatttcaccgagtgaagtctgtccggcttcgcgtacaaactacactcggtggggggcatttgtttgatgaatttttgtgctaaaaattcatagaagaaataataaattattgggcatttaattttatatgagaatattatttgtagcacaattttactgaatatatacgagacgtgtctatatgacatgtgggtctagaaattttaaatattatggtgtccgaatatattcgatattggactcgttttgttgtataattgaatagaaagtgatggttcaaatggattttaaatccgatatacgattcaaaagattggaactattaaaacaaaagaaataagaagtgctatcgttactacgtgagcatgcatggtcattggctgtggcgattaaacatatggggcccactgtcattagacatgttaatcacataattatctccagactgcagtacacgttgacggat

SEQ ID NO: 62179 - DNA, 706 bp, Oryza sativa
tctagcatatgtgaaatcagttccctggagagcatctccatctcaaactgccatgacctcacagagcttccatatgagctgggcaagctgcattgcctgagcatcctaagggtatacgcctgcccggctctgtggcggctcccgccttcggtatgcagcctgaagaggctgaaatacctcgacatttcgcagtgtgtcaacctgacggacctccctgaggagctcggtcacctgacaagcctggagaagatcgacatgcgagaatgctcgcgactgaggagcctcccgaggtcgtcctcatcgctcaagtccctcgggcacgtcgtgtgcgacgaggagacggcgttgctgtggagggaagctgagcaggtcatcccagacctccgggttcaggtagcagaagagtgttataacctggactggcttgtagactgatgttcctggatgcttttggctccaagctcacctttgtacagatgatgtgtatatttttccctgtctaatacaggatggaggaacaatccactctgcaattttgacatgttcagtgttcatgcaactgactctccagcagcagccaaagcttgctgagaaaatagaaccatagaattaatagagattttttcttcttggcacaaagcatatttacatacacatagcaaatacattaaccaatacatctcttctgtctctctgtttaatacaa

SEQ ID NO: 62180 - DNA, 722 bp, Oryza sativa
tagtatgttgtattttaagtttttaacagttgatagagcaaaattctgatagcataccttggctcctgtgtgcttgaactaccactaaggcaccagtgaagtgctgtgtttccttcaggatcggcttcattgacatcaacatcccccatcaggagcttctttgtgacatttacatctccaacctttttgccgggtcggcggaaggacgccgaccaaatttcattaagatgaaagaagagttaccagtattacacgacattagactgtcgagccggggaagaaccccgaataaaagaagaaaaattaagaaaactgagaaagactatttacaagcaccaaagagcttaaggctactcctcgcaagagaaaaggccggctgctctccagatcaggacttcctccttaatgtctgcaactaagcgatcagccacaaccgatttattctcaaaaaccctggcattcctttctttccaaactctccagcaaaccagcatgaaaagtgaatcaaaagcagtcctgaacctcatctgaaaacagcggcgggcacaatgccaccaatctgccagttccatgccaagctgagcagggagaggaaaagtgacattcacccaagccttcaattgctccacactctgttagtgaaagggcatttgacgagcaagtgattgcagtcctccggcgccgattgacatagcagacaagtgggatcatgtggccaacct

SEQ ID NO: 62181 - DNA, 711 bp, Oryza sativa
tgccattcgttacctcatagcttggcgaccggaagaaaagccaacacacaaaaaaaaatcccacatattttttttctctctcctccttggaaacaagacaactcatttattgtttccccgagtcgagtccctgttgctttgcacatgaactctactcggcgggggcatccgtctcatatgctaataatatttgaagcctgaatttacaagatgtgtgtgaagaaggcctttatgacgcgtggcaaaaaaaacacgtggcaaaagaaaagaaggatgacaacgtctatgatttccggacggaaattattcctactaagtttactgtggtgttcttattacagtgatatgattacttaatatatggttggatcataccaatgtccatgattttcggacgacaattaatattataagttgtacagtgtaatgtgctttctacagtgatttattatttaattgggtttcacccgtgtccaagattttcggacgacgattaattccaacaattctgcactgtaacgaatttttctacagtgatcttattatttcatgaacaattggattatgccaacgtctatgattttcggacggcaattaatcctatcaagtttatactgggacgcgttctcacagtggcccagtcaattacgtacagttgcactgaaccagcatctatgattttcggatgatggtcagtcaatatttgggagc

SEQ ID NO: 62182 - DNA, 768 bp, Oryza sativa
tccctcaaccgcaacggcaacaccaacaccagcaccgatcccccagaattcgaacccggaggaccagatcggacgacaaaagggagctcgcggacgagacggagctcgggattcgctcgctcacctgggggggcaggaaaaggcacggggccggagctcgattcccacgggcggcggagctgagatctcacggcggcctcgccgcctcagggcaccacgccgagaccggcggcggaggcaggaaaagtctcgtgtcgtcgcggtcggagccgaagccgatgaggaggaaccggaaacccaacaacccgagaagccaaaatacctctccctgctccccacgcgtccgccatgggtgaatctccaccgtccatctttgatcggacggtcagaaaccatccccagctgacgatgggcttttttctcggcccattgggcttgcaattgggcccatttgtttgtatgtggctaaagcccaccagaagagagctgtgtcctcgtctcgtctcgtcgccggcgaagctcaccgacgacgcgacgccaccccagccgccgccgcagccgcagcccggcgaccggcggcgccgcccccggctccctgacccgccgcggccgcacgggggtaaggcggttcccctgtcggggctctcgccgcaggtacgcgacgttgcctcttcttgttcgtttccccccgtgctccggcgatcttttcgccgttccagatccgcctccgctcccgtgctttgacctggcgttgcgcggtttaacttt

SEQ ID NO: 62183 - DNA, 10824 bp, Oryza sativa
tctttagccatttatgccttgtcagtccatctgacaatagtttaaaatagccaatcccatggaatacacagttttctattcattcaagttataactgcatagtttggtaacgtttttgtaataactttctgtcaccttatggtagttccattagccgttattccctgatattttgaatttgtttaatggggtatgtcaagactcaagagttacattttcctatgttcctgatttttgttcttttcagggagtactggtgttgtccattctgacgcatcttgttcttgatgcatgtatccattctatttataaatgttcatcttcaattttggttttttttatgtatatattcaacttaagcaccccttaactatgtaagtcagaatatctttttcaagaggcaacatagctgatggggattcttccataaacatattctcagcgattctcaattgcagcaaggtaattaaagttgactgcattgagaagttctatgtttctgctgctcattaccttagtaatgtatccggtgtctattattcttcaggttctgggcgatgcattgttagggaacatcgtatttatgaccatgttattcctggaagtgcaatttatcctaaaactatcttttgatattagaaggtacattgaatacctgtgatgtggaaatttcaattacatttgttggtagttcattacgcgcaaatgaattggtgtattctcaattggaattatgcaaccagtagggattctgtaatagtacacttctgttgtagaagatgaaaccatatcagaatttcacattaaatgtgtcatgggttaacagttgcgcttactttgtcatttctcaggtatagggaggttctgttagccgtcatcatttcaagctacttcaagttatttctcatggcaatgatggtatagaagatttttgtgatgatttatttctaagttttatttgacttttttatttcctttcacgttcatcatcaaattttgcaggtttgggagtttccgtcatctgttatattctttgttgaaatttctgttctctcttcaaatactgtagcactgagaggtaagtgcacattttctttcctcggataattctcgtctttgtttatgacaatttaaactgttgtatcaatgttgtttagctgttcctttttcttgtgctcccactccagtaacattcatgttccctccattgggtatatagaacttatgcagcatccctggtcattgaatgtagctgtgttgaaaagcatgtagaaaagctggaaatcgtagattttagtgtcattactttatgtatgttgtgtgaactggcactgaattacagaatcctagtaactctgcagtccttccacaagcactactatacaatactagggtgaaaagggcacctctgttgtcacaatctccagtgattggatcatattgattaccaaacatctgcatcaaataattgaggttttgcacatcccaccgtatcacacataattgattgatagatgcctcagctttattgtttccatcttctagatttttctttgaaataagctgcaagtccaatacagaatcaatagtatagtgcgtttatcactccgatacttcatatttgaattctggatagataacctaaatacaaacaggttcatcgttctgaagcattaatatatcgatgcacccttctctttctagaaaaaagtactgacagggatgttctttgatgaataggaacctaatacatagctcatactattgatgatcacaatgttcctgtttcttttgcagttgtgacggagttttcaaaggcccattgcttcggagtctgctttggagcgcacgcagcaagatacctgactgagcgatggcttctcggggcgccatgaacccaaccgccgtgcttcctgcatccatcaagctccctgtagctcgtggtgccccccaaattcatcaggattcaggaccacccgccatgcttcttgcgtccatcaagccccgtgtaggtagctgtactccccagtttatgcagcatctaggcatactgtgccgctttgatgagcttgctctgatgaaaccaaatgtgatcatttgcaatgcactcactgactatgatacacactgttcctgtgagttgcaactggagtgtctcttaggaccttttgtacgagatgttgagcaatcctctcctagtttccccatctaactggggacagtacattactttatggctggtctattttcttgtacttatatgcccaacgcagtagctgctgctgctcctgttcagcgaagtacgcaatgaaagggcctgttcaccttctgatgattgtaacggtggcttctgaagaggtatgttccctttgttccatttgcaatataatgatacgaatacatacaccatacagaataaggttttgaatattactcttaacaagttaggctgcagcagagtttcagttcaagagtctgaatattactcttaacagttaggcagcagcagggtctcagttcaagagttttgttcttcagtgctctgaaccttcttgaattgaacatgtcctcttttcctgtgctccttcccttccttttgctggttcgccaccaccaaatgcttatctgcactaacaccaaacagctccaacaaatatgcaatctgcctcctaatccacagttttgttaatcacctgcactgaggcgagaactattataattcgttcaccctgctcatgatacatacaagatgatgtatcgagtagacggggcacaaagtttgcttaaacaaaattacacttttccccggaatttaaaaaactcacacttttgtacgtaatttgcgctaatctgcttgtgtaaagcatcgcattatcggttgggttgcgatcatcgcggccggcaccactgaaattaacaagtggagtacgtgcgcacttgtttagtgtgaatgtgtggtagctttggtcgtgtttgcttcagtcttctgtggagcctccactttaaacaagctcctctcacaccatcatttttaggattaggacaaataacacactaatttttaggataaggagcacactatctattgcgatgaaaactagaccaagtcaagaattaagacacgagaaatagatttcttgttttttttttttgctgaaatcgttgtacttttagtaatttttttattaatgtgtagttggaacaagaaagttcagaatttgtgtgcttgaggcaagcggccagcaaataagaagaaatagatgaagcatcatcaaggctttcttttagctgtttaatatttgttgaaatgatcactgtagttagtaaaagaagttgcaactaattaatctccgcaacttttgacgaatgttgcaataattatggattcgggtgctacaacttaattagtgagcttaagcacatcaatgcgttacgtgttacgtcagatttccttagcagctatgagaacctacactcacatatgtcacacaccaaacgttccctaaagctaactaacaaagcttaaattctacagtagcaatgagtagctagcggcgaatcgtatcaagaaacaaggtgagtaaaataaataatataatctaaaactttatgaaagatacttgtcaagacataatactcttatatcctcccttgaccttcgtgttgtgtaactttcttatcatctactactatagctagtgctgtcacctttcatcatcttccaacaagaagtggaattataatatggagttgagcctaatcagtgtgcctcaacttttttttttcttttttgagacggtgactacttatgatcaacgcgggattttgagttctttgtctgaagaatattttatctttagaccgtaagtcaagcaaaatttagtggccatggaatgtggctctcttcaaccgagtcaccaaattacatgatcaacggctattaatcatcttgtgcacccaaccttagcttcaaagaattcttccttgtgcatgattgcactgcaatatatgaaatctgaccagaaaattccttgtcctgtcatgtagatttcagggccatcactggttgtaccggacctactctattttaatttgggccattgcaacattaagaaaccagactcaaagcttccaaactgatccacaatacaatcccaaatcaatatcgttatttcatttgcaaaccaataatttgaatttttaatttttaattggatggcaaaataagcagcataaacattaatatttttagcttcctgatttaaatttctatctcttgacaccaatgatatactcctaggtaaacagagaggggaaagatgtcataaaatgaatctgacaacattaattaaccataaatttagctgacgttgacatgctagaaagattaagcattagactggggaacaaagttggtcaagcacccgtgctagcttacacttatatagctaataggaagcttttgctgctaaatgtgcgccccaaccaccacctagctgcgtctaatttcccatgacacgagatcgatcatatcgatgcctctaaaatccttaattaggtcgaaacacaacacgccaagacgcgcttagccaacacacatcaagagaactaattaatcacatcttaattggtaggagaagtccaatgctgattaatcattaaaagggatgcaattaagtaggactctgagatcttcattggagcaaatgggattcatagactggtgatacctttgttcccagtgttgtccatgtacagtcactcggatttgacgccctaacaatacataactagtacttgtcatgcatattaactaggaaattgatcttagctaggccccaaaatgatagggggacacgctatctcgtgatagttattgacacctacggcccattacatagaaagttacagttattttagacagaattcacggcccagttagttgcaagaagtcactgtgtcaccagatggcctacagcctaccagtgaccagccaccggccgtcccatttatgtgttaaaccttgtttggatgagcttatatcaggtacagtttctactgtaatctctgaaaatgatttgtgtaactcaagtagacatacactcgtttcatgcatatctttcaaaatgttacaaaaatgtttttttataaaatagatatcactacacaaacatataaggtcaaattcgacttatataatttggaaaagaaacaacaaatatcaactataaaagttacgcacgtttgatagccacatttatcatttgtgtttcaactcatgtaagtcgaatttaaatttgtatgtttacgaagtaatatattacatactgatcaaattgttttaattttttatgactttttgagtgacacatgaaacgagtgtaccactcaagtaaaaaagaaaagctttcccataatctccaccttctcaaacaataattgagaagattataagaaccaatcactgcataaggtgtgcatgtgtacgtttataaagacaagtatgcgtgtttgtgtatatgagtgtgttaaaaaaaatgaattcagacaaaaataaactattaacaagaaggcgttagctaagaaattacacactttatttagattctagctggtttagtgaccaaattgtttccaaggccttacctagctcttcctcgccaaaagaaaaggaaaaaaaatgcaaggggtttgcttttttctcttcgtttttttcttttatactttgtggacatggggccatgcatgcagatgtttttttctctaggctttaggaagccacagcctctaggtatcaaccaagcagcagcagatttccccagcaccccacgggtgattgcccccatctgaaataatttaatcgatcgttggcaaatcgacgaaaagtaaatacagtagtggattgttcgtagctgatgcatgcttataattatatattcttgcaattatatatctaccccggccaatgcaggagcaggatcgacgacgtgatatattccccggtctgtggatcgatcgatctaccggttgctataaagtgtacgtgcgtgcagtgaccataggataccggcatattgtcacgttgatatcagtccacgcatgcagccatgtactactcgtgtttagtttctgaaattggggagaagtttggggaaagttgttagtttggaaaaaaaattgagagtttttgtgtgtagaaaagttttggatgtgatgtgatgtgatgtaatgaaaagtttggtgtgaactaaacacaccctagtactccctcagtaggcagaatataagaaattctggtatttaaatcttgttctaaactgtagaaatttctaataccattccgttaatcacccgtcatttaatttcttttctatcttacctctactcgttaattatttttttcttaatattagcttaaaaatgcttatattcttaaacaaaagtactactataagaaaaaaagataaccaaggaggaacttaattatcaaataattacaatcgtgtaattaattgggaattgaacagagtacctcggggttaaaatgacaagcactttctatcaccgctatcaagtgcatctggggatattacaataggcatctgcgtggttttcacatatcctatgcgtccactgggcccaggaggcattggcacggcgagtgtggtggcccggcggcggcggagggcgcgccgacgcgtcctgatcggggcgggccggcgatgtccccggccgccccggcaagcacgcatatgagccgtacaccccgtgcccccggcgtctgcacctgcgtgtaccgctcgatcgcatccgtccgcgtccgtatctgcatgcatgcatgtgtgactgtgtgagcaaaaggtttgcatattactttttctgtttcacagttaaaattattctagttatgaatgtgtgaaatactaaaataactttcatcgtgaaacggagggagtacgttgcgttgcatatgaatcggcttgtacctgtgtggctgtttggtctggctctcgtactaggacacatgcacatacgtataccgggaggagcaaccacgtacgtacgcagcactgccaactacgtaatcccttcactttaaaatagacaaacataataaagatacgaatgatataaacttcttaagatttgtagtattaagaatatatcatattttatattaaatttattcattttacaacgaaaggatactacgctagctattacgaccatacgggtatctattgaggtgatctgtatggcattggcttcttttcaaaaaaaacatgtatggcattggcaaagtggttcagataatcctggcagagaggcatgaattgtttcgctcaaccagagcaccatgaatcgatcggccgggtgcattgcgcacgttgtctttggaattgacggatggaatcaaccaattatagttttattacctaagttatgctttgggccatattttattacctaagtttcactttggaccacacttaaacatatcttttcactttggatcggataaatttaccattgttacgatttggaccaccacgaacgattttttttctcatgcaatcaacgatcttaaacacatcagctctaatatacggccgatctcctctatatatggttcatatgtttgccgaaagggaagttaaacatgacgagaaaagttgttcatggtagtccaaaccgcaacaatagtaaatttacccagtctaaattgaaaatataggtttaagggtggtccaaattgaaacttgggtaataaaaggtggaccaaagtgtaatttactaaaaaaaaatcaaccaattatctccagcaatggatcggagtgacgtccacccagaggcgaagccaggatttgagattaggaggatgtcggtgagggtaagccataagagttgagaatgaataaccaatattaatattgatagtaaaaaaagggtcaaatagttactctcaataacaaccaatgtttaaactaatcctttaaaaaactggaattttagccctttaataatatcatccaaagtttgaaactagtctttaatttattgctaaattcttttaatgtaaactattgaataatctcacaaataagtataatctattttactttgaaaaagatgagaaatcacaaactaattttgtagatcatgtttcttgctaatgtttttagacttactaactaactaagctgataataatttcaagctacacaaataaactagataaatacttattttagttaatcttaatatagagtaaaaacagttgggtgtggtggtggtgttcagatggggggtgttggcaccctctagcaatcccctagctgcgcgactgcgtgtctgcgtccaccatccacgggcatcacgtaggcgcaccatatgtataacttgttgcatatatatgcatgcaatatgcacattctcgacgtttcgaaacgttgggttaaattttataactttgactattaattattttttaaaaaataataaagcaacatatattgatttatcttacaaaggactataacaaagtaaaattaattatttactatatacactataataaaaatatattttaaagattatgttatattggaaacatcaataattatgaaccggatgaagtaaattccgtgaacctcctcagcttctcttgacgccgcatcctcacattctcacctccctctcgagtctggaccatgccccagctttaatttgctggcggctcacctctttttggtgtagatccatgcatgaccaccaaatcattctgttcttgatacctcctcccttccgaatgtgtccatcgtatccgtgacaaattcatccccccaatccaaaatcctaccaaacgtcgaagctgtcatggcttcctgaatgatttttggtcaccatactagtagcacacgaccatgcattatcagctcattactgtcggttcggcttgaaccaatggcgattggctgtgtttggaactccaaattcccgacacctccctctcattttccacgtgcacgtttttcaaattgttaaacggtgtattttttataaaaagtttctatataaaagttgcttaaaaaatcaaattaatttatttttttaaaaaaaatagcaaatacttaattaatcatacgctaatggaccgctctgttttccgtgcgggaagattgggttcccaatcctaaaatctgaacacagtgtgtatataactatataccactgacggttatcgccacaaatcggcattgcttcgaactgtttggatgcctgacgtaaaagatagcggtccgggttttgaattggttggctggtcaattggactgcccaagggtttaacaactatccaaggtcccttctttttccccgcaaaccacaattagagaaacggatttgctaaataatggaaaatactataggacgatatcgtgttaaataatgagaaatgtccaaacgtgctaccgttctgtatcatttcccggatgtatggattgaacccacgatctcaagtgtgcatgcttgggtccctcaccaaccaagcaatgacacgattccaatcagttttatgccagttacattgtaactataattataccataattacatgtaaaagtttttcatccaaaaaatggtcaaaagttatatagctaatcccttagagaaatgaccccactaagggcctctttgaatcgcaggattgagaaaacgtaggaataggaaaaacgtaggattttgataggaatgtaaatgtaaagcagaggattgtaaaacgcagaaaaaatatagaaatgaccgtttaattgagccgcatgaaaaacgcaggaattggatgagagagatagactcaaagaaaagttaccaagaggttgaagctcttgctaaattttctccaaaatctctataggattgtccattccataggaattttaaaggattgtgaaggattcaatcctttatttcaaagggctttataggaaaatttcctataggattaaaatcctctaaaattactatatttttcctccaattcaaagggtcctaaaatacaaacagtaattgatcccatggattaaatttctagttcaaccactggagttctaaaaagaaaagttcaactactggtgacctagtgcacgaatcttgatgtcgatcaaacggccaaaattcgcaagatttagggctgatttggtttgaggccctaccaaaatgttggtagtgccatagagtagatttattactatttagccaatccaaatactatcatgaagctactaaaatattggcatggcacaaattagcactaatccaaacatgcccttattgaaccaaatcagccaattaatactcctcaatcaccaatttaccacccaaatacccggatccaattcttgactcgacgcacgagttacacacttaactacacgagacgacgaaactcgagtaattaagcccagccagggtcatatcgttacctcgccgccgcaccggtgagtgtgtcagtcaacgccacgaacccaactccactcatcctctcatcccgcctctataaatcctacccgtacgtgctaccaactgctcgctcgatcgatcgcccacacgcgctccgcacgtcgacgcgcaaaacccctcctcccctcccctcgccggcgatggagccggccgccgccgccgccgccgggcagctcgacgtggacaagctcacctacgagatcttctccattctcgagagcaagttcttgttcggttacgatgatcccaagctcgtcttcagcggcggcgacgagccgcagggggcggtgaaggggactctggcga

SEQ ID NO: 62184 - DNA, 5428 bp, Oryza sativa
ggcaaccccacggcggcggccatcacccacgtgctcaacaacaagcgcgagttccctctcgccgccggcgtcgaggacctcctggtcatctccatcggcagcggcgagtgcgacaaccgccccaccggtggcccgccgcctcgacatccgagatcgtcaggatcgccgccgaaggcgtcgccgacatggtacagaaaaaaacaatccatccagtgtgtctctctgtgtggtcctcttcttcctttctcgcatgcattcttgttcttcgtgctcccttggctaacgccttctccccgacgcatccttgactccaggtggatcaagcagtggccatggcgttcggacataataggacaaacaactacatccgtatacaggtcagagaactcacagccatcactataccaccatgatatctttgcgtttgctttagcttgatcaatctccatctccattggtgtctttgatcttgcaggcgatggggtcgccgcgggcgagccgaggagggatgagatgcggcggcggcggcggcggcgatggcgcggggtggggcgtggcggaggagatgctgtcgcagaagaacgtggagtcggtgctgttccgggggaagaagctggcggagcagacgaacgccgagaagctggagtggttcgcgcacgagctcgtcaaggagcgggatcgccggaggacggccggcgcgctcgcccccgccgtcgtcaagcagcagccgtcggagtcggcgccggcgacggcggccgccgccgatggccacacgccgccgccgacgtcgtactcgaacctggtcagccagatgttcaccaccatcctgtagacctgtagacgtgcgtgcgtggcaagcgaaatgtgcttccgatgtattgattctctccccttatttttggctgaattttgtaaatgcagagtaacaaaaatgtgcatgcttgccgtgatctgtacgtaggacatgcctgtttttttttttaatctccctctaaatcctaggatgcttaatggagagctggtaagttgactaaaagctgtagaatcaagttaagtactgctagtagtgatagctgcaacctgcaatcaaagaaactcaaggcaaataataatatatttaattaaaaagaagatcagatcactgaaacaaagtgctagatttaatgaaacaattctaagaaattgtacttggcctgtactgtcagaatttcaacaggcaatacaaaaggtacactcctgagctgttgcaagttgcaagcttcagactccagattccagaacagtagttgctcgcaagtcgcaagtttccaacaaaagaaaataaatagaacgtagttgctcacacatctagcgtgatgaccccgttccccgttgatgcacggagaatttcagtgtgggtagggtagaacttgtctggcaatgtaaattagtagtaacatgcataaaatctggctatttgcatttactgctatcacacaatccaatgcaaaactcattcatgatcggtcaacttcacaatgtttaccatgtgatagaactatagaaatgaatgagacgtcatggagatattgatgtctagattttcgatgcaaaatggatttctcttttcttctctgtacccagagggaacaaatgctaatcatattccagaaaagcaatagttatttcctacgcaaatgaaactgactatagaattcaaatagtactagaattcttgtatttcagaagctacgagggtgtgaaaaatggtaaatccatgattacctgtaggcccaacagaggagcagtactccctccatactaataaagaaagttatttaggacagcgaaacggtctccaaaacacaactttgatttcttatttctataaaaatatttattgaaaagtgatatatgtatatttttatgaaagtattttttaagacaaatctattcatataatttttatattttcaaactcaacaacttgagagttatttatgatttatattatcaagatttaacttaaatattgttctaaacgactttatttacgaacacggagggagtatgctaattactcctttaacgcagcggagagacaggttctgggcaggccggacccggatctgcgactgcaagaagcatgcagcttaactcactttaagtaaaaacaccaaatccgaggtgcgcgtgttgacgggctggtgatgtattctttgatccgtcgaaataggtggcactcttcatgcaacgtggaggcctggagagctgccgagctgggcatcggttatggcttgagatgctccaaatccagcaaatttgtcttcaaatgtgatttgcctcatatatatactctcctgcaagaggcgtcacaccattgattccacccatcaaaagatatagtgcaaatgaaaagatcacagaaaacagggattgtatcagaatgcatgtatatattgatgtcaggaaacacatgttcaacttgggttgaaggattggatgtcttactttgttattcatgtggtgtgggggactgagctgatcctaaatcccaagtaatgagcatttaggtcatgttaagagtagcttattaactgagtgcatgggctactgtatattttaccagacaccacagatcggacctacatatactgtccccttctatgatggagtggcctaacagcaatgttgataaaccatcatgtaaacagcaccagaccatactagtaggtaaataggcatgcataaagcataatgatctaggttacaacttacaggctacaaagtagtgctggtggtgcaaaagtagctccagggggtgataaacaggtactactcaggagtcaggacaatgcctaagacaaaggagggaatataaaatttcactccagccacaccaaccagcctttttccaaagatcaaagcagtaatttgtactgcatgctacagtgtgaagatagatcactgatgagaaaccagcacttgtgcaccagatggcatgagctcggtatcaccattcactgcaccattcaggcattcactgggaggaccagacactcccagttagtacagctgaggctttgagtactgcatgcccacactatagtcttgtccccctccctccctgctgcttgctttggattccattttcatgcatgcataggtacataggtcacacgtgtagcattactagtacataaatctgctatggcttgtttgtgtttgtaaatgcaactatgcaagtagccaagaatctctctagtctctacccagggatgaagtaatggagccatcactcatcagccatgcaacaacttgcaacttgaagagttggatctaatctcgctccttttgcacaaaaaagatgatcgaaccacgtttgcaaagcgatttcttggaaagaggagtgattaactattgtaagtagaaaaaaaccgccctgggtaaggttagttagcagttaccagcttcgtcccctctgttatagtttactctggggagtcagaatgacgggttatttaggggtctaggatctttagtcacatgtttggctacagtagtggagatttttaatgtttgttgctttgtcatagacgatcttatagtttgttttcttaatgaagttatatacatagacaaattagacctgcagtgtttgtctagggaatcctatcctgcatctctgtaacgaaattcgtcaatacagacaaaggaaaaactgttcatgctcatgcttttatttggctctctggttgttctcttccattttgtactggcctgctattttcaagtagctaagctgctgaagtatgtagttgccatagcatcaaggttataaattgtgaaatggataaaagttgcgttatagtcatcatttattaatagtcaatggatcgttccttcttttttatgattagtcgatggagaaatttcttgaagtctgaaattcaaatgacggatcgtcctaactaccaaaaataaatggtaaactctgaagaagcacaaaacacgagcaagagaataaaatgcttccatattttacatccaaaataaatacacaagatacggatattgctgcatcaaatgaatggaaaatgactgcttacttgacaggttgatagatatatatgattgggtggccacacgtacgccaccatgccaggaccatgcatctgctgtgactgttgtgagcagcgtagcgtacttcgattcagttgggaccctggatgaagctttcagaaaatgtgctgctcacctgcaagaacaatcagtctgcatagcgcacgagcaacgcatgcagactgcctatacctaactcgcagccgattagattgttttaatcaatggaagttttaaagaaaaagatatgtgttgtattgattattgtatagtactattgacgcaagcaatacttctataggtgtgcaatatatatcttatatagcatttgaattggcataaataaagatgcaaaatatagctatagccaaatgcattttcctactatgaatttgcaacctcattgacatatataacagagtcgtagatgcagttcactgcatcttcaagagaaagaggcattgttttggtaatatatgacaacaggagaggggcctgggaaacaagagtaaaaggggatttttctcatagaatgaaaaaaaaaaagaaacaggcccaggtatagatttatcaggtaagtatggcctagactaaacaaaaaaaaaagctactctgaaaagtactctgtagtagctcacagaagatgtatacgcatatttgggttattgccaatctcataatcattgaactgaaagaaatttgtgggtgcttatagtcttaagaactatatatagtttatataccctttcaatgtgacagttaataccttgaaaaaatggagaatgataaggctatattctcttacctttttcacagatgctcatgaagggtgaccaatttgcacatgaaaatttcctgtgggacaaacccaaaattcttcaacaagaaaaggaaaaggtggatgcaaggatataggaatgtaaaggctaataagatgaactcagagaatatgcaacagataattgaaatgattacatagggaacaaaccatgcaaagccttcttttaaactgaaaatcgtacctgtttctgttgaagatgtggaaccattatgtgcagcgatacaattgctttgagcatttctagctccaaatagtagtgtgaatttactaacctatttattcactcacaatagagcacatattgtaccaaaatacatcagtagacactaccaaactaaactgaaagttgctctgttgggcaaattagattaaaaacaaagctataagaatatgaagtctggttggaaaagatttctcccaacagtgcacttagacatttattatattaggtcgctgggcagcatctgatatcattgcaagggtaga

SEQ ID NO: 62185 - DNA, 15601 bp, Oryza sativa
acaggtacctgattgaaatatcatgggacagaagaataaactgactgaatgaaaactacaaaattttccaagcatcatataatagacaacttgcaggattgattagattatgtgaataataagggcgattgaagatccctttagtgctatgctatttaggaatttatttttttctcagcaaatggttccatctaaatgtattgtgataactgatagcaggcagaaatgtgctgtgacaactgataaaagataatggaatcctattcaacttaacataatagcaagtagaaatgcattgtaataactgataagaatgaagtgtgttacaaacttgccatggaaatttcatcataaaataggtaagtggaagaacaagtgaggggaatggtgatgatctggagttacatgaatggctaacatgtaggttgcatataccttagtcaaaggctctgagaatgctaacataagagcaaaacaggggcgaacagggatatcctgaatcatcattgacaattgtggaagcaatgacaaatctgagaaggaaaaataatgcaactgctcagacattcagctgagatatcataaaaataccgctgttctgtgtaattaggaacaatggtacaatgtatcctacatgagtccaatcaaacaccggtttattttgacattaagtaacctgcattgtacccttcattaaatgtgcattttcttgctgtcaacttattgtttggacatggtagctgcaaaaccatattctttaaaaggaaaaaaggaacaatcttccataaggaggcaggcatagattcatataggagcattttcttactgtcttcactattttgtcaatctattactacattttaaacaaatgtagaaatcttaagatacagacaatgataaaattaagttatagaaaacaagagttatttttctaatcaaagataaatatggttatcctggttaccataaaccgtcagaaaaattagaacaaagaatttatggtgaaagaatattttctttaattaattgtagtgctagacctcctgatcaatataatttgctaaaaaaaactattgtacaatattgtctttcaaaacataacataagttcataaacccattattttgaaacttgtgttatggtagtgcatattatgaagataatagaataaaacgaaccaagaggcggtggtcttccagttagcccagaaaatcttggtgatgctatattcttatcggttgctacaacataatcaaaatggccaagatctctcccatccaaactagccagtaaccatgaactcctatcttgaatccagtccatcctgccaatggtgacaccaaatttggccaccacacctaacaggcacaagagatagcatgtatgagcagcaagttctagattgctggtactgaagagtcataaactcataatgctacaaagtaagtctaaccatcctctagacaaagtgatttgcatattgagttcatgcctggcactcccacatacttcttaattgttccctcctgtgcgaatataatgccagaaagcttatgttagtaagtagaaagtatcattttaagcggtgcagatacataagactacatatcattctaatccacccccaactccatcttttgataaggatcagcactacaatagtaccatcaacatcagagacatcacaggttaagttgattctgaacatgtgagtaacggtagttcgatctatccactaaatttttagagtactgcacattatatattcagtgatgagtagatttggcagcagaaagatggcttactattccaagtgcaacctactgcattctgcattcagacattcagttaaggggttcaccagtaaactatcccaattcccacagtcatgctaccactagatacgtgacatgttcaagttgaagcctcaactatgggagggtttcgaagcctagaaccttctcgaaatcagtgaatttgccggcctcccgatcgaagcacgcgaacatggccttccactcggcgacgagcccccgcgcctcccacccgctcacgacccgagcaacctcgtcgttgctcacggtgaagtatggcgcgccgtggtcgaatcgcagctccgtgccgtcctccatcacctccctgcgcccacacaaaccagcaaaatggggtggaaaaaataacagcaccgatcagcgcggaaccaacacacgcggcccgggcagtaaattggtcgagcacctccgctgcgccatgcggccaccggccccgcggccggagtcgaagagcgtcaccgccacgccgcgcgcggccagcagcgacgcgcatacagcgcccgatactgcatcggtggacaaaccaaaaaggggatcgcaggtacgggtcagttcaaacgggagcaatcggatcagagagagaggatgagggattggaatgggctgcgtctgcttacttccgcccccgatgacggcgacattggcagccgaggcggctgcggcggcggcggcggcgctcattgttcgaggcttcccggcgacggggtgcggtgcggagaatggagagcttttccgatcgaggcgggagggcttggctgcttccgcggtgaagagattgcgcgctgcggcgtcgacgtggcgtctcgtggacccctcgcttttctgggctcttctccatccggcccagcaactgaatttggcccataaggtccaagtcttctggactaatcttttcgctcatgcttatacttatacttatcagccaaaccaaaatttgaatttttaatcttaaatttaaagttgattttagagttttttttgttatcaaagtttattttacaacatttgcttttaggtcactaagaagcggaaatcctgtttggcgatcgatcgccctggggatggatcagcgatcgatcccctcccccctccctcccaccacccctccacctggttttcatttttggcaccgcattattttcttattttagtaaatttatacacctaaagtttatacacctaaagtttatacatctaaagtttagagaccaaaagtttataagtcaaaagtttatatatccgattcaaatttgaatttgaattcaaatattttttttatatatagtatttctatacatctaaagtttatagacctaaagtttatagatctaaagtttataagtcaaaattttatatactcgtttcaaatttgaatttgaattcaaatattttctatatatcatatttctatacatctaatgtttatacacctaaagtttatagatccaaagtttataagtcaaaagtttacagacccgattcaaatttgaatttgaattatgtcgacgtttgatgtctcgactacggtatttggacagtatggggatcgtcggtgctaggatatacgcgagactgaggtaaaagaaatggggacgaggatttttatgcaggtttgggcccctgaattgtcaggtaataaccctacatcctgttggccgaagccggtattgctctttattcactataatcacaccagtacaatatgtggggtagcctatctaactgttgtcgacatggcggtctgaagatctgactcgtagtcgacaacagggtagccttcctcctcgagctcgcgccctgacggaatcagagacagtgctagatccctatggccggcctctgaaggtaccggatagggtcgatccaggcgtatctctgatgtcgatatctggcggcttgtcttggtgtatgttgacttgtatgctgtggcttctatgtcgattgtgttgggtgttgattttgtcaggtgttaatcctgttgggtgttgattgtcttgtcccccatggtggttgttgatcgtgttgatcatctcatatcatgggtgtccccctgtcctcctaggggggcttgtatttatacccataggtgtcccctcgtccaagtagaactagggaaaccaatatggatacaatccgagtagtccttgttgtttccatgtagaactctggttgtcttttcttatccagaactccctccatatctgaagtcagtttccgtataagacatggtatgtggtggatcctgccaagatttagtcaactactattaggtatgtggtatccataaccctgacagtagcccccgacttcgatgcaaatgaacgaattcatattctcaaccgcgcgcaaacattggagtaactgttatcgagctcatgtgaccgttctcggtgagtttagagataacgttggacttcctttgtcaacctcgtgcgagcaccgaaagggtttgtgtaagtcaatctctgatgtcgaccgagaaagtatagagcgtacgactaattctcacatcttgctgtaatcgagaatttggattgaagtcaagaaattttatctcggcgggtacaccatctcttcattccgtattccttgtcgagatctagcaaccgttctcgagcgattgagaaggcgtagagtctgcgacggaactttgtcgacattggtcgtactcgccttagtcgatcttggtgtagaaccatagagacatggagtcttcgtcaatgtcgaatagaattttcctgaaatcaatactcagaaaagaatatcaaataaaaatagcccccgagcgaacgctcaaagggtgacacgttataatatgacagactagtgaattgaatgtacagaccagtgctttgtatatgagtgtcttctctcttaccgactccgatcagtcagtttgtagagtcatacactctccgtagcccccagccttgtcgtcggagaatcgttatcagaagataaggctcttggacctttgacctgcctcggttgaacaagcactgattctagcccctagccgtgaagttggaaaatccatttccgattacacggcttagttaatacgcacggcgagaactcttacacgaccagatcttacatggtctttcgtctctgaaggatccgacaaggccttatcggctctgggcgtgcccagccgaagttccctcaggttcctcggaggccttgtcaagacggcgtaaagggacagtaggataggtttcaacgctaggtgtcatctgggtaagggatctctgggtaaaacacttggcgatcttgtgtacctaacatcaactttattgaagcaggggtaatgggagaatcgctggtcgaggaccagacagtagttgtaactcgaccatttgaagtggaaatagtgggagaaacgagaaacactacatcgctagtcgaggaccaggcagtagtcgtaactcgaccacttgaagtggaaatagtgggagaaacgctacaccgctggtcgaggaccaggcagtagtcgtaactcgaccacttaaagtggaagtagtgggagaaacgctacatctctggtcgagaactaggcagtagtcgtaactcgaccacttaaagtggaagtagtgggagagacgctacatcgctggtcgaggaccaggcagtagtcgtaacttgaccacttaaagtggaagtgatgggagaaacgctacatcgctggtcgaggaccaggcagtagtcgtaactcgaccacttaaagtgaggcaagagagatcactacgttttactggttcgagaaccaggagtaggagtctcttaatcacctataggggcgctaaagttggtttattacatgtgcatatcatgtggccagcatgactcccatacccaacttatagcatatccggatatccgttcgcaatcatgtcgggtgatcaagccgacggcgttcgcgaggaattatccgttaacaaccttttctcgagtagtccagcgatggccggtgctatgagataggtcgtcggtcttcgttggcaggttgggtgcgataactccgcatttgtcgagaatgttctcgataatggagtgtactcgatcataacctactcgagtgctcaattgttcctgaaaaatattttctagaatgcaagatatatagcagataatatcgagtatgtactcaaaaaactgcatggatcttctagtattatcaggacataacgagcagatgtaattattaggcattatgtaaaccgtaaacaagaatgatttatacataagagaacggagtgagcccccggcgttagacaatagttggcctatcgtcggaagtactcgcacaatggatattgtataagaagtatgctctaggtaaacataataaattattgatctgacaatactgtatgatctgaaaagtaggtacggtaaattgtgtatataatattgcgtacctttgtagatacatgccggatgtatatacggaattattagattaattaaaaatcaatcttactaattaccttatttgacttgcatatggtgaacagccatcacacgtggctcccgagatgatacacgtgtactgtacggggagtccaccaatccgatcagtgcatggtcttatgtgctgatgtcatgcatgctccaaatggtttatttttcaacatttgcttctaggtcactaagaagcggaaatcctgtttggcgatcgatcgccctggggatggatcagcgatcgatcctctcctccctccctccacctggtttttatttttggcactgcattattttcctattttagtaaatttatacacctaaagtttatacacctaaagtttacacatctaaagtttagagaccaaaagtttataagtcaaaagtttatatatccgattcaaatttgaatttgaattcaaatattttttttatatatagtatttctatacatctaaagtttatacacctaaagtttatagaactaaagtttatagatctaaagtttataagtcaaaagtttatatacccgtttcgaatttgactttgaattcaaatattttctatatatagtatttctatacatctaatgtttatacacctaaagtttatagatccaaagtttataagtcaaaagtttacatacccgattcaaatttaaatttgaattcaaattttttatttatatagtatttctatacataaatttactgtagtgaaaaaatttgtgtggtgtactgtagtagaaagagaagaagggggagaagagggaggagtataggggtaggcggggtaaaccgatcgctaggcgatcgcccattagcctcccccactaagaacacgtatataaaagttttattcacaaattattttttgtttgcaaatagggaataagcaaaacgatggggccgctcttttctggactttttttattaaaaatgtcgtgcgtaattttttttttacgaaacgtaactatagttgataatattattacacttgggttaacttgcatttacaccacagtaactgagaactaattgcgtccacttctccactataaaaaccattcaagcctccggattccagcgcaagaggcacagcgcgccactccacacgaaatggccaagctcacggtattcgtggccatcctcgccgtcgccgccgccgccgccgccgcggccgtctcgacgacgacggcgcacggcgtcgccgtcggccgccgcgctctggatgagtacaggagcgtgctgcgcgtgatcgtacccttggaggtggccggagcgccatcgtctgggtcgttggacgacgacgcggcggcggctctcggccccgacctgccggagtttggagctgcgccggcggctggccccgccgcggcggcgtgcggcggcgatgaagttgactgcgacaacaaggtgccggtgtatgggccgtagcccatgtcgtgtgaaggttttcacttcgtcgcctacggaattgatgaagtgcgtcgttttgaccatgtaaatggccttcagattattattgttacacctgaataatgaaatgcagaactatatatatcctaatttaatcaccttatgtttttttttctctctaggataaatgttgctagctagtgatttatcatatttggatatgtgagactccagcaaagatacagcaatgtgacagattttttttcttcgtgcatggtttattatcctcgtcttcttcatcggctccattttagatagctgaaattgatggattaatggattacctgattttctttatagctatttaagggtacaagcgaataaattaaatcatacaaaattgaaaggttgttctacaaaagtatctcaggaaaatttgatatagaattctcctttacacgaaacacaccgcttaggaagcttgcaaatgaaaatccaaaatcataatcagtgaagaacagggccggccatcgttgtcagcattcttttttttcctcaaacaataaattaatgtgtttccatttaaaagaaagaaacaaattgtcttccatccgaatatccaaaataaagccaaaccaaggtgaccgccgagcaatctacctcagtccagaacttaaacgacattgcacaaaccgttctgtcgttataagattcgatgatggttcatatgcagataaaactccagaatctgcttacaaaataaacaataggttagatgcttgcggggattttttttttggaatgctcaattaaccttggcgaatggacatatcagagaaatgtacacatactcgaacaaaattttgtttctgaaccaatgagattaagaacaaaatttgcagcaagaagacaacaaactcactagcatttcaaatattccatacgatatattttaggtgtttttagatgaaagatcatcacgatccggctttgaaagaaagcctagacgtccattacagaggttaattacaagcccaacctaaaaacaataggaaacataccaacactaattccatcacaggagcttgcatctagcaacatcttctacccaagttccacacaaaaacacccaaaagatcaattttcctaacccacgagtgctattttttcagatctccagcggcaatacatcctgaggatatgtttaagtaggagttgaactgcagatatactgcagagccacatccaaagccaaaataagcttaatatatctgcttcttgagcagagtaaacactagctagtactcctggtagaactccagatagatctacagagagcacagaaaacgttgaacgaatcaatcgttgaattcatattcaaaatcctcgaattcgtcttcaaaatcacccatcaggtcagcacccatggaagccataatgtcatcaggaagccgctcagggaggctttgcactattttctcccactccagtcggaacctcagtgcttcgtcggcgtagctgcagaagagctgaattggactgaaaggaggttcagtagaaacgaggaagacgggattcaacgaatctatggctccgccgatcttggtcgtctcctcgctctcgagttcatacatgtagatgtccgcggatgtgaggtcgtcgcgctcctggtagtagattcggttgccatcaatggcgttgaacttatccgcgttgatggatatgcacctggtggcgccgacgaagatggcgcggccgccgccgatgctcttcacctcctccagcgatcgatctccttcacccctcccgtgctcatcttgtaaatctgcacgatctttctgtccatcttgaagatgagcagcgcttcccccgcggattccaccacgaagcaacggaacgcggggttcgcgcgacatgtgtttgtgattttgacggcgagagggagccccgtcttgatggcctcggggaccaggatcgacgccaccgaccctagctcgccggcggcggcgtagcggccaccgacgacggccagcctgatgagagcgcacgcgtagctctcctcgaacacggagaagccttcgctgtcggggtcggcgaagtagaccttggcggagtcgtcggcgagcaggacgagggtgggcgaagcgccgatgacatgggcatcgaacccgtcctcgcaaggcagcggcgccgcgaagcgcgtcgtggcgccgcgcttcgcggcgccggtgaacgggttgaggacgcgcaccgcgtgcgggggggctcgcctcggccagcacgaggtcgccgccgggggcgctggcgacgaggcggtagcggcggccgcggccgagcagcggcaggtccatgcggaggaagcggccggtggcggcgttggcgaagaggcgcgcgtcggtctggaagacttcgtcgagcatggcccagtggcgggggcggaagcgggggtcccgggcgctcgcccccctggggtcgtcggtggcggagcgccagcagcggcagacggcgcggtagcccatgtagtagtcgaggtcgccggtgtggaggaagcagcgggcgatgcggttgatgaggtccaccggcagcgtcgaccggggcttttaactatttgccacacttaccagagtggggcttaacgatttgccactaattccacatattatagacacataagggttcatatgttatagacacggtgtgacaaatcgttaattgacatgtcacaagagtgacaaatagataaattttccgcgtcagagcttttaactatttaccgctttatgagtggtggttaacgatttgccgcgaccagtccgccattgccgtaggctggaggaaggggtgaaaggtttggaagcagtgcggaaagcagctgaccgacgggcgacggtggcgcgatttgaagggaccagtggctgcactgcccgggggatgtggagtagacttttattgtggcgttttccaacgtggacgacgaggcgaaaggacgtcctactcccctactatgcgcgattcccgggggaggtggggaggtggtgggacgtgtgggggtggggccgtgggggagtgaaaggaaggcagaacgctgaacgcagaagcgaggctttgtttagatttcaaaaaaaaaaaaaagccaaaacttcgtataaaatgtttgacacatacacgtagcattaaatatatagataaaaaaaattaattgcacagtttatatataaatttcgagacgaatcttttaagcctaattacgccatgatttgacaatatgatgctacattaaatatttgttaataacggattaattagtcttaataaatttgtctcgcagtttatagatagaatcggtaatttattttgttactagtctacatttaatacttcaaatgtgtgtccgtatacttcaataattttacacccaaagaattaaacacacccttagcaccaatgtgtagcacaatctaatcttaatgtgggccctaatacaagttgactataactatttctattgccacaatgcttaaggccttgtttagttctaaactttttcttcaaacttccaacttttccatcacatcaaaacttttttacacacataaactttcaacttttccatcacatcgttccaatttaaaccaaacttccaaatttgacgtaaaataaacacaccctaagtttacataagaatagatgttggcccattcacacttgccaaaccaaccatttaagaatagagaagagagagaataaattcttcgatttctttattctcttgtggtgcactctaaacttatggttgtttttcttcacaaattttgacagtttgaccctttgcaaaaactatttttacaaatgaaccgctgccaaaacttatttcaaatctgatcctttttgctcaacgccaaatcatgtggcgttgaacttagatacctcagcgccacgtcagctggcattgaatgccgtgccacggcggatgggagactaagtcagcgtgccaacgtacattcagcgccatgctatttggcgctgaggtgtctaaattcagcgccacacgatttggcgttaagcaaaagggtcagatttaaaataagttttggcagcagttcatttataaaaatagtttttgcaaagagtcaaattgtcaaaatttatggtttttcttgttgttgcctagtactagcttattgccaatgctatgatgcactttaaggatcttaaggttacacttttgcgacattgtggttgcccttagacatataaaaaattttacaggaaagttatttaaaaaaatcgtgttaatcttttcttcattttttctaatacttaataaggttaattaattgtgcactatactccttgcgtttaaaagaaaggctctgtttagttcgttcgtgtgccaaaatttttgaagtatacgaatacacatttaaagtattaaacatagactaataataaaataaattatagattccgcctgtaaactgtgagacgaatctattaggacattcccaatccaagacactagacatagtttccataaactctacatcatcaagaaactagtactagacactactcttccaatgcaaacactactattccatacttaaatttaatgctacttatctcacataatgtcttggatgttgtgtagaaaccatgtctcatgcaagacatggtttccttctttttcctcatttattcaattgccacatcatttttcatcctaggtgtcagggttatagataccacatacctaatagtagttgactaaatctcggcaggatccactacataccatgtcctatacggaagaggagttctggataaggaaagacaaccaaagttctatatagaaacgacaaggactactcagattgtatccatattggtttccctagttctacttggacaaagggatacctatgggtataaatacaagccccctaagaggagagggcagaggatgaacacccaacataatcgacatagaagccacaacatagaagcctacatacgccaagacacgccgtcggatatcgacttcagggataagcacggctagtaccctacggtgtctccggatactgtcaggagagacgaaagcactatctctgatctcgtcgggcacggattcgaggagaaaggctaccctgctgtcgactatgggtcagatcgtcagaccgccatgtcgacagcagttagataggctacctcaaatattgtactggtgtgattatcatgaataagagcaataccggcttcggccaacaggatgtagggttattacctgacaattcacaggcccgaacctgtataaaaatccctgtctccatctcttttacctcagtctcgcgtataccctagtaccgacgatccccataccatgcaaataccggaatcgcgacatcaaacgttgacactaggtgacaacttattcaatgctatggacaccatcctagttattgggttgggaatgcccttaagcctaattaatccattattagcaaatatttattatagcaccacattaccaaattatggcgtaattaggctcaaaagattcgtctcacgatttacatgcaaactgtgcaattaggttttttcgtccacatttaatgtttcatgcatgtgttcaaacatttgatgtgacggaaaatttgaaagtttaaagaaaaaaatttgaatctaaacacggccaaatacaatctaggaaaggatgtgaccccttgatcccttcgttgtaatagaagcgccgggacacatcctcagtacgttcgtctcgttttacgtctaaggagagaagggctatgaggctgcgttcgggacccccacggcatcaaccaaaccggtgaaatctttcgttgatcagcttggatcgacatacgcatagcacgtcctctgtactcatattcatccttctttccacaaatttcattcgcatgagagaggaaagacacaagtgaaatctgaacaagaaaatggatggatacgtacaagttgttgctgctgccctgccccactctatcgtggaatcgcagtagatgatgagccccatcaccgatttcctttctataatatattttaccaagacaaatttattataaaaatatatttgtttacatctaaatttgtcacctatggatgaaatagaggaaaattgccaaagtttgaaaattaccgggtttccttcacagggccggtcagaccgcaggtatatgggcggtctgaccggctagtagggccggtctgaccgcaggtatgtgggcggtcagaccggcagggtccgagtccgagtctgttttcgtcgggtctcgggtttccttgctcgggaaggcatattttgtgttttctttggtttctatcccgagttggacgtggagaagggcctgtagagggcaagaccaacccctatttaagggacaaggccggttcattgtaaaacccccgaatacaatctatttgaatcgttcttttactatgttttctattgagtaaatttcacaaaactacagatactttgatcaaactatcacaaaactacagatttaagaatgtatttcacaaaactacagatttagagttaaatttatcatggaactacagatttaaggtattatatcacaaaactattgatttaacaactattttattacaaaactacacatttaaaaactattttatcacaaaactacaaattttataactttaaataaataatagtgctatgatctaaactctagaatatgtagttctttgataacttaatcactaaatctgtagttttgtgatatggtgcattaaatctgtagttccgtgaaaagtttaacgctaaatctgtagttttgtgatacacattcttaaatatatagttttgtgataatttgacacaagtatatgtagttttgtgaaatttactcttttctattttaccctagtttagttcatctttgttggtttgcgccgtaaaccgtccaccgccgctgcgagagtgcgacacctctttgtaggtttatcctgaaaaccttccgttttgctcacgagacgggtagttatcctcatatcgatctaaatcggtctagaggctgattttgatctctaaattggctccgctagccggtttaacttttctttttgcaaaacccatcttgatttggccttttggctagatcgaggtggttggcgactccatatcaccgcaaggcgtttaggtgttgcgatcgtgcttatcgacttgtcacaaaaagttgctaacaatatttaataattattttaatagacctaatttgataatgtaagtattactatatttgtctgtaaacttagttaaatttgaagcggtttaactttgaccaaagttaaaacatcctagaacctaaaacatagggaatactattaaatccaaataacactttcaaagaattcaaagagcaatttagtaggattcaaatcctacataaattttactagagtaaattacactcacggtacatgaacttgcgtggtggatgcaaataggtacaacaagttgcaaagtgcttatttcagtacaataactcgtctatattgtgcgaattggacaaaaatgatccaaacaagcaaaattgttagaacttagcatgtactgatgaggtagcagtttaatttacatacttattatgttttggagatcttatttgcaatccaaataaaaagagaaattagtgatgcaaaagtttgtttcatttcatttctgaggaattttcgttccttcataagtcatcttatgtttatttatatctttagggccaagacaaaatctggcgtggcatagtgcaagtaacactaggaaattcattttaatttctatgtctagaatttccattttattgaaagtttattttcatgacc

SEQ ID NO: 62186 - DNA, 3880 bp, Oryza sativa
  unsure (1)..(3880): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccatgtccgagggagcggcggccgccgcgccgtcgccggcagagatgtacggtgacgaactaggcgacctcgagaacaaggtgccggtgatagggccgtagacgaagggcgtatcgtacggccgggatgatgctgccgcgagttaatttatacgtttcaatgttcactgctccctccgtcccattttcacgcctaactttaatcgtctgtttttttataatttatatctttattgttatgagatgataaaacatgaatagtattttatgtgtgacttatatttttaatttttttaaaaaaattgaataagatgaatggttaaagttgtacgcggaaaattatggctgcattcaaaatgaaatgggggagtatgaagcaagagcgatcattaggctgctaattaacgtacgtttcagtatttaatttgtaaacggacgtgctaactaaacatataaactttgttaccgtaataatatattagttgacgtttatacatttgtgtagctctaaatttgcctattcttttttcttgttttcaatttgttcttcacttcttctgcttcagttttggacttcaaatatgatcagatgcatgcaattggatacgtaattaaccaattttgatccagtaaacaagcatttattacttttctaattgagagttacggaaagcatttaaacgcgtaatcgagctctaaataatgttgagtatcgtttctttctgaggttttaaatatatgcaacgtaacgcataatgacctggataattaacggtgctagtattttgatcaaacgcttaaacctaacgattcttaaaaataattcatcccatcaaagtatctctctgaaaagaaaaataatatcaagcttatctagctaatgaaaaataataactttgattaagctttttttaaaaaattaatggtagtctactctactctacctacaaacagtcctaacgggattttttttttcattttaattttttaatatttacagaaatattataccgacgaaaatatttacagaaatagaccctgccatccagtatagagcagcaaggtgacatggcacacggcgccgtgtgcgtattttgcgctgaggtcccttgctgttaaatgcagtttttgcctgctcagcggcctccccgagggcggtagggtatatttctgtaaatattttcgtcagtataatatttctgtaaatattaaaaataaaaattttaaaatgaaaaaaaattcgtcctaacggaagcagaagcccactagattagctagaacacccggcccatgggcttggcctacccacttgatattccaggcccattaagcccaacccagcgaagcgaaacatatcccacccaccccaccgtctctctccatttggactccgattccacgccgacgtcgccgcctgatcgtctccggcgccggcgatcccaaccgccgcaaccaccgcctctccctcctcctcctcctccggtaggtgctcgcggccgctcgacggccacgcacgtgctcgtgtctcgctgtcccgtccgccgcctcttctccactcccccacgcttccgctccagatctgcctctccgcccgcccggatctagccaccggttcgccggcccgccgctcgggagctgaaccgtgtggccgagtggcgacctctcctaccgcgtagccatggtaagatccgttcattctatccggtttcgtggtctgtgtagcgagcgctgtgtttgcttgcgcggggggaggaggatgatctcggaggagattagtggtaggaatggatctagtgttgggactgagatggatgaactttctgccatttgctgttgttggtcttctgcagatcaatttcgtgctcctgatcagccgccagggcaaggtgaggcttaccaagtggtactcgccttacacccagaaggagaggactaaggtcagcatcctgtactgaattctgtaccaaccactgatcatatgatgctgatgctgtttctctgctctttgagcatcactagcggtggctgttgcttctgttcaatagttagacgatatgctttgtagttcgtgtgatccatgtgccgtggcagggtttgcaacttaggctgtttttgcttaaatgtacactaattaaacaagcatattattctgttctaggatctgtctgtatttagcacccatgtttcagtggaccttatgatgatgatgattcttgtctcatgctcaaaggcacggtattggttcttttttggttccacttgtgggtttaatgtttgcggaaacccgaaagatctgttctgagcccatgaataacactgtaggtgcccactgaacattcttgacagaatacacaaagcctcttcattttattattcttgggtttgcagtgcccaattgcttatgttctgttggtgagctgcactgtactgtttatcttgtatgtaattttctacacttgttgaaaaggttatccgtgagctcagtgggctcattctaacacgcgggccaaaactctgcaactttgttgagtggaagggttacaaggttgtgtacagaaggtatgattccagcatgtcattggtgttctattgtttgactaatcggttatgttgcttcgtggtatcttctaaattagctattttatgttctgtttataattatggtggcaaggtatgcgagcctgtatttctgcatgtgcattgatgctgaggacaatgagctcgaggtccttgaaattatccatcacttcgttgaagtactggaccgatattttggcagcgtgagtgctttgatgctgtttatcatgtagcttctctttcatttgcttgttgtactgctgttttgagtccttgtttcaacctcattaggtatgcgagctggatttgatattcaatttccacaaggtaatatcttttggttctattgaagttgctactacagaggatctaggattggaatttacatgattcttcttgctagtctattgtca

SEQ ID NO: 62187 - DNA, 2520 bp, Oryza sativa
agctagctctataagcaacatcattgccaggctacaaaataaaattctactccagtctgatgtttgctctcttttgttgtgttatattggtaaatgcaatgtactagtccatttggtctgttcagttttctaagatacgtctttcaaggtgccaggattaagaatgaacatgatgtaactacactgtatccgctattttgaaccgaagtcggattttctaagagaaaatgtgcatgagagttgatcatggagagtgcattatcttgagcagttgtgattattccacttattgttcgccttctgtattgcaatgcgtgtaaacatcagttatcaacgtccctgatagctttatattacatgcaacacctgggtaagatgaaatagagcttaggttgtaccttgctgttggcacatgtgaatgtgtttgtgaacactcattgattgtatactggtatatgtgcatcctgaatatccttttcacttatccaccacattgcccgttcagttgctctctgcatgctcacttcaaattggaattcacttcttcacccactattcccctaacccaaggaaaatgtcacactttcattcgttttcacttctcggggcttgtttgcctctataaacacctgcactattgtttcctttcttttctttcttgatgatctttagcctctgatatcaacgagaagttgtgacctaccgactctgagtgagcaagaaaaatagagtgagcatgggagccgttgggagagcaagcattaggacatcaacatatcaaagctaccgttcacttgtctttgcatgcagagagtggaaactttgggcaaagatgccttgcactagaggcaagccagctacactgtgtgactgataatgttgaagatgagacaactcatccacaccgagtagttgatcaggttgaacatgagagacggccttgctgcctccagtgtggatcatggcgaccctgatgttgcatactagaacaataggccgcagttcgattccccgcgttgcccacaaggcctgggcaacgccgatgctacatactagtcgcacgattggaagcattggctgctcgaggagtcggcgctgccctcgtacccattcttatcgacccctttaattgttctaattttggagtgttcatgcaaagtttgattctcggttggtagtgacaatcctcctgtacggtgtcctatcttgtcagatgtcttactcaaatttaatattgccatcttatatagtattggttatattggatctttgaacttttttcttgagtttaatacaaatccctttgtcaatcaatattaactaaaagccatatgcatattaatagactataaacacagttagttttcacattttaacgacctatgtcaatgtcaatcattttgcactatagaataatcttgtatataaggtaagaattcgagggtttgaaaggtatcaacctttgctagcttcctctccattgtcaatttgtcagtatcaatgctcaaaagttgacagcatccatccacagtacgacgctgcatgcctctcctcagttcttgattctaggctacctgataacaacataatcctctctctcgatctcgatgttgtggcttcaaaaaggaaagatgatttttgagaatggaaggcatcgagagaacacttgcaattatagcaaataagagatgttgtaactatgtcgttcttggactttgatactacttgtgaatggctgtggccctccatcgcacgaccattctctctacatttgttttctttgcttctcaccagctccgatatttcttaaagagttaattttgatttttttgctgtaatttatttttcatcattagcttttaaattgctatgaacacatatataaaagttctttcaaaaaattattttggtagctaataaacgatgtaggtgaaatgatagcacttgcatgtggtttgaactccaatgtcccttcaattctcatgaggctcacatgtcaaacttgtgcatctaaaacaggttcagttggccgggaacatatcttatgcacacaactaacaaatatcaccgaaaatatttagaaaatattgtgcatatacttccaatattgttacacatatgtgtaaaatcttaacctcaaatccattatattttaacctaaaaaataaatattataagtccatcagaatttatcttttttccctctttatataggatgaatttgatgatgggacttcacacttagatgtaatattattgaaagcacatgcataacatttttttaatttttagtgatattttttagtttttttaaactaaactggcatgagaactgccaattatatttcattaaacagagtaaaaacccacggtctacagaaaaagaaaaacaacctctcgacgagtagagactcgccgagtcctttatccgcggccggtacaaccatacaacacacggagctccacacaactctagccaaactatcaacgaaacaatggcgcgaatccaacaacgaatat

SEQ ID NO: 62188 - DNA, 4423 bp, Oryza sativa
cctgaagcgccaaaacatgcactggcaacacccacatccctagagagaaactgcagatgttatcattgtcaagcttcgttgcaccccaacgacatagtagttccgactctacccgatagagacaaccgaagaagttggatgccaccaatacaagaaatgagccaagaaggagaaggcctcaccaaacacctaggcatccaatgcatcgagctgacacaggagtccaccaacagtaaacgatgcatgggtaaggttctccaagacgatgcccccaagaaggatatgacatgaaacgccaccaccgtccgtccggaaaccggattatagttttcaactggagattggtagcggtgaagaaaacgccataacgacgccttcaaaacgggaacaatgccaaaggtgtcgccgtcgtcatgccagccaaaggctaagcaaggctttcgccaatgatttccatccagagccactaccgacccacacaacaaccgtcgccgaaccaccacataatctctttagccatcagttagaccagttcaccaccccacggctcaggtagactcacaggcctgctcccgcacgttgccatggcattgccatcctctgcacaagccgccgggtccaccctctcctggagctccccatggccaagacaagatctggccataggagaggaggggctccacgaagagtggtttgctcagctagctgggaagacgggacaccaccaccgccaaccgcttccccgcgcacaccaccaggccagagagaggcagctcctcccccatgcgcccttgacgcacgccgctgagctaggggtgacaactcctcccctcgccgccgcggtccccgctgctcgatcctcgggccaccgcctccacgtggccctcacgccgcggcagccgccgccacctccgcgcggcccttgcgccgcggccactgcctctgagcggccctctcaccgccgcctccgccaccgcgccgcgccactaccgacccgcgcggctcagcccagatccagccaagggggaccgaattcgaactcgacagcgtcggatctagccatcgtcaccagggccgcgctctcgtcctccggtctcgtcggcgccccaaccggttgaccatgagtgagggagaagggggagtcccgccgtcgccgtctttgcagctgcccggcttggcagcgtggcgggggagaggaggggaagggagggggcgacggcgaggttacgccaccaacgtaacctaattgagttcggatattttttagttggtgtgtatggtatatacacgtgaagccttgtgtgcatatgatacgttttcccagttaatcagctccacacaaacgagcttgactagatactaaacggaaccaaacgtgcaccccatgttcaactaaggtcggcatatatgtagaaccttttcaagttctgagtttcttctttccttttagctaagttttcatcaatacttagctccggtggcagattggtgaagcacatgaacaaaaaatttaattttaccccggtctttggagggtagcaaagtacctaattgagtatgcaaaacacaatctgaactctctgaaaaatatgtgtgatctttttgttgtcctaaatttgtcccatagaacatgacgtgatcttgttgttgtcctaaatttgtcccatagaacatgacacaacaatatcattgagcgtattaattagcacctaggaacttggaagagactacgctaatcttagttacacacactcgagaaggttgcagcagcttatacacactgtattaagctgcgacatgatatattccctttttccctggaaactacgaattccctagaagctcaacgagtgttgggcttggctgtcatgtttccgccgcctttgctagcttaggttagttgttgagtgttattgtagttgtgattttgtccagtttttcttaatgaactttgtacggtaagatttggtctcgtttctttttaaaatggacaccttcttatttatataaaacattggcaacgaccttaccattcgggaaggaaaaaaaaccaattaatcaatccctacaacacaagaattaggtagatgtatttgggaacactcattgatttatatgtacattctgcttttttatttcccctcttccatcttccccattgcccattcaattgccatctgcctgatcatgagagggaatttacttcttcaactgctagacccctgacctgatgaactcctttataaacacaagcttgtagcttccctctttctcgacgaccctactctgagtgagaaagaaattaaacagggacaaaccatcgcgacttatgagtatggaaggcgtcaggagagcaagcccttgaaaaccaatcaattggagctatcctgtgcagatttttgcatgcatcttgatgagccatctcaaagaagaagtgcagtttggcgtgctaatcttgttcatcttgatccacggagctagcctaacaacggtggtcttggcaggattagccttcgccgagttggtcgtctcacagttgatctcggcagcctagcagtgtccttcaaccacgctcggacgcaagcacggtaagcagaaaggcgaggctgcgcgggcgttcgttcccgccataaagcttctctccatggtttctggcttgctggctcttcgtccctctcgtgtgttcttaggctgcttgtgcttaaatgtacatttgtaatttattaacaagtgggggtggatgatgagttcttcttctaccagaaattttattttcattcttgttctctgcatattattcagtaataggatcctgaccccagctcctaatctaaactctgtatttttcactgtttgcctgactagtgaattggagagctgtggactgtggttgggatggtagagtgtctgatctttttctgtcattaatggacctctggtttcttttcataatgagatagaagtgtttgtttgtgcccttaaatgttaggagaaacatatcgtgctttcatcatctaaaacctcacttgctgctacttgaacattttaagagttgaagtgggaacttaggttggtacatgcagatgtgtttgtgagcactcattgatatattggtggtatatatatgtgcatcctgaatatccttttcacccacattgctcattcaattgcccctctgcatatatatacacactttaaattggaattcacttcttcacccactactactcccctaagccaatgaattcgttcccatttctctggcctttattcgcctttataaacacctgccctcttgcttcccttctatccggataaaaatccttactcctgatgccaatgagaggttgtgtgtcctatcgactccaattgagcaagaaagacggagatcgagtagagctagtgactgagcatgagaggcgttgggagagcaagcactataaggtcaatactctgaagctatcgtgagcaataatgatgtgtttgcgtgcgctttgctaaattaaagctgtgggcaagaacttcttgaacgagaggtagctacagcgtgtggttgatcaagttactctagagagacggcatggctgccgcccgtatagttggcttggtgtacctacgcccatacaccggcagtgttttcttgctcatgggcagcttcagtgctgtttcttctacctagagtactcttaggagccaaaactttaattagacaagttaggccattttgactttatgtagtcaaattaatctctctaagtttaacatgtttacataaaacatcacagcattttcaataccaaataaacatactatatatcaaaatatattcaatatttggttttaatttggtgttataagagttgttacgtttctccgtaaaatcgatcaaatttatagaagtttaatttataataaaaaatcaaagtgttttgtaatatgaaacagacggagtactagaattttcatgcgtagtttgacctttttcacgatatgtttgccatcttatattgtggtgatactgtatcttgactttttcttgagcttggtatactgtcccctttgtcaattgttaatcgatataattaaaaatcatatgcatgcatacaccatatcaatagatcgtcgtacaaataactgaaggtcaagggtctgatcgaatcagtttagagttctatattgatttgcaaaatctcacttggacacacgttgtgttcatgagtgctagctaatgttttttcctccattttttttttccggagaactccattttcttccccttactttggctgtgttcggcagtggctgttgccatcctctactcctcgttttccgtgcgcacgtttttcaaactgctaaacagtgtgttttttgcaaaaaatttctatacgaaagttgcttaaaaaatattgatccatttttaaga

SEQ ID NO: 62189 - DNA, 7271 bp, Oryza sativa
ccgcgcacactatccccgttgggaacctctagtagcgaacagatagcatggagtttattatctcacccctccatgcatgcactcctctacgccatgaccagtgtgtgtttattctgaatattttttttctacctttttcaccactgcccaatgcccacttcgtttaccttatgctactgttttacttaaaatgcaatttacttcttcacccgctactactttaaccctctatatatcctgagtagagcctcgctacggtgctctccactaatagtagaaaacagtttgaaccgttgatcttatttgagctaaagattcaaaactatttatactaccacccaattagcgatagtagaaacataaaggggtattattgtctaaaagaaataagtgtgaaaagatataatcgttattagcagtgactaaacttttttccctcttttttagctttctcgatgaaatactacttgccaacccagctgctacccttctttctcgatgatccttatattagcttcatgtcagtgagaagtagcaagctagctatctacccaagaaaacatatagaagagtgtgtgagaatggaaggcattgggagagccaacattaggagattaacaagtccgagctatactgtgcacatgttatcatgctcgtcccagatattctgggcaacaattcttcgaattcgcaacagtccagcgtccagggggagataatcagggtgttaacggcctggctgcctcgtatagcctcaccagcctgagaattgcatgcctgggctgggttgatcaggcttcgtgtgcacctggcggcgcatttccctgattttttcatgcctcacctaacctattcactgtattttcctgtttttctgaccagtgaagatcagcatgtggttcttgatgggagaattcatctgatcttttgcatatgttgtgtacctttcggttggctggttatttcatatggttcagtagaggtgtttgtgccctggaatgtcaggaggagcatcatgattcaaaatctcattgtttttacttgtttcttttttcttgttttaatctaatttaagtttaacactcgtacgaaactaccaataaatttgcaaaacctactttgtggtccatgatgcacacaccatgtaccatattctggaataattaatatgctacatctattttgtcctaacaatttgctttctgaatttaataggattcattggtagaggcagctaaagaggaagctaaattaaattattgcgcatgctactaaataaaattatactccagagtctgatgtttgctttattttggtttgttgttatattggtaaatgtaatgtgctagtcaatttggtctgttctgttaactattttcgttgcgataggtttaagaaggaacatgatgtgtaactaaattgtatcttttactttcaactgaaagcagactttctaagggaaaatgtgcatgaaaatggttcatggagtgttgcaaaaattagggggttgctaattcgtgcatacgcgccagcaatggagttggcgcgcaagttggcggcccctcctcctacgcgcgtgttttcttttttctttttctttttccaattttggcacctcccttaccttagcgtgtttttctcaatttttttcccgctgtttctttccgatatttttaatctttcgcacacgtattttcaaatgtagaattgaaaatttttaaatcttgacttgaaagtttttcaatcttaattgatagtttcaaatattgagttgaaagtttttctaatttgagataaaagtcgaaaaaaattgattcgaaaatttaaatttgagttgaaagcttttctagtttcagatgaaaagttgaaaatttttaaaatttgacttaaaaattaaattttgagttgaaagttttaaaatattagattgaaaaatttcaaatctgggttaaaagttttcaaaagttgacttgaaagttttgaaaatttgagttgtaagttttcaaatatgaatttaaagtttcaaattttgtgttgaaaatttcaaatttagagacatgtttaaaaattgagttagaaagttttaaattgtagatgtactcacacgctaattatggcgctaaccacgtggagggcgtggagggtgatgtgtgcatgtgtgggcagtgggcctgcgcatccgaaacgcgcgcgtggtggcttgaccgcgcaacagcaatcctggcaaaaccatgatctgcttataccactcaattgtgctctttgtattgcaatgcctgcagatgttgccacttgttactccctccatttttttttttgacattggttagttcaaaattgaactaatcaatgtcatacattaatttgtgcaaggaggtagtacttgttagtgttcttgtgatagctttgttagtgtattgggaatgcaaattttcatccctcgagaggacatccctcgttgtttgcatgtcatctaaatagctattaaaaaataaaaaaattgacaataattaattcaaccctctatatcatcacaataaaaagaatgttagtctgagacgatcataactcctatgacttgtatataactttgctttcctgctctatcaatatataaggcaatcttcttgactttccctaaagaaacaataaaagaaaatttgggtgataaagagacaccatctcttgtcctgctgcttcttttcattttacttatgtacctcttctgacgggctataccttgtctggtatacacgtcgacggttgttactcctacaattctatgtaccacctcttgctcttgagctatgagctatgttggggttgggaggcatcgggagagcctggtccatccaactgctgcacatcgccaccgtgcggaagtgaccaagagtttgcttcaatacattcggccggctgagagaattcttcctggctaaatgtatttgcctttgtagttcgactgatgataccatggagctctacttatttgcaccttcagcaaaatggaaataccggaccaagtgtgcacggggccattcccgagttctgggactatcacactccgggcccgggtgttcttctcccagtctttcaccgctcgatcgagcatttcttaattattgcttaattaggacgtacctaattaggcgttgctaagtagcttaatttcagtttcatttctctgtgaagtcttcaaatgattctgattgacatatgtgactcaacttgcacatttgcaagaggaaattaaggaagggaaaaattaactcaattcgttgtgaaatggtgtgcaattaagatctccgtagttatacaaagtgactcgattgccttcataagcatcaacccggcctattgcttcctttctttctcgatgatccttagcccgacacgtcaatgagatcatcagaagtctgaagctatatatcaactcgatcggagtgagcaagaaaacacatagaaaagtgttgctgactcgtgagtatgtacataggcatgcatagaaggcatcgggagagcaagcacttgcaacgcaacaagttcaggatgtcccctgcacgcattggcaagcttgcccggaagagtccgtgctacgttgttctgagtcgcgatagcgcaacgccacaggggaggggagccgatcacggcgaacacggtggcctggtagcgtggctgggctgatgagcgcacgtgttcctggctcgtttcctcatttcggcgactaagccagccctagcgcatcacctgggcttgacgggaaatgacaccgggccgatcggggtgggtagaaatgcgctgtggcaagagatgtgtttttctataagagatgtgtggatttaatattgaggtcccatacaaggagcggatctagaagaagatttaagagggactcatctcctttttccttcttcaatctccttactctttattttcttcctattctttcccttttatctcccccttctagcaatggtgatccagcggtgtaggggggacttcacccacgctggatccgcctctggtcccatgtttgatccccatttcgttcccaatttctccataggaaaacgttccaaatctctccctcttttttttataggagtaactaatttttgatttttaatccatgcagcatatattctttttatcttttctactccgttgatttatatatattattcacgaaaatttgtcatgggtattgcaaatcacagtgcttgtaaatgatgtcagattgtcatcagttatgagtttcccttgataacttttatttttacactcaagaactggttaactggttaagattttcgagcattgtccatattcatataaatgttaatgaatctaggcataaatatatatctagattcattaacatatactccctcattccctaaatatttgacgccattgactttttaaaatatgtttggccgttcgtcttattcaaaaaacttttgtgaaatatgtaaaactatatgtatacataaaagtatatttaacaataaattaaatggtaggaaaagaattaataattgcttaaattttttgaataagacaaacggtcaaacatatttaaaaaagtcaacggcgtcaaacatttaaggatgaagggagtatatataaatatgggcaatgctagaaaatcttataatatgaaatggaggaagtagcaatttgcagtccttgagaatgtaccatgagataccaatttttccattataaatttagtatcccttgatatctagatactatgagataccaaatatacaatagaaaaaaaatattacctcatgttatctcctcaattaccgtaccgtaaaaaaaatgctcattgaaaaagtttcctccactgatcctgttacctgttgccctgttagcagtagcagtgatgtgtttgtacgcgagcactcattgattggtactgtttttctttcttttctttttcttggccctcttccaatttcccaataatggctcgtacgttcagctgccctttgcctgtactgtaggcacttctactggaaatcacttcttctcgccaactgcatgctctctcctatataaatgccacctttgataattattcattcataggactcatcggcctttataaacactcacccctgtcgtctcccttctttctctatgatcctcatagcttggtttaatacgaactcctgagtgagaagaaacagatggttaaacatgatttgatctcattgacgagttgtgacttgtgacagctagtgatcagtatgcatgggaggtgtcgcactactagaaaaatcatttgttgtcacgaaaaaaatcgtggcatcaatactaaaattgtggcaatagatatatgttaccacaattgtaaaatcgttgctagccgtggtaataaacagcatggtaataggttattgcaacgatttttattttgtggtaataaatttagatgttgctacggaatgaatgtggcacaaagtcatattacaacacttcacatcgttgtaataaaaattattgccaccactccatatgtagcattagttttacgtaccaaattaaaatttcaaatattaatctatcatcctatctatttatctagatatcttttttattttgtgtcttcgctaggatttgaacccaagacctgtccttcaggtgtgctctcctttatcaactcacctacgcatcaattctattggaaaatgcatatcgttccatttgagcctagctaactgagatttgaatcatatatttgaatatctaaaagatttcaaatgaaaaagttatcacctataaaattgtagatctcgtcgagagctataatttccatataaaatttgtctcaatccgagtccatatgaaaaaaataagttaaattatgagacaacaatttttttattgcaacgaatttgttgatcgtggcaacaaaaaatagtgaaaagtaccatgtactatataaattgccacaaaaattaaaattgtggtgatagaacatgcttttttgcaatagtacgattttttgtggcgatatctcattttttattgcaacaaaagtactaaataaaatagatcgttgcaataaaaaataattatttgccacagaaaaattatcattgcaatagtataatatattgctacgaattatgttttgttgtaataatttggtggcaatagcacaattatcttgtagtgttagggagagaacgcaccatggaatcaaaccattcaagcgctataacctgcttgggtggctgccttagaacactacgtcgcgatgctttggaatcgcgaccatccagcacaagggagacgcaggggctaaccagcaaccagggtccagggtagggcgttctgacgcaactgctactcgatcgcctcatgcttgaatgcttctgccgattcggtctgcacgtacgatttggtccgaaacaacacaacgtgcctcatgcgtgctcgtcatctccgtcaggacatggcaccgctgcatcgcgtgtgcttgtactttgtaccacggtcactgtttgatttagttttttaagttgattattaacacgaatcatccacttgattatatgaataaagtagatattctgtaagaaataaatttaacaaacagtttaaagaagtggtcaactaatgcagtagatatccattttcaatacctactccctccgtattttaatatatgacgccgttgacgttttaatcaacgtttgaccattcatcttattaaaaaaatgtaattatcatttatttcattgtgacttaatttatcatcaaatattttttaagcatgatataaatatttttatatttacataaaaaaatttgaataagacaaataattaaatattgataaaaaagtcaacgacgtcatacattacattaaaatatagagggagtactttattagtacccgcgttcaactctcaatatttttatattgtggtacgaaggtagttggaaagaaaaatgacgtagatatccattttcaaatgagggacgtttataagaggaagggtagttagaagtaagaaccataagatgagaataaatttgaatattagatgattgatgcgacaagaactgctactgtaggatgttattaactacgcatcctaaccttattcaaggtcttcgatgttgcgcaatattaactactccatccgacccataaagactacatgtctaacgttcaaaatttgtctcaaagacttcatttacagggtttacatgaacttcaatacatttggtcagctgagaaacttctt

SEQ ID NO: 62190 - DNA, 3935 bp, Oryza sativa
ttagcttgatatcaatgagaaattgcaagttatcaactctaaagtgagcaaaaatattaaacagagaaaagagttgtgagtatggaaggcatcaggagagctagcaccaggagagccacaacgacgagctatcctgtgcgcgtgtttgcatgtttcctcgtgagaccatggacacggagcctttctgatcccaacagtcttgtgctgcggggaggccaaattgcgggatgatggcttggctaccgcaaatatgagctgcatcagcgtgagaatcgcgtgcctgagccgaccaagctacctgagatggggtcttccagcgttctctattccgttggttctcctgcccatacttgtcgatcattaggagcgcaaggaaaccgatcgttgggtcgaaatcatattctatcctagagtttccttcgaaagcatgcaaacccatgcacgtgatagctttgtactgatcgcgcaagtttgcatgatttcaaaggaaacactgggatatagtatgatttcaactcacgatagggtagccaatctgcgctagaaaggccagaatgccattctcatgagtcacacagcccaggcgcctcgtgcctcagctgtccaggccgtacgtgtaggcgcgcttaattacctgcctagcttgttctcccgcactggttcgagctagcgtgaactccacaatggctgggttgcaccggcttgctcaagtgtggctacgtagcctccttccttgtcccctttgctcccattttccagtgttgtccgtcgagcatgcatgcatatcactattatttcatttttatcattcggtattataaactaacatggagatggactttcatctctcaaggggcatacccatttcttacatatatgcatgccacacctaaataatcatgaaagtttttaacaagatagattaatataaggtatatcactttacaaacatataaattcaaatttaacttctataattataccagaaataatctatcttttttttaaagaaacaaaaataatctatcttgttaattctatgggctgctctcatttcatcatgtagaaaacattgctacatcatgtagaaaacattgctagacttacgatcaattctccctttcatcttatttatatggacaattttattatccttaaaaaggtatcaggaggtattacattttctattataaaacttgataccttatatatatatatatactagatgtcttgacgtaccaaaatttctgaagcaaaggtacctacaattactttctcttatgacccagctgtaccttcattgctatacacacacatcacctcctgctgcttccagtggcggagccgagaattgatcacgctagggccgattagggctaagttgatgtgttcttagtaaaactctttatatcttcagctttttatagtattttgcataacattttaatggaaatttggtcctaagcctagggcctaagccctaattgccccacccttgtctctgcccctagctgcttctacagttgagccatactttgtatgcattacactgtgctacatcgaactctcattgggtatggtaggcatcgggagagccttgtcgatcccacagcagcacatggcccccaagcccctagaacaacggcgcttgcctcaaaatgcagtttgcctccacatgtttggtatagggtgacacccttctttctggcagtagttcgaacactctttggaggcaaagcttccacagaaaatgttccggcctccagcaaattaaaatggaagcggcaaaaatacacgcctgaagccctatgcacggatgtattgaggggatgttcttctactggagtctaccttacgcatgcagcaggccttatgtaacgtgatgagagattttagcttgcagtttaagagaaaaatatatggcttgttagtttgtgaaatggtgtactgttaagatcgatctcgacaactgttattgaaagaaatatttttcagtgatcatttttacggtgagttttacaatggtccagaccattcatatgtttaatctaatggattcatatatttaatccaatggattgtatctattcatactatcaggtagtaaaatacctttttatatcaacataaaacttataaatcaacattgagatcatttctatcattgatactactatagtaaaatattactggtagagatcaacgattctcttgaacaaatttccgtagttttggatgacgcactagctaggatcgtaggttgccttgaccattctaaatatgattatttagactatgaaaaaaaaaagaatctataccgattatattaccagtagtgatcatcgtaaaatatctctatttgtattaccacacacggtactagaatatttttcactaatagtgtagaaatataaatcagtaaatcaatagaggatttacaatgctctctattggtaggaaaataccaccagtgttatcatcagtagaagtaatcttgaccattgatttacgactccactattagtagtagttgatgcagatgtggtaatataaataaaaaataaaatttattggattaaaaagagataaatagtctatattagctttactgatagtaaaaagaattgcccactttctctgataacatcaaacgtttcgtgcgcccagttagacgcagcttcagtctctatatatatgtgcacacaacttgcacctgagtcggatactcctgtgatcgaagcgttgctctaataatacaacaaatcaagtggttgatcaagtaaggtgtaagagaaaatgattgatgtatcaaggggcttaattcttttggcatatattgggaatggaaggaaccaggagaaattctaccacgatattctggatcagcctcacgggaatttcttgagaattttcttgtttgagaagaatttcaggtagcttttcgcttgatggagcaacaacagtatatctgaataatgctgacatggactgcattggctggtgtgtagatgatcctagcaaatgtgatagacctcctctcagctcaagactgacgccagcaggaggcaaggcatgtatcgttgatacaacttcctgctcgagaacttctctgaaaatcccaaatcctgaattaatgtagcgattcgatgtagagcatcaccactcactgagtcactgtggttgcattggtccaatcgacgattaatgcacagacatgttcatcacatatatccccttaaacgccttttgcgatatgatcaccatggcatcaattcgttgtaactagaagacatgaaagtgttcgtaaatttgacatacgtatgtcaagatcacgtgaaaacaaatatagtccctgtgttttgaattacttattattctagtaaacttcacataaacctacattgttatcctcgttaaatacatcccagttattttttttcaaaccatatgatccaacggaaattgtgactctattaatatatacctgcattgatgaagggtagagaggaaagatcacgtctaaagtgctttggaatatgagaaaatattttggcacaaaatttaaatgctagacagattaatagcaataagaaacataggaaataacttaattaatttgcaaaaccaacacggcaacaccttatctttttgtcatcttactatcttagccatgtccccatatattagcaattttacggtttttgaggagataccatcaggtatcactttttctattgtaaatttggtatcgtaaatttggtatctatcgatttctaggtgctataagatactaaattcttgtatctcatgataactcctcaaggaacgtaaaatcgaactcccatatatactacacttcttcatgcctcacatgcccttcgtctgcattatcaactacgtgatcccatctcgacatcagttcgacatacaagtta

SEQ ID NO: 62191 - DNA, 5006 bp, Oryza sativa
attagaaaaaaggatatcttgatgagtttcaagaacagatcgatcgaactatatatggatgacaagaaaatactgatcatgactgagaacgggaggcgtcaggagatgttctgttctgctggaaacgtgggacagtatccagacacaaaaaagttggaattcggctggagcattcgctactaaactcaaaagtgagcgtccgactcctctcgtagagacggccaacaccggttgtcccatgcgcatgatgtgatgagtagagagtatagtagcaagtagaataccaatagcggcagcagagatatcacaattgcaacaattcaccgttcaagcatggagtcgaggaagaaattatgtttaatgattgatagatcatcaagaacgtagtttgcaatatgttgggaataatggaaggaaccatgagaaattcaatctgccacatgagaaattcaatctgccactaatcgatggatcttgctcacggattggggattttttttgtttttgttttttgggttcactggagatattccaccgtagcctttcgctcggaggaacaacaaccgtagcctaaaaactgcaccggcttgtgcgtcatcgtcaatgatcgatcctagcaagcatgcatgaactactcgcggttgtattgagcctaggccttacgctgtgcttgaatttgtatttttaattgtaaactcagcctatcatggagagagatacgcacataggccacaacggattttttttatttattaaattttttacaaatctacacctacacggtatatgggagggtgttttttaaaatacgtcctccaaaagaacgtttcttataatgtgacacgtgatcgttattgtaacgccccgacatttgttagctataaacacagctaactcacaccggggtgttatgcattacctgtgatatagtaccagtcccaggatacactagctgatactcacagaataaatgtggaatcaaagtaaactgctttattacatcactgggtagtagtccttataaacgttgctatcatggacatgcccatagatgaacaacacaacattacagaaaaacacaaaagcgacggcgcagaaatgaatagcacggagaactaagcaactaagcgactacgcactaggcaaagaacctagacaactaacttatttcacaggcgaggcttggggctaggcacgaaacatctaaaagtcttcatactcggcttgctcctggagatacttctcggcggtcgggtcgacgtcttcatcttcaaactctatagattattataaggggcaagggtgagtacttaacgtacttagcaagccagggaaaagaatgacatgtcggtttaacaaggaggctacggttttatttgcgaaggctgccattttggcaaaatgatttatttcacaaaattcctagtgagtgagtcaagttttagttgtcgagaggaggctcacgcctcgacccattccacaagttgctttgcaacaacttgtcacaattaacgaacaacaattaaattgttttctctattagttcctttttcacaacaacacagttcatacaaatatcctggttatcccagcacatcaacgtcatcatggccctaacaacaccttggtgtcggacgacaccccaggtcacacagacccgttcctaaccacaaaagttagccgtctgccacacaggcggactctggtaacgttcctttttcagtaaccacttttccacaaacctttgtcaaacaaatctacgctatgagaaacaccttacactcgcccttgaccgtgggcacggctgttcgaacagttcattaatctctgcagaggttgcacgctttacccacacgacacgaaacttacaccggtactggccggtaccggaagttcgtgataaggcctttccaaagctaacccatgaaaatcacataccacctagttgggctaaaatccatagccgagtatcaggcaatgacagccgtcatccactcaggaaataccgaggatgcctcctactcctactggtaccacgccacaatagaggcaaaaagacacccatgatgggcaataaatgtgtaacacttcgtttcctcatcctcggtattccacaaccattggcacaccaactcccatgtgaaaacaatttactcaaccagaggcatcccataaatactcgtgtggtcgcattgtaacgtgttcggatggatttcccaaaggaatcggtccttaacgacaatacgtggccaaaccacaaaggcttgactccgcatcatcaccactttcacaacacattttatttcacaactcctcggtacaacgtaccggatttttaatcaggtaatttggaataacccaagtttcccacacggcaacaacgtaagcatggctaagcgaaactacctcggtaatcgtgtaacgataccagcgcaaacatttgtggagctatcaaaggtatggaaacatcaacctatgtaatataaatgcgactactaggttggtccgtcggttgttaaaacaatccgaggcctaaacatgttaatcgtgtatgctaagtaatgcacttttcaaacaacatatctttgcaaatatagaggcaaagtgaccaaagaggtttgccttgcacagggttggggtcttctcattcgaaagcggcgtccggagcttcctcgaactcgggctcttaacgcgaaaacaaagctaataaacaaaaggcaataaaacaagctcaaaccagagaaacaatagcaccactgtgtagatctcaattttagaaaaatttaggaacttaacggggtcaatcggagttatggttgatttactatgaattttcaaaggataaatggtttttctagaatttcatttattggacggcaagagaatattccgttggaatattccgctagactaacagcaaagggagggggcccacctgtcagcggccaatggaggaaaggaggcgcgggcccggcttgtcagcggcttgagagaggaaagggaggtggggccggcttggcagtggttgaggaggtcttcttcctcctccacgcgctgctctatcccagtcccgggcagcgatgtgccgtggcggcgaggctcggctcggcagccggcgaccggggaggcggcggagaattccggcggatctccggcgaggcaccgccggcgacggcggcgctagaaggcgcggcacagcggctatagacggcaacacagagaggagaacgagcaaaagtgagagaggagagagagagatggtgatggtgtggggagaaggagctcgggctgcttccccttttataggcgagcgacgcggtggcgagctggcggtctaggcgcggcattccgggcgtagatggctagcagctagggcgggattccggggcggacgagatggcgatgcgacgacattgcgtcatgcaccggtggcgacgcgatgtgaagcgacgcactaagacagacgatggacggcgatggtgatggcgcgacgcgacgcgaagagacgtgcggagagcgagtttggcaacgggataaggatgacgcacggccgacggcggctatggccggaaattgggcggtagggttctcagatcgatgcgacgcgagcgacgtcacacggcggtggcgatggaacgcgagagagagggagagacgcggctcggcgacttcccggaaggagacagtcgacaagacgacgaggcgacagcgaagggacgcgcgtccacggatgtgaggcggcgacgcgatggccaaggtgacggcgcgaggcgacggaagcggcgtcatgcggcggtggcgacaagacgcgagagaaagagagagagagagagagagagacgcagctcggaggctaagctccttcctcacgaagcaacgagaacggataagggagatgatcggataagagaatgactcggcctagggttagggatgacgacgagtgaggtggcggccgttatccgtcggggtcgatgcaacgggcgacgggatagatggagtggacggcgacgggacggggtgacgcgaggcgacgtggctccgtgtctcccggagagaaaccggagcgaggtcgggcttggcgcgacgcgattttggcgtggcgcggcctcggcctggtgcggaggcggtgcggcgcgggtgttggcacgacgcgcggcgcacgggagggtgttttggtgcaacacacggctcagcacgactcggcgtccgggcgaaacatttcgtcgaacaccttgtgtgcacgtggctagctgcctcaaggaagaagaaggtgaataggagctaggctgggctggccgactggggaggagaagagttgggccgaggggaaaagaaagagaggatgaggcccgaactgaacagtactgcttcacaatttcgcaaggatttgtagagtttgaattttgaggagatttcaaaggatttgaatttgaatttgacctaggatctcacagaaattttaaaggcaattctaagagaggatttgagatctatttggcacaaaatcaactaagaaccaaattaactccaaaattttaaatgacaagatttttaaataaaagcaaataaaatacgggtgctacagttatcgcatgctaacggccacgtagcagagcggcaaagggattggttgtaaaatggtcagtttcccctctgctcggttgtcaaaatacgctcacaaacgtgtaccacatcattaaaaaggttctttgggaggaataaaaacgctctcctaattaaagagcggtagtaatgtagattttatagaactatgaaaaaatattttaataaataaaatgaaaattttaaaaatttcagccacagccactggtggagaaaccatctttggtcagtcgaccaaaatatataatattcctggttgcaataaaaaccgggactaaaaatatctttagtcccggttcaaaaggttagagttttttttatctttagtcctggttggtaataccaaccggaacaaaagatctatttttagtcccggttgg

SEQ ID NO: 62192 - DNA, 13110 bp, Oryza sativa
ggcaacgggctttttttttcttctttttaaaatttgtgattcggatctgtgtatttaatttgtgtgtgatgtgaatgtgatgtatctgtgatgaactttgtaaaatttgtgatgtatctgtgatgtatcgaattggggagttgaggatttgaggatttggggataatttatttgggattttgggatgtggatggggtgaaatcaatataatgaagaaaagaaaataataatcgagcaaccggggctagactagctctatctttagtcccggttttttactcccggtttttttatccgggactaaagatagtgatctacagggggttacgaaccgggagtaaaacccctttctccaccagtagcgtactctagatagtttacaaagtactgcctctggtacttgttttgatttatagcatttttttatgggacattagtccttgaccaatcatatttagccagatctgaattatttttcattttatctgtactttatatccctaatttggatcacatctcgacactccactagtaagatagtgtggttgttgtatctgccattttcatactcaaaagaaaaaaaaacaacctagtcaatgatgggacataatctaatacagtgaatttggacgtggttatatccatattcgttaaatgccacgttgtctaggttaaatgctccactaagttatgtctcattgttgtctagattggttttttgggacagaatgagtatatcataaaagaagtaattatagtggggattgtctgtggtactactgtacctgcggtagttgccgctgacacgtaggaccacccgtcacccgtcaaccactgctactatgggtgggcattcggtctaaccgaaaaatttggttcggttcctcggtctttttgaaaattcggtctttgtaatctcaagaccgaactaaccataaaaacagcaaaaacatagcaaatcaacaaaactatctgtaaaaacagcaaaaacaaagcaaatcaacaattagtggagacggcgcccggcggtggaggcggcggcggcgcgccggctggaggcggcgcccggcgatggaagtggaggcgcgccggcgctggaggcggaagcggcgcctggcgatggagcgaaggaggatgcggatgggatggagacgggacggcgccgcaccaagatggatggggatgaaacgatgcttgtgacgcacctgcccctagggtttcttattagtgggcttattgggccaactagatctattgagcctaattcggttatttcggttaattcggttaattgaggcccatgaccgaataaaccgaatatatttcggtctttcaatagttgagaccgaattatagaccaaatttttcggtctcggtcttttcggttcggttctttggttcggttttattctgcccacccctaactgctactatagatgcagtactacagaatatccgtgtccaagtaatcaaatgaatttaatttgttgccatcaccaaccaattaaccactttcctctcaaaagaaaagaaagaaagaaagaaagaaaagaaataatggttagtcctctcttgacccagtactcatcaaccagctgcctagcatgcttcggcctctatatatacacggtctctgctcactattttcatcctttgcttcttcattctacacactctgcactaacagagaaatgaaacttagcacatgaatagaacaacgtagtgaaaaaaatgattgagagctttgggctcttagaaatggaagtcatcaggagaattcctgtcagaaaggtttgtgatcatttttctttttcttcggaagatcctcttttagtccttaacagcagatacgatgcggcaaaaatgtgtagccattaaaatgtaaaactgtcaggtctgaaaaaaacttgagtttggcaccaattagttagaaggatgtgaaactgaaaacggccatcgttccttaactttgtagagaaaaatgccgttcgatccagagtacttccgtagagtgcaacaaaatatgaatgcaaatcaaattagttcatttagtaatatcctgggtacgaactgtaacctgtacgcatgcatttcaactacttgaagatctaatatcgtttttcttttctccacaggaacaatcacatgtctcatggttagcgccacatcatcgtcactagtacagctcgccgtaaaagccagacagagttcgtccacgtcgacagtagcagtggcggagctacagagaattggaggggtgcagtattcaatcaggtgtccatacccatcgagccatatagatttttcaagtaatatattgtactaaataattatgcctcccattaaatatttaaaaaggaaatcaatatgtgatgccaattatatcaaaattaagaggagtgcaatgataaaaatactgtactgaccaatgtgagtaaatgcattatactagcaaaaccgaaatgcattgccccaacctccatgttagctcttaactaaaaaagcttatgaactattcacgtcaaatagatacatcatacattatcttctactatttatgactctacatttaatttttttaatgcttgttaaacagtaaggcaaacctggatatttatatatattcctttcacactgttggcttgttctatcggccacttcttttataaaaaaaaatcccaaaaaatcacctatacagcattgacaaatagtccgcaattttcgggagtatgatctaatccatcaggagccttgttatgaacacattagtgcattgaagccttcctagtagcacctgttcggcctggtgatctgcaatgcacgcactggactttacgtcttcgtggcttaattctcggtctgggggtacacatacgtgagccaagggggtgcccacatagtcattagggggtattaatcactaattttactttcctagtcgggttcctaggaacacctggggactacatagctttgcccctggacagcagggtgacgtggttgcacgcgatcatcgagcaacacaacgggcaattctaccatgatcaaacaaggccttacagaaaaaaaaagttatttcgataataacgcttgaattttcatcaaatttaaatttttttagcaaaatttgctacagtgcatcgaaaaaacgtgtaattagctcatggacaccgcaaaaatgagaatttgctatcgggcataaaaaaaacgtgtaattagctcctagacactcggacgttattttattatttcctgtgaatttgctatcgggtataaaaaaacgtgtaatttgcgatcgcgtcctcgacggctgctgtctcttccaccggccaaccacaccaccctgatgtggaccaggatgcgttctgtccggcctactccacaagttgtgctattgactgatgcacctgtgcaagtccatgagatatttcgttcttcctgcggagaaaacaatattaattagatgatcagtagtttgcctggatgaaaattttgaaatttgtattcacagaacattggtaaaaaagaacaaatctgattaaatatttatattttgctgcaaaactcttaatcaattgataatttttcctagtcagaaaatgcatgatggtctgcttcggatccacatcctttcaactgattaattagtgtcaaactaacgaatttctcttaagtgcttagatctcatggtctaacattttaatcaggggcggaggagtcggtatggcgctcgccataccttgatctcccgccggacccccccccctcctgcagcgaatcccaggtcccagggcggtgactcacatggcgatggcggcatcgctccgagccggcggcgaggcatccaactgccgattgccgaagccaatcctgcccacagcccacgtgcgaacaggccaaccaattaggcttttttttggtgtaaatgggccttttcacctgttgaacatgaaaccctaactccaaaattccccatcccccattccccaatccaatccgggcatccgactgaggaggcaagcgccgacggccgacgacgacactgtgactctgcgacagggagctgcgatggccggtgggggctcggcagctggcggggtaggcgggtgcgcggccacgctgggaggcaggcagcagctagccggccagggccaggcagcggcgcggcggcgtgggcgtgctgcggtgcggccgcgggaggcaggcggccagcgcagcagggcagccggcaacaagcagtgagccacagagccagtgaggcaggcagaggagagaccgagagaggatacatattcttcaaaagttcaaatggatagaaagagaaaaggaaaagcattgtcttcacaaagaggtacatattcttcaaatgctgacaattttagaacatttttgcatttgtttcatttgttttgcatatttgaagagttattggacctggggctcttgtagtgcatgcccaagtactcatggaagccaaaatgttgcagtagagatggaggaggaggaggggcagatggaggagcatgttgtccaagagcttggggaagaacgtgttgaagagaattttgaaggtataactaagttcaacccagattacattggctgtgtttagatccaaagtttggatccaaacttcagtccttttccattacatcaacctgtcatacacacacaacttttcagtcacatgatctccaatttcaaccaaaattcaaactttggatccaactaaacacagccattatgtctgatctggggcttcgcgctagtccatgggtcacaccgccatatctagatttttttccatcctccgccactgattttaatagaggtacattcttcccacatggtatatatgtaccatgcgcactcgtgaaagagtcgatgcgatagcagttttttagagtaattatcacgtacatttctcataggaatgctcctgatgccttccagtcccaaaaattaacacaaagctctctatcatttccttcgctatattgttctattcatgcagcttcattttctatgttagtgtgagtgtgtgcaaatgaaggggcaaggatgcagcaattgagcagaaagaatgtactactccgtatatatagaggctgaaactagcattagtgttagagtttgtgtcgaacatgtgtacaaaatcggttacagtttaggacttagagttgtactaggtataggaatagagtatgagtcggactatatcctaggatctctcataaatagaggggcgtgcctcttgtaaccgcatggcgacttagcacagcgagagggagcggctgccggcagtgaccagccgtgagtcgttgtaactctgatacgctgtaatatgctagatcggggaggaacgcccgcaatcagtgacccagagatgtaggcctcggcagaacttcgttatcaaatatcgtgcctcagtgtcgtcatcgtatttggatcttctatggcgtttcttccgcgtttggtttccgatgtgatttgggggccggttttataacagagacttcaagttggcaccttttggggagaaagtaatttggtttttgtatggtgtattggtgtacaccatcgtcttcaagggcattcgtaattttcaatcacattgaaagcaagcgaaaagaaaaaagaatcttattttccatgagtgcgtaatagtaagtaaatcgtcaaaaaaaaaactggagcgacctaagcaccaagattctagtttatcttatgtttccattcaaaaaaaaagtttattttatgttcatgtctgatgattttaccgaagttttttgcgtatgaactgcttgattgaagatgtaattacatcatttttcttttatgcaggaccaactaaatccctgtagcacccgttccgtcgtggcgcctagcgggaaaattatctcttaaaaaccctaattgcgaaatttgtttctttgcttgttgtctagtgtccgtgccatctcaagatctcaatccccgatctatcgtcgagttcaattccgaatccaattccttccaaatcgaatccctccgcaaaagtctagtttgcctcccccgggttcgatgggccgaattccgctcggcccatctcttccccggccccctctctcccgggcgctccctctctctctctctctcgctttccccggcgcgtttccccccctgctcgctgctcgcgcgtgcgagagccgcgccgagcgccccctcctctcgcgtgagctccccgctcgcaaagccggccccgcgcgccgtcgctcgcgcgcgcgcccgcgtggcttcccgcccgagacgcgtcgtctgcgccgtccgcgtcgcccggtcccgctgcccagccgcgccgcccgttgtttcccgcgcgcgcgtgccgagtggccgaccgcccggtcgccgccgccgtcaccctctgccgcgccagcccgcgcctgtcgcccgtgtcgtcgcgccgctccaaaccgccccgccgtcatcgccgtcgtcatcgcccggcccccgccactccgcgcgctagcctccaaggggcggaggcagagagcccctctccctctgccgagtcgccccgctccctccttttcccgaatcggcaaaggggcgagccccctttctctccctccttctcctctttttctcccctttttcccctctcgccggcgtcacctcctgtcgccgctttggacgctagccggagcgccagctcgccggcttgaccgcccatgtcggttcccctctctcaaaccgacattgccgcccttttaaacccgtcttccccctcccttcctttcctctcccattcgcctcctcaccgttgccgccgctcccgtgctctgcctcgcctccgccgtccatcgccaagcgccgggagagccggttcgttcgtggacgcggaaggggactccgggcgcgccctcttcttcctcttcctcagcccgaggccggagagattactcccgcgccgccggcctctcgtcacagcgcccctcctcttctcggtaatgtctctctccgttcttcctcctcgctccatctcctccccctagctttcggtagtagcttgagtagactccccgtagttagccggcgccgccccgaccgttgccgtcgctcgccgtgtgctcgccgccgtcgccgcccgagctccgtagcacccgctcgtcgccggcctcgctcggcgtagttccgtccaatccgacgctagcgtcgagttcccgacgccgcgtagatgctctcaccgctgggaatcgacctctcgtgacctcgtcgccgtttccctcttctcccgccgccggttgccgccgccgcaatccgccgccgtcgagcaacctccggcgaatccgagccgttggctcgtctccccttgtcacgtgcaaccgcccggtgtgcacgcttttgcccgtatcgccgtggttcgctccgccgctcgccgccgccgcccgccgtccattcgaggccgggtcgtcgtctacctcccgccggcccgcgtggcagccacgtaggcgccacgtcggcgccagctcagccagaccgggtcgggccgaccccggtcggtccctccgcgtgcgcgcgatccaccgcgagccgtgaggctgcgcgtgggcccgccgcacctgcgtccaccgcggaccgcgcgcatgcaccgcgtcccgtccccgcccgcgcgcgtgcgtcgcatgctccctccgcacggtgagccgagccgctgacaagcgggtcccacccgggaccgcgcgtggtgagcccggtccaccggctctctatctcctccctcccgcgcgcgcgcgagtttgggccgccttgggccagccggcccatttagctcggccggaccgctccatttctcttgggccgcgccctagccgtccgagaaaagtctatattccctccctcccttcttttcttttttctttttcaaaaaggatttaaataaatcctttttcctttagaccaaaaatccaataatcttagaaattcaatatcttcccaaccgtaaatccgattgactccgttcaacttccaaaattcctcaaatctcgagatctatctaatgacacgcttagaggtcattaatagggctttattttcgccgtttgttgagttgtcctgtttcgcgtgtagtttcggagcccgaagatccgcagtgcgaggatttcgaggatcaagctccggatctcgagcaaggcaagccacctttgaacatcttgagcctatatttgaaatttaattatattgcttgcgaaatattattcattgataggatcacacttaatctgttgtcccgtctgcaaggcagattggcagacctacctaatttgttacatttgatccttcctttgttaattgttataccatgtccccttgtaaccacccagttgcacctcgatattcgtgcactctgtgcgagtatcgacggtcgccttcgaacttaaaatctgagtaacaacttgggtaaaactggagttttacaaaagacttggaaaacccgacacccgggtcggtgcttgcgaactaaatgaatttccaaaaccgcggaccggggaacgtacggggtgtacggtttcccgctctcgcacttaaggaccgattccttggaatttcatccaaacataagacaagtacaaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgacccgggttagtaatgtcgtgtgggtaaagtgtaccccctctgcagaggtcattgaactgttcgaacagccgtgcccacggtcaagcgcggatgtgaggtgattcctagcgtagttttgtttgactactgcttgtgaaattgctgttgtgaaaaggggttcgatgtttgaaaaatctgtagctgatgggatcagctaggcccgggtggccgtttgaaaagttgttggcccgggtggccgtttgaaaagttgttggcccgggaggccgtttgaaaagctgttggccggatgccagctgttggccgtttgtaaaactccagttgcacctcgatattcatgcactctgtgcgagtatcgacggtcgccttcgaacttaaaatctgagtaacaacttgggtaaaactggagttttacaaaagacttggaaaacccgacacccgggtcggtgcttgcgaactaaatgaatttccaaaaccgcggaccggggaacgtaccgggtgtacggtttcccgctctcgcacttaaggaccgattccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagttggaagtctcccgacgtggctgatccccacgggctgggtgacccgggttagtaatgtcgtgtgggtaaagtgtaccccctctgcagaggtcattgaactgttcgaacagccgtgcccacggtcaagggcggatgtgaggtgattcctagcgtagttttgtttgactactgcttgtgaaattgctgttgtgaaaaggggttcgatgtttgaaaaatctgtagctgatgggatcagctaggcccgggtggccgtttgaaaagttgttggcccgggtggccgtttgaaaagttgttggcccgggaggccgtttgaaaagctgttggccgaatgccaaccctgtttcaagatctaaagactgatacattgcacatactccgaccggacgagacgcactgtcccatccgtgtcgtttgagaagcactcacctagtcgttttagaaaaagagttcaaataaaaccaaattgcaaaaacaacagccttcccctggcttgctgagtactcccgtactcacccttgttctatataaatatcccccccccagttgctgaagaagatgaagcggatcctgctgacgaggagttcttccaggagcaagtcggctacgatgagttttagggtttcggcctagttcccaagtcgcgcctgtgatgattggtccaagtcctggcttccgctttccttttgtaatgcagttgtgagctcgggatcagtccgcagcccaacatgactgtacttctactctataataaagagacctctgttgctgtgatactctgtctccctgtgataccagcattgtttcctgggactggtatcgattaacaggttaatttggagcgtcacgggctagttccggtcgggactagttcggggcgtgacaatcccttacacaagggtaggatggttgatggagtttaggaatttggttaccgacagttcatgtcagtactaggtgttttcagtttcctaggtcatgttatgcaggaccgcggcaccagtcgtctctctagatgaggtacaaaatgcttaatttgtggcactaaccagacaccagcgcgatatagattgatgctggactagtcgatggcatgatacagtccacactgacgatcagactcagttcttgaatccaagctagactctggaacaaacgttttagattctaagttttttcataactagacgagttgatcaggattggggatttgctggattagactcggccattttggcattattggaagaaactacggttgagcaggatgatctcgtcgttgcaaaacttgtagccagatgagtaaacatttgtggttgattgcatagataaagctagcattaacgaatgcttttaggagtagagttcgtctcaaatacgaagagaaggatgtacaattcctggaaaaagaaaagatttgcagttattttggcagcgtattcatatgcagctattcaagtatttgagaaattaaatagcataaaaatgaccaattagccaggcccaaaattggccatgtatattcatcttataatgcaaaggccggacgctgcccattatatatataaaaaaaagccaggcccaaaaagaaaacgagcacaacataaaaggaacaaaggttgctgtaatttcaacaatgctagctcttttctgaaactttttccatcaattcgatcctaccaactctgcttaaactcttcttggatctctgacaactaacgtgcagccaacaggccagccatcttctttatatatacatggcctcattcatggctgcttctcacctcatcctctgaatctgatccatcaaataccttgtctaatgcctgataactgagaagtgacagaagaagacgctgtcatattgtacactgatagaacagctgtgcttgagtgtagctgggtgagaaatgtttgagcattgcattggcctcctactaggagtggaaggcatccggataatttctgagaaaggtgcttgatcaatcgttctctactgaaaaatcaagtaccaccaaaccacacataaaactactgtcatcaaagattctagctttctcagacaatgagaagcaccacgaataattatatatagtctatcctctattttcttcgtgataatttactaactgggttcctttttttttgaaaaagaatttcactaactcggtatgcctgtaaactacttgattggagatataacatcactatttttgtctctttttgcaggagctgcacatgggatgtacgtggctatattggtactagctatgttaataagtgggacatgatttcatcgtccgggttctcctcgtagattatgtcctctacatcaaagtattcaagtcattgtcgtcgaggctctcatctcatcctcgcagtcgatttccgcctcgtcatcgaagatttcatcatccggattctcctagcagattctatcatctacatcatagcattcaatgtcacttaggcaaccaataggactgtacgatgccaagcgttgctagttttatattagagcaattttacagttattgaggaggtatatacctgctaaggacagtaaaatttattttttatattatattataagtaggggaaaaactttatataaccacccagggtgaagaaaagaaaaaaaaggaaaaggaaaggcaaaactacatcagaacatgctagggcgcattatctataaaaaaaagggggggagggcatgctagggcgctattctcgttgtctttcatggggttgtacgtgtcaagttaaatggttgggtaactagcaagctagctgtaaactatggctatggctagttaacgtatattcacagttaaatttatttttacgttgtaacctatagaagttaaattagatcttgcatgtttgtagagtgattttcacatattaatatgtcttgttgattttcttttaaaaaaatttataattatttagatgacatgcaaacaacgagtaaatgtcctctcgaaaatttataatagtttaccaagtgtgatattatcttcactttcactgaagtagtttacgtgtatctgtgtatgcacggtttactgtttatttttcacgctgcacagaacattactaaaaaaataactaatttgattaattattcatgttttgctgcagtatgctgaattgccaatcaattattttttctgctttgcaaatgaatggcgggctctctttcttgtatcgtcaccattccggccgccatcgcccacatcccctcgcccctaccgtcgtcgtctccactcccaccgacatcgctgtccccgccgccagctgccaccctaccaggatctggcagtcaccatcgccgctgcactagaggctcccctggccgcccgcacagggagaggcgtgaagcccaaccgccgccgccgtccttgcaggtacatggctctgcggccactacggcggtggcgaggcggaagaggaa

SEQ ID NO: 62193 - DNA, 14154 bp, Oryza sativa
cgcccctgggggagagcgacgcacatgaatgctgttgaaaccttatttatgtttgtgagttggagacacaatggacgaattgtgacgttcgggacttcggggtacgctgtgcgtgtaggggttgtcaatattcagttttaaaacttaagattctatatggacattcatccaaagtttagaggatgcatgcaattctttttattatagttatgaatattacatatcattgactgtctgagcaagcaatatatttgtgtgattaaggagagaaggattagactggccgacatatgtcaagaaaggggataatggggagtggattctaatccctcgaggggacatcccctcgtatacctttttctttcaaatttgatacaaatagttgtgaaaaattctaaaaaaaattgacaatgtagagtataatgatacctactagtccaccaaaattcatgttccaattcgatctacacatcgagaaaaaaaaagacaaatttagatataaacagtacgctactattcatacgctgaatttgtcttttttatatctcgaagtgtgagttgagtttggacttaagattttgtgaagttgtatatatgtgttgtatgaatgttgtcaaatttttccagaatttttcataaccgtttaaatgatttttgagcaaacgagggaacatcccctcgagggattagaatagtttcccgggataatgcgcaacgctacttgatgggggacaaaactacagtaaaaatcgaatcgttcttgactattttggtcttttggagatgttcgatcgagcaacccaatgatgcaaatcccatgtaaaaaaaacaaatatagatttgtttttttcaaaaagaagttaaaatctttgtctcgtatgtattgataaagcaggagaaaaacaaacaaagtaaggtgttatttacaggccttgccggaaaaaaacatcacattatactccctccggttttattttaattgacgctttggacaatgacatgctctacgagacatacctttgaccttatttttctattataatatatacaataaataaatgcatgtttacttttattatagtgttttgaaagacaaatctatatatgtttttctagtttctttgaactaaatatttttaaagttattgattgttaaagttataaaagtttaacctcaatcttgtctaaaactttaattaatatagaaccagagggagtaatggatacgaagattaagaacatcacgttaaaaagttccattatttcgaagcagatatgttccaacttttcaaccgaaatgatggttccacagatgaccttctaaagtcggtcaccagtcagccagtaacatggaaggagaatgctgctgctaagtctgtaaacagtaaactgtttgagagatgatgacacgccggtgcaggtaactgaactgcgcagggacatttagttgataacgtgaagggaaaaaaaacagatatttgtcgttgtttgttcctgcggagtgtgcaatcaagtagccctccgttttaggttataagatattttgactttagtcaaagttagactattttaagtttgactaagtttatagataaatataataatatttataatactaatttcattaaatcaataattgaataaattttcataataaatttctacaaacttggtcaaacttaagttgaatatattttcataataaattaaatataattgattatagaaaaaatattattacttttttctacaaactcgataacttaaagcagtttgactttgattaaagtcaaaacgtcgcataacctaaaacggagggaatatttgttttctattttgcaaatgaatggcgggctctttcttgtatgcacaccctatctcttgtttaaggtgtcaaacaaaaacatttctctttaattaagatctctcacacccttaacattttaatggctacacatttttttccgcatgagttgtgcttttcacgcccacttctctctatccaatagcaattatcacgtacatttctcacaagaatgctcctgcagatgccttccatccctaagaacccatgcatagctctctatcattttcttaaccatattgttctattcatgcaaaagcttagtgcgagtgcgtacaacgaagagacaaattaagttgcaagtggtgagcagaaataatatgtatatagagtccaaagacaactaggcaggtgctagataagtaatggagagcctgtgaattagttgaataactgatagatgcacaaccacgatcaacattgtgtcgagacgcaatcgaaattatgggggcaaaacataaaaggtctgacagctaacgaccgaaagtaggggtaaaaatgcagaataattcgataattagatgcggctgtacatgggatcgatgtacgtggctaaattggtactagctaggttaataataagtgggacatgatttcatcgtccgggttctccttgcagattatgtcctctgcatcaaagcattcaacgtcatcagcgtcgaggctctcatcatcatcatcatccaattcttcctcgcagtcgatttcctcatcgtcgtcgaagatttcgtcatcggggttctcctcacagattccgtcctcctcatcaaagcattgatcaatgtcatcgtcggtctcatcatccaagtcctcctcgccggagaaggtcgtgtccttggcggcggcgatcttggagtcgacgtggtcatagttgctctctgtcgcgtcagatatctctgcgttctcgtgcacgaccgcgaagctgctctcgctgccgtcgtggagctccacgctgtcgccgccgtcgctgccgctgaggacgacccagtcctccatggccggcgtggcgctctcctcctcctcctcggcggctgctgctgctgcgtgcgtagatcgaagtatcgaagcgatcgtggtgaagtctggttggtggggtggtgatcagatttcgctatgaggttcaaagcggcgaggcgcgctgcatatataggggtggatacgttacgggggggtaggattcgaactcggcgatgtccgtttcagtttcagaagcaagaatccgagttgagacggaaattcgtcgttgggaacaccgctacgacatgagacgtgagtcggagttgggaccgcgtttgaggctgtgaccgtgaccgagaccgacatctactttccttgagtattaaggacttgtaacctgtttgtgtttgtgttttggggttcgttgccggctctctttgctgctgatgataaggagaacatgtataggcctcacgagtcctctcttgttacgttacttggttcatgcgtttagttattgtaagttgccatcttatgtaccaaatcccctacaaatcgcgcatttaaaattttgtaacttgaacacggagtagtgcataactctgatggggatgtggaccacgtttggttgggcccagtttcagtgagttgggtttttacaatggggcagtattgcctcgttgatatcaccatatgtaaactatttttctttctttttaaacgttatattaatagtagtattacattgcctgatttttttttgctttttagaaactttcattgccaaaataagactagtaaatataatggaatatcaacccctgttttcttcgattgaatctcgaccaaatttattccgactaaacccaattcaaggattttgtttgtacttactacatatatacaacttgagaaatttcaagaaaaaacagccaaattaggagtgacatatacctgttgagttgtgatccaaattcatttgcacttaataaagactagcttctaccgtagtggagcataggcccgtcgccggtagatttgggccggagcgtacggatcgtcatcccttttagggtttctaccatatatatacctcttgtaagccgccgtgcggcgttgtaacctcaccccagatatagtgaagatattttgctgactggtgcccgtggtttttctttcctgtcttgggagggtttttcacgttaaatctcgtgtcttgattgatctattattctttatcgtttatttgtctatcgtttcataacaatactatcacgatcgatcatatgattcatatcatatatactctctctgtccctaaatatttgatgtcattgacttttataaacatgtttaaccgttcgtcttgttcaaaaaatttaagtaattattatcttttgattcatttttaaatttaagtaatttaagtttttgaataatattcacaatagttataagacgaacagttaaacatatttaaagaaatcaacgacgtcaaatatttaaggacggaggaattaccatatatataataaaagaacatgatatttgcagtactaaaccacaaactttatcagcatcactccctaataaatccttaattctaattcaatgcgcagattcgcagaagaaggtacacgacaccaaagagcaggtagaagactgcaagcgaaaccaccccgtcttggagtgcgagcgtatcagggaggaaggccgccgccgccgtgttgctcgcgctaacgtcaacgccaacggcgaagctgggcgcggccgccatggcgcgcaggcccgtggctccctgcgacagcgcctccacgtcctgcgccgccagcccgccggcggcggcctgcatgtacgaatcgatcgcgtcggccgccctcaccatcgccgctgcagcctggttccgagccgccgcttgttgcatcgcctgctggaactgcgacgacgtggacgccggctcggccgccgccgccgcgctattcccgcctgccatgtcggcgctgtcgccgtgcgcctcgccatcgccggcgtcgggagcagtgtcgtggtcgctctcaccggcgtcagagggctcctcctcgtcggcgccgcttgcgtctccaccgatctcctctccgagctgcgtgccatcgaactcgtctccggtgatcagctgatagaactcctcgccgtcgatgagctccatgcagcggccacagacgcacacgtgctcgcactcctcgtcgcaggagctttcagtttcatagtcgtagagcgtgtcgccatagaagaaatccaggaactcatcgttcaagccatggaagaaatccaggacctcatcgtccaagacgctttcctcctcaccaaagctttcattgtcaatgccaccatcggcgagaacctgcaggtactcctcgaagtcgtcgccgttaaggctttcgtagtcgatgccatcgtagccgccaccggcgaactcctcgggctcctcctcatcatcactctgctcgtcggagacgctctcctcctcatacaagctctcactgtcaatgtcgtcgtacttgccgccgtcgatctccatgtcagagtcggtgtcgatgtcgttgtagctgacagggacaccggtgaactccggccactcctcttcagcatcactctgctccatgcagctctcctcctcaccgaagctttcgttgtcaatggcgtcgtacttattaccaccatgctcctcctcctcctcctcatcgatctcctcgtcacaatcgctctcctcctcgtcgtcaatctcctcatcagaatagctgtcctcctcgtcgtcgctctcctcctcgtcagagcttccggtgtccacggattcatcgtccgggttctccgtgccgattttgtcctcttcatcaaagcattcagagccatcgtcgtcgaggctttcatcatcatcatctaggtcgtcctcgtcatgggaagattcagtgctttcagtatcttcgtcagaatcgctttccaagtcagtggtatcctcctcctcgtaatcgctctcctcgtcggtgctttctatatactcatcggaatcagtctccaagtcagagcttccgatgtcctcctcctcgggatcgctctcctcctcttcgtcgtcgaagatttcatcatcggggttctcctcgcagattccgtcctcctcatcaaaacattcaatgtcaccgtcggtctcatcatccaagtcctcctcgccggagaaggtcgtgacctcggtggcggcgtcgatgttggagtcgacgtggtcattgttgctctctaccacgtcagatatctcggcgttctcgtgctcacctccgacgatcaccggagacacctcggcaatgtcctcctctgccgcgtcgagcaccggagcgtgagaagaagctgcgacgtgctcggaagctattcccgagaacgcctggccgtatgagacggtcttaaagaaccccggcggcgaaggcgaaggttgcgacggcacggcctccacggcgatcgccggcgtgtcagcggcacgaccgcggacctgcacgaccgcgaagctgctctcggtgtcggagccaccaacgtcgctgccgtcgtggagctccacgctgtcgccgccgtcgctgccgctgaggacgacccagtcctccatggacggcgtggcgctctcctcctcctcctcggcggcggctgctgcgtgcgtgaggttctcggcggcggcgctcgtgcgtagatcaaagtatcgaaccgatcgtggtgaactctggttggtggggtggtgatcagaattcgctgtgaggttcgaggcggcgagacgcgctgcgtatataggggtggaattatacgggggtaggattcgaactcggcgctgtcagctgtgtcgatgtccgtttcagtttcagaagaaatccagaatcggaaagccggagttgcctccgatttctatcggctatggacaagcgaacacacacgcacgaagcactcgggctcggtacatgctagctgatggggttgtgaattgtgatcagtggcgtgcaagaaagtaaactcattggcttaaccacactggaaatttggcaaagactcacgtttgcagttgcaggggccttcgatgcatgtgcttctgcggtagtttatcagttattggtcttcttgctcgatcggatggtgaaattgaaatatggaattaatgcgaatgtactgcatataaacttgcacgagttgggatacaaatcagggggttgtgtcaatacaattaaagataaagaaaatctcagctttgctacatttgctgtttctgaaattttttccatcatttgctatcaagtctgcttacactcttcttccatctctgacagctaacaatgttttaattatggattttcattagtccaacctctgtatacataaaagatatacacagccaaaacatacacgtgttctctctttatttttcgccgggatggcggaagaaacgccgtcctgttaggatttacgtgaaatattgtttcatatggtttggatagggttgttagctctaaatagagtttgctgttatccctccgtattaggagatgagctcaacaaccctgccggctgtatatatgcatgtacttgtgatcagcccgtttttgaggcttctgaattaacacgaaaccacccactgaggtgttctccacgcttgcatctctgttctttacatggtatcagagcaaaaactcgatctatattagatctcatggcgagttcctcctcctccaccgcttttgcaaatcctttgttcggcgtccaagtttctgagaaactcaccaagcaaaatcactccctctggtcggcacaagttctcacagccctaaggggcgcgcgactggagggccatgtcctcggaacatccgttccaccagaagccgagcttgagcagaaggaaggagaaaaaggagagaagaccgtcagagtcccaaacccggcgtatggcgaatggtttgccacggaccaacaggtccttggttttctgttctcctctctgaccagggagattcggtcgcaagtcgcaggcgcaccgacggcagccgcggcatggaagacgatcgagaacacgttctcgacacgatctcacgcaggcgcgatcaacgttagattggctctcaccaccactcagaagggccaatcgactgtcaccgagtacgtcagcaagatgcgtgctctcggtgacgaaattgctgcaacaggaaagccaatagatgatgaagaacttgttgcttacattattaatggtcttgattcagagtttgatccagtggtggaagcactcatcgccaagaatgcatctgtcactgttgcagaggtctactcacagcttcttggctttgaaaacagggtgaagatccgaacagcgtgcgctgctacgagtggaaaccgtggcagcggaaatcagggacgtggtggcggcaaccctcgcggccgcggcactggacgcggcggcggcggcagcggtggccgaggtggcgggcacggccgtggcaatggacgcggcggcactgacaacagacctacctgccaagtctgtcacaagaaagggcatgtggtggcggactgctggcaccgctacgacgagaactacgtccccgatgagaagctaggaggcgctgcgacgcacgcttacggtgttgacaccaattggtatgttgacaccgaggcaaccgaccacatcaccgggcagctggacaagctgaccacacgggagaagtacaagggcaccgaccaaatccacacagctagtggtgaaggtatggatatacagcatattggtcattcctatgtacctacatctagccgtcccctccatcttaaaaatattttgcatgttcctaaggcatcaaaaaatcttatttcagttcatagacttgttgctgataattatgcattccttgagattcatcaaaagtattttttgattaaggacaaggtcacgaggaggacaattcttgaaggaccatgtcggcgcgatctctaccctttgcctgccggagatccaataaaacaagtctttgctgtgatgccatcgttcgagcgatggcatggtcgtctagggcatgcctcaaagcccattgttcttagggttattaatcaaaataaattgccttgtagcaatgagtctcctagtgagtctgtttgtgatgcttgtcaacagggaaagtctcatcagttgccatttcctaagttttttagtgtttctagtaatcctttggaacttattcattcagatgtatggggtcctgcctctgactccgttggagccaagcgctattatgtgagttttattgatgattatagtaaatttgtgtggatctactttcttaaatttaagtctgaagtttttgagaaatttaaagagttccaaagcatggttgagagacaatttaatcgtaagattctaggcatgcaaacagattggggaggagagtatcaaaaattgaattccttctttaagcaaattggcatagcacatcaagtgtcgtgccctcatacccatcaacaaaatggtgccgttgaacggaaacaccgtcatattgttgagattgggctatctctccttgctcatgcatctatgcctttgaaattttgggacgaagcttttcttgcagccacttatctcattaatcgcttgcctagaaaagtaattgactttgacacacctcttgcacgcctttttcaccaacaacctgattataaatctcttcgaacttttggttgtgcttgttggcctaatcttcgtccctacaatactcacaaattacaattccggtccaaacaatgtgtctttctcggttttagcaatttacataaggggtttaagtgcttagaagtggcaaccggtcaagtctatatttcccgtgatgtcacctttgatgaacaggagtttcctttctccaagcttcagccaaatgctggagcgcgtctacgtgctgaaatttcccttcttcctgctgatcttacatcgcatgcatctgatcaagggggagtagcacatagcaatgatcatatgcataatatcctacctgttgttactgattcctcttttgagaatgatgctgcagatgacacagatgctagcgacagcaatgcagaaattaatgcagagcaacctgatggaattcatcctggtgcatctaccggggtacacacagcagaaacagaagtggcggcagaatcgccgtctcgtactgatcagcggcgcgccgtgcaggcccctgagcaacctgcgaccgtcaccgaaccagcagccgccacgtcgtcggctgtacagagctcccgcgcgagttcccgctccatcgcaagccaccaccagctcggaggtgacacatcgccagggcctcatcatgatgcggcaggatcgtctgcggctccggaggttatcgctgcaacagagcaaggtgatattaatgctagaccaaaaactagactccaaagtgggattagaaaaaagaaaatttatactgatggcacagtcaaatatggttgttttacatcatctggggaaccacagaacctagctgaggctctaggagataggaactggaaagaggccatggacaaagaatattatgcattaatgaaaaatgaaacatggcatttagttcctcctaaaaagggaattaatattatagactgtaagtgggtctataaaattaaaagaaaggctgatgggagtttagatagatacaagggtagattggttgcaaagggtttcaagcagaggtatggcatagattatgaagatacctttagcccagttgttaaagctgcaaccataagaactgttctatccttagtagcttctaaaggttagagtcttcgtcagttagatgttcaaaatgccttcttgcatggagttctagaagaagaggtgtatattagacagccaccaggatatgtaaaatctaaggcacttaactatgtgtgcaaactagataaggcattgtatggattgaaacaggcacctagggcctggtactcgaggctaagtacaaagttgaatgagctggggtttgtgtcatcaaaatcagatacatctctgtttttctatgataagaatggagttactatgtttatgcttgtatatgttgatgacatcattgtgtctagctcttccgaaaaggccacctcagctcttctgcaggatttgaatcaggagtttgcactgaaggatttgggagatcttcacttcttcctaggaattgaggttaaaaaggtaaatgatgggctagtgctaacacaggaaaagtatgcctcagatgtcctgagaagggtaggtatgagtgactgtaaaccagttaatacacctctgtccatctctgaaaagttgtcaagtcaagggggagctctccttggtcccaatgatagcactcagtaccgcagcatagttggagcattgcagtatttgacattgacaagaccggatatatcattttcagtaaacaaggtatgtcagtatttacatgctccaactacagatcattgggcagcggtaaaaaggatattgaggtatataaaacatactgtgaaacttggtctacagattaacaagtctagttctttgcttgttagtgcatttactgatgcagattgggcaggctgtcttgatgacagaagatccactagaggatttgatgtttttgtaggacccaaccttgtatcttggagtgcacgaaaacaagctacagtttctagatcaagtactgaagctgaatacaaggcattggcaaatgcaacagcagaaattatgtggatacaaacattacttcaggaacttggtgtaaaagggcctagagccgctaaggtatggtgtgataatatttgagctaaatacttaacagcaaatccagtttttcatgccagaacaaagcatatagaggtggattatcattttgttagagaacgagttgctcacaagttacttgaggtgtaacgctccgctttttgcgtgacattaaaaactaattcggcaaaatcctaattgcgaaaatttcgttctttgtgtgcgagtctaagttgtgccatggatctcaattcaatctccatcgttgttccctttcgtcgccatcaaaatccaccacctcaagattccaattccgattcaagtctctgaaatcaacatcctgaaatcaatcgtcgattctttcgtccctatctctctctccctctctctaatcaatctgcctacctactatctatccatcgatctgtctatcgatcttcctattcgtttatctacccatcagccgatctatctgtctatgtatcgatctacctatctatctaactaaccagctgtctatctatctatcaatctatccgtccctctacccatctacctttggaacctatcccataccattgtcccaactccaaagataggtctcacttgaatccctctcatctaatccctcggaccgccgagtataactttgctccaaagaaacaccgaattctcgcttgggtgcttccccttgactcctccctgctttgtcagaccaagcctcaagttcgaaatccaaattcaatttccaaatctcatatccctccgaatcgatttcctcggaaaaagtctaatttacctccctcggttgttgtgggccgttttttttttccctcggcccatctctctccctcagccgctccttcctccctcgcgtgcctcgcgcgtgcgccgctctgagcgagggcgctcgctctctctccctcgtcgaactccctctcaccggcgccgatttcccgccgccgccgttcgaaatccggccgcaccctcgcgtcgcgcgcgcgctcgcccgcgcgtggccgactgcccggtcgccgccgcgtcagccctggcagcctgcgccacgcagccgcccatgccgccctgccgcttgcccccacctctgtgcgcttgcgtccaaaacgtggagccagagctcgcgctcccatccttctctccctccccaaaatggcatggtcgaacccctcctttccaccctgcccttttcctttttccctcccgagctggacctcctctgccgcccgtgagcgccagccgcgttcttgaccgcgccagctcgccatccttgcaccctcaaccgccctatgtcggttcctcccccaaaccgccttccccaccctataaaacccaagctgagatccctccccatcccaatcaatcgcgttttgctcctcgcctcgaccacgccattgccgccgtcccactgttcttgccgtcgccgtccgtcgccaaacaccgagggaaccggtgcgtgcgtgggcgtgtgacgcaggactccgggcaccctccttcctccccttccccggcctgaggccgaagagctcgccccgcgccgtcggccatctcccagcgcacgtcccgacacggtagccttccgttccccttcctcgctccatctcctccccttagcttcgggcagtagtgcgagtagccttccagtagctagctggcgccgccccgactgccgccgctgctcgccgtaggcttgccgccgtcgccgcccgctctcggaggccaccgctcgtcgccggacctccatggcgtcgctctgccccatccgatgccagaaatgggcttcccgaccaccatagatactcccaccgctttgaatcggactcccgttgcctgtcgacaaatcccctcttttaccaccgccggcggccgccgccgcaattcgtcaacgtcgaactccctccggcgaatctgagccgttggctcgctccttctcgatgccctcgtcactccggtgtgctccccgaagaccaaatccgtcgcgcttgctccagtgaacacgcccgccgtccgccgtccatctcggcctccccttcttccttctcccgccggcctgcatggctgccacgtaggcgccacgtcggcgccacctcggctttgaccgggccaagccggtcagccgcccccctccctccgtcttccctcccgtgcgcgcggtccacggcaagccgtgcggctgcacgtgggcccgccgccatccgtccacccggtgcaccgctcctaagccacgtgcacccgaaaccctagcgccgcacctcgcatgcgcccatcccaccgtgggccgtgtcaccgacaagcgggccccacctggaacccgcgaggtgcactcggtccaccgaaccgctcccccccttccgcgcgccctaatgggccgcctttcccgtgcctgcgccggcccaaatggctcggccgagcctccttcaaccctcgggccgcgcccttgccgcccaaaaaagtctaatatacatccctcgtccatttccttttccataaatcaattctttattccaaaattccatgaatcatttcc

SEQ ID NO: 62194 - DNA, 7402 bp, Oryza sativa
cataaatcaattctttattcaaaattccatgaatcatttcccttggtcccgcacgtccgtgactgtcaataatattcttgagaatattatttctataaatttcataaatcaatttccccttgttccacaaatatcttcctttgtccacaaattccaattaaacttccaaaattcatatctcccgatccgtaacaccgattgaccccgttccacttccaataattccgtaaaattgagatctatctaatggaactattatttagtctaaataggatctttcttttggtcttttgtttaggttttttattgtttgcgtatagttgcggttaccggattttcgtcgatcgcgggttttctcgaagattcgtgaagcttcgtgaagaccttgagcaaggcaagtcaccctttgaccaattgctcctataattgaaaaatcattactattttgtttgcaacttgcattattagaatcatacactcaacttgcttggcctcggtttgcgtgccaaaccgtcggacctacctagtagtcgcactaattcctgtaggtcgtactaccctgattccttgtcgctccacccttgtggtacctcggtattcgttctctctaagcgcgtataccaaatattccacatacaccattgtttgtcgataatatgggaaatgggtttgagaagcctttaaaacccgacctgtggtgtcggcgtgtttgaaaataaaatgaattgtgaaaactcgcgatgcaggtgctgtgcctgggtggcactgtcccgtattcgcatataagaaccgattcctttgggaaactcatcaagcataacaagtgcaaccacatggtggtatgggacaccctggctaagtaattagctgcttttggaaaatcttgtatgtcaatagaggcggaaagccgggatgtgggggtagaggcatcctgggagtccgaaacagaggaaggcatccgggagtcctaaaaggaaagccggagttggcccgatgttggtcaaggagaccctctatgtggcatgaggtgacccaaagttagctttggaaaggctttgtcgcaaacctctaacaccggccagtgtctggagtaagttcgtgtcttgtgggtaaagtgtacccctctgcagaggttaactaactgttcgaacagccgtgcccacggtcatgggcggatgtgaggtggttcccgatgcgtagatttgtttgcctgtgctttgtgaaaagttgttgtgaattgggaatcgtaaccagaatcagcctaagtggcagatggatgacctgagtggtcagaaacgaatctgtgtgattcgggatgtctgcgggcatcatagactaggcttcccgagtggaagcggattgctttgctgctgggcagctgaactttgggagtccgcaaaaatgaaaaaggctctgggagccgcttaatcaagtgaaatggctctgggagccgataagtaatgatctgacccgggggtcagtacattaccatttgagttgttgaaaagcatctcttaagtcgaatcgagacgcaagtctcctctcgacccaaacttaaaaagaaataaatcacttagtgattccaaaatgttttcaaacaaaggatttgcaaaacaaccttgcctctcttccaagcttgcattaaacacctaagttcccgtgacttgctgagtacgaaagtactcatccttgctctatataaatatatatatagttcctccgccctgaagctgaagatgaagtgaagtgaagattagggtttcgtcctggttcccagccatcgcctgtggtgttgggtgttagttcgttggttccgctgctgctgctgttgctggtgttttctcgtcagtgtcttcggttgtattctcaggctgtcctgagctgcaacctaagttaaggtaaataagtcctctatttattttaaggattttgcaatgaatcatatttgtcaccgtgggtaccagcactatgtcctgggactggtactgtgatcgcggtttcgtaggaagcggttcgcgccgtttttcctgcgacacgctcctatcaggtgccgttgtacggcggtgccggattggggtgtgacattgaggtagagtatgtctcatctaaagatcaagttgcagatggctttaccaaaaccttgacagtaaggcagatggagatgtttagaaacaatctgaacctggtaggttgagattgagggggagtgttaggatttacgtgaaatattgtttcatatggtttggatagggttgttagctctagatagagtttgctgttatccctctgtattaggagataagctcaacaaccctgccggctgtatatatgcatgtacttgtgatcagcccgtttttgaggcttctgaattaacacgaaaccacccaccgaggtgttctccacgcttgcacctctgttctttacacgtccgattttttattaagaagaaagggtgcctcaattacatttgtacaacaaacaaggttattgcgacctcgacacatacacgagttctctgacagctaacatgcagccagcaggccattcgccttctctctatatatacacggctggttctagaggtcactgaatttgatccatcaataccagagaagaagacactgtcactttgtacactgatagagcaacaatgcagtgtaatgctcgactgcagctggtgtgagaaatggctttgttttcaactggcctccttaggaatgcaaggcatctggagaatctgtgagaaaggtacttgatcaatttgtctctactaaatattgggtgtccttgtcgccaaacagcatttggaagtgcatttcatcatgttgaaaattttgaactttcatacatggtgcaaaaaactcattggagacttcgatttggcaccttttggggatgaagtaatttggtttttgtatggtgtattggtgtacaccatcatcttcaagggcattcgtaattttcaagcaacagcatgcaaaaagaaaaaaaattatgttccatgaatggtaatagtaagtagcacgtcaaaaaaaccggagcgatcgaagcaccaagattctagtttgtcttatgttcatgtctgataattttactaaacttttttgcctatgaactgttcgattgacgatgtaattacatcatttttcttttatgcaggaccaactaaatcccttacacaagggtaggatggttgatggagtttaggaatttggttaccgaccgttcatgtcagtactagatgttttcagtttcctaggtcatgctatgcaggaacgcggaaccaaacgtctatctgaggtacaaaatgccttgtggccctagcaggaggatatagcattatagcttgattgatgctgggagtcaatcgcatgatacagtccatactaccgatcaggttcagttcttgaatccaagctagactctggaacagacgttttagcttgttttttcataactagacgagttgatcaggattggggatttgctggattagactcggccattttgggattattggaagaaactacggttgagcaggatgatctcgtcgttgcaaaaacttgtagcgagatgagtaaacatttgtggttgattgcacagataaagctagcattaacgaatgtttttagtactagagttcgtctcaaatacgaagagaaggatgtacagttcttagaaaaagaaaatatttgcagttcttttggcagagtattcatatgcagctattcgggtgtttgagaaattaaaatagcatgaaaatgcccaattagccatgcccaaaaggaaaacgagcacaaaataaaaggagcaacggttactgtaatttcaacaatgctagctcttttctgaaacttttttcatcaattcgatcctataccaactctgcttaaactcttcttcgatctctgacaactaatgacaactaacatgcagccaacaggccagccatcttctctatatatacatggcctcattcatggctgcttctcaccttatcctctgaatctgattcatcaaataccttgtctaatgcctgataactgagaagtgagagaagaagacgctgtcgtgttgtacactgatagaacaacaagctgtgatgtgcttgagtgtagctgggtgagaaatgtttgagaattgcattgccctcctactaggagtggaaggcatccagataatttctaagaaaggtgcttgatcaatcgttctctactgagaactcgggtgccaccaaaccacacataaaactactgtcatcaaatattctagctttctcagacgatgagaagcacctatatatagtctatcatctaatttcttcgtgataatttactaactgggttccttttcttttttgaaaaagaatttcactaactgggtatgcctgtaaactacttgattggagatataacatcactatttttgtctctttttgcaggagctgcacatgggatgtacgtggctatattggtactagctaggttaacaagtgggacatgatttcatcgtccgggttctcctctcaaattatgtcctctgcatcgaagcattcaatgtcatcgtcgtcaaggctctcatcatcaaccaaactcaaaaattttccccaactaaacaaggccacagtatatatacatagggtccaaagacaactaggcaggtgctagatgtgaagttgaataactgatagtatatgcacaaccacgatcaacattgtgttgacacgcaatcaaaattatatgggggcaaaacataaaaggtagcgacccaaagtaggggtaaaatgcagaataattcgatgattagatgaggctgcacatgggatcgatgttacatggctatattggtactagatttcatcgtccgggtttccaaacagattatgtcttctgcatcaaagcattcaatgttatcgtcgtcgaggctctcacaatcatcatcatcatcatccaggtcctcctcacagtcgatttcttcctcatcatcgaagatttcatcatctgggttctcctcgcagatcttgtcctctacatcatagcattcaatgtcatcgtcgtcgaggctctcatcatcatcatccaattcttcctcgtcgtcaaagatttcatcatcggggttctcacagattccgtcctcctcatcaaagcattcaatgtcatcgttggtctcatcatccaagtcctcctcgccggagaaggtcgtgtcctcggcggcggcgatgttggagtcgacgtggtcattgtttctctctgccacgtcagatatctcggcgttctcgtgctcacctccggcgatcgccggagacacctcgggtaatgtcctccttgtcctcttcggctgcgtcgagcaccggagcgtgagaagaagctgcgacgagctcggaagctttcccgagaacgcctggcggtacgagacggtcttaaagaaccccggcggcgaaggcgaaggttgcagtggcacggcctccacggcgatcgtcgtgtgcggcagcgccgccggcgtgtcggcgccgacggccgcagcggcacggccgcggacctacacgaccgcgaagccgctctcgctgtcggagccgccgacgtcgctgccgtcgtggagctccacgctgtcgccgtcgctgtcgctgagaacgacccagtcctccatggccggcgctgcgctctcctcctcctcagcggcggctgctgcgtgcgtgagcctgagttctcggctgcggcgctcgtgcgtagatcgaagtatcgaagcgatcgtggtgaactctggttggtggggtggtgatcaggtttcgctgtgaggttcaaggcggcgaggagcgctgcgtatatagggggtggatacgggtgtaggattcgaactcgatcggcgctgtgtgcagatgtccgtttcagtttcagaagaaagaatccgagttgataagggaatttcgtcgttgagaacaccgcaacaacatgagccgtgagcgtgagtcggagttgggatcgttttcctgtgaggctgtgaccgtgactgacatctccttttccttgagtattactccagtttaaggacttgtaacttgtttgtgttttggggatattcgtttcgtgttgaccgtgactgcaagttgtgggaagcgcaggatttttatttaaaaatataagtttagttttccatcattaatttgccttttaagcttatgaccgaagctaagtttattagtacataattttgtagttaattttagataattttgtacataattgacagagtacgcattatgtactgcaggtgttggagaaattaaacgggcccctccagggcctgaaaattcccagcccaattgactaggcccaaagagcaaacgagtccaagcgcagcccaaaaggaaaaaagaagaaaggctcaagattttctgaaatgcaggtattatatatattttcttggactagcatcatattcgttcgttatcgttgcaacttattacattaaatatgttataagtatgaaatataaggtaaattaattgatgaattatttctaaatttataaaacctatatacataattatatgacaccaactgaccaccttcatacactcatatatatatatatatgccaaatgaccaacaactacaaataaaccctacagataagatatacagtcctatattatatagggctgaacaatctaccatctcatctcgaactctctaagatgggcaagacaaaattaagaattaagagagcactccatcaaacgccaaggatctgaaactaatacatacatatacacatgcataattgcgtaatcaattggcatgcatgatcagtcacttgaaatcaagatataagaccatgatatcaatcgtacacacaggtcagctcatgcatctaccataatctaacctctcctaatcagatcaagatagaaaaccatgacaacaattgtatatgcatgcatttatgtcagcagtcagcactaccatgcatcagaaaaaggtggcaaacagtacatgaaacaaactagctaggctgtcaataatttttttcagagaagttgctcaccaagtgactgcatgcagatgtgtaatcaaccagagaactattagtacacactatatacacaggtttgctcacttactgcaaatcatgacagcgtcacacacaagcgaaaaataaaatgcatgcaatatgtattaagcataactactcatcaaactaataagaaaccataaccaagcgcataactaattaaaagagactaattgtaataagaactaataagactactaaaactgcagtataaactaccgtatgatccatgtttatcaggtttaattaagcgtgtaatcttaagtgagcacacacaatgagtcaatgagagagagatagagacagagagagacggtcatgcttggctcct

SEQ ID NO: 62195 - DNA, 6997 bp, Oryza sativa
ctcgctcgtggtgcaataatgcaaaccgcgcgcgcgcgcgcgcccgcgcccgtccacgcgcacgtccctacctaccggctcacgcagcgcaccgggacgcgcgtgttttgacggcttgacgcgctcgcgcgcagtcgcacacgtacatccggcttgtgtgtggttttgcctgattggctccgtcgccgccggttgtcccgcttgcggcgcggagaggagacacggggtcgttcatccgtttaattatttgttggtttcctccagcgcagaagctggagagtgaccgatcaccgttccgccctctccaggaccgttctcgccacgttctagtactacctaccgcgtgcagaagattgctgtaccagtttttttttttctttttggagccacatccgtcacaccgtcctctctcatcaatggcgacatgtctgtcggatcaagacgttggcctgcagcagagtagaccatacatatgtgtcgaccattcgcccggggtggcactgtcactagtcttcgccaagatttgtactttgtaattgaggaggaacatatagaacgctagctatatagttaggtccaacgaaatactttatatggactgacatcgatacaatacctaggtaccatacggatgttaacataaacctcacgtttcaattaattgcatactgtacatgttgcagtatttctatttgcaatcggctaaaaaacagtcaaagggttgctaatgaaattagagggagactacaaaaaggatcccgttagaacgggatattttaaatgactccttccctttctttctgttagcttccacatgtgtttctcctagcacctggtaccttggataccagctagtacctagtacctggtaaatttggtaccgaccgatacttggtacctggaaccttggtactggctggtacctaggtatcacaaactttggtacctaggtacctggtaccttggtatcggctggtacctaggtatcacagactttggtatctaggtatcaagcatgatacttgtgggtaacaggcttgatactgaggtatcgcgattaatacctgataaagatggccgtggcacggacacagaagatggtgaggtttggccataagtcggcggcgaccatctacaggaacatgcgcggcagcaacttcatcttgaagttgatggcgaaagagaggaggtagagattctagagtaggttatcgtcggcgttgcggcgacagaggcaccgggaccgccgacttcttcttcttcttctgcggcggaggaggagccacctgtgctcactagcaaggaggcggcgggagcagcgggcaaggacgatggtgctggtggctcgcgaggcaacggagaccttggcaaggagtgtgagggaggaggggaaaggcctcgacgcctacagtgacggggagcgccagtggaagaagcggcgccgcagcaggcggaggacggcgtcgaggaggcacggcgagatcaccctcgacactgccccgacctcgccgacgccgggccgttgtcgtccacctcggccgccggagacgacgacggcgaccccttcctcctagctggcttcatttccgcgctcttggagagagagagagagagtttgtggaggggaagggaaggagataaggtagaggagaccttatcccgttgtgacgggatactattgtgtagattctctttttattaaacaagtggtcaattacccgtgcattgctacagaacaatatatatcaagaaaaatgtatgatttattttgctataatatttgaaacatttttaaacaaaatattagttgtgcataggttaagaatggtttctcagtaggactgtatactgctcatacgaccaaaacagcaccccggatctgtcaaaatttacgatttgtcacatctaaaatatacaaataataaaaaaacaaatgggccggcatactgtgaatattattacggcccaaatgaaaaacccaaattgaagcccactcataaaacaacttaaacatattaaaacaataataggcccatcatacaaagaattttgagcccaataaaaattgtccagattaaaaattcaaaaaatatttggatcaaggccaattcatccaagcccatatggaggccaattatataagaaaaagaaagatagtagcattttcttaacatgtgtgttgagttgttgatcgactaaacatgtgacgaaatacaatttaatattagaggtggtgaaggaggtacaccaaggatcatgcagggcacatcaagctgcacgggcggtagcatactagcaaccaagatatttcgccaatggctatactggccaatcctgctacatagctccgaagagcatatcacgcaattcgtaggtgccaaaaacatggtatatctcactccgtcccatagtacaacctttagctgatcttgccggtctggccgttcgcacactgggagctactccggatgtggattttcatccctcgaggggacatctcctcgttgtttgcatgtcatctaaatagttatcaaaaaattttaaaaaaattggcaacatagattaatacgaaatatatcactccacaaacatgcgagaccatattcaacttctataagttgcaacaaaaataacaaactaaactgaaaatagttatcgcacattcgcaactatatttgttatttttgttacaacttgtagaagttgaatttaaacttgcatgtttgtggagtgatatatttcatattaatctatgttgccaatttttttcatattttttgatgactatttaggtgacatgcacgaaacgaggggatatcccctcgagggatgatttcactttcccgagctactccctatgtttcacgatgtaagactttctagcattacttatatactatacatatagatgttaatgaatctaaatatatatatttatctagattcattaatatctatataaatgtggggaatactagaaagttttacattataaaacggaagaagtagatataattggtcctttcccaacgacaaagaatagctacaagttgcaatcaagtacttttgaaggtggattgaagcagaattcttggccaccatcacttcagccaccgtataatgatttgtgtggaagaaaaacattatatgtcgctttgcattggcgtattgaaataattcaccgcgaagggtctggctcataaactggaaacaggaaggctaatataaaatagttattgccaacttaatatattgacattggatttatccttgttcagttgccagcttggttttctactatagtatatacgattaagagccttacctggtgaaggtaggtgggcctggctcaccacaaaacctttattctttctcatgacgtaaactagtggagtcctatcgatatcgatcttatgttgctatatacttagcatttgtgtctacgtaaaccaacataaaagaatgtaacaaataattaatgattgcttaccttggggaagatctttttagctcagatcttcttcgtatggtcacctgaaccactatttacatgtgcgatgcaataccagcttaagcataacgaaattctcagtaaactacgttgtaggattctatgtggcccgtatctaaattggttttcttaaaacacgatctactgtagtgccgtgatatagaataaaccatattgcctccgtttcataatgtaagtcattttagctttttttatatttatatattgatgttgataaatctagacatatatatgaatctaaattcattaatattaatatgaatattagaaaagctagaatgacttacatgtgaaatagcttacattgtgaaatagaggaagtatatagtaagcatgtaattcaattttccttcgcctcttttctttctgatgactggttgtctttccatgacgcaagccaccccacggagagctagtttgcacctaatttatctgtctataaattgtaatgtaaacaatgtcatatcaggcataaaccttctgcaccactaagcataaacgatgtcctggcttgctttaaatgtcttatccagcgaacactaacacacaaacgttgctccgaaagtctatcttatccgataacgattagcataaactaaccttaggccggtgtctaaatgactttaacatctcatgtgatttcttaagtgccgtcagcatataggcaataccaagtgattttagatggtttggacgtttggtagttttcaattttcatccagatacctctcttgacaattccatccacttgtctattcctgtcctgtgtggaaatgatcatgtctcgattctagataggcaaaatcaatagatatgcagttacagaagttaataggacgaaatggtaggtcctatataaggataacgttcaaaattatatataagcccctgcgtaccatgtcaaattatcaattgagactttgaaaaggaaagcacaggtctcaacatggcagatatggagtgaaggatcatcgtggcctcttcctttatttctgtgcatttttatgcttcgcttttcatatactcggacaggacattgctacggaagaatagaagatggtccctttagttttacactccatttttttctggtttgttggatgccactgctaacattaaactatgcaaacagaacgttcaccaaagaaattaaaaagaaaaccacactaacctccgcagatcgactctagctaatccatttttactagtatgatgttcaaaggccaatggtaaatatatggtgaaaatcccaatttaagtagaaactagtgtaaacccatcaataaaaaatggaaaccagatatttcaaactgtaattggaattccacctctaatattaaaaaaatgatagatcccttaatattcttgaaaaaccatggataactagtagcttgaaaattgtttacttgcccgttcgatagtaaacaattttttgctcaacttacagccttattatatcaaaatatatttcatctttctgtcaaaataatatatatttcatctgagatgttggtggcctgattgaacttatttctacaatttccacttgattttgattctaaaaaacgttaacttttctttttagaccaatactatactacgggttggtttggtttgtggcctaaatagaccttaccaaattttgtcaatgccaaatttaggcaagttttggcatgactaattttggtaatgcaaagttatgtttggattgaagccaaaatagcctaagttctctattgaaatggcctatttttttaggcatgctaaaatttggcttcaaaccaaatagacactaaacactattgaaattgctaaatattggtaagcctaatttaggcatcaaaccaaatcagccctacaaaatcatttaataacatacgcggattgacgtggatcacaaacacatagtgcaagacacctacatctctgagtttgcgtctttatcacaaacgtagttttttctccacatctgtggtatatacttttatagactggggagacctgtgtcactatatttgattgtagtcacatctatgacttgacttttccgagcaactcaaaaaaatgtcgtattttactagatatactaggtactccaagtattcatacacatgcgcaggtcacatgatctttctcgaacctcccagataggtggcttttcctatgactcaattttgaaatcaaaaataaatttgaacaccttgactcctttagcctcgcttttgtttgtaggagtcgtcatgcattcatactatagcaataacatagagactaaaacttgcactttgtcctcaataaacatgttaatcccttaattagtcgcattgttaacccaccaggggctagatgcacttctagcgagtagattgcattgagatctacaattttgatatataacatgtctctgtctaatataatttaaaatttttgtttttaaaaatagatttgagaacttgtaaggatactgagacaaaagtctataatgaaaagtacttagagacacaggtataacctgtgtccgtcatagatatcaggcacactttttatggaaccaagtttgtgatgataaacctcattcattgacacgttttctttatccacatctatgatttcttagcccatgtgttttatttcgacatgtatctgatagcttcacagacctacatctctatggtcatttcagagacacagcgtcaccaatttcgtattttgtggtagtggatgttaattgtcatgaaaataccataacaagttaacaacaaaatcctcagctgaaacccccacatagcatgaatgataacatccctctgctagaatgatggatatatcaatggggtcgtgacatcaaacaagagaaacagggaaggcattaaacactcttcatcctaattacatgggataattgaaaagatgatttgttaaaataaagtgtatccaacacattgcataacagaccgttgaaatataggcaactctaaccctagtttgttgcctccactactttcctctgtccttgccaccgccaaaggggtgccctagaatctggctgccctcgaggaaggtggtggcggggtctcttccttttctggcgtgtgccctcttccggtggtatcgtcacgaagttatcttctttttaatcaaggccttcactctaacctacaaactagagtcatcttggtttcgattttcgatgtcgtttacgtcgatagcttagtgactcttcatatggaccgtacggattgtggaaatgtgtatattgccttcttcgttttataatcatttgagtagcatatctaaagatgcttgtagctattgtgtttctgatcgatcgaaattgtcctaagggttggagggggtggaggttatggctcgcagcgacgaggcaacaatattggggactttgattacataggtggcgctctttgggtaccgatttcttgagtctaaggttaaatctctaggtct

SEQ ID NO: 62196 - DNA, 6636 bp, Oryza sativa
aaggcattgttttaggagagcatttttcatagtgtaagttttgctttggtggtatttgagaatgaggtatcaattgtggttgtattttgctctacggcatgacattctttccatgtcttccttttttttctttttaataattataggttatgtgcatcttaattatatagaggttatgagtgatttttagaatagttgtatcatcttgatgtaattgtttaatatcaatatagtttcttttattaaaaatattaaaagtatggctacataaaagagcttttcacgatgaatctagctatcaatataattttaatatttccaatgaacgatgctagtatatggtgaaaataatgttgtgaaaatataattgtctactatttggatggagtaccggttggcaagatatcaaactcgtatcgtaccaaatcgatttttttctgaaagcctcctgaactggtatgatgtcatgatgcagtgcatgtaaatattgatgttcaaggcatggcactttcttgctgatccaccaaggaagtgtcacctgtcaagcaggatatatagcttcttatgcactcaaagctgaattatcttggccatcggccttccaagctaaatgagcaatggatgtacagccactcattatgctacaactgactactgaggtaaacatccattgccatgcattatgctaaacgcactcgatcgctagaacaaaaaattggcagcacagccacatatcatcgagaaagtccctcttgggacgtatagtttactcactaattccccttttgactggatagtgttctcttcattcgtaattgattatcgtattatcaaaaaaaaatctgatttgatcatgacaacaacattgggagctagcgaaaatgtcctttttataacatgcatgtatgcatgactttaatgcggagattagttaaatcaccgatcgtctttaaccatatccaatgcgtgcatgaatttaatgcggagattagttagttaaatcaccgcttgtctttgctgaattaaagtaaaactatatttatttagggatggagggagtagttttcggtaataatccaatgtggtggttactccaattactcactccgtattcgtaaagaaagttgtttaggataatgttcaagtcaaaccttagaaatataaatcatgaataactctcaagctgttgagtttgaaaatataaaaattatatgaatagactttttttttgcaaaatactttcataaaaatatatcacttttaaataaatatttttataaaaacaagaagtcaaagttgtgttttggagaccgtgtcgctgtccaaaacgattttctttataagtacggagggagtatattagaaagatactacacggatagcaaagtgaaagtaggataaggctattcccaactcaatgactaggatgatgtccatattattaaataagctaccatctaagatgaaaaatgatgtggaagtgaatacgtgaggaaagagaaggaaaccatgacttgcatgagacatggtttctacacaacatataagacattatgtgagataagtagcattaaatttaagtatgtaatagtggtgtttgtattggaagagtagtgtctagtactagttttttgatgatgtagagtttatggaaactatgtctagttccttgggttgagaatggcctaattaactagttaggttttttttatggtataacctgttcactcaagttcaaacctcttcgacttaatatgggtagtcgtatttacggctaattattttttcaacggtagacaatatagccatctgtaatgaggtatatatggtgattttaccaatccctaaaagtactgaactaatctgttggaagtgtttataggagtatggtgaaatacgccctcagttttcaattgaataactattgccagaactactttaatggatcactcgtcttttataaaatgtacaaatatttctaattataaataacaatgatatcatattataaaaatgtattactaaggttttgcaagaccaaacaacgaatttattgcatccaaattaactcgatgatataaagtgaacgtagctcatatcagctagttaagtttcatacggtgaaactagctcatcaagtttttgtaaaatcaaaagtgtttttgattattattatgtgataaacaattggcatctgagattattggttttgaaatttggattattgtcgaagtggttttggagataattggatttacaggtgttaacaggtactgctgctgttttgatctggtcagactgggcaggtgctgccggtcggaccggcgtgtattgcgcggtcagactggctagcccgcggtctgatcggctaacattgtgtcggtttcggtttcagttgtttgtttggatatccgtgtttgtttcatgtttatggattctagacggatactatgcatatgtaatactgttgtttgctaacaatgagtcaagttggagatagcttggttttggaatatggtttctttgtttgattcatgtgtaggtgacttgatgcctcgggagagtatatccggtgatggatcggaagtcgacttggggataaggcgatgtctgtgacgatcatatatcatacgggatacttaggctaaagttcaatgcacgtgattggtgaagattccatatggcatacgacggaggtattgtgtgcgtatgggatgtggagtcgaatttggaaggagtccaaatttggtatggttagagtttgtaaagtttgtttcttgtgcgggaaggttttctaggtggattaggacttctagaatgagtttggttcgtggctttaggctgcctacctcatgtataaatagagagggagcgtgaggcttcccggtatcgcttttgagagcattgagttgatagtttagttagggtttcgagtttagtcgagatttttgtaaggagtactgttgttgcactttgtaaacatagagaggagcaataaagttgtcatctactttgagagttcttcgatttgtgttttctcgggttcggcgctctaaccggtgaaacaccgtcggtctaaccggctgcattgcggcggtcagactggcggcattgcggcggttagaccggcgtcggcgtcaggaggctgaggcgacttcggagcagtcagatcgggcaatctacatcggtcagaccggcggcacaggcgcggtcagaccgacgggactactctagtcagactgatctatatcgattcgagggtaacttttaattccgctaaaaaattatgttttttggtataccaaccattcacccccctctggttgtcttagttcttgtgtttcgatcctacagttttaaatcctgtaattattacagatgctcatatttacggctaattattatttagtggtaagtaacgtcaccgctaacagtgagatactcatgcttatagagataaagcttacatgtatatatgtttatacaaatgagtataagtatgttacgagcgtctatgtatgtttaagggttgtttctaacgagaaaagaaagtgactcaaaagatgagctggttgtacgtactaaggtctatgactgggcacgacattaattgcgtccaagatgatcctcatgtgggtgtgtcacacatttaattttttttagatatgttgttcattggttattgttagctaattattaattttgaatctcataattaaattagttagatagtatattctttcaagaatataaaccactaagaaaataaatatttagcaaaatgagtgtaactcaactggttatgtttcttacggtgaaactagtaaacacctcggtttaaatccgagacttgacacgagtcctcgtatttttatactatttcaaatgttagtagttgtggtgttcgttctgccacaccatccctacccactaacatttggtccccataatctatactattacatcacccctcaatgacaattattcaataacaaaaatcataaaaatacaacttggactaaatatgtgcttaattgacttagttagctagaaactcaatttgttttccgctgcaatgcacgagctcttccatagtatttctaattattctttaagtgctaggcaacatatctatcaataacaagatatctgccgtgacttgtcaatctcaatatacgtcgagcatgtttgtactgtgtctctaaaaaagaagatcaacatttataactttagtttaaccattaaactaacaacatacattagaattcctagtaatggtggataaaaagtaattagtcaaatatgtggttttatcagtttaacatatgagtatttatagtaatggtggataaaaaaaaggtaatttggaaccatgccattataattttttaaagtttgagatatgccatcggtatcacaatgacatgtaggacctacatgagtcaatgacatgtgggtcaggatggcatatatcaaattttgcaaaattataatggcatagttacaattttccctaaaaaaataattagccaaatatgtggttttattgcaagggaaggcttcatcaatctcaatatgtatcagctgcgttcgtactatgttttaaagaaagaaaatcaacatttataactttagtttaacaattaaactaacaacatactccctctattcccaattgataatcacatatatttttaggttattgtcaaatgatcaccatattagtattcgttctctaagtctattcgcataggagtaattaatggatattggtgcatatatccatgcacacaaccatttataaccaacatgcaatgttttggtttgttattggcataaggtaaacaatatatggctgagtaaggggacccatcccacatgacattgtaaaagaatgcaacatttaatagaaatgcaggatatttgtaaattgggtacaatatgatcaattgtaatgcatgactttccttgctcttgcactgatgagaccacagcaacgtcttcaagaaaccgcggatcgacgaaacggccgaaatctacgcgacaaacagagcacacaagcaaaacacactataagactactgaaacaggaaacaaaaccatttttaatggattctagggatttttatgaatttactgagacttgaatggacttaaacggagctcggatgaattacttatgaattttagaagataaactatgtttttactaataaagaaaagccttaataacttttattgcgtaatattacccagggctgatgtcagccgggggggctcggcaggtgggccccgcatgtcagcggcacaaggggagagggagggggtgccggcacgtgggccccacgggcaatggctaaaagggggggtggtccatcggctggtgggccccaccggggcagcggcacaaggcgggggagggggtgccggctgctggctcggcacggctcaagctggccggccatggcgtggcggcgacggcgcacgaccgccggcaacgacaagcggcggcgcgggaggcggcgcggacggcgcgaaaggtggcggcgtcggctgaatgcgacggcgcacacgcggagggtggcggcgctcatgggagggaggaaaggaagaaggagaggggatccctcaccgaggcgatgacggcgatcggcgcgggaagagacgagcggcggcggcggttcggagaacggtggacaaggtcaggcacaacctgggaaaggcgatgaccgggttaggagaagggaaggatgaccacggcgactagaacggccggccagagttgggcggaaatggagagctcaccggcgtgcgagggaggcggcgctttggcgacgtttggcggcaagcgagcggcggccgaggtgtgccgtggggagagcggcggagtgcacggcggaggccctagcggcgacggcgtgtggccggagatgggcggcggcggcggagctcgggtgtgccgtggggagagcggcggagtgcacgggcaagcgcggcaagagcgaaaaaaggtcgaggggggctcgagggagtgatttataggtacaggagggggcggacgtggcctgggaggtggccgatttggccggcgacgtggggtggagagagagagtgcggggtgggattcaaaatgaatctcgcccatttttgggcgcgtgcgagggcgggaggagcgggggaggggcggcgacgtgggcgcagggcgcggagtgggcacggggaggcgggaaaggcggcggtgtgggcggttgccgcggggtgcggtcggctggaggaagggacgaccccgacaggtggggtccacctgtcggcgtcccggagggagggggaaggggaaacgggccggtccaacaaggagaggccgagcgcggggtaaggcgaggtggactgggccgatggcccaagaagagggaagatgaggaaaataaaagggaaaaaaatgaattccctgggatttaaaattgcactttggtgatttttaattggtaaaaattatttccaaggctctgaaaattccactaaaaatcctgttaatatattgcaacatggggaactcaagaaaaattccaccacgccatttccgattattaattgcattgattaattagggattcaactctaggttaattaaacaat

SEQ ID NO: 62197 - DNA, 1222 bp, Oryza sativa
cccagagggggaaacttcagggcgtgacaatgtcgctcccgccatcgctgtttggcgctaccgcgcgagcagccgcgcgaacttcgccgccgctcggccatgcgtcgccgacagctcctctcgacgttttccccactgtcgctctcccagagaccccttcaacccccctcctttggccgccccgcctctttcctctagccgccggcctcccatccccttctatcgccgccgctctgcttccgccgctgccgcgcacaaccgcgcgccgtcgtcggccattccccgtcgattcctctcgcctccgccctcttggagctcccgtggccctccccgaaccgccgccttgaccgccggccttccttctcgtgcccgcgccgtgccacccatcccgccgccgcacggctgtcgtcgccggccgccgtcgcgccgcctccccatcatccgagccggtggatggaaccgcctcgaccccctctcgcctccagtgcccgcatccccctccgatttgccgccgctcgccggaacccgtcggctgccgtgcaccgtccgatctccgggcgcgctcccctcccctctcgtcatgccagcgtggacgccacctcagcccccgggcccgcttgaccgagtcaagccggcgcccagtcagcctcccccttcatccctttcccccgtgcgcgcggtccatggcgagcccaatggctacgcgtgggtccgccgctatcccgtccaaccggtgcacaccatgtgagccgcatccaccgattcaaggcaacgcgtcccgcgtgcgcccattcttccgtggaccgtctcaccgacaagcgggccccactcgggaccccgcgaagtgaacttggtccaccggaccgcctctctctccccacccgggctctaatgggccaatctcctttgggccacaccaatgccacccgaaacaagtctaatatatatccctccttgatttcctttccacccttgttccataaatcattttcctatattccaaaattccatgaatcattttccttggtcccgcatgtcaatgactgtcaataatattcttgagaatattatttctataaatttcaaaaatcaatttccccttgttccacaaaatatcttcccttgtccagaaattccaattaatcttccaaaattcatatctcgcgtaattccgattgactccgttccacttccagtttttctctaaaattgagatctattt

SEQ ID NO: 62198 - DNA, 25094 bp, Oryza sativa
ccttgtcgccccacctttgtggtacctcggtatctgtgctctctgagcgcgtataccaaatatcccacatacaccgttgtttgtaaaaacttgggaaatgggtttgagaagcctttaaaacccgtcatgtggtgtcggcgtgtttgaaaataaaataaaatgtgaaaacttgcgatgcgggggttgtgcctatgtggcactgtcccatatttgcatataaggaccgattactgtgggaaattcatccgagcatataacaagtgcgaccacacgggtgcaatgggacacccctggctgagtaattagctaattaggggagccttgatgccaagagaagtggattctccagggtggtgtcgggtaggacccctgggcttcctggcacagtatggtctgggaccaaacctgttgttggtctgggacccctctcgtcggcatatggtaaacctgtgtcggctctcgaaatgccttgtcatgaaagccttaaggtctcccgacgtggctgatctcacggactgggtgatccgggttagtaatgtcgtgtgggtaaagtgtaccccctctgcagaggttaactaactgttcgaacagtcgtgcccacggtcatgggtggatgtgaggtgtttcctgtagcatagatttgtttgcctatgctttgtgaaaagttgttgtgctgtgggaatcgttaccagaatcagcctatgtggcagatggatgacctgagtggtcaagaaacgaatctgtgtgattcgggatgtctacgggcatcatagactaggcttcccgagtggaagcggattgttgtgctgctgggcagttggactctgggaatccgagaaaatgaaaaggctctgggagccgactaatcaagtgaaatggctctgggagccgagaagtaatgatctgacccgggaggtcggtacattaccaattgagttgttgaaaaacatctcttaaaagtcgaatcgagacgcaagtctcttttcggcccaaacttagaaagaagtaaaccacttagtgatttcaaaaatgatttcaaaacaaaagatttacaaaacaaccttgcctctcttccaagcttgcattaaacacctaaaattcccgtgacttgctgagtacgaaagtactcacccttgctctatataaatatatatagttcctccgccttaaagagaagatgaagtggagtgaagaatatggtttcgtcctggttcccagccgtcgcctgtggtgttgggtgttagtccgttggttccgctactgctgctgttgttggtgtttcctcgtccgtgtcgtcggttgcattctcgggctgttctgagctgcaacctaagttaaggtaaataagtcctctatttattttaaggattgcaatgattcatatttgtcaccgtgggtaccaacactatgtcctgggactggtactgtgatcgcggtttcgtaggaagcggttcgcgccgtttttcctacgacacgctcctgtcaggtgccgttgtacggcggtgccggattgggagtgacaagaacccaatacgagattaatcaaaattcaaaataaaaataaaataaaatccaaaatagaaaaaaaaaaggagagtccaagtataaatacaatttaaaaatatttaaaattcggaattaaaaataagcaatattgaaagaagtatacattaataacccaatacgagattaatcaaaattcgaaataaaataaaataaaatccaaaaaaatacaatttaaaaatagctgaaatttggagttaaaaataaggaatattaaaagaggagtccatataagaacccaatacgagattaattaaaatttagaataaaaataaaaataaaattcgaaattagcaaaacaaataaaagaagagttcaagtaggaatacaatttaaaattagctgaaattcgaaattaaaaataagcaatattgaaataagtatccatataagaacccaatacgagattaattaaaatttagaaaaaaaaaaaaataatatccaaaattagaaaaattaaaagagagttcaagtaggaatataattcttaaacaactaaaattgaaaataaaaaataaaaatattaaaagaacacaatacgatattaattaaatttgaaataaaaattctgaaattagaaaaaaaataagatttcaattaggaatacaatttataaataactaaaattgggataaaaataaagactattgaaagaaaataccatctaaaacacatgacgagataaattaagtaatagacctataaaaggagtaaagtggtggaggttgatacgacgtataaaaactgttaataaaacaccaaatagaatcctaatgacgattaaaatgagggatgacaggcagaccatgaagcaaacgagcaaggcagtgccgggacttctagaaagtaaaaaaaaccattgataattatattcgatttttaaaatctaaataacaataaaaaggagaagcagcggacggggtgtataggagtatagttatagagccgccaacggttgacgggacttctagacaaaaaaaaaattccaacgatagttatgttcgatttttagaatcacaatgacaataaagagtagacggcggacgggccatgaaggagcatagtggcatcgttggacgagacttctaaaaatcataaaaaataaaacccaaacaagacaataaactttaaaaactatagggtctaatttttaaaggttcggaacttctaaaagtaaaaaaaacaatgataatcatgttcaattttaaaatctcaatgacaataaagaagggaggcagcaggcgagccgtagagaagtgcaatggtaaagccgctgacggtttggcgggacttctagaatgtaaaaaatgaacccaaacgataattatattagatttttaaaatcgcaatgtcaataaagagaagagacagtggacgggtcatagaggaatataatgacaatgtttgacgggacatctagaaattataaaaacgaaacccaacataacgataaactataaaactttaagatccaatttttaaaggttacaagaagaatgaagagaaatagtggtagatcgaccaagtaaataaagaaggagatgacataaggggtagcaactggtgtgactttaaaaaactatataattagaaacacggggatgataagatttggtctttcgaagtcttaaagacaatgagatagctatttaataaattttaagtaaaaaaatcctaaaaatatatatgattttgtttggatgctagccgcacaattgcgcgggccacccagctagataacatctatatgaatgtgggtaatgctagaaagtcttataacctgaaacaaaggtagtatatgataaaatagtaaatttaaaattatgagggtggtccccgaaaaaaaatatatgaaggtggaataaatttatattaacgagccagctcgtaagctgagttaagctaggctttaactaattaagattaatgaaacgagtgttaaaaaaacgatctgaaacgtgttgagccttaacgagccgactggctcgttatccacccctaggtgaaatcagcaaccaccgacggagtatggtttacacggttaaagatataaggaagcgttaagcttcctagcttctagttgatggcaccacgagtccggttcctgtagcttcttctgaggcagtaggagtaggcagttagtcagttaggcaccaggccgtggcctcctctcgatgcagagtcagtacagctatcaattagctatgtactactcgtactccgtatgctccaaacctaggagtacaaccttaaggcactgctggacagcagaatagcacatgctagtaaatctgaaataacaaccaaaccgcaataactgccccctccatcccaataatattagactagggtgtgtttttcacatcaaaattaaaattttaattgaaatttgaatgatgtgatggaaaagttaaaagtttgtgtgtgtaggaatgttttgatatgatggaaaagttaaaaatttgaagaaaaattttgaaactaaactcagcctaacaaagaatgtgacataactagtataacaaatctaaagggagaattatctagatttatattgtactaggttgtgtcacattccctcatagattatttttttataggatagagggagtatattgaacttgagagttacatcttacggagtacattcttttcactactatgaaggtcattcgtaacgagttgtaacactcatttgtaataaatagacgtctgatcaaggatgggtgcctcgtcatgaatgagtcgtcagtgatgtgaaaatctcatatgggtcaggtcccattccgtcaccaattgtagataatgggtgaaaaaaagtttatacagtgacggcgatgtagattactcatcaaagatgagggatcatcagtgatgggtttgaccgtgagacccaatcttcaatggggatttttttttcatgtcatatcttagtgcctatgtaccaggtcgttagccgttgtcactgttgagccattcacgattcccggttctatatcagtgtgtatagcaacccaaaacccatcgatcaatccaaagctcccctatctaccttatgcaaattaatatttgttaaaatttaggtctgaaaggacgtaaagtggtggttaattggtgatcacataaaacaactgttgggatctctagatgaaattaggttgcccatgtacaatacgggtactcggccgattgttgttccatcatcatggacgaccaccaccatctggcccgtctaccatgccgcctcgaacgcggagacactcggtagctggcaagcagaacgagtttgggcagcagagaggcggaacgggctaggtggagactggagtaaggggcagtggcgctgctcatcagaggaagggggtggcgctgcgagcgaattgtcggtctgctgccttgaatcgtaagggttcaagtttttatggttgaaaatgcccctggctaatggggaattggatattactctgttggagaatggccaacgtatatatccctaaatgaaacccaattttaaaattagggtttcttttgtgaaaaacttgctccaacagtttctctaaaattgtatctaaaaattagaattccttatcctcctttcttgctcttcacaagttgggagacgctttctcgctcccaatttctagaaggcgatacgtgaggagagctcacgcatggggagggatggggtaaaacaatttatgttcatgtatcagttggtagttacggccagtgggtccaccttttattattggaagttgatttaaagtatctcttgaagacaaaaatttatttacaccttaaattttaattaggaatttcaaaaacataattttagaatagatttttgggtatttgttggcatgctcttagtccacttttatcccaccattgatgcgctttaatttctgtgcaggtttctattcgatgagcattgaagcacttccctttatagaactatttcaacatgatactacatagggttatgtatcacgtgctaaaagccctgtaattttatataattaacttggaccatagtacatgtggttttataaaatttactcttaaaaatactttcatatgagtagttgctaataatatagtacaaaagaaattaatacttaaagtatacgttaaagagagtgttaaaataaaatgcagcttaaattttgggatagagagaatactgattagaatgagtgtctagaacggtaaaacattctttaaaaaacataaaaacttatatttgttaatttaaaaaattagaactattagaacacgcataaggtgttgtatacagtcaataacgcctcagtatgatggggtgggggtggaaggatttttacaccgtgtgttgtgttgtgtactcgtgggaaaaagattactttttgcatgaattaacgcacgtactgttctaaaatttaaaattataaaattaataatgctgtaaatctaaaaatataaaactaaaaataaaaaaaatacttattaccctaatacaactttttgttaattacgaatgcatgtgttaccaacaagtaatgcgtagtacggtaacgaattcgtagtgtatatatatgattctatccaccaaagatttacagtaaattttagtgcacataagcatatacatggtgcactgtcaatatatgattttagtgcatcccttctctataggtgtacatattcaggggtgcatgtagtggcttgtgcatatatgcgtacgccctcctccgtgtgtgatcgcaaaagagaaaagaaaaaggaactattatatataaacagcatatatataaactatatatttcgattatatatagctcctccctctggaagaacggcgggttgcagaagagtgaacttggatagttggcagctagagcagccagctagctagctggagtccttcttgcattggtgggcagactggaaagagtaagctagcgttaattttccctttgtttttctccgtctatatgcatgggttatcttaaattgcaggttatttctttaatttgtccattccagtaccttcagcagcttgttcttgttcttcgtgatcaacaagagatcgaacagcaagctagcatagcagtctaccagctaacttacaggctatctcgcggtctcgccatgttttgtagatcagctttagtgcaaaactacagattataaggtacttgattaattaattacatgtagagcttaccgctagcctaagctagctagctagctatacgaaacaattagggataaccatatactacgcttgatatatatgactgtaacttgtgaattaattcgtaacctccttcattctacgcttcttttgcttgtacgtactgacagtggcagagccaaaatttactgaaggttagagctaaactatatctcaattgatgggttgttagattttatctaaaatttacattatgatttaaagagatataaacttaattttagagataagactactttagacctgcataagcccctgcgtacatgacagtatcatcaccatatgtttgtcatcttctttccttattttgcacatacatacgcccatctcacaaacgaaaaataatttgtgaataaatttttatatacgtattcttagcctaaaagcaaaggctgaaaaataaacttcgatatgaaaaatcctgaaattaactctaaatttaaggttgaaaattcaaattttaattgataagtatatgtataaacacttattttgggacagatgcattatatacaggacattaaacagctactataagtttctacttctagtgtggtgatggctgtgccctaggcctgcattcgcccctccgtactgatgacagtgtcattaccatatgcttgtcagctttatctgcttgtctgattctttccttgattttgcgcacacctatgcaggaaattaaacagctagataggtttctagacttgtgtggtgatggcatctgctcctccagttcaggaagaacccctacagccagggacgaaccacttcaggagcctgcttgctgctgctgtgaggagcatcagttggagttatgcgatcttttggtccatttcaaccagttgcccagggtaataattagttcaatacgaatgcagttgcttggtgatattgttcacaaatataaaagattatggtattttaatttatccataaatataaaagatttgttatcctgagacataattttgtactattttatttcatacctatcaacttttgtactaatttgttcctcacctaccatagtttatatgtactccctcaatcccaatttaatcattccctaagcaaaaagcaccaaaactaaggacatcaaaatatgcatcattctcaaattaatcattacagttaattacagttaaggtgtttcatcgcttcatgtcccgtggattcccatgttttaaatattacatgtcattgcaccaatataaattaatcttggttggttgcatacaacacatttaatgatgtgcatttactgtttgcataagttcatttcataaaaaactatttgcataaataaacgaaaagacacttgttagatgatgatcattttgggaagacctcaaaaattttaagctgggatggaaggagtactactttattctcccgtataccactatgacgtgacattttgttatttccttaattctttacttaaaaatattataatcccttatatttatgaaggaaggtagtaactagttgtagaccagtggcgcaggtaaggagaaaaaaagtacggaccatagacaagtgctagagtgattactcaagaagaacaaagagaaaaacaacatattctcaattgcatgatattattggaacacaagaaggtcaaaattcgacagggcaacaaccacgattcattggcaaaagcacataaaagtacgaatgaaaaaataattcaacaaaacaggaagcaatgacgaatgttgatcaattattcaatttgatgctaaatcgacaaaattcccaatgtccttgagcctttccctttcctcttctatcagcttctcagttatcaaatctcgaaataaaaaacggcaaaggatcacaaattcacaattacaaatgagagaagtgtaggatcgaatcacaacaactaagccaaccagaggggggtgaatgattggtatacccaaaaaccgaaaaccgatcggtctgaccggagtagactagccagtctgaccgaagcgtagccgccggtctgaccagtgttgatattccggtctaaccgccaaaacttgtcgctgcctcctgttgccgacgctggtttgaccgtcgtgtgcccaccggtatgaccgccgcgatgccgccgatctgaccgccgtgtttttgattttacaagaagcacccaaccttcaactgaagtccgcctgcctccgatggtccaatctacaacctgcatgccttgtcagcactttgcctccctggctggcactgcccaacaggggaccctaatcggtgactaggcatgcgcccctccccttgcgtgacgctcccccctctagtccattactgttccttcatttgtttactgctagctaaatggccaaatgttccttgtaataaatgggtggtgctagagccttaacacccagagccttgcatgctaatgtatggaagtggatgctcattctaaagcaacataacaacaataccttatcataggcatctgtcttcacaatggactcatgaaagaaatctggcaatcctagaattggtgcttgtaccaaagccaacttaacgtaattaaaagtttgttgcaatgattcaatccatttatacttaacatcttttttgaccaactctgtcaagggtttgatgaccactccgtagtttttcatgaactttatgtagtaagcaaccaacccttagaatccacttagttgtttgaggttgttggcactgacgaattttgcacaaccttgattttctatggatctatagccactgcattgacaccaattatatgccttgttaaacagtttgtactgctataagatagcaaaaacttcctttaggtgttgcacgtgctcctcaaggttttcgctgtaattgaatatgtcatccacaaatagatagaagcacacattttcctattagggtagtaaagatagtattcatgaggccctgcaaagtggttgaagcattagtcaggccaaatggcttcaccctaaattcataaaggccttggcgtcttttaaaagttgttttgtgctcatcttggtttaacaacctgatctggtgataaccatacctgggatcaagcttagtaaaccattgtgcactagccagctcatcaaggacttaatctattacctatatggggaaatatccaatgaaaaccatcaaataaataaaaaccgataaaaactggacctatgagctttctaaattcatctaaaaaaatagagacggatgtaggcatgaactatattaattgccactgaatttttaagtaatttgttttatgaatttagaaaacttttaatccgatttttacccttttttcacttatttgattttatttacctgatattcccttacttacataatatacgttccgttagatattatctcccagtatttatatactaaattatataatacctaaaaaatattacctgtagagttttgacttggaatgatgggttctacaacggcgtggtaaagacgaggaagatatccaactcagcagacctcacggctggtcagctcgtcgtgcagagaagcgagcaactgagggagctttactactctctcctgtccggcgagtgcgaccaccgggcgaggaggcccattgccgcgctatcgccggaagatctcgcagacacagaatggtactacgtcgtctgcatgacctactccttccaacccggccaagggtgagtatttcatctgctagcttgatgccaatacacacatacgagatgatctgttgatcgatctgtgcctatacacatgactgatcaaacttgtcggttgatctgctagcttgatagcaactccaataataggagaaaacaaaagctgggtaaaccagcctggaaatgtctctcatgacatcttaataacaagatatacattgctgtactgtagtgttgttattgatctgctggggtacattctgtctgcaggctgccaggcaaaagctatgcaagcaatgcatctgtttggctgcgcaatgctcagtctgcagatagcaaaacatttctacgctcgctattagctaaggtacctatatatttccatgctgtgctgctcgatcatggcatgtcaaccatgatgccttcaaacaaagataatgttcatgcattatatatcctccatataatcatcatatttaattatttactccatatataatgtcatgatctgactcgatcgcacgctctccatgcatgcaccaatataatgtcgtcgaatgctgcagagcgcgtctattcaggtatatatgtaggtagagttgtacatagtactccctccttccaaaagtctaagtcatatttcattctttggttttttttaaaagtctaagttctatttgtagtcactatgtgctatattaatttttttatcgaaacccaaaaaatcattttagtacttattggttgcatatttattagttttatcacatagtgaaagagttaactatacattagtcttaatgaaaaagaaataggatttaaacttttagaaggaggaagtattttagctttcaaattgatatgtacgtgtacgtcgatcgatatctctgactccatctaaatatctatacatcttacagacaatcatctgcatccccttcacgagtggcgtgcttgagctggggaccactgatccggtaagctcatcgattgttcagcacgaacaactatgcatggagctatagctagctcaatcgtccagtgatatagacatagtgtattcctcatctgaaaagacacttttgagaatggatattaacacattttaataatatatagtacatatatatcttaacggggttatctataataatcattagaattaatcattagaagggcattttttctggaatgcgtttaagatattttttgtaggatagaggaagtatgtattactccatttgattattcatcttataaaaaaattatataacgattatttatttttgctataacatgtttaatcattaaagaatttttaagtatgatatatactttaagcatatttacattaatcttttaaataagataaatgatcaaatattattttaaaaatcaacaatatcctatatattaataaactaaggtgtatatatgagagaatatcacgtgctcaatatgttatagcatgtccggggttcgttttgctcaactggcaaggagcgacaaagccattgggcggcagggtgtgattcttcgtactcaccaagtcaccatttcctaaaattataaatatgatatagttgcgtctttcctaaatattattgatgctaagcttctttttatatcccacattctttttatgttattaccatctcacattttgagtctagcacagtaaagcactattccgtaacacccgagattccatggaaaatgcttcaaatcagccgtccgggcggaaggcaaaaatcggacgttcacatcacttgggataggtgcatacagtcagatttaggaaaactattcataatgattgagaattcaaacgttttttttcctccaactatttatccaaactatgaataaattatataatttgattcattataattaaatcttcggaacaagatctcacatcattgtattccgatgactttttttctgactctttttagtgttgcacagtgttaatggaatgtttcaataaatattggttgatgtttcacatagttatttgtaatgttgcacttggtgtttttccatgttctagcaagatcactgtaataagatctcatatgattatatttctaatgaaaaaatatatatgtgtgtttttcattaggtgtaaatggatttttcatgtgtgagaaatagtgtttcaactggaatttcactttgtaataaattttaagtttactgttgcaacaaaatgttgctcatagtattatttagatgttttaatagatattttcttatgtttactatttctttatgacagttgcacataataatatacttgatgaaacattcaaataatatgatgtgcaacattcacaaataagtaatgaaacatcataatatatttattgatcccgtgtacaacggtaaaacatcattcggataaaaagcttaaaatgtgcaacataatcaaattatatatgaaacatttatttctaacacgtgaaacattaaatcttaatgattgaaacatatataatttttcaatcaaaatataaccgtatgagatcttgttgtaaaggtttaattataaggaatacaaccatatgatcaaaatgacaataagataaatggtttggaaaataaatcatctcaaaggttactaatatatgttaatcaatacatgcatatagtatcatcaggtagcagttatgtggtcagcttgctgatatagtactctgatagcgtccgatattttgcgttgcatcggacgtccgagcggtagtctctcggtatgttacatcatgttttagactttcattatagcatatgcctgccacaacatggaacaggtaggaaagacaatttataatgcaagtgcatatacagatatacccttattatcatatttgtttttcacaatttgtttataactatttcaataacatgtaagaaagcgcagctattagggctgaaggggtcctggcctttctcaatgaatgattttacaatttttaaaaaggtactggaggtccatattttgtagtgtaaaatttggtactctcagtattaggaggtatgaaaatttgcactagaattttttagccttttaaggactgtaaaatttctcttttccaatagcccaataacaacaaaccacccccccccctcccccgcgttctctccctgaaatgttacaattaggtaggtagctaacataatttacctctccattttaatttatattcctaaaatattagctaattaatacttgcagaagataatagtttgttgcttattttgctaagatataggtttttttcccgtattgtttgcctggtaatttacagttttagctctatgatattaccaccgcttatgatgcctttctttttctactatatgtgattttttaagttcatacgataaattacctgtgggaaatgttgaaatttgtgtatatttgttacactgtattttttatgattgacatcacttgtcaggttggtctccataataattagatacttgctttaccactacatgtaagacaagagaacatacctttaatgaacagaataacattttgcaaactattgagctacaggaggggattctaaattctcgaggggacatcctcttgttatttgcatgtcatcaaaatggttatgagatttttttaaaaaaaacaacaagatatattaatatgtcatagatcactccataaacatgtaaactaattcaatttctgtgagttgcaaaaagaacaaattaaactatggctagttaacgtatattcactgttaaatttgtttttctcattgcaacatgtagaagttgtatttaacattacatgtttatgaagtgatttatcacatattaatctatttttaaaatttttaattttttctataaccattttaataatatgaaaataatgagaggatgtcccctcgatagtttagaatagtttctcatttgagctacaagcaaaggtagacatattccactaaatgttatgtttatgaaaactagagggtgcaacattcgaagatgtagtttttgctgttccactcagtataagtcagctcttcacaactaattatatgtggagtgctattgaattcccaggttttggaggacccaaagttggtaaaccgaatcgttgcatatttccaggagcttcagtttccgatatgcttagaggtactaatgagcactagcccttctccgaacgaaacggaagatgccgacatcgtgtccgaaggcctcatcactcacaacgccatcgaagaggggcagatggttgtctctgatgagtgcgtgtccaacgccaaccgcgatccaatcaccatggagatcgacgagctctacagcatctacgaggacctggacctggacatggacctggacctggacaccgtgcgctttctcgaggataatggctggcctgtgaaccccagctcttttcaactggtcccggcgtcgtcaacggaggcggtggcggcggcggcggcggctaatgatgtcgacggtgttgcgaattctcaagtgtcgtgcttcatggcttggaagagcgcgaagtcaaacgagatggctgtgccggtcgtcaccggtatagagtcacagaagttgctgaagaaagttgtggactgtggtgcacggatgagcactggtcgtggtagtagagcagcgctaactcaagagagtggcatcaagaaccatgtcatatcagagagaaggcgccgagagaagctcaatgagatgttcctgattctgaagtcaatagtcccctccatccacaaggttaattaattaatctagtgttccaacggttctatattatactgaaagttatatgaattattcatcgagatgatttgtcactacaggtggacaaagcatccatccttgaagaaacgattgcctacctcaaagtgttggagaaaagggtgaaagagttggagtccagcagcgagccatcacatcagcgcgcaaccgaaacaggacagcaaaggcgctgtgagatcaccgggaaggagctggtctctgagatcggtgtcagcggcggcggcgatgcagggagagaacaccaccacgtgaatgtcaccgtcacggacaaggtggttctcctggaggtgcagtgccgatggaaggagttggtgatgacacgagtgttcgacgcgatcaagagcctctgtcttgacgttctctccgtgcaggcgtcggcaccggatggtcttcttggactgaagatacaagctaaggtaaggtctatcgcgccgtagaattgcagtactgaacgatgcttatatgtttttttgccgtatggagttatggtgatctgttcgtatgttgttgcagtttgcttgttctggttcagtggcacctgggatgatcagcgaagctctccagaaagctatcggtggctagcgtcgagagcggcacacgtacgttagatgaatttgaaatgcaagaagcagaagcagaagtgcagaactacaatacgatcctcgtgaaattttatttattatatgctcgctggtccagaaaaatatttgtttcggaagatagcttcaatcacatcctcatgttcatgcatactactccctccgtattttaatgtatgacgccgttgacttttcgaccaacgtttgaccattcgttttattcaaattttttatacaaatataaaaatatttatgtcatgcttaaagaacatttgacgataaatcaagttacagtaaaataaataataattacataaattttttgaataagacgaagggtcaaatgttggaaaaaagtcaacggtgttatacattaaaatatgaaggtgttagttcttagtatactgtacggtgttgatgaggtaccgtacgtatgatatctgtatcgctttcatttggatcaggatattgtgcagtggttgttatatattagaactgcaacttaagcagttatatatgtgcatcttgatctagaataaaataaaggctagggtacatagcggtattataacaaaaatactgtaacagagatttactattatattggtactgtagcactcactctaactgttggataaaaaacagatagcctaaacttatgtgcagttgctattagacagttacaatagcaaactgcatttgattttaatccttttcattaccactatgtggtctaactgtattgaagacgtatataatggcatggttaaaattttacataatctatatataaaccgtccacacgcacctgtacacccggggcagcgcactgcagtgcacacgtccctcggccatcgcgtttgtggccgcgcgctcacgcagccgtgcttgacgacggcttgacgcgctcgcagtcgttggcacacgtacgtctctactacttatataataaaaaataaaaataagagatgatggtccatcgtccgtaaaaaaaccgtgggaaaaaaaccgtgcaaaaaaaactatgtccgataaaaaaacggacggaaaaaaaaatccgcggacgaaaaaaaccgtgtaaaaaaaaacaaagtccgatcaaacgggcgaaaaaaggggaaaaaaacaggaaaaaaagaaaaaaataagtccgatccaaaaaagtaggggcgaaataaagaaaaaaaagaaactaatctgactcggtctacacggtaaaaaagggcgaaaaaaggaaaaaaaattaaacgaatccgactctgtcgacgcggtaaagaaaagggcaaaaagaaaaaaagtatatgtccgattccaaagaaaatcgaatcctattatatgtgacacggcgtggtaaaaaaaaacaaatcgaatccgattccatcgacgcggtaaaaaacaagcgtaaaatttttttctgtccgattccaaaaaaaaaaagttgcgaaaaaagttttccgtttctctttctctatctctatctctatgtctactacttaaaaattaaaaagtgtttccgtcgtccatccgcaaaaaaaagcgtaaaaaagaaatcggcgaaaaaaatcgaatctgattatatgtgacgtggtaaaaaaaattaaagatgtttctgacatccgtagtaatgaaaaaatggcgaaaaaaagaaaaaaaaggaaagtccgattcaatatctatatatacctaattaagaaaatttgtatggcttatgggttatagaaatgccatcgcacgtgcgatcgatcccgctttaatacccctccgatggcaaaagataaaaaaagaaaggaaagaaaaaaaatgagagaccgcatcaaatttggacctaaattctaaagaaaacactactacaagaatactagataagattcaagaacactaagaaaacgccgacgccggaaggggagggtgtcgccgtcgcttctgaaccgccaccgccgtcgcagggatgtcggtatgtcgggccgctgccacattgttttgagagagaggggaggaggggaaatgattttagggttagggtttgggctgttgaacttttatataagtcggaatgaccgtctatcagatcggacggctctggcttctcccgcgtcaggccgaacgccatttccaggccgcccacacggaataagttcactttaggtcgcttaagttgttcctccccgattctattcctaggccgcccacgctattgggccgccttattgaccatgtgtaccctccgtacggaacaagttcactttatgtcacttcagctgaacttttttatttcattataaatatattttcttaaagagctcataacatgtaaaactaaaccttaatcatataatatttttatatttgttataattttaattacccgtcgcaacgcacgggtattttttctatgtcaaaaaaagaccacgacatataagtgagagatatataccccacacacacccacaggctcatgtttaactgaactgacaacagattttcaattacaggtctaattgttttatttaggtgattaaatttgttttcatttatataattagtttgctctatttaagctttttgaaaattgctaaaatttgagaataactttcctacttcgtattatattatttttagctaatggaattaatggaaaattaattatatatttttatctttttgattgaccaaaggtcactgcaattttatttcattattattattattattattattattattattattattattattattattattattattattattattattattattattattattattattattattattattattattcctttatatttttttcccaccagtatacatgattaaaactacctttactcgttgcaacgcatggacatcattgctagtagagaaaaaaattgaaaatatacaatttttttaccgaaattgcaagaatatactaaataggggaagatttgcgaaaatataccgcgtcgcactttgattaagcgagagcgcgatatcgcatcatggattagcgaagggccaacgctattgctaattgaaaccgcgggagcgctaatgcatcagtctcgcattccaaaagctcgagaacgactcggtctcgcacgatcgtagagcaatttcgcggccgtctgacgcgaacccagaccggcagggccccaagcagtctctttgacagcgcgagagcgcgtcccacctgctaatggaatgcatgagccatacacgtactggcatatgtccatctatatgtgtgttcagccatatatacatgcatgcttggctaatgtatatgcgtatacatgcatgagccaacaagaagatgatctttgagggctatatatatgtgtatgcatattcgtatatacggcatgttcacttgtggcctgcatggacacgattcagcggccgtattcactaacgatatgcacgtattcgccggtatagccggtatcgatttttgattgagcgataacaaagcgctctctcgctttgctagagcgataccgcgtgtcggtctcgtgcattgggacagcgagaccgatatctttgcgtgtgcgagaccggcggtccactcgtgcccggtcgtttcgccaatgtgggtcccacgacgtgctcggtctcgcgcgttgggattacgagaccgatttcgctctcgcgcttgcacaccacgataccgacgcaacaacgggtcggttccttcatgtggcggtctcgttgtttctacaagtgacaccgccagctcaaatgcaccctcacgagttgatagtggcggtatcgcatttgttgtcgcgaaactcggtatcgctctttcaagccacgatactgatagtatatttgtgcaaatcattcttcatccggtatatttttacaaaacaaatccacaaacagtatatttttgtaaatccggctagttgtgtgtggttttgcctggttggctccgtcgccgccggttgtcccgcttgcggcgcggagaggagacacggggtggttcatccgtttatttgttggtttcctccagcgcagaagctggagggtgtgaccgtgaccgatccccgatcaccgattccccgacccttcgttggttgactaccgcagtggattgctatcagtttttttttttagccacatccgtgtcagcgataaattgaagcctctctgatcagtggcgataaatggcgacgacattgacatgcttctgtgtaactctgtcagatcacggcagtgtctagttcccttccaactttcaaaaattccgtcatatctacatacatacgtagagtattaaatgtggacaaaaaaaaaccaattatacagtttgtatgtgaattacgagacaaatcttttaaacctaattacatcatgatttgacaatatggtgctacagcaaacatttgttaatgatgaattaattagacttaatagattcgtcttgtagtttacaggcaaaatctataatttgttttgttagcaaaattggttatatagcatcgaaagttcacgtttttggttttatagcaccgaatactaccggttcactttagtagcactcaaagttcaccatgtttccatttttaacacttccgtcaattctcgattgttttccgtccgtcttgatccagccacacacacgatatgacgtttctacccctcacaagtacaagtataatgcatgtcaatgaggggtagaaatatcatatcatgtgtgtggctggatcaataacgatcaagacatacggaaaaattgacggaagtgctaaaaataggaacagggtgaactttggatgctattaaagtgaaccggtaactttcggtgctataaaaccaaaaacgtgaactttcgatgctatataaccaattttgcttttgttttgttattagtctacgtttaatactttaaatatgtatccgtatatgtcaaaaaaaattaggtaaacaactaaacacttcgttggcctgcagtagagtagagtcgtagaccatactatatgtgtcgaccattgggccttggcacggggtggcactgtcgctagtgtcttcgccaagctagtttcgcaggaggaccgcaacgctagctatactaatggtccaacgaaatactttatgtgctatgtatgtactaccatgttgatgttaatataaacctttcgctccaacgatccaccgtgctatagtatttatttttttttaattcggttaaaaacagtcagaaggtcgttgatgataatatttatttaaacaactggttaattattacccgtgcactattatggaacaacaaaatagatcaagtaaacatataatttattttcctatcttttttatttttttttgaaaattatattagctatacataagattggttgagtggttctggcctttttttcagcttgtcattaggggtgggcgttcgctttattcggggttcccagttcggtttgtacggttttgtggatgttcgttttttgaaaaataccaaccgatttcatcagaaaatttttttaaaaaatgagcccagataaatcgaataacttcggtactgtcagggttacggataaggcataccctctatcatatgacttatggaatataccgataaggtatacattcacgtatacgggttgtttccgtatacgctttaggaatttatctcaagttatggaaaatatatctataagtttaggaatttccgaagtcctactcggaaagggtaaaatctctagtatatcgtgtcggtttacatatctccaagttttacttgggggttaaggtattccacggtataaaagggacccctagggagaggcaaagggcatcgcatctcatcaccaacacactcaccaaagtttacgaagccagagtccacgggaaccaactcgccgggagatctcgtcgaatccctcgactacgatctcatcggtatcacttgtttcagttactctctttgtaatctgttctcatcatcatcaatcacatataaactggactagggttattacttgataaggggcctgaaccagtataattcttgtcttttgtctgttttgatgtcgtactacgtagacccctgctccaacgtaccttaatactctattcatccagtccgcgagtatcactcgttgacaagtacggtgtcggtttctaccgatcaagccaaccaagcgctctgtctctacccatggaggtgcagtcgtactagtggtctggttgggccattgtttgctcagaccccacaagaacattatgtacacaatgggcctatgagggcttatgcatccttcaaatggagcaacatttcccagaactcacgacgggacgggatatagtgcgcgctccagccgctgaggacgactacttcggttttattgggagttcggttcatgcgtgataaaactgatctctaaaccgaggaccgaagcagcgcaaagtaaaaattgagccttctcccgaaaactggagaaaccactagttcggctcgattcgattcggtgttcggtccacggtttatttctgcccacccctacttgttattcagttttgttacaggagaggagaagtatatgccatgcaagctatggaggtaggaaaggcgaacggatgaaactcctcttttatagtagctgataagtaataagtgttggagtagagatccccatcaattaccccatccgctaaagaaagccaccaaggatacaagggaccatattggtggtttattgaagaccattggatttctgcatatcaaatacgatggcctaaagtcgagtcctcaaaggatcgaaaactcttcaataatacacttgagggataaagcgcgcgaagctctcaagtaattcgaagagcatacaattgccaaaggaaattcaagctaaaacttagacaacgctcttcacgaaggaaagaataatcccaatattcctagaagatgctcagggaccactagccatggaaccgggaatcctagtgcttagcttggcccatgggcctaaaccctagtcgaaatacatttctaacgctcattgacttgtgtattgcacacaagttcaattatctctcgaacgagattgagtgaatagtaacatagagagaacattgctgcatcacaaagtggtctgctgtggctgcaactaggtatttgttgcccatatctatattgttttgggaggttatgagtaaagatgaatcatccatttaagttttgggtatagagataataatacccactttacccatattcataaggtactagaaaagaaacgcaacaaagcagcgtaataggccaaccattaggaaatatcaatggtccagcctgtataatgttttaatgggcaagttttataaatgttttttaaacaagttatataaacggagaagatgtgttttcattagcatccaggatcaattccttctcggctcttctcttgcttgacccgatcatcactgttggcatcactatccacttctatttccccacccctatcctctcccttgacatcatccgctgcctctcccagtcccaggtccttcttctccataggaaaagaagcttgagtcatcattatcgctagtttaaataggatggttgttttggctctgcaccatagctattcttctagcccaaccggcaaaaactcaagaaaataattagcccttttccacgattaaatcaacgattgtcgacttaaatagaaaagatttatacttgacgctcacccagatatcactcctccactggaacattggatttccagaagggctgtaatatgatcttgggatgtcaatttctattcctattagttgatttctaatgaaggagggcggcggcagcagggggaccggtgagatgacgcagacgaaggaggaggcaaaaggtggaggaggaagcaagaaaccgggtcagatcaaggtaggagatgtggttgtctcggtaaattcagaagtcaagaaaggaaagaattatgtttctgagtttgatgatgatgaagatgatttgttggaattcgataaggagccgcgggtgattagcgacaagaaaggggatgatcaaaagggtggtgcacgggtgaaagtttgctctaggtgcactcaaaagggacatggtgttgctgattgtaaggtggatgtttattgcgatatctgcgactgtagcgagcatgtcaaccacaaatgtccagtcctaaagcttccaaagccggtggtgcaggcggttgggtatgcggttgaaggcctagggtttcagcacatcccacatcaaccgcttcaaaggaacaagaaaaacacgaagaaggctcttgtgcgtgtggttggtggtgctctttcggtggaaaggttggtcactcttctccacaagttgtgtccaactaaatggaagtgggagccggtgccgcacgggaaggacgcttttgttgttcttttcccttcaaagggcgaattgcaatgggccatcaactttgggggtgcagatgtgaaggaaggaggggtagccatgggagtgagggtggagtttgaagagtggtttgtggaagaagagggttttcttctacctaaggtatgggttaaggtttttggactaaggaagaaactaagggaatatttaactttatgggcagtaggctctcttttaggggcaacataattggttgatatgaaaactactaaaaagaatgtttttgggatattgtttgtggctatccttaacccaaaattgattcctaaggtgcttgatgtggtaattggggatcattattttgagttaaaatttgaggtggagaagaaaggagtcgatgagaatggggaagaagtggagtttaatttggaggattgggatggagatgaggaggatggtaatgtagagggagaggaaagtggagaagacaatgaaggaagggagaagggaccaaaaatgtcaaaggttgatgatatggtaaccgatgacaatcatgataggggtgaagggagtaaagaggcacaggaaggtgctgatttagcgaaagaaatggatttttctatgatggctgaaaatatcttggatgtggctgtccaagatgtgttggaagaggtgtatgaaagggtagagagggaggaattggaggaaaatgaggcaggggtgcagcaggaaaagattgttcagctggctaatgttggagaggtgtcgatgacaccaaaaagggctagcgagaggttgatgggcagcagcgggagacattcacttgaaaaggctaagtccag

SEQ ID NO: 62199 - DNA, 29871 bp, Oryza sativa
  unsure (1)..(29871): unsure at all n locations
gcagccctacaaaagaacaagaaacgcttactgtctcacatgagaattcaatgttccaaaaaagtatcaaatcggtaatcagttttgtgcggtcacccacctataatgtttatgcgatataatcggtcacttaaagtgtaagcagttttatgcggtcatcaccccaccttatagcgattatgcgatatgatcagtcacttaaagtgtacaggaatgtggcacctattcattgtatgcggccttgtcgacattttttttaagcactgcatgacggcatgagatctgctgaaatgtgattctgagaaaagctctacacgtgaacttgggcactgcattgcctccaccatatgctttctctgaatttattcgtacaaaggtactctctacaaactaattggtttgtatgcatacaagcaatcccacatacttacttcttcttcggaagttcttccgtttgtcatgagtggcagttggcgtaaatgtgagtaaagttgatcatggatgatgtgtgttaaaaataaacattatattagtaagctcagcatgttctgaagtttgttgagttttgctcaacctgattgctaaggaaaaataaacgttatagaaactcagaattatagatgctggtgggaaggaagaaaatagaggaataccacatgtaactttgcttaagataatcctgcacaacaatgaatggtgacctaatgttttgtgatcctgcaaagactagttttacagaattagaaattattgtttttattctaaggaaacattgaagtcgcaaatacaacagctgaactcttttcagttatctagagtttttttagatagaaaattatttagagcttaccagtattgctcttagatcttctccattcatttctgcacaaaagttggagtggaacaaaatacaaggcataataatctatataaattatatattacattggtaaaagagatacagattgggagtttttcttagcttccaattcttctagagatcgaaagcatctaggctacaaaagttccatttctgcattacaagaaaccaagcagttaacaagctaacggccaatgttaatcagcttgatctgttaacaaaatgtaatgcattacctaggttgcaattggagctatatacatagggcaatattagcacaccatacatatagaaaaatcactcctcgatcacaatctccatgtccatgtccatgtcagatcttctgcccctgagcccaagaatctcgccattggcaatcctttgcaggtcagcgacagatagctgatcaagccatcttacaacatggtttgctgcttggagctcataggcagggtatcggcttgcaaccgcaacacacctcatcccagcagtatgcgcagattctattgtcgaatttgagttacccagcacaagacaaacatcaggctcaagaccaagttgccctgctgtgacctcaaacatctccccctcgggtttccctcggcagaaatcctctgctgccactatagcatcaaagtagccttgaagaccaacagcttttatcccttcttctaggctcaaccgtgggcgaggagttgtgattgctattggaatgtcaaaatccacaagggtgttcaggaaatcaagaacacctggtcgcagttggtagaatctaccacgtaatgttttatatattacctccttgcgtgctgccagcctttgtacttcttgtggatcttctgaccaatgtaagacttctaaaatagcctgatcagtcctcatcccctcaatttccttcagcactgcatctggaggaaaagactttgcctcttcaagtgataacacgtaccaaactcgaggctccaaatctggatcatcatcttccacaacaactccttcccactccaagatcacaccaaattgattactacttaccatttcttccttctttagtttcttctttgagggtggtcttctagccatttctggtgacgccaacagccagctgaggttttcagggagcctataaaccaatttgtagaacacattatcctcatgggcctgggggcgattcttcaggtcagtggcatgaggcttgacacgtatcctcttcattctcatactttgacccacagtttttgcaagtgaaagcacattcagtgtagaatgtgagttacttgaccagcatttcctgtaaagtttgtgaatggactggtgggaactaccaaataagctgactgaaaatatcatctcgtcccgaacccctagattatcaaatccttcgtggcaagtctggttctgctcctataaagaacaaagagaacaagagaagaatcaaacttgacctgtcttaaaaacaaagaaatcagtacaagtacaaaaatgcgcaactatattagagggaacagaaggccctataaatcatcaatcttaagttaagtcactcaaagtttttgtgggaggttgggggttctcctggacaatgcaagttccgcaaaacgtgcaacttatatttggggagcttaagttctcccaaaaaacttgcatagcggcaaaagttgtcaatatactagattgccatatgcatttgatttgcaacttacttcacactattgcggtatacgattgctacttgtaggacgcactcttccaaactgctaatttgagttcgagaaagaaaagaatgccgagccccaataatgtttgccagcatctgacagcaataatactacatgaagcaaagtgccttttactaaagagatccttttgcatctgagacaaggttattgtaggtaccaggagaggaaaaaataaaagttcagcttagtacaaaaggttgcacgaactgaagcacaattgctgagcttaagcaggtagtgacattgcaaagttctagccaatgacacatatatacagctccaacaaaatgccaaacaatggggcatgctcacacacacacacgaactacccccttttcagtattttctcccacgcagacgaactaggagcatgcgcaaaacaagaatagccaaatgcttcaactaccaaatcccagacaatccaagtgaaaccggatgaatcttgctgacctgaggaggaggaggaggatgagcagccgaagagtgagtgcttcggcaggaggagcgagcggggggccgaagcagaccagacgaggaggcgctcttgtcctctgcgcttgcgctccccttgggtggtggtggccaatggccatggcttccccacccggataagccgacagacgtgtggccgtgtgggcggctgcctctccagttcgtcccggacacggtctccgcacgacaatggcaggtggggcctgctgcggtgtgggccactttgtcagtgagagcagaacggaaacgaaacggcggggaggcccaggggaagttgaggcgctcgcggttctcgatgggccatgggaagttgtatcggcatgtgtgagcggtgcgcccagaggcccatgaaaagttgtgtcgaaccagttccggttattttgccatagtcagctgtccaacgattattttgcgccatacagttaaagagctgtgagattttttttttcttgatgcatttattaattcaacatctttcctttgtctcaaacaagtctatacggaaaatttctagaggaatgcaaacctcttaaattctttcaataatatgttgttccaaaaaaagcctcaaagcagattttaaatataagcttctgcggtaagaaatatgaataagtgattgcttgtttatatgcataactaaaaagtgttatattttaggattttatattattcaaaaataatttagaattattatttattttatttgtgactggctttattatccaaagtactttaaacgcaacttttcattttttatatttgcataattttttttaataagacgagtggtcaaacagtacaagtaaaaggtcataatcctttatattatggaacggagggagtatagcagtatctacaatgtgggaataagagtaatcacagcatcagcaatgtatatagcaaaaagtgattaatatatatgggactcacatacatggactttaaatatagtaatatacacgagataacattaggagagatagataataggagtattgtttattttatatgggtagtccatatgcatatagggtttgtttggctactagatttatggttgcgctgtagctgcaccaacaatgccgcacacacgcagcggtagcatagccacagccgatgttgtccgcttgccgaatagcccaatggatatctttcattattttcttcgtattgatttattgtacaatgttactgtatgactgatgtaatattatattatctatgaaccatgttattgggatatcctaagggaatcttatcagtatattgtaaatgtagatcttaagcaccaaatggagcaaatgggctctttgcttagacctgatatctcaaataaaaaattgatattttttacaaacatccaccttaacacttattggacttgggctctatagagttacatgcatcctatatattgtataaaaatcatcagacgaatctctatgttttcttatccatattatttaaattttatttaatattaatggtgttctatatatctatataccgctaatgctctgacactcctcttgagatagaggggataaaaattcctttgttccaaagtaggcagggaaggttgcagaaaaaccccacgctccgccgctaccgcgatggtcgctccgacgaccaccaccccgcctcctcctccgccgccgccgtcagagtccacgcctaccagcgacccaaagcccccgcctccgccgccgacgtcttcgaccgcggcaccgaagaagcggaagctggaggaggtggggtttcatcactcaccctactacaacatcagagcagccgtcgccaacctccgcggccgcttcattcaggtctcccccacctcgaaccctaagatatttgttgagtggcatttctctgctctgccatggcagcagcagcagcagcagcacaatcaactgaacaggtcatgttcccgtgttctagcgcaacgtgtatgggatgattttgcttgacgtggataagtgtgatcaatggttcgagttcgagagctcgaagctatttgctccgtgctgtgcttgctggtgaaactctgggagaatttaaattaaagttgaagttgaattttgggccaagtctcaatacaattaggcgcgtaatctctttctagctgaaatttatggtgtgatgattctgaactgagttgttaatgccaccattgtcctactatgcaaatgaacattttcatggctgatgtgtggctttgggaggtattgagagttttaccccatattgttaatcaagaggtatacctcgctctcagtagagactatacttcccgattaacactaaaaatacctctctacctcccaaggaccagagaaaaatcatattattgtatcataacttacaccaaattgatatccctgcttgctgttggtttgacaattgtaaatgcagtttgttctgggaagaacatgaatccgctctaaaatgtttactttttccttgttgttttgaagttatgcaaaggcactgatacccaaaagaaagatgccgctcttgagatcctgaaaggtaaatcctaatttatattgtttttgaacagacatgcggaacgtcctgattacattttgagtttttgactattttttatcatcatgctcgcaagtacagaaatcagtatggtataggagattatgttgatcactcgaacaattttactttcaccttctttcataaaagcacacttctctcttgatattttgcacactaagattacctcaggtgatttgacagtcattgcctctctgtagatgtagtccatagtcacttcgtgctgttaagatatctaaaacccttgtgattggacacttgcaatttttcatcagttgttacatttctataacttgtaaacatgttgtttatagtcattatacacttttacaaattcctacttatattgtcacatgatgtattgtattaggcttcttaatgcaagcataactatcggttacatactccaataataagatgcctagtaccctacattagtaagtaagtgaaatatagtgcattagtcggtcattctgttagtgtaaaaaaggctactgatgtacttattcataatatcctgcattagcccaatcataattagcaatttaaaatgtacatgttatctgtaaagttaaaaggtcaaccaaagtggatccctgttgtttggcctacaaaatctgttgagcacctggagcttaatgttatatctggatgtgtttattgatgataagtttaagcaatcttcccttggttcacactatgcagagataaaagttctcatggaattatccaaggaaatgcgacttgatctcccaactgcagctgggcctgtaaaactgatggatgagcctacatcaagagatgccagaaatatgcctgcagggaaaatcccacccggagagaagaatcaagttcgtccagcagaccaggctgcatcctttatgcatagttctggtgagaaggtaccactcaatcctgtggacattaagcatgatgccaaaccgagtgtaacagattctacaaagaaatcaggacaatgtttgcaaggatcttatattgtcggtggatctcccattggctggaatttccttatgtggcctggaagtagcacaaggtactgtggtttaaccagatcagagtggttggcacgtcaatctgcaaaatgaaatgccatgatcctaccccccagcaatctaacaagtaaaggcagtcaaactaataccgtactttcagatattcctgggacaatagcacaattatttgctggtagccgatccgatattattgagcagcggatgacacctcagaatgatatatatgacatggtaaggcatggtagtatcaatagaaagcaacttttgaatgcttttgatcgctccctacaggatcaatcaccactagatatcatgtttttcttgtagtaaactgtatgagccaagcgctcttgctatgtttttctgttcagaaatggaaaaatcaagtaatgtaagcgcatggcaacgctgatatagtgatgtatgctcttgcttaacaagttagaagtgtccgactacttttccttcctttgttttttgttttttttttggcaacttacaaggaagtatctgatttcatattgtcgcttatatttgtcaatcttgctcaaaccctggcagtggacggcgtccgaagtgctcttcagtgtgtgctgctgaaaactccaatgtatggtccttccagacgattatcagttgcaggaaaacagaaatcaccctaaataagggattgcttacaagctttcaagattcaactcaagttttggaaaaaataatttcaaactaggcccaaggtaccacaatattgtacatgaaattctcctcatgcaggtgcagctgatttgttttgttagtcaggtcctaaagatgccagagtcaactgtcgcttctccctgtttaaattcattttttcatacaccggtgtagtaatcaacaatgttttagacaattaatgaaatggctgattgaattggctggtggaatgtggaagcgatctgtggccggaatttatgatatttatccctaccgttttcacccctgcatatataatgatacagtactccctatgccatgtctcaaattataacgcgtggtttgacttggcatagtattcagaatcaaactttaattattatccatagtaaatccaatgccataaaagtacatatatgctgaggttcttaaaactattatataaactagaaaaaatgcccactattatataactagaaaaatatccgtgcgttgcaacgggtagaaatatttttggatcgctatacattttactctttgattttgtaccaaaagttcatttcattccttccttgtcaactggagttgtaggtccagctcgcagagccgactgttgtcttcaacctccgtaagacaatgtcgtgttcgtacatgccaaaaccgatcctccccatcaaatccgatcaaatcctccccatcaaatccggttgaatctttctcgatcttccaaaattgattgagggtttttgatacactcaatcccctcgtttttattaaaatcggagctacaaaactcgggagatatcctctttccgtttttattaaaatcgaagcgacaaaactcgggataaaaagggtgaattttaaatggagattaaattcagtgaattaaagcggagttaaaaggggaaatcatagtaaaatggttagggagtagcggggaattgatttttggcaatcaattggaggagggaacgcatgggaaggcagatcgacgaggtggtggcgctagtgtttagccgggtgttgacgaaaaaattgaacacaccggcctgggagatctgcttagctcctgtgcaggtccaaatcttgatgagatgcagccatgccagtcagtttgatcctgcaactgacaagatatgcaaacagtagatcaaacagccaatcggctgacaagccgatggagtagttccagccgatagccgataatagccgatgccgataccagccgatagcgatagggtttaagcgatcggctatatgtccaatgtagataatgatataaaggcaatcggctgatgatgatgaaataaaataacaatataatccagtataaaccaatcggcaaataatgatatgataaataagcatcgatccgaaggttagagcacacatcggctggaggtctgatgtcatgaaatccacaagattagattaaacagtgaaacctttgttgtcatcggctaaatccagcttatatgtatatacaatccttatgagctgatgcaacatccagataactcattggctgaaacctcgatgaaacccttattggcaatcaagaagcagcctagagattatggttctaaacacgacttagtagatcaaacttaattgatgcagcactaagtatgaaaagaaacataatatctaggcaatcaagccgttgactgagttttcagggtggagggtggtagatgtctaagctaatctaatctaacaacgcgatttagccgataccggcagaaaccctaaaaagagaagcagtcgatagagctaaattgatatgctaagactagattaacatagacatatgataaataggtaggcaaatatatcatccaaaccagagcaatcaaagaggtcgaatgtactgatgcagccttgaacgacgccgacgtaaatgatacaattgcccgggccagcgaaacattggacttaccccttagccggagatcgaacaccgatgcagccccgcgtcaggtgccaagttccgccggacgataaaataaagtagaaaaggtaaaaggtggcgatgcgccgaattgtattgatcgtgaagatagattacatagaccccgggtgtacatatttatacccatgtgttgatacaagttcttgccggacaagaaagaaactttcctaaagataaaaggaaactaacaaattatttctaattaatagataacttgccatgccgcattctctttgaactcggtcttttctggataagcttcatttagtagatcaatctccttaaccgaatatagcaagaatccgacaactgacgacttgacaactctcatcggctaatctcagaacttcaaagccgatgactactccggacttaccaaatttcactgttaacaccgggcgacaaaaaaaatatggcacgtaaaaaaatccttaccgcatgcgaaaaaatgcaactaaaaaaacataaacaaagaaaaaaagtatgaaaaaaaacccagtaaaaaggcctagaaaaaagtaaaaaaactgtggatgaaaaaaagagaaaaaaggtgaagaaaaaaaggcggacgaaaaaaacaatggatggaaaaaaacagaaaaaaaataaaaaaaataaaaaggttcagaaggacggaaataaagaaaaaaaggacggataaaaaagaaaaaaaaagaagcggacagaaagaaaaaaaaggacggagaaaaaaaggaaatgataaaagaaaaagaaaaaaggtgaaaaataaaaaaaattacggaaaccttgcgtatttttttaattataggtataaatatagatatgctcatgttcttaccgtttccttaccgatttgaattggaattgaattggaatcaaacccgtcttgttccggactccagctgctcctgccatccatagagtttgagttcatctcaaattgcaaacttaacgtcgggtgattataaaaatttatttgagccattatccaggcaacctcgattgggcaggttgaatagccgatatggcagaaggagaggagaagaggggcaccggtggcagaggagacaagaaggagaaggtccccctcgggttccggttcgagccgaaggaggagctcgtcgagcacccctcgccgcagcccgggccccaagcaatcgccagcatcgcctcttccgatggagaattctcctcgccgcagcccgggccggcaatgggaaccagcgaagaggcgtcgggcaataagaggcctgcggaggagcacgccgccgtggcgcagaggccgcatcagcagcggaagctgaccatgggaggagcgccgccgccaccgcccgcgtcgtacatcggcggcgccggcggcatgcaaatgccgctgagaacggccgtgcacgacaatcgagccgggcaccgatggcacgtccggccggccacgcaacggcgcctcctcctcggcagcacgcgacggtcaatggcccgatgcgaatgccgaacgggcaggtggtatacggcgaccagatgatgatgcgacggcaaatggcgacggccgcaaacaacaaggcaaatgatgtttttgcaacagctggcggcacgcaatggccagcaggggatggtggtggcagacaacgggcaggcctcgtcctcgcaacggccgccgccggcgtgcaacggccagcaggcgcttgttgttcagggatcgcaggtggcaagcaacggacagatgtcgccggtacaacgacagcgggcggcaatggcagcggcgtacaacaactaccagtatcaccagatgcttctgcaacagcagcagcagcagcaggcggcaatggcgtacaacctccaggcgcagcatctacaggggagagaggtggtggcacacacgacgtcggcacaacagccgcaagcgatgatgccagcgcagggggcggaggtggaacaaaacggagagacgaagtcgtcggcgcaacgggcgccggcggcatgcaactgcccggcgcatgtgcagcggccgcaggcgcggccattcaacaacgtccctccgacgccattgcgtcctcgcccggcaacggcagcgcctactaactccggcaactcctttgatcggacactggtgatgcgacgaccgccgtcgccgtccgtcgtccagccacggcccgcgcaggagacgcccgagatgcacgcgaggcgtgtgctttggcagctcgtgaaggagctcttccgccaacgacgtatcgatcaggctcaagccgctgctgcagctgagcaagaacggctgatgatgacgccgccggcgcaggcgccgcagcagccgtgctccgacgcagtacggtgcaacgatgatggcgagaagcgttccgcggaggtggcaactacggaggtggcgccggatgggagcgcgtccgcagaaggcaacgatcgtcaacgtgagtcacgtgactcaccggtcgctccacggaccgagtgatttagggccccgttcacatagatgccaatttaaagcataccattattgataaaattaataaatatatggatgtttctaaaccatatcattattcattttggcagtgatttgaacatgcctttagttgttgctaaaattgaagttgggatggtatatctttcttggaatttgtgataatgcttttttttttgcaagaatatgatatactagcttatatattccatctctttggcaaaggaggtggaggctgcggcggcggtgatggtgaaggggacggatccagtggcggcggtgctcgatggtgacttcaaggataccaatggtgagccaccaccacgacggcggcggcggctgcggcggccacgatggccgggcttaacttttctatgttactcatgtctgaactggttgtgatgttttttctagccagatcctacatctgtcactttgttgcagcgatatgtttcttttagggcatgagcaacgtatcttgccagactcagtagtaacgtgggcccaagatacaggtgatagtagtatatgaagttacccacaatgcttatttgtgtgagtgagaagtaaggtaggatcaggggcgaagccaggatttgagattagggggtgtgggataaagataaaccgtgagaccaaataactaatattgatagtaaaggagatcaaatagtcaccgtcaataacaagcaatatgtaaactagttctttaagaaaaacttgaattttagctctttaataatatcattggaagtttaaaactagtctttattgctaaattcttttaatgtaaactataaaataatctcacaaataagtatcatctattttactttgaaaaatatgagaaatcacaaactagttttgtaaatcatgtttcttgctaatatttttagacttgctaactaactaaactgataatactttcaagctacacaaaataaactagatagatacttatcttagctaacttaatatagagtaaaaacataggggtatagtggtggtagtgtttggataggggggtgttggcaccctttggcactccccttacctgcgctactggtaggatccacttaaaagttgattcctgtgaacggtgcgaaacaatgactccatggtttcttctactaatattttacttgcatgtgccagatttacttctactactcatttactgtacaaatgatgatatttatttcttatgtaccggtagtagctctatgataaggtattagttgcttatgacttttacaatggttgccacctggtagcaagagtgcattcaatgcttaatacctagtttttcatcacattatggacccttaagggtagatctgttttgaaggaattatgacacatagaaaaaagaaaaatgaaggaatatgaatgcatacacatttctatccatatgaacttttccatgagttctgagtggatgaaaaattcactataccttctctttacaacttgtaggaaaggaaaatttctttgttttttctatagctacattcctatgaactaaatagcgttcagaggaattaatcctcaagaatctgaatcatttgaaattcttcaaaaacgaataggccttaagctttgtttgcacggcgccaccacggcactatgctcagggtggggttcctattacctgccgtgctactgtgcacaacattcctcagaactgttttggaggttactatcaaaaaaaaaaagtgtccaagaaagagttatgatccttaatcctactcatagcctgagaaatctagaaagaaaggaatcaaaagatcttcgagcaaaagaaaacggcagtctccaaccttatggcaaaaataaaggaagaggcaagaacctggataatggtaagcgcaaggcgacttgaagaattcatcccaacttaactacggcgcttatgtaattttgtacagctcttttttacttctaggggaagtttttttttacgtctatatctaatgaaataatgaaatagtacaatctcatgttgattccttaaaaaaaaaagatgtacgaaaccatgcacaagcaattttagtgatctcctacaggccaaaagcaccacgtgcggaaaaattgcagcgatcttctcagaagaagaagaagaaaataataataattttcaatgatcactttcacttatattattcaaacgtttgtggctccatcaggaaagaaaattattcaacgtccgtagctccacgagggaaataaggtgtataaaagataacttttctagtggactattatttagtcttttgtggctccttctggaatgggaaacaaatttagccacaatgaaaataaagtttagaaaatatagtttctctagtgggctattattcaattgtttgtagcatcatcgggacaaaaatgtaggaaaaaatgtttgccgcttcatcagaacatcagcaaagagattgttggtaaaattccatggagctctccttttgcagctcaaataggccagggcagcaacaaaatcacctccctaactgggcttatgtggaaaaaaaaaagcttcaccgtcaaatgtaaatcgtttgcggcttcatcagaacatcaacaaagagattgtagggaaaattccatggatatctccttttggagctcaaataggccagggcagcaacaaaatcactgtggaaaaaaaactccatggatctctccttttggagctcaaataggccagggcagcaacaaaatcactgtggaaaaaaaaaacttcaccgtcaaacataggccagggcagcaacaaaatcactgtggaaaaaaaaaaacttcaccgtcaaaagtaaaaatgtgaaattgttaaatagggcccaaccgggttcgaaccggtgacctcttgatctgcagtcaaatgctctaccactgagctatggacccaatgatgctgatgtgcaggacataattgatacatttatttaaatctctccatcagaaacgtaactccagccaataaatagcagttgtggatcgattgagatggggtgaatgccacactcttccaatcaatcaaacggtgcagcctgcagcaagctacttccgtttatccacaactgcaaggtctacaaaataaatgtcgaaatctcccggcagtgtcatatatccggccggtatcacctccctgtccggctatctccatctcatccagccgctaccgtcctaaactcccaaattaaaccagcgagcaacagtcagccaatactacaagatccagccactcagcctctctttcgtggcacccgatttggagaacgacgcagagccaagggtccggcgaccatgcagaaagttaaacgcggcgtggtgactcttcgcctttcgcggttcatgcacgcagggaggaagaaaccacggtgagaatgagaaagttaaacgcggcgtggtgactcttcgcctttgcaccattcatgcgcgcagggagaaagaaaccacggtgagaactgagaacggctactgttgtactccctcagtagcataaaaaaccaaactataatgttagatatgacacattctaacactacgaatatatacatacatatattcctatttgggatacaagaatatgtcacatctggtataagaatatgctacttaaaaattaagtttgaaaatttaaattttgacttttgcttattgatttttagttctaccgatggggctcttatactccaactcttgccctgtttagattctaatattttttattgggtgaataggcaaagtggtcctccaaatttcatctgaggctcagtttagtccttgatatttcaatctatccatattagtccttcaagttttcattttagttcaaacttatccttaaccaacaactctcttcataaatgatacttatacccctcatcattcacatatataagagagaaattgcatgcttgaattttttttatagataatacatagtatattatgtaaaacgaaaaaaaaatatgtattagcaagtgtatacgatagcaattgcttaagtttcatgtgcacatgttgaaataatgggaagtagatctgtaatgttgtttatttatgttggctttctcttttctagtatatagatgtatataaattgggggcaaaaaggacattttctaatagaaatattgactagaaatagccatatggcatattaagtggatccaaggatgatttcaagccaaaacaaatatttgaagtatctatgtggacaaaataataggtgaaggatcaaattgagccttcgctgaaacttgaggggctaaattaactattcacctatttttcttcaaatttctaactttttcgtcacatcgaactttcctacacacacaaacttttaacttttccgtcacatcgttttaatttctttaaacttttaattttagcgtggaactaaacacagcctcattattgtgtgcctatataaagcctgcaagtctagaggctactgggcactagaattctggaaggtagacaagcataaacaaccatatatcagtgacgacataagcgctcaatggcgattggctcggtggaatccgtggccgttgtcgcggtgcccttcccggcgcagggccacctgaaccagctcatgcacctgtccctgctgctcgcgtcgcgtgggctggacgtgcactacgcggcgccgccggcgcacctccggcaggcgcggtcgcgcctgcacggctgggaccccgacgcgctccgctccatccgcttccacgacctcgacgtccccgcctacgagtccccgccgcccgacccgaccgccccgccgttcccgtcccacatgatgcccatgatccagagcttcgccgtcgcggcgcgcgccccgttcgccgcgctgctcgagaggatctcggccagctatagccgcgtggttgtcgtgtacgaccggttgaactccttcgccgccgcccaggcggcgcgtctgccgaacggcgaggcgttcgggctgcagtgcgtggccatgtcgtacaacatcgggtggttggaccccgagaaccggctcgtacgcgagcacggcctcaagttccaccccgtggaggcctgcatgccaaaggaattcgtggagttcatcagccgggaagagcaggacgaagagaacgcgaccagctccggcatgctcatgaacacgtcccgggcgatcgaggccgagttcatcgacgagatcgccgcgcacccgatgttcaaagagatgaagcttttcgcggtcggtccactgaacccactgctcgacgcgaccgcccggacgccaggccagacgcggcacgagtgcatggactggctcgacaagcagccggcggcgtccgtcctctacgtgtcattcggcacaacgtcgtccctccgtggcgatcaagtcgcggagctcgccgcggcgctgaagggcagcaagcagaggttcatctgggtgcttcgcgacgccgaccgcgccgacatattcgccgactccggcgagagccggcacgcggagctgctgtcccggttcaccgcagaaaccgagggagtggggctggtgatcaccgggtgggcgccgcagctggagatcctcgcgcacggcgccactgcggcgttcatgagccactgtggctggaactcgacgatggagagcctgagccatgggaagccgattcttgcgtggcccatgcactccgaccagccatgggacgcagagctggtgtgcaaatacctcaaggctggtctgctcgtgagaccattggagaagcacagcgaggtggtcccggcggaggccatccaagaggtcatcgaagaggcgatgctgcctgagaaagggatggcaatacggcggcgggcaatggagctcggcgaagtcgtccgcgcgtccgtggcagacggcgggtcctcgcggaaagacctggatgacttcgttggctacatcacaagatgaagcaggaatatcctgtgattcttcgagtggtcggatatgctataaatattaatcttacgtcgaaacatatcaaattttaaaaaatggcctaagtaggaaaatatgtgtaccactccctccattctcaaataagcatttcccggattcaaattctgtatgcagtagccatttctgaaatactgattccattgtatggaaattcaaatcatcttcagacaatcaagtgctatgaggggattttaacaatttaaaatttgatataaggtgattgaaacgaaatatttggtcttatctttttctttttctaaacaaaaacctacaggtgcttagatgtatgccggacgggccaacaggcccagcatattctaatgggctcacattgctctaccatggtgaaaagaaaaagttcactcgaggtctctcgctttgtcgttgagtttcaaaatcgtccatgaatcatgcaaacgaggcccccaactttcaaaatcattcaaacaaggtccctcgatgcatggtaagtccgcagtggctgatgtggcattaggagcaaaactagaaactaaaaaattaaaacaaaatatgcgggcccacatgtcatcctcacctgccaccctgtccagcgtctaccatgccaagattttcgtcaatctctacatctaccccgttccctcctcccttcgcatggagctcaaggcggtggcagagctcggacgggctcaccggacacctccccctctctcccagaaccgttgaaccacctctcccccctttgccaccgacggcctcccaggctcgctgaagaagataagagagagtagaaaagaaaagagaaaagagaaaaaataagagatgtggaccctacattttcttcttctctcttacatatgggtcctataatttttttttttgttactaggatgccacgtaagtgaaactagagatcagtactgctataagatataaattgcacggttttatatagtttaggagtgaaaatttctagtattaaggattagggatgttatacaaactcgacataaagcttaagggacggctggtgaacttattcctttcctcccctccacacgtggcccgtgtacaggccgacagacaagttttccgggggggggctaatgcgcgactggtcgcgcagggtgtgggcacatgaacagttcgctcctactactactactagtctactagtactactactagagtaccagtctactacttcctctgtaagactttctagcattacccatattcatatagatgttaataaatctagacacataacttctaaatgaatataaacaatgcttgaaagtcttacaacatgaagagattactactgttattactagcgcctactagcgcttctgctgctactagtgggccccacgcgcagctagaactactagcattgctgttgctgctgctaggtggtggtggtagtagtactactactatactacaaatagcactactaatacacacacatacatacatacatgtatataaacttacatttcatatttttaaaactttcaactcaaatttttaaaactttcaactcaaaatttgaactttcaagtcaaattttgaaaatttttgactcaaaatttaaactttcgagttaagatttaaaaactttcaactcaagatttatttaagttttgaattttaagttgaaagttttaaatagaatgttttgaaagttgagataaaatatctaaattgtaaaatacattaaaaataaaaaaacactcgctaaagattaaaagatcgagaaaaggaaaacgcgccagcaaatggggagagcgcaaaaaaaaaatcgaaaaaacatatagcaacccccataaaatagtacagcatttgttacattttgtaaggttgagttcgtttcaacatctctgttttgacttttccttattttcaattaacattcttaatgaacggttaaacaataggtatatttatatatttttttataatttataatagtttatatttaattaatcatccattaataacttatctcattttacgtaccagtaataatcttcagttagaaaatgaattgaaccctaatcatccgttaataacttatctcgtttttcgttttatataatcgttttacccctactgctataacgacatacattttgtaggataggagtaagtacaataaatgcaagttggcaagtgcagcagtcgagcaacttgcctgccggcgctcgacctacaattggcaagtggtgatcagccagttgggcctttttttcgtggcacccaatttggacaacgacgcagaggcaagggtccgcagcaaggacggcgacgaccatgcagaaaattaaacgcggtgcggaccgtgcggtagattcttcgcgtttgctgcatgcgcgcgagggaggaagaaacaaaccacacggtgagaacggctatgtagtaatctctgggactctgccgactgccggacgatggcatcttcgcgtaacgtacgtaacgaagaaggaggccggtctggtccaagagcctcatcgcacgggagtagtactgtagtatccaatcagcctgatgtgcgatgtgcgacgccctggtcgtcgatccacagttccacacatgaatttgctgcaagtttaactaatgcaccaaaagtgcatatactattagtgaactaaaacatcacatgacaacagtgcattagtcgtagtacaatttaaacagtaagattccctggaaccaaccaacaacttctctgcctcgagaatcgagatacagagcacatgccaaaatggtatacaaaacgatatcatcgcagagccgcaacagggcggtacgtaccgttttggagaggccgcgatacaagcgatcggcccgccgacgccgtcgttagtcgtcactgatgacgagcgcgccacgctcctgcagtctctgacaatgattgagccagcggctggaagcgccgttgttgctgacgagcattctaggaagggcggatgagcgcgagggggcgggaacagatgtgcgtccgtgtcagccctcgaatctctgatgctctggatctgcgcgatatcagcaatgggaattggaagctactgatgtaactttttccccacatatttgtcttcgactgttcgtgcgtgtgtgcctataactctatatataacctgtaaaagtgtataggctacggggcattaaaaatcctagaaatagacaagcataaacaagcaaccagtgacaagagcactcgatggcgattggcacggtggaatcggtggccgtcgtcgcggtgcccttcccggcgcagggccacctgaaccagctcatgcacctgtctctgctgctcgcgtcgcgggggctggacgtgcactacgcggcgccgccggcgcacctccggcaggcgcggttgcgcctgcacggctgggaccccgacgcgctccgctccatccgcttccacgacctcgacgtccccgcctacgagtccccgccccccgacccgaccgccccgcccttcccgtcccacctgatgcccatgctggagagcttcgccgtcgcggcgcgcgtccctctcgccgcgctgctcgagaggctgtcggccagctaccgacgcgtggtcgtcgtgtacgaccggttgaactccttcgccgccgcccaggcggcgcgtctgccgaacggcgaggcgttcgggctgcagtgcgtggccatgtcgtacaacatcgggtggttggaccccgagcaccggctcgtgcgcgagcacggcctccagttccaccccgtggaggcctgcatgacaaaggaattcgtggagctcatcagccgggcagagcaggacgaagagaacgcggccagctccggcatactcatgaacacgtcccgggcgctcgaggccgagttcatcgacgagatcgcgacgcacccgatgttcaaagagctgaagcttttcgcggccggtccactgaacccactgctcgacgcgaccgcccggacgccaggccagacgcggcacgagtgcatggactggctcgacaagcagccgctggcgtccgtcctctacgtgtcattcggcacaacgtcgtccctccgtggcgatcaagtcgcggagctcgccgcggcgctgaagggcagcaagcagaggttcatctgggtgcttcgcgatgccgaccgcgccaacatattcgccgactccggcgagagccggcacgcggagctgctgtcccggttcaccgcagaaaccgagggagtggggttggtgatcaccgggtgggcgccgcagctggagatcctcgcgcacggcgccacggcggcgttcatgagccactgcggctggaactcgaccatggagagcctgagttacgggaagccgattcttgcgtggcccatgcactccgaccagccatgggacgcagagctggtgtgcaaatacctcaaggctggcctcctcgtgaggccatgggagaagcacagcgaggtggtcccggcggaggccatccaggaggtcattgaggaggcgatgctgcctgagaaagggatgacaatacggcggcgggcaaaggagctcggcgaggccgtccgcgcgtctgtggcagacggcgggtcctcgcggaaaggcttggatgacttcgttggctacatcacaagatgaagcaggaatgtctctaattcttcgagcggtcggatatactatactccgtcctattaaaaacaaatctagaacatgatgtaacatattatagcactataaatctagacatgtatatccggattcgtagtactaggatgtatcacatctggacggagggagtagatttgaatcattcgtcaaaatatattaaatttgaaaaatgctcacagtaggaaaatatatgtactactctctctgttatcaaatataagtatttgtagaattcaaattatgtcagcaatataagcatttctgaaatactgatctcaatttacggggattcaaattattttcagactatgaggatcctaccagggggatactaacaattccaaatttaaaatttgatcaatcactgaaaactaatattttctcttatcttcaaatttcgctaaacaacctaaagtgattatatttatgaacggtggtatgatatatattttttcaagggaactgcctgactacctgtgtctcgctccagccccatcagatggcgaccaagcgcccgcgtcgcccgccacctccctcctcttctccgcatcgccgctgcttgagcaggccaccgacaagccagctgaccgcaaggatcacaacggcggagctcccttccttcccccgaggacactacagcgggcaggtgcaccgaggcagcggagaaggtgccgtccagatccggggtgacagaccagcggcaaggtcggcgggcagcggggaagagggtggtgagtcagagtctttgtttttttctgaacaatcttactcagatatagaaacacgttattatttatttacgaacatatacccccggcactcgaaaaaattggaaataacaattaggaaatgtgaaggtccaaatggcggatcttaatagagtttagtggagctcaaaaattcaccgttagcctccacatcttcaaaatcaaaatatattaattagaaagaaatactcacgaatgtgtatagaataatagaaagatgtactagaagataggcgcgcttgttggcgtgatcgctaattaagcatgtgtcttatcttatttgttggagattatatatatgctatttaaatcttttttggaatttacatttttatagcagttagttacatactcataaaatttcttataaacaccatacttttaaaggtatgttttagtgtgttcttagtttcatgtttgtagaattatgaagagaaaaaaatgaaagtatgatagtaatatatgcttaaaaagcattcaaggtggtagttagtttaatgtagaaaactgtatttttggaatcttttgccacttttgtgaattgaaagtatttacatataatctgtttgaatttggggaattataagaaaatacatatactagtactgattgttttgcattctctggttcttttttttttcattctctacgaatatagatataggataacatcattgttaacttgcttgttaggaatttcagtttcacccattgtatttcttggagttgtttatatccacacttccctaaacagtaaaactcgtagagttagcattaaatgtttttacaatttacaatttatattttatttgttatttgaaggaaggataaaagctttgctactttatggtttgtatgttaatattactttgataatacaggatgctaagggcaacaacaatgtatatggcaaaagtagtctatagagatgagacccatatatatgaactttaactattgtaaccttcacaaactatatggatagcaaatagtattagtaggagagaagagatagagacaaataatatattttattctctatgggcaacccatatgcttatgggtagcttttgttatttttttttatggactaattccacaatgttgctaggtagctgaataaatattatattgcttatggactacttaattttgaagtacattgtggatgccctaacagcttggtttggcacctacatctttaatcttcaattttcaaaataccacacttctttattattattttaggatttgatactgcaacatgtttatactgtccacaaggcttggcgttcagcccgtagcaatgtttgtgcaccaacatggctaagccacatcccacgtgcgtgggaggctgggcagctcagcacgactgcacgaggttggctcagcccgcactgtccacgcatagtgatgggccaacatggctcctggctacgctcatgggctgatcaagcccatccacgagagagattgacaaggacgtgactctccgcgcgagaccaaacacccgaaattaccgctgtggagttttttaccattcgtaatttctcgtatttatctcaacttttaacggtgccacgtggtccaatctgcagccggcaaaaccgcatgcttgagaggatggatggatggatgtgtatggtggtgtctgcacgtaagcatatacgtagtactacgtacaacattgtctttgggaaaaaataacctcatatataggccgccgaacgaggcgcagaaaaatgggaaactgtttaacagctcgagtggacgttcacccgtttattgtatgttatctaaatagttataaaaaaataaaaaaaatatgaataagatagatcaatatgtaatatatcaatacataaacatagaagttaaaatttaacttctacaagttgtaacaaacaaaactcaaattactatatgtatatttacaattaaatttgttatttttgttacaacctgtagaagttgaatttgaacttgcatgtttgtggagtgatatattacatattgatatatcttgtcaatttttttaaaaatttttcataaccatctagttcatatgcaataaacgggtggacatccactcgagttattagaatcctctcccgcagaaaaatggtggtatgacacacaatggagccgggtggactgtggaatattatttgctagtcggctgtgcatcggagcaattctagccgttagcggtgcagcggaagcttccggtgcaacccatttccacacggatgccaagttgccttttgattcaccactggctgagctcactctgacccgcaaacgccagtgcccgcagcctacatatagccgcatctgcccatcaaggttgagcacagtcatcgagcctacaatggagccggtggccgtcgtggcggtgccgttcccggcgcagggccacctcaaccagctcctgcacctgtcgctgcagctcgcctcgcgcggcggggtggacgtgcactacgcggcgcccgcggctcacgtccgccaggcccgcgagcgggtgcagggcggggacgacgcggcgctccgctccgtccggttccacgacctcggcatctccacgtacgcctcaccgcctcccgaccccgccgccgcctcgcccttcccctcccacctcatgcccctctgggaagcctacaccgccggcgcgcccgccccgctcgcggctctcctcgacaagctctccgcctcctaccgccgcgtcgtcgtcgtgtacgaccgcatcaacgacttcgccgcacaggaggcggcgcggctgcgcaacggcgaggcgttcgtcatgtactgcttggccgtgtcgatgctcgctaggaggattgctccccaggagcaccaacggatcctgcgcgagaacggcctcaccaacatcaccgtggaagactgtgcaacggaggagttcgtggattacatcagacggacgagggcgaccaaggagatgtcgcctcccagaggtatcctgaccaacacgtgtcgcgcgctcgagggcgagttcatcgacgtcgtcgcggggaacctggccgccgacggcaagaaggttttcgccgtcggaccgttgaacccactgctgcacgggaacgcgtcgaagcagggcgaccagcggcagcgccacgagtgcctggactggctcgacaagcagccccctgcgtcggtgctgtacgtctccttcggcacgacatcgtcgctgcgagcggagcaaatcgaagagctcgcatcggcgctgcgcggcagcaatcagcggttcatctgggtgttgcgggacgccgaccgcggagacatattcgcggaggactccggcgagatcatcagccgccacgcgaagctgctgcgcgagttcacgcagcacaacgaagggagtacggggctggtgatcaccgggtgggcgccgcagctggagatcctggcgcacgacgccacggcggcgttcatgagccactgcggctggaactccaccatggagagcctgagccacgggtagctgattcttgcctggcccatgcactgcgaccagccatgggacgccgagctcctctgcaagtacctcaaggccggcgtcctcgtgcggccatgggagaagcacaacgaggtcacgccggcgaaggacatccaggaagccatcgaggaggccatgctttctaacggaggagtagccatgcgacaacgtgcacgggagctcggagatgccatccgcgcctccgtggccgccgccggctcgtcggtcgtcgcgcaaagacctggatgacttcgttgcttacatcacgaggtaatcacgtaccgagattgccacgttggaattgatgattctgttctggtaatccaattggctttgccattgggccaggccaccatcttatatctcaaggcccatctggccacgtcgccattccggccataggagcagcagcaggcttccatgtcagccactgctcgatcaatttagtggccctgtttagttgggggcagatcatgaagtaaacttactgaggccttgtttagttggggaaaatttttgggtttgtttgtcacatcggatatacggtatatatttaaagtattaaacgtaatctagtaacaaaacaaattacatattccgtaaggaaactgcgagacaaatttattaagcctaattaataggggtgaaaacgaaacggatattatccgctccgaatccgtccgaagtgaggatatggtaagggtttttagatatccggccggatgcggatgcggatgcggatatggtatcggttatatccggcggatatggattatccgctattttaagcggattatccgataaacgttttggcggataatccgaatttcacagcccatataacctctcaatttggcccatttgacacgagcattttcatcgtgtaaacattcagcccatccacgtccaccttatccatcaatctatctaggagttcagtccgtgactccgtcggcgtcgtgtcaaccaattttttcatcgagacttctcttcttccattcctcccacgccgccgcctgacttctccacccagcgccaccgccgccacctgccttctccaccccggcgccgcggcctaccttctccaccccaaagtcacctggttgtctccgtctcggcgccggcgacgcctcctgccatctccagcaccaactctgtcgtatgtgttattatcagaattgaagtctacttctctagatcatctccttctgaccttagctgcatatgtgttattatgtcatatgcaatatgcaacttattagtagtactgtatgagaattggacatcatttgtggacctccaatgttctatcacccatgtcatgtgatattgttttttctaatatttgtggaatttctatgtcttacgtgttatgtgaatgcgatatatcatgatgtcaatactatatgtgtcgattacatggacagaagacaagtcaatcgttaacaacttgacattatattatgatgtgatcggtgctttcatgagtcatgtgaattgtgagtcattgttgctcattgtacagatgatcagatgttgtatcgattgtatatacatgccacatccgattatttttatccgtttccgagccgagtccgcaccgactccgcaccatttccgacatccaaaataatccgctccgcatccgcatccgcacattatccgcaccgcctccgaatccgattaaaaaatatggtataggatatggtatgactactatccacccgaatccgatccgttttcacccctactaattaatccatcattagcaaatgtttattgtagcagcacattgtcaaatcatggcgcaattaggcttaaaagattcgtctcgcaatttacacgtaatctatgtaattgttaatactccatgtatgtgtccaaatattcaatttgtcagtgtaaaaaattttcttttgggaactacacagagcctgagttgaaaggatcaagctatcctgttaatgcagtgtctgatgtgcccttttcacttctgcctcaagttctggcattgaaggtttggatgcggcttcctgttcccaatttgctgttcgcttccctgttcctttcaggtgtcacaagacgattgttagaacttctgatggacctcagcacagtgtgtgctcctcatacaaacaacatgtcttgtattagtagtaaattaattggaaataacgtgatttaagccacttattataatagttaggtactaaaaaaagatccgatcgggaaaaaaaagatccgatggggaaaaaattaactatggtgtcatatatctctcgagaaaggagcaggcacnnngaaggaacagggaagggnncagcnnattgggnacaggcnanccgcatccataaagcttaggcattgcggcattgacatgccaaagtgaaaatacaatctgatcatggaaacggaaagagccacgccatgtggtgcatgatgactgtgattgaaaagcagataaaaacaacactagaatgaatcgtaaccgtacgatgaaggatatgtggaaattatatggtctctcctgaagtctcgggaaggacagtgcactccgatgatcagtgaaaatatttgcaaaagtacccattcattctcacatatttacattcaacaccttgaaaagtttgatttctcaatctatggcattattctctccccaatcatcatttataattgtaccatgtaaccaataaatagagaagaaaacttgcgtgcttatttttagggcaaaattctaaactatatatttaaataagattaaatttaatttatagctttatttatctcattaaattttagcatacatggctattataattgatatacattacaacgtttcccgtaaaaagccagataatagtcacaattatttatgttacttcttttaaactgtccacaagataaacatgtttcttaaaacaacataacttcttttaaaacttattattgatagcacattataggatggttagaatcgcacatgagacataagctagttgacctgaccaaaggttagcgcactactccttccgttcataaaaaaaaaaccaaactaggaaacgtcacatctcattctaggttagtattttatgggacggagggagtacatatggagatagctttacactgataaattttgtagagggaatggta

SEQ ID NO: 62200 - DNA, 10551 bp, Oryza sativa
agtgctgaatacagtgcataagtgcaggttgctctacagatcccgacctttaggtttaagagctcccaagcagcttcttgatatccttctgcagagatagtatggaaatgttataatgagagcctaacaattcagcctgtagaaagagattgcaagtggtagtgcaggacattacctcaatactaagaggggaggtggtgggcgcatagcgatccaccacgcgaccctccttgtcaaccaagaatttggagaagttccacttgatgctatcaccgaaaagcccacctttgttagacttcagatacttgtacaggggtgcagcattgttaccgttgacatcaacctgacagataaaaaaaaaagagactcaatgctactccacagaaacacctcttcgatagataaaacatgtgacttatatcattttgcttcacactgataattactctgattgagttaaaagtattgcgttaacttaccttgtcaaaaatgggatactcagccttgaagcgagtgcaagcaaactggacaatctcctcattggagccgggttcctgccctccaaactgattgcacgggaaagccaatatctcaaagcctacaaatcacacattggtaatattccttagcggtttgaaccacaacaaccggaattgtttaaagtgaagaactactagcacatataataactaaagcttaatgatccatgtgaccatgaactagataattattccaacttccatggtgaaggagtacaatatgcaaaggcaattacaatatacaaagatatacaaaggcaacgggtcaaagacacaccttggaccttgtacttctcatacagctggctcagctcagtgtagttggagttagttaagccactgaaataattggtcgaagaaaatgcttagcggtgtaaggtgaaatggttccatatagataaaaaaatatatatagagctgcctacgtcagataaggacaattatgcagaaaacggttccataaaataagcagcagtggacctattgatttggaccatctttgcagtagaccaaacaaagacagtatcgcagttcacaatacgagttaatgagttaatgagctgtgcttgtatcatgatatttgcatgattcatatgggaccggttcagttcaactgctcaacagggctggggatgctctgaatctgctagtgatattctgttttgcagcagtttattattctctttggcaaaagacaacaaatctgaaagttttgggggaaaaaaaaacttgcggaagttttctagctagccattccgctaaaacaatcctacatcaacctgttgatgtgtagacggtgtagtagtaaaattccatcataaaatggggggcgtaatgaagtgaattaagtaccattgggatgcgacgttaacgatgaggagaaccttccccttgtaggtgctcaggttcacgtcttttccgcttgcatcctgcacgccctcgcaccaagcaaaacaagctaagaaattcggtgaaacacccaattactactgctcaacaaattcacgtcaagcaccaccccggattacaggcaccccccccccacccaccccccaaagtacgcacggctcgactgctcgagcgggttcgggttttggaaagcccatcccaatcactgcaggacagatcccttcgagaagggagcgccgccgaccgagaggaggaactgaccttgacggtgaagtcgtggacggaggtggcggacggcgcggcggccatgctggagcgagcggcggccgagcggtctccggaggaggaagcgggtggttgcgaaacggtagcgtggagacgaggacgaacgatggaagcggtgggccgagagacagagacgagacgtgatcaccttggggaagggggggagtataaaaaaggccaggccgaaggtgtgaacgcttgtaaacgcagcgtgtggcccacgcggaggaggatgctcgttgccgccgcgttctagggaacggcggctcgtggagacgggtcccgccgcgtgttgggaggaggaaccaaccgtacgtggcgcggccggtcaactcgctgtgcctgcgtcactgcgtcgcgcatcggttgggttgggttgttcactcgtgcacggacacggatatgaggggagcggggcgcacacattatcgccacgcggcccacgcccatcgcgtttggggggcctgctcaactgtcgatggttgcaaaggcttgcagcacgatgggtcgggctggggtaactgatggtctatggcctcatgggccgcaacacgaatatcgtatgtggagggaaaaagtacacccaaggtccctcaacttgttatcgaattacaaaatcgtcccccaactgcaaaactggatacaacgcatccccaacttacaaaaccattgcaaaatccctcggtggttttgagcacagttttgtccgatgtggtggctgagtcaatgggggacccgtgtggaccccacatgtcaggatgccacgtcaacaccctttctcttctccctcccctccgttactcctctctctctctctctcccatttctccccttgagcatcggcagaggcacggcggaggccagcgaacgagcgagagtggaggcacggcggaggcgcggagaggccggtgagctcctcccaagtccaaatcgttcatcgccggcgagctccaccgcgtggaaagagaggaggcggggtggccgcggtcgtcggcgatgagttcgaaggcgagggcccagaggaggcgcggggaggccggcgagctcctcccaagtccaaatcagtcgtcggcgagctccaccgcgtggaatggaggaggtggggtggccacggtcgttggcgatgaactcgaaggcgggggtccagaggaggcgaggggagagctccttagggatggagcggacggcgacgaggagcagggcggcggagtggaggaagcggcaaacggcgcatgaggagtcctccagcgccgcgcgccatcttgtcgtcctcctccagctcggtcaacgcctccccgcgctcgccgccggcgtcggtgtcggcttggcggtggcggcagcacaagaacggccggcatatggtggtgccgatgaccgtgcattgcgccgcctgtggaagggccgctgggtctccatcgccaccagggggagggacgccgccgccctccaccgcttcatcgccgccaccctcctccgctcgcttctcccccacccggatgttgcgccgccttcgtccgccatgccgaatgccgtttcgccgcagaccggggggacaagcgcccgtcttggagaacctcgtcgtcagagcctggtgcttgcgcccgttgccgaccagcatgccggccactggcctcgatgaccaggaggacgagcacccgccgcccggccgctccccgcgccgtcgcctgcccgctccgccggccggacggccgctccccacgccgttgccgatctgcttggaagggaggggatagaaagaagtgtgggaaaatagactaatgtttcaatgacatgtgggtcccacatgggtctcacgctgactcagccaccacttcggacaaaaccagggttaaaaccgccgagtgatctagtctacaatggttttgtaagttgatggatgccttgtgtgcggttttgcggttgggggacgattttgtaattagatgacaagttgagggaccttgggtgtactttctcctatgtggagctaggctgtgctgggccgaaaatcctttgtttgggctttattaggcttcggacacgatgaacgatcaacgtaggtggtctggtctggtctagccgtgtgccttttaacaggggataacgtccaattgtaggtcctttgtctaggagtcgagttttgaatcgtatccctcaattgtaaaaccagctataatgcgtagcccaactagcaaaacctatacaaatcaagtctcttgatctttttagatggttgttttgtcctacataacacgttgacttagtctttgtttgacgtggagtttatgtgtgacaccatctgaaaaaaataataaaaataaatatataatgggacctatatgttagtaataatggtacattaaaacttttaaaaatataagatccacatgtcattcacattataaaaaaaaagcctaaactccctcgccctctctcttcccaacagcgtatagcacacctaccctgagctgcagcgactttgaagagaggggatatcctagctcggtgtcaccgccgttaggaattcctgctcgatctctcactgagggattaaatttgtattggctttaatagttagggttattttatatctagatttgtggttgagagacctttatttaaggatctaaagtaaccttttgctttaacaggctatggagcccataaaaactcactacaggtcccaatgtttatgatgggttactgttgttcatggggcggatcaagcaacaaattcaataatgcaaccgatagccatcgagcatgttttccagagtcgtatgatcgtatactatcatcaagtgcaatgaggtcagtggatcaggtagaagccttaattcggtggctgggttatggcccttgacaatgatcggccacaagagcgaaggtgtataggtagctaagctgaagactgaaccagttgtgtttgcctgctctcggcaagatagctccactgccctagtcggagcactatctttcagctcagaatgcaagtggccaaattatcccaaattcccatgcaaagtttcagctcagataccaaatgttcccactgcgagccacgtaggtagtagtagtaaagttcagggcatcttttggttcgaagtgtgctcaattgcgcgttgcgtgctaaactgcttagttaggttactatgatgccacccagaaaaagagttaggtaactaccaacgtcgattagccaagttgcacgggaaacccgggcatcatcacgaagcattagcatttctgcttttgagattgacgacctgtcccctccattgttaggaagtgccaagattagatggattgcactacaacgtatcacctgctagtgttggcaaagtgctccatatttaacacttgtaaacacacggtgcatatatacgtaggtaatgtacacatttcaggtgccacacaacacacactagcacatttcttttagaaccacattagcacattgtcaacagatatctacacctcttattctaagcaaatgctatgcgtgtgtactgcatgatcaacggcccagttttgggctcttgtagtacctcaacagcagggaccagcagacgacgctaacggaggaagcagccatcgcagcgccggcgacccatggcggcaagcggaaccgggtcgacgggaagagcaccccggcagcgatcggtatgccgatgatgttgtagccgagcgcccagacgtagttcatccgtatgcggaagaaggtttttctggacagatcgatggcggtgatcacgtcttccaggttgctcttcatgaggacgatgtcggccgcttcaatggcgacgtcagtgcctgcgccaatcgccaggccaacgtcggctgatacaagcgctggagaatcgttgattccatcaccaaccattgccacggtccttccggccgactgcaagagtaaaaaaaaatcggagggtgtgaataaccaaataacggtacggcaaaaaaaaccaggagacatgcaaaagattttatgatagctcacctgaagttctttcaccttctcagctttctgctctggtttcgcttctgcaactgtgttctcaatgccaacctctttgctaatggcattggcagtcccccagttgtccccagtcaccattatactctccaccttcatagatttgagatacgaaatcacttcgcgggcatttggttttattggatcagatacagagataatgcccacgacttcttgatccatagccacaatgatcgctgtttgggccttctcctcttcttccgttaggatttccaaagcttccaccgggatatcaatgcctgaagtcaacataaagctcttgtttcccaccataacagccctgccacttatttttgccttgacaccgtgccctgtcactgaaatgaaatcccttgcttcagtccagacatggctctcttccgaatggaacttcttggcatgctccacgactgccttacccagtgggtgctcactgttgacctgaagaccagaaccgataaaatttgagcaatgtttctttttacaaatcacaacaaaagaaccttaaccaacctaggaggaactaggtgacatttttaattaattaagaagaaataggcatccgaattcgcctcgatgaggacttgaacttgggtgggtctaggcatacatctatgccctcaaccaaccttttcatatatcacaaaggaatgatattttgctacaagtaataaaggcattgaatcaaaaagatctagcaagcttgaaagcatacctctgctgctgcaacgtaagcatagaattcacgcaagaccatgttttttaacagtcttgtgttgaccacaacaggcttcccaatggttagtgtccctgtcttgtcgaaaacgatgcagtcgacctataaatgccataaaaaatttgtcaataatttgatgtttgcaaacatgtgcatctaaaagtacaatgtttttttatggaccttctgtgcactctccagagcttgcccacccttgataagaactccttgtgaggcaccaactccagtagcaaccatcacagctgttggagttgcaagccctaaggcgcaagggcatgcaataaccataactgatatcccgaattggagagctagttgaaagctatccatggaagatggtatccatgagttagggtaaccatgaagcctcccagctaagaaccaagcaagccaagtaagcaaagaaagaatgatgacctgaaaggatgaagaagactatttagaattgataagaaatgatatccgttgaattaccacgatgaaactgaacttaccaggggaacaaagactctagatatctgatcagcaaacttttgtacaggagcttttgccatttgcgctgactctactagccgtacaatctgtgcaagggcactctctgatccaacaaatgttgcacggacatgaagcacaccattctcattcaccgtccctcctatgacagtgtcacccttcctctttgccacaggtcgtgattctccggtgatcatgctttcattcacatggctctgtccccatataacaaagccatcagaagcaactttcccacctgggactactttgatcacatcatttttctgaatcaacctactgtcaatttccttctcgcccacaacattcccttcatgatcatatatcaacatagttgcagtttctggtgcaagatccataagcttggcaatagcctcagaggtcttcccttttgccaagatctcaaggtactttccaagaaggataaacgatatgagcattgaactagtttcaaaaaaatcagttgccatgtaattatgtgaggaggcagctcggaggatggagtaaactgagtagaagtaagctgtgttggtcccaagagcaatgagtacatccatgtttgatgagccgtgggataacgctttataagcaccagtataaaatctgcggccaattacaaattgaactggcgttgacaaaatccaccgcaagagctcaccaatgctcatcatgttaataaccttcttttcgagcccatccttcagccctgggatgtacatgaacaccatggaggtgaggaataccgggatggtgaatactaaactccacaagaaagactgcctgtatcgcttgatctccccatgtctatgctgctgccttccatctgcttctgggtatatcgatacagtaagatcaccagaggcagctgactcaatgacttcaatgaggtctcgaggacctgtctggtcaggtttgtatgagatggtgatcttgtggagctcaggatcaacttttatgtcttccacaccaggaagagcttggacagagcttttcactatcatgattgatctctcgttgagtgtgccatccactttgaggtctatcctgctctgatcatctccagtggtgatcagtattgcttcaaaacccgtctcttcaactgcatgggttagttgactggcagtaacgattctacggtcataacggatttctgcctcttcagtagccaatgcgacagaagctctctgaacaccaggaacaacttgcaagatggattccactgtgctcgcacaagatgtgcaggtcattccttttatgtgcagcctgcatactagaatgtttttttccttgacttcctcatcaatcagcttagcttcaaagcccacatcctggatggtttccctaattttttcctcctgtcaaatggcattgatgagcacaatttccaaacatataagaaaggaagaaaaattggattgaaacatgtggacatgtgtaatgtaaaaacatgaagtaaaactattgaaaaaatggaaaaagggtaccactatgaaaatgttctgttagatgttgatcaaatacagaaaacaacaaagttatccaaaatgcaatggaactaatatatgttttctagaaattcaacagatccaaaacacaaatagtctttctttttaattcccaatcaatataaagcgctacgaagaaagaggcactatccaatgggacggtgacaaagacaggcttcagctcatagtgggatcctgacagagataactgaaatactgtttgtgttatacaggccacccaactcaaaagattgtaaacaaaacttcaatccttacatcaaagattatttctcgaattgtaatatcagtcctttgcaatgtactttatccataagtgtgccagcatcttctaactattactgaccaaaagttactagatgcagagagagttgacacaaataaggaaatgcatgaccaagcaaccactatgttgaaatatctttggtttgtttcatgtcctacaatggggatcaaatgaaattatctttaacagtgaacttacagccttgcacagtgggaaaatgacatccaataatagaaaaggcaccccctttcgttctaataaatttcaagatactgattaaaagcgacacatcttgatcaaataaaatattagtttttccgaaaatatattcaggataataatgatggggaataagattacaattttgcatccccaaatgcgccactgatcagagagcgtaattatgagatgataaacgtgagtaacaaattgttcctgaataagaaaatatattccaacttgtagtattagtagtaactaatcaggcatatgcctgcatctagtggaaggaacaccaaatgaacaatttggaactttgcaacagaatgaagagtgcaacagtgtaaaagtcgccaagcaaaacaggtaagtacaaagtttacgtggtacagaaaattagttagttaaatctgaaattctgatttcagtaaaaagaacttgaaacagtcgttttgggaatatcaggtaaattagaattacatggcacatgcacattagattgttcttcctttctactttctgtccagaagcagaggttgtctgctacaaacaataagcaggacgtccatttttttatcaaatacgtcttcatattgaaactacaggtctgtgcaaatcttaatacttgcagctgaaggagttggtgggatccaacaggccaatccatgtttcaagggatccccaaaagcagctagcagttcaacgtcacaagcaaagatgtctacttgtaaccttctaaaccgcaaagagaacttttcacgaacccacctcacatttcaagtatttctgaacttgtggagcatcaattaaagctcactcaaatcctttttcgtgatactatgcgtatggacatttctaataacatgttcataaaaacatgctttaatcagtgtgtctgatatgctacctgtctatctactgctaatgttacacagctatgtatttgtctctacgcgctaaatagctgggagcccggagcctgggagcctggaatttaataaagttcccgtgtacctacttccaagatcaaaccactttgcgtataagcacccgcaactaacggtatggagtatgaaccgaaaaatgtcgcacacaaagcatcattcatttttttccccttattaaatttacctagctatccacaggctgatcaatctggtcgtgcgggaagcaagcagcccgtaagaaacgcggcatgctttaaaaaaaatatatggaaaaatcggagcgacggagccttcgatactcaccgagacgaacgccgggtagaagacgacctgcgcgcggcccccgaggacgtcgacggcggcgtcgtggatgccctggagccgcttgacggccttctccaccgagcccgcgcacgcggcgcacgtcatcccggacacctcgaacaccgccaccttctcctcctcctccgcccccacgggcgccgcctccagatcgccgtcgcctcctcctcctcctcc

SEQ ID NO: 62201 - DNA, 1129 bp, Oryza sativa
attctgtttttattttcctttcttacaatttgatcgtttgatttgctgctggtttgtggtgaaatggtttaaacatggctgaatttatagggtcggggagggtggcgtgaggggcgccggggtggtggggtggatcgtcgtgctcgctcaaaaactaaaaagagggtaaaaaatgaaaaaagaaagaaaaaagagagcgcgaccgctctagcgcatggttacgtattggaaaaccgcaacacgaaagtgctcgcgaacgcagcattggagtaggaaaaattatgggtgcacctcataaatgctagcgcaacggcgcaaacgctgcaacatgtagcgtgaggtgaaaagaaagttgggacgtcgaccgatgaccgctctctcagcctggttggggtacacgtcaggcgccattgcatttcgagcatatgcttgtgacatggttaagtgcaccacttgaaactggtgtttttttttttcagattgcaatgcattattatttagactgtactcctatttaagatctttataatgggaagttatttaacaggtatggtatgttacaaatagatgtgatgtggttacattgtcatcaggtaatcaattctagttcccatacgaaaacgtggtttcaacaaataaatgggtcaatgggagaggaggttttcaagctttaaacacaaaccaaagtgtgagaagatttatcacacccccccaacccccacaaaaaatacaactcgatggttacttaatattcaaaacgtgaatggtataagtttagggcttgttaagtttctaggatattcaaaatgtaataatagaaaaaaatgtagaaatagtatgggaatacttgtgcaaacttttaagaattgaaaaacataggaaaatttcttatggttgtgtagcaaacgatccaaaggattgaagtggaggcataggaatttttctttggtgcaatcttttaaaataaatgataatgtagtgtccatttcaaaggagaagtgaataagcctttaacatacagataaaatgaggtgcttcgagtaataccaaatcttgtttgacactttagcgttattatttttcatatagctggaatatgaacgcctattaaattttatgcatcctaggc

SEQ ID NO: 62202 - DNA, 1003 bp, Oryza sativa
gatgtatggaaataaatacatcaaattgtaactttacagttttcagtgtatatgctcactagatattaggtagtagtagtaccattatgatctttagttcaagaacatctgcgtataaaatatgtagaaggttgggtatttccattcaaacaatggctcaggaggaaacagtagaggcatcagcatgagtttgtctagcaatcaatggccaaattacctgattaggctgtgggcaatcaacaacaaatccaatcaagcagcgaacatcatcagaagctgctgtggaagatgctgatcctaacagaagttcaacaacaaccaagagttcatcaatcagagcattaatttcacccaaggatctctttgttccagtaagggcaaagttatcgatcgaatttggttcccggattgcccagtagcaccttctgcagctatcaagaagcatttgcaatgcatttgcatccctcatgcaagcagcctctgtaaatatcatgtctgcaagcgaggacagaagcttcttctgtaaaccataagtacatgaactccacatcttcaggtccaacagcaaagtactgaaaagctgcactttaagctcatggttgtttctttgagattggcacaaggatacaattgcatcaactagctcctcatcagtcactgcctccccctctccaccttccatctttggaaatgcttgtaattggtaatgtaaaacacgtgacaaaatctccggtgaacatgtccgacataattcttcattatttccaggatgctgaatagccagggaaataatcctgaaaattggggcagaaagagaagcagtggcaatcgacaattcaccaagcataggttcaagactatccatctgcacattgcttatagtcaacggaagtaaagccattggaccccataggctaaggcccataaagactccgcaggccgcacacgagatgaaacatgaaccaacccaagaacttctgcaggccttcggtgagtgcctaca

SEQ ID NO: 62203 - DNA, 6016 bp, Oryza sativa
cctgtgagtaaatacaattcttggtagaaactacagttagcagcttgctctcaagagctcccacctcatttttgagaactcttatgttttgctatgggaaaagccctattttggtcattcgactttaggatacagtttgtgttcagactgaattttttttcaaggatgctattatggaaacaaattgagaaaattgctggacaaccaaaactttttaaagatactatttacagaccattaaatgaaagtttctgaaccaaagcgggccattgaaaagttaaaggtcctaagagaaatcagagccctttttttattggtcaaaggcacattagttatatgactttgagcataacaatttgttttgtccagagcaagaatttaaataatgtgttcaggagtttgagtaacataacatttctgtatctatacctatttcactaaaactggaaccaacaaggatgtgtaaattggacctaaaacatataagttgatgttaatgtgggaaaaggggtaaactactccgtcaacaaaaggggggggggacaaacctgctgagccagaaggggaagcatctggacataatcgtccattcagaagactaggatgataaagaagatgtaagcatcctcctatctgttggttcaatgtaaaactctcttcggccatgttcttaacatggtcattggttgctctccaaggcaaacctgcaccatttccaaaactagggagtacatctcctccacgggatgccagacgacccatcctttctggcccaattggctccctaaaaatgtatataggtcccatttctgcaaacaatggacattgtcgcctccgcctctgcaggcctgcaatagttggtggaggattcgttccaatgcagcaaaatgctagtggttttgagatgcgtgggaactcaaaaggacgactctcatgcaagcttccatcaacgtacaaccgcaattcactgtcgccctttccaagcaaaccatgcttgtttgtgtgctccaacccaacgaagtaccatcgctgaggtttaaacgcataagtgaagtgcagagaagccttcttacccctcccacccccactttccaccaccaagaactgtccatggaagtaagcctccacaccctgattatctgaagagagaaagctaaaaagtctaggcatgtgtgttgttccttctcctgcaagagcgctggctgcagcagctgctgacattgctgatgattttccagatgttgctgcggctgcagcagcaatggcagctgcagctgttgctgtactaagtgtatctgagaatgattctatgtaaatccaagtagcaaacccgtagccattagagaagggccacctgctgtcaccagggccaagcaagccagagctctccccgtcaaactcaaatgtcgcagcaggacctcttgcttcctcactccccatggctttctcaagtgccagcatcagtggtgttgcccagcttgtaccaagcgccttcttaaccaaaccaagccacgaatgcaagtccttcacgctaagcgagtgcccacccaatagctggatgcaatggagcagtggtgttccgtcccagctacttgcccgacccattccaatgagtagcttctcagcagaatcgaggaggacgggtagaaggcccgatgaagagcacatggcacgattgcgtgtgcaggcgcggagcgtggcgtgaatgcccacggccatacgagtgcgcggagatggctcatcgccgcaggggaggtaaggcaggagctccgcggcaacaacggcggctctcgagttgaacatgatgcttgggggagcgccggtgccggtcttgtcttctacctcgtcgaggccatcggcgccgcccatggtgccaagcagcacgtccacgacggtgtgcggcaactcgccctgttcctcggagaccatctcgtggaggcggttcaccccggccgccgccgcggccccgcctccgaccatgatcgcgtcgtcgaccgcccgcacaacctcctgcggggcgtccggcggcacgcccagcggccgaggccttctcctcctcggcggcggcggcgacggctccgaccgcgccggcgtgaccgccaccgacgtgcccgcgctcgtatccggatccagctcgctcccctctgcacgcacctcgtcggcgagcgggaccgccgagaactgctcgtcggagtcctgccccgggggcggcggctccggcgaggaatccaacgactcgcggggttcctccgccattgctagggctttacgacatcaacaccaaacaccgaacaaggtctcgggaataaaaatgcgggcggaatcggtcaacgacagtgaaaaccgcgagcgattcgagagagagagcgggggtggagtggaagggggcaggtgagcagcgcgcaatgcggaggcgcgcagatctggtggcgttcgggggtgggattggccttgcggcgcagcggcggagaggttggggatcagcggcggtgcatggcgagatccgcgaggcggagaggatgggtggggatatcagatggacgaactggacgagaagaagagcaggaagggggagaggtagtagacgacgtggcgcggccggcgggttcacggtcacgggtcgcggccgctttccagtgtcgcagcctcgcacccagtcgcaggcgtttggactttggtgccgcggtttgggccttcgcggcgcattgcgcccgttaaggaagctgactaacaagttgggcctggtggcccatgtgacagagacagacaacgaacaccaattcaacgagcaggaatatacacttgttgtacgtgatgaaatttttttatgaatctggcaaatacagttttggagttttgatctaagcacaacccctagatggaagttgaatccaacatgatttcatttcaagagaagttcaactcattcaagatcaacagcacatgcagggccaggcatgatggaggagctgctgagctgcatcgatgcaggaccaacaataaaaaggagcaacgtactactcctattgcttcaatgcttgcagacaaaggaaaggtatggcacaaccgatggtcgttcacacgattgcgatttgcaaactgaatgttacggagtacttacgatcgaagtaggatgcggcctactcccatggacgtaaacacgtttaagacagtatacatgcatgaactgaatagcagaaaggggcattttctcgtccatgtactattactgctagttattccaatctcgcaatgctcgattagtgacctatatgtgcaagtgattacaatttaattacaaagaactttgacgagtaccacatggactgattaaaaaatctcagttaattctctccgcgaactactgtgacgttcaaaaagtgattagtaggtgagctcgcctgacagtctgacacgactcagaaagattgattagtccagatcttcgcgaggtcatgtgcaaagttgaaagcagcagtgcagcattatactcgttgagtcggtgcaactttgaagacacgctacacagccaagcatctagttagtgttttagactttcagtcacgcagtgctgcagaagccggacgcgatgaacttgtatcccttctggcttgaggcaatgccatacacagctaaatgcttgcctgaattgtgcaggctgacttttgcaatcttgctggaactgtggttattgtcttttcttattctggattttgaatttccatttgcatgctttccaagctctccgtgcatttcgtgcaaagaaaacaaatattatacaaaattcctgaaacatttttaaagaaactttccaacttcatattagtttaactcattcatttatatcctcagacaactacataaaaaccagattatgcataatttaatcaatttcaattatcttaaacgggatgtgtgtgttagttttgcagggtgtaggagcactgctatgcatacaactcatgcatatgactagcgtgcgactcaccttatgagactaatcagtttgctcggattcttttcatgctcaagtctttcacagcttagtcatagtcgtacatgggtcgtatgcaaagtgattcggagggcgtagtacgagtacaagtacaagtaccccaagggaaatctttttcggatttccgtagactacctaaatcgctaccatgacttatgaccaaaatgtactgagggagtcacagtggacttgtgtagcgttcagcatcgtcctcccatgtctgcaaaggagaaagtcacatgccacgttttcttccagacccaccaaaataaagttcttgtgtccaaagtttaccaccgggttcttggagagaaactactcgtttgggtggataaaagctaagagtactagtactcatttggatgggaagaaaaaggagagagatgaaaagtaaaaagtttgtcactggtgggaccccctactagtacttgcactgtggagtatgaagcttataaggttcttcgtctacgtggcatacgaggaacagcaaaaatcggcgatgcactgtgaacgccctgaagatgcctcacttcaggcggagcctctccgcttggatgatagaccgattatttgagcctctccacttggatgatagaccgactatttaagcttggaaggagttgctttcctcctttctctccgttaatttgtaatctgtaatttgaacaatttgctatgtatctctttcctctaattagctctccccctgttgatatttcaaaaaacaacactcgctggaatagtggaagcagctagcaccccaaagatcattcaaatcacagatggacaatagacataggtaacggcgcttaattgattactctgtgcattagcatttgtttacctcagcttcccccaacccaagggccaaggccccaatcccaagcgtcgaccgacaacaaacggccccattgtcctgtagcatttccagtaaaaaaaaacaaccctattgcttcacttattcgagaaataagtgaaacgatgtaaatcctattgcttcacttattcgagaaataagtgaaatgaagtatttacagataaaaagtaatttataaataattttttttatgtacgtgttcttaacaatttaaaatcaaaggtcaaaaataaacttagatgaaaaaaaacataaaatcaactctaaaaattgaaaattcaaattttagctgataagtataagcataagcgaaaagatgaggctgaaagctagcagagccgcagaggaaccttgaaactgatcgaaacccaccaggtttcagccacccgtttgctcgaaatgaaccagaatgaagcgctcaggcagagccgcagaggcgaacatcacatccttgccgtattttcctcttcgattcaaataccatgcggcacgcacggcctgttggcctgattctggattccagtcgctcacatacacagccacgcaggaattcatatggcacatcaatacatatatgtacctcagcaataacaggaaaaatcgatattggaataacgggtctagaatgggccagatcggagaagataaaagatcatctagtttacaggagtactaattaatgaattgacagtactctgatcgacaggtaggatcaaacactgaaagcctgcatatatgcaggaacccgatgcaaaaacaagcattgttctgttcctgctggagcatgagagcatgcatgcatatatatatgcctgatcgcttgatcagctagcacgcgcgaacgattgattaagggaggcttgggaacatcttggttaattcagagggctctcgctttgacgatgtccatgctcatctcgctgggatcggtcgcctgcagctccacctggatcccgtccagctccctcttgaaccggtccttggagctcgcgtacagcatcttgctcctcaccttcgacgtgtccggcgacctggaaaccaagtgatcacaccgcagattcagagatccaagattagtcgaggcatgcaattcaatgtgaaggcaaaaattaattaaaaggcgc

SEQ ID NO: 62204 - DNA, 8318 bp, Oryza sativa
ggtggtgggcaatggcgatggcgaatggcaaagagatcgatctccaaggcctgaaagaggggggaagcaggcaaaatatagataagcagctttgcatggcgccatgccgccacgttaggaggaggagccgggccgcgcgtttgaccaacgatcccccttcagggccttcactactatacgtgcgcgagacccagaccaacatgcgctccaccacccatccacccatcgccgtgattgcgagacaacggacaggcatggcacggcgagtcacaaactcatcttcttgtctgcagcggctgaatgcttcagaagttcagagaatgcgcaattgcttcagaagttcatctttggggcagcaaatactgctccagaaatctataacgcggtttatttgagtcgtcaagcgcactagattcttcaactggtatttaaacgaattattgatgactatgatggtaacaaaacaactagagactggcagagaagaggcgttaacagactggcagagctccttgaatcaacacaaacgcaatgttgacacccaagaacatcacttctcaaaacattgaacagtagatcatattaaattcccgttgtacgttacaaaaccgtgatcccccaatagacaaaattgttcggaaggatcttcttctgtatcattactggtaagctacaaaggttacatagtttaaccaaagaattttacaactttcggagcttgttttacttttgccttagtgttggtattcttgtcaccatcgcctgtctctgtggtagattttgaactagattgtttagccttctttgccttggtgtgtcttgtttcttcttcttcaataaaatcgtcatcaaggtcatctccaccccggagaacagcattgtcttccaggtgatgctcctccgtattgaaagctagaaataagcagaagaccaaataaatgagcggctactaataactgtacggaaaaaagttaccagatgtttgatagcaccatcggacaaaattatagaccatctcaaacatataagaaatcataacttatctcacacattagcatgatggcatctgcttggcgccttagccagactgctactactaaaggcgtattcacccaattacccatcggcacagattctatgttacagtatagcatcatgttatgtttctttaacaaaacaaaagaggcacgcctggcaggctagtcattttctcctcataaggttagccaaatgcttacatctaagtattaatccttaattctcacatggatagaaaaggtaaacataatctgttcttctttctccaatgtattgtcaaaacaagcgtatggtctatacatccatgaaaacacttcaatggttatttactaaatgtaaacagtattaataacaagtggatacaaagatcagctacaagaagttagtgaaagttccaaattttttaaaatgaatcagcaaaagtacaatacacatgataccgtggaggaatgttaagacagttcccacaaaatgttacagttgaggtttgtgtttaccatcatccccagaagatatcaagtcttgcctccctctgtttggacaatgcttggccaggtgtgtaacttcaccacatatcttacagcaacctccctaacaaatgtatagagttagaatccacacgtaatggagacatgcaactaaataaaggaaagataatgcaagcagaacatccttcaaagtggacattttgagcccctaaatgcagaatgttatctcagtccaagatcttgtggtgataagggacaacagagtatctgataatacctttggataaatgccgtgtttgttttcaggacaattcttgctcaaatgtccctgctgtttgcagacaaaacagcttgcgaactttgtaccccctgtatgcaaaaatcatgctaaatgtgcgaggaaatcatatggctgagggtaactatttgcaggtatcgagtatggaaactggcaactgtatgagatgaaaggatgtattatttaccattttcaatgggtttggggcacttggaaagtgagtgcccagattcaccacaattataacagaatttcttcaaattttcatcatttttgtcagggcaattcttcaggctatgacctcgttgcctgcagagcaagcaaatctgaaagaagaaaatataaatattaaattttagcttgaaaaccacaaatgaactggtcagactttgaggcaactaagtactgaaaaaaaaaatactactgactgaaaatatataactgtgacagccagaatccactgattaaaggttggaatggaagcagtaaaacacttatcaggatggcctccagaagtcaccgttttgccattcacctagagatagatacaacgtgtgataaaacaaaaaaatacagaacaaccaatacacgcactgcccagtgcccactgctaggtattgcataacgtaaataacaccccgcaacattaaacagaacaaggcataaacagaacaataaacagaaaacccatactgatttcgttggttttaacccccaataataacagaaagtcagaaagtacaaatgctgatctaaacctaaggtcaccttaattgacgttcttaggtccatggcttctatagcaaaagacattgggccgagcaaaaattatccccaagagcttgcaaaaggcagggattttgagacgaatggtggtaggcagataccttgttcttctcccagagggacttctcggggcagaccttggcgacgtggtccgcggccttgcagatgaagcaccgctccccgggccgcatcccggggacccggagcgggtgcttcgacctccccgcgcctcccccacccgccttactcgtcttcttgaacatgctcttcttgttgttcttcttcttcttggtgccgtcggcgggaggggtcgggttggcggggaagaggcccgggttcgcctcgcggaagcgcttccgcgcttcccgctgccgcttgttcgccatcgccttgggctacggacgctctctcgccgtcgcgcgtggtgctgtcctcgagcttggtatctcactctctctctctctctctctgggcggcggcgcgcggcggcgggggacgggagtcgggaggggagcaagggaacagccgagcaaggagggcttcgttttgggaggcgctgacgctttgagattcgggctcacgccttgatccaccgtccacgcatctagaagcagtgggagccactccgcgaaataacggctaaacgaggggtatttctgaaaaaggcaaatcagggatctttttgtaaaattcgcgtcaagcgatctttttagataattcaaaaaaaaaaaaaaaaatggattacatcgattctgccataagacatacttcctccgtttcacaatgtaaatcattctagcatttcccacattcgtatcgatgctaatgaatccaagacatatatatgtcttagattcattacacaatgtaaatcattctagcattccccacattcatattgatgctaatgaatctaagacatatatacatttttcacattcatattgatgctaatgaatctaagacatgcatcaatatgaatgtgggaaatgctaaaatgacttatattgtgaaacagaggaagtacaaccataagtttaataagaaaaaggtaaagataaaaaatgtaaggggagaaatctaacgcaaaaatggtccagatgtccagcagttcagcaatcagcactctagactgaagtattgaagtcaatggcaatgcaatttcctgcatcgagtaattcagcagccaaggcaatttcctgtaaggaaccaatggatttacaggttttacagctactagccccgtctattcaaattcaggtacagatttcatcagtggtacaaactggactgtccaatcaacgtttatagagagactcccagaggacaccgaggtcaacattgcctccagaaacaatgatccctatcttactgctctcatgccaagcagagctttgcttaaactcgtcagagagggcggctgcgaggcctattgctccactcggctcaacagccaccttcagcatctcgtagcacattttcatggcgtccacaatggcattgtcatccacaacaatgatatcatccaccaagtcgcgcaccaccggcctaaaatgcagagatcaaatctaagaagttttcttgaagcatgactgcctgctgggtcaatagatatttcaaataaaaccgcataaatatttgcaaatgcatttggaaaagattgatgctgacaacaggttaacattttactatggttgtaattagtgtggggaatgcatttggagaagattgatgctgagaatcggttcaatgtataatgctttaccatgtcaggtcaccaagaaaagctcgaagtccatcagcaatggtgttggttgaaggcaatgttatgatctttccagcagccttggactgggcagaatcatcagcaccctttggttctgctgccagaatacgtattgaagggtttatggccttggcagccagtgccacaccagaaattaaaccaccacctgtagtgtagccaaaagtatatgcatgcgtcaaaatagaaaagaaagacttgtgttacagaagaagttaatacagtagagtacagaccactgattggaacaattattgtgtcaatttcagggacttcctccaaaagttcgagagacactgtaccttgaccactgaaagaaaacatcatatcagaatttgcatgattcactgaaaagttcatgtttgctattcaataagctaagagtacacattttaaagtggcaagacatggaaagaaactaaggttgttaaacacaagctgtatgaaatatgtcaagtagatattgccctttttagtctaggctggtatataaaaaaaatcatgaaacctggatgaaatatgatttaagagtaatgatatcatatacagtttgaattaagtgctgatttcatgaattgatagtgaaccaaggctactatcaagtaatttcatatactcgtaagaagaagagcctatcaaagttcaccccgctctgtccatttcaaatcccaaatggacttcttttgcatcaaagtagtaagctcaggaattgggactaccagataaacaatagagtactagtgacatgttcaatccacttagactttagcagcaccagtatctaggggtatgatatgttaaagcaaacagcttttagtctctgtacaatgtgttcatgatttgagatatgaacaaactttccgcatagcaacagagcaactcaataaaaaagaacttagaacagagaaatcatacctgatagtgtttttattattgaatgggtgaacaagaatagcaccagtttcctcctgaactcttttagcaacagattctcttgattcaatggagacatcactccagataatatggccaccgtaccgcttaacattgtcaaccttacatgccggtgcatttcttggaatgacaatgtaagcaggtattccgcgtagctttgcagcaagagccactgcagcagcatggttcccactgagaagaaaccatttcaatcagttcagttcactgtgatgcttcttaggattaggatgccaggtaacattgcaataactatgaagctagcactaacctgctatgcgtcacaacgcccttggatgcctcatcatcatcaagcgcaaatatcgaattggaagcgcctcggatcttgaacgcccctctacatcatatattcatatccccacacaagcaattagcagcaggtagaaattagcatggcagatatgccaaacaacacgcgggggggggggggggggcagtgactctcacgccttctggaagcactcgcacttgaagaacagctgcttccccactatggcatcgatcgatgttgatgacagaacgggcgtcttgtgcacgtatggtgcgatgcgagcctgcgcctccctgatggagtggatgtccgcggcatagccatggctttctgcgccatcgccgccacttccacctctgctccccatcaggccctagtaagtactcgtgttagctagcaccacatcaattctcaatattgtccttagctcagtgatatgggcttcaaattcagtgactgaaatactgcgcgcaagatagtaactagtattccatcaaaagaactgcacaaaaaataaaatctatcccattacattgaggggagggcaaacgcaaatggggactacatcagtggagtagtaactgcatcaccaggaaggcaatcaacagagaaaaatatcaagaactatatgattcgagcaggcaaggtgactcaagaaactaaccgaggatttggaggagcaggtgcagaaatcttgcgcggagaggaatccgaagcaaggagaaatcgcctaaccttgagtgacagtccgggcggagatttggaagttttttttttttcctatttgagcgatgaaatccaagaacctaacgagaagaagatggcgttgtggtgattgacgacttgaggggcagccgtgcagcctgcaggccactgtcttgtttgggctaaacttatctaatgggcctccattgttgatatctacgagatcgtgtttccgagcccatttaaagcaatttgcatctgctcagcccatatcgggtattaaccctaccgattctgagcaagaaagtcttcacctgaatctttcgcatttctgcttttacgtttgctccctggaatactagattcccagagcatcgagctgcgacaagtaatagctattaagccgataataattatactcgtcaagcatttcttgatcaatctgtgatcacgtaatggcggtagatacagaaagtattctagttttgcctttagggagtaatcgatcactgagtgtgagtcattcgcagatcaccatacgtaaggaaaggatcacagggaaacgctcatcactgtcagtgttccccagggaggtcatgaaatctgctcaatggggcacggcatagtgtattgcctctattttttacaagcatttgtcgcgcttgactaaaaaatgcacacattaaggaaatcactgtcatattaattttgacaaaaatgtcatctgctaatgctgttgcatgaaaaaatttgacagttatcatctgctaaaagagaataagagaccatattgatgattggctcctgctaagggtggagatcgctctatgcgggctgattccagagttgacattcacattttgcctgggcactaaattaactacggatagatacagcttagctggacgatgacttgccacttggaatgtcggatactgcttggcttttcttcagtgattccgtaggctactgctacaatcgatgtcagtagtgacacctgcctctacctgcagttcttcaggattcatgtactaagaacccactcaggaacaaccttcccctaaacgagctgaacagctagtcttaaacaaaccagttgtttaactagaaattaagcagccagctcaactgattgactgtcaggttaagctatcgcctatcggatgacgccacgatgcagtaaaacaaaaaacagcgccttgattaactatcacgcaactcgatcggattagctcccatgtgtttgacttttggatgccaactttgcgttaaatcgtccgagtttgaatttttcgcgcgattttaaacgaagatgccagatggctcttctctaaacaacgcttaaagataccatcagagcaagaaatctctgcgtggttcgagagattagctgttatccagggagaaccgtcacctgtttttgttactactccagttaaaaataacccaaacctgatttgacttcgattgtttttgaaacgccggccggttcgcttacacgtctgtgcttgaaaacaaattaatctgagttgaatttgattcgttgtttcaagaggatttcctggcagcatgcccaaccttgttcggctgttcccacatattctataattcaaaatttgatgcgaacgattgcagacgcaagtatgctggcaccacaagcgaacgaagcaaatccaggtcaaatttgaatttaaaactttttctatccaaagcgctccggtcatccaggcgtttaaatatttattcggggagtacttgacgtgtggaacgtttaaacgggaggcgtgatttcaaattgtaaacggcatctttgtcttttgtgtatgaatgtcttaccccgaaagacgtggacagatgcattttcaaaatgacctataccctccgtttatgaatctggacatacctaaatgtccagattcgttatgtcaaaattcg

SEQ ID NO: 62205 - DNA, 1078 bp, Oryza sativa
tgttggagcattgcaacgcttactggtaacaaagacaatgttattcgatacacagtagctgaattatgtgatgagtaatcttaagacaattgacaacctaaaattgacattctggagtctatcagaacacatcagtatgacagatcgtggatgagccaagttgtaataaaattaaagttcactttctgattatttttttttaagaactggtcatggcaccatcaaaatttagtaaatatcaattacttacttggaatgttcctcgtacaactttcaatggtcgcaccatcgacgatggaagctcaacaataattctctcatcagcatcactaggcacatatccaggtgcaataaccgtcgaccgaaccaaattgcgatcagcagaaatgccagaacctcgtgaatctattgatcctttcacagactgttgatctgcttgttggagtcgatcgtcaacactgctttgagttgtgtctgattctaactgctcattgtcctcatttctgtcatccactgacatggcctcagccgttattataggtgcagttgatggaagtgtgtctgttactaaaggttctgtaccctctgggttgcattcatttgattgtgcaacattacttagctttcgctcttcataatcagcagctgcacccaaatgatcagaccccttgtggttccttttcataaatcttctcatccttgaagaactttcagtaaaatctaatttccagaaaatctgaaatacaggaaagaaaagaaacatcaaaagatgtcctgcaggttgtcttttccttctatttttgtttcttttgtaagggtgctagtataccagaatgcgctggtctggaaacaaaatttgctggggaacagggcagaaaaacacacacacacacacatatgcaaaaaaaaaagaagaaagattagaaaaagttgtacatacacgatcaggagcacacaagggttcaccgaaaggtccatatagtctgtccatctctgttaggcaatgaagaagatggcgccatgctcgaactccagttgacacccgatgtcgattcagcacatcagcttgtgtttgcct

SEQ ID NO: 62206 - DNA, 2914 bp, Oryza sativa
gatgtataatttagcattaataccacataacttaagctatagttggattttacaaagaaccagtccatacctcaatgggtaatgcatctgctgccaaagcgcgatcatcagcaatcagtggattttgcccatctgaagaagttagctcatgaataccagccaatagtggacgccaccttctcaagatggctataaatggtggtaaaatcagctcaatgtactgtttccttagggggctcctgtccctaccaatagcatgccatacctacagaatgaataatatcgcataagctttatgacaaacgaggaataacttctttgttatcccctacaaaataaacattgcaggaatatagtgcctaaacattataagcataaaagattaacatgcaacatctgtacatctacaaatttacctttgattatagtgtttggatgagcaaaggcaggttactgttcaaaaatcagaatcacaggcaaaaggtataacatggaattcgaaacaactacaaaatttggtactcaagagtaaataccgaacacactttatctaacaggtatcaaacataattgcaaacactgagagtaaaacaaatcaaacagctaaataggagaaaacgaaggaatgtggaagtatcaacaattcaacatgtacacaactgcagatgggcatcactatttcttctcttttttaaaagtaaattattagaaaagaaaagagaaaattaacagaaaaagaaaaagaaaatagatttaagatgtgagcatacatctagtcacttaaaaatttgcagagaaagaaatctactttcaggtgatataatctgtagaactttcttgaagataaacgatagaaaaaaaactaaaatattgcactattttttattagatgttccactccgtagcatgggtccacaatcacttagacaaactatatgcttaggttaagaatattaaaactaacctctgaatagagaatagaggaagcaaccaacaccctttgtctcttagattcattaattggcatattgagaatgggaccaagcacactgaaaaatcacaagagtaccaacaaaataagaattgataaaaccagagtaaacgccatagtcacctagatatattatcatgtatataggaagccaactgtgtttccatcaaagttgcggctaccaactgattgtgacatatcatgccttagagcagttatatttttcaagaaataaccaatgccagatattatatcaaagcatatagtatacaaatcaagaaatgttaggaccctgccagagattgttagcacttcaccagtcaccagtgcttttcttagcttggtggattttgctagtgtttcccctctcaacattacccaacattgaataaataattttcagcttccattttttctcctgcagttaaacacataccactaactttgattttaactgttgatacttgatggtgcatagtgcatacctccacagaagtgcagatcggggtttccttgtagatgagcgattgttgctgtcaagtggcatcatgcttccagcttgatggcccaacccttccgatatgacatcttttatgctgatgttgcctgtgaaggcatcaccttcaccattgtcatcctccctcattgaaacaagagtcattctgagcatgcaaaggaatggctggtcgctatccagcaactgataaagtgcagtcataactcccataccagggccggagccccctccaatacctagaccaccaccaagtccagaatcatctaacagcaatgcctgcagcactgcaactgatttcttcacaagtggaaggtcaacccaagtcccatttgagtccttctccagaacagatttccaaaattcccaaccacttccaccgccaccaaatgtatcagatttggatgggattccaacgccataccacaagcggctcctgtacttccaactttcagcaagatctgcaatgcagctcccataagaaacaaatgcatgtttgacagattcataaggttcagctgctgctgctgatgtaagacgctccatcacagcagcagagatttgtccgtttgaatcagccattgaagtaagcacctgcttgatcacacagtaaacaagaatgaaactacattcatatgaaggaacagtggactctatatatagtcaatacgtgaccagaaatctattaaaactaatgatatttctttcaatagcacttgtctgttttacatgcattatcatgctgtcaacttcccataattgtgcattctacagactgaaaggcatatgaattttcctacgtatcacatatttagaactttctttcagaattcctatccagtaaagtggtatgcatctttctgtatgaaccattagacatatacctccgtccattcagtattattgtctatgtagatttttttttaaaaaaaagaagagcagtattcaccatggcaataatattctcctgtaacatgtggttaaaaaccaatgcaggacagggtagcctaagtgactggcataaagagcctcaaagatataggtaactatgacgaaaaaccagcagtagtaagccagaatatagattaaaaaaattctaaaaacttaggtgactaattgtgacacatagtgccaccttttgcaactatgcaccatcttgaagaaaatagtaaatggaatctcagaacaaacatgttgacgaaacatgctagtgcatatagacctaaaaatacaagtattccagttttgagtcctgttagaaataaatatcatttgatcaaaatgatgctaatagctgaagtaacataaaatatatatagccatgcgttacatacatctaatggaaggccaccagcatcagtggacaaagatgatcgtcttgaggtcccagcatccataggctcattacc

SEQ ID NO: 62207 - DNA, 3315 bp, Oryza sativa
tcatcttgttttagaatataaaacaaacatttcaagaacatgaaatacattcagtgtgattgcatgatagaagttgcagtaacccataggcactgttagtgttacgcctgctaccataatgcctctaattctctttacgtaatctgccaaaataccaatattttgaatattatccccttgattctgtattgctgtctgatatcagattcaaggagaagagctatggtagcagtggtgcaacatcggggctgacttctagtttggcgtttacaccagttcaggtaaattaaagattttttagctgtctcgtttgcttcaaagataaataaacggtatgcttaatctttagttgttttgacttgggtcatggaaaaggtagtacatgtaatttttgtttatcaatagcttcaccagtagaactcttctaaattaggtgtattctgctatgctgctggttattgcacagcttcgtggattttatgttgctattcttgtacggtaagttgggtactgcacaccattgcatggttggttttgtcttgaaatctgacgctgtatgttttgtaggctaatatcagagttgatatgcgcctgcattgtaacatatttgcaattacatcgattagtatttttaatgtaacttttcttttcatagttaactgcgtaggagtcctctcgtcattttgtttttctaatgctctattatttgttttatcgtccaggggatagagttgtcaaatccacaggcccacggcaacctgcttggaagtggaactcagagcacctatttttcagagaccgggacgttctcgaagatcaaaaggacctgagctgataagcaaaagtttcttcttcccatcagcccacagacccgtcataatcctcaggatgcaccgatgaatccattttgtaatgtactccaccttatacccgaattcagcagactttcgtggtgctgtttgcaatctctagaagttcgctaacttccatacggttcaagttaattcgacatgctgcgtttgatctgatgccgtctttgcgttcaacacaatttactgtttttggtaggtgattatcttatctgtcatctcatctttaaagtgtaatccctcttgtttcttacaaggtgctagttttgcgtctagaatttctgaaacaaagataagcatcagttggtgttcccaacttcccaatgttcccatcagtccgctatcaaggcagcgtacacgcaagtggattttacataaaatctttgaccaattaacggcgaatagtctcagcataacctctatgtgatggttgcatccgtatactcaaaacatagccaaatgccaaaatttacatgtacaaaaatggggttgctcacactggttcaccctacagagaattgtaagacagaaaactgtctgaaccgagcaaccaaaaatggatacaacgctgcaaacaatgtaaaatgactattcacccattctacaaaaagaaaaaccatcgggatttttacagggctactcgataaagttcgtttactcagcagttcgctgaataatatgatctgctggatatggtgtacgacctagcctttgctcagcctaactcgcaggtcctattacttatccactttgtacagatagtacatctcgagccatcgattcattatgctaacacgaacagaaaatgatctttaagctagtaatgatttaccaaaataaatgctttttgctcatgactgaagaagcccgtcaccttcccaaccaagacgtaacatctgatccactaccttcaagctcaactgcaacattaccagctctattagaacgaaggttaagtggcaacgtaagtactttatggaaaagcaagtgctaaatggattttgatacatcaggaatttatggtactcacagcaggatcagtgaacactattagctgcttatcagcagtagacagtagaagatttgtgttctctttgtttagagcgattgctgtgacgtcctggcctttccccagctccattgtatgaaatacctgccagtaaaatatttctggtaaggttaccacaaatgaaaaataagccccccccttttttttttgcttgtgacactaaccttaagtttatgcagatcaacaaagcatacagaaggcacatgaacagattgcctagtttcagcttgtttagatatgccatccttgccatttggttcattaggttcatgatccccagtctcagtactgtcctcacacttataattgcttgaagaacatgttcccattaaggcgaaatggccatcagtagaaatctcaatgcaactaacccgtccacaaaaaggtgatagaactgtggtagcaatagggagtccattgacagtgaatgtagatagtcttttctttgattcattccaaaccagaatgaccccttgagaagataagcatacagcatgtgcctccgctacattaagcttccttatcagacgaccagtcctcaaagaatgtagaagaacacctgacatgtttgatgaggatacaacaagtcccaagtcaggactgactgaacagctagtcacttcctcaagatgtcctctcaatacatgcataggaccttcaattcgacgcctcctgatttctgtaaggttgctcacactaggactgcgtggtgttgtcggagttgttggtggaggctcaggggcatttttcttatgtaaggagcctgcctgatgaatcctccagagtataactgtggtatctcgagaccctgttacaaggtagttgctatcatgagaaagtgcaaggcaggtaacaggagcaagatgtccagtagcagtttcaatagtcttcgctccatctggggagatcaacttcacagaaccatcagcatgcccacctattattgagtaaaatggtattagaaagcagacgaaacttcataaaaaaaatcattaaataatggaagctgcctaccataacacttcattaaaatccagaagtttctatttgagaaaaaaaatccagaagtttttattcgagaaaaaaatccagaagtttcagatcaagctgtttgcttgactttatctagcgcaacaggtgttcagtattttaatttaaatccaatatatgcaagatataaagggcaaatttgcatcttgattcgaagtgttgtcacaactcacaaggcaatcttaaactacattgcttacatgcgcgtgactttttacattacaatatgaatccacaactccatgctgtgttccatttaatgcctttcttgtacgttagtgaatgtctagcacatatgaacttcattggctcatgacaggggtgcag

SEQ ID NO: 62208 - DNA, 717 bp, Oryza sativa
tcttgaacatggaataccagctccaccatgtgaaaactagttagctacacaacccaaacttaattaaattgccagctaatgcttttgggttcaatttgaactactttccagtgttccacaccaggtaacttgaatctgtttacttgacttctatttgacaatactcctcatccaaggtggaataatttggttctgttcaaagaaatgctttgaatcgtttgctttgggggttgttctcaatagccagggtttaatatagattacctgtagatgtaaaacttctgccaatggctttctcctcatgtggggaatagttagcaattgagatggtgtttgtccaaagtaagcaatttgatcttgcatggcttgccgttgcaccttcagcattttcagttttaaaaaaatatgagcagatagatgacaacacgggaaaccaagcactagcttgagcgcatactagtacttactggatctgtgattttgtcaatgtccacagttccttcatatgtaatgtagaagaacacattgttggccattactgcttctttacccctctgtttaaatctgcaaaagaaatattcctaggtaaatggtgatatgcgaggagaaaaaaaatagaattggcttcttaaaaatactaaacagaagtcctatatcaccctacatcattcataaatgctaaatttcaataattcattgatatgatgctccaacggg

SEQ ID NO: 62209 - DNA, 1488 bp, Oryza sativa
  unsure (1)..(1488): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagctgggtataagctcagtgacgcagtcagaaagatttttaagcccgaacaaattttgatataactagtatttgctattaaaaattttatttactcattaatattgaaatttaatgtagttttcaccagtgagtccgggaagctgcccaggctagccgggcggtggcttcgccactgcagcctagcaatgttcataggcggatctaagggtggttccggtgatttcgggaccacccaaaaaaattcagcccaatgtatatatatacatatgtgaaaaataaacttttgaaaaaaaaactcatttcatcaatctatacttttaactttattgtatttaaggtattttaaaaaattatataaattagatcacctatataaagatacgtcacttcaccactggcaatgtctctcatgagtcccatgttgacaagaatttgctttaccgtgttgttgttattgatctgctggggtacattctgccaggttacccggcagaagctatgcaagcaatcgatctgtttggttgtgcaatgctcagtctgcagatagcaaaacctttctacgtgcgctcttagcgaaggtacatatatatttcccatgctgtgctagctgctcatggcatcgtcccttatgcctccaaagaatataatgttcagttcccgagaaaaaaaggataatgttcatgcattctccttgatctaatcatcatatttagttgttatttatctccctgtcatgtcatgatctaactcgcatgctctctctctctctctgtgtggtccaactccgtccactaataatatcgtatgcaaagagcgcgtctattcaggtatgtaggtacagttgtacatagtacggagtatttcagttttcaaattgatgtatactgtacgtgtacgtcgatatctctgactccatctgaaatatctatacattttacagacaattgtctgcatccccttcatgagtggcgtgcttgagctgggaaccactgatccggtaagttcattggatcactcagcacgaaaaactatggacctatatatatgtagctagctcaatcgcctagtgatgatcgaccaacataagagtatactagtatgttataacagagtatcacatgcttggtatatgttatagagagaacctattatatgtcctgagtttatcacaggtctacgatttgtcattgattttgtcacgttctataatatgctatcgattttgcttaacttttatgattta

SEQ ID NO: 62210 - DNA, 11353 bp, Oryza sativa
ccgcatttaatgcggcgcagcgcagtttatccggtccgtgaccagtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagattcattccaggcttcagcgcaagtatggcaaggaagtcgccggccattaaatgaagtttgaaatgggcgtcctccgggaaagctgacgagcggggcaggagacgtgcgctctgcttgtcaaaggtcacttccggctgtagactagccctcattgtaaaaagcatgtttcctttcttaggcagctagaggcccatgtggtgacccctgaccagataaaaaggaggcccaggcctaagagagaagggaggaagacggggggctagagcggaaactctgtctggctctccggcactctgtattccttcacacacagatccaccagaacacaggagtagggtgttacgcttctcagcggcccgaacctgtctacgtcgcccgtgtcttgtgcgcttcctttctcgctgacattccttagatcgagggcgaagaatctcacttagcgcccccggccgaaccggcaaagggaggcctgcgcggtctcccggtgaggagccccacgctccgtcatctggcgcgccaggtagggggcgcgcgtgtctttctaagccctcgtcctctttcgtgtgcgccaagcttctcccgctcagcccaatggccgaacgggcagtggcgcatagcctctctccgaacgctagcggcgacgacggggagcagaacccacgccgtcgggctcgcaccccaccgtccccctctcgtcgaaatcttgggcggggggaggcgctcggggaggtcggaggatccgcgacttcgccgcccgcgggcgacgggggaggacggcgagacggggcgcgtcgccgcctcgtctacggcgatggcggcacgccccagggcgcgctccaggctgcgggcgcgctcctgcgtcacccgcccgtcgtccccgatccagagactccagcccggcgttggctggatgacgtggccgacttggtcatgacggcgcagcagagcctaggcgccggcgggaggtcctccgccaccgaggcctctggcgctgccgccgccggctccacgtcgtcgaggcggagggcgcggcgagcggcggccgttacccgccgttcgtccgccattccctcatcaacgcctccgacccaagaagatgtgcgtggggggtcggatgcccgcctcgatatcgagcaccggcgcgacgctcgtcgcgccgcccacgcaacggagggcgcttcctcgtccggagcgccacttcggtccgggcacgggggccggccccccgtgtccccggttggcggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccccatggccctgaagggtcaggcgcggggttggctaatgaacttgccacccgcgtcggtccactcttgagaggatctgtaccagcagttcaccacgaacttccagagcacatatccacgcccaggcgaagaagcggacttgcacgcggtacagcgaagggacgatgagtctcttcgctcgtacattcagcggttctgtcaagtccgcaacaccataccgtgcatccctgcacacgcggtgatctacgcgttcagggggggcgtgcggcacaaccgcatgctcgagaagattgccttcaaggagccccagaccaccgcgcagctttttgagctcgcggaccgtgtggctcgcagggaggaggcctggacctggaactcctccggttctggtgtggcagctccggccgtccccgggtccgccgctcggtcagggcggcgggacaggaggaggaagaaggggtcggcccgttccgacgacgagggtcatgtcctcgccatcgagggtgcttcgcgggccccccgaaaggggaggccagcgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagaggcaggagcgccgtgagggcaaggccccggcggctcccgccggcaaccggcgaggtgagaccaagcagaaggccaccgccgaggacatcgacgatggtgacgatgacctggggttccaggagcccgaggccaccgtcgccaccgtcgatgggggagcgtgcgctcacgcttctcgccggagcctcaagtccatgaagcgcgagcttctggccgcggcccctacccatgaggcgacgcggcgggcgcggtggtcggaggttgccctcaccttcgaccaaaccgaccacccgccgtgcgttgcccggggaggacagatcgcgatggtggtttcccccaccgtttgcaatgtcaagttggggcgtgtcctcatagacgggggtgcagccctcaacatcctttcccccgcagcctttgacgccatcaaggccccgaggatggtgctccggctgtcccagccgatcatcggtgtgacgccggggcacacctggccgctgggtcatatcgacctcccggtcaccttcggtagttccgccaacttccgcacggatcgggtggacttcgatgtggtggacctcagtctgccctacaacgcggtcctggggaggcccgcgttggtgaagttcatggcggcggtccactacgcctatctccagatgaagatgccgggccccggtggccccatcaccgtccatggcgacctcaaagtcgcgcttgcttgtatggagcaacgcgcggaccacctcgccgcggcgtccaagcccgcgggtggcgacgagaggctcagcacctccgtcccggccgccccaaggcagcggatggtcacgtgcgacgaggtcccggtcaaggaggttgccctgggcgacgtcccgtccaagaccacacgaatcggtggtcttctggacgacaaataggaagacgcgctcgtctccttcctgcgggcaaacgccgacgtcttcgcctggagaccggcggacatgcccggggtccctagggaggtgattgagcaccgtctcgccgtgcggccgggcgcaaggccggtccggcagaaagtgcggcggcaggccccggaacgtcaagccttcatccgtgaggaggtggcgcgacttctggaggccggattcatccgtgaggtcatccatccggagtggctggcgaacccggtcgtcgttcccaaggcgaatggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggctaaagaatgcaggtcctacttttcaacttactactcgaatttctttgggtagccagataggacgcaatgttgaggcctatgttgatgacttggttgtgaagacgtgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcaaggctgggagagaaggcagtacccctatttaagctcctcaaacgctccgggccgtttacctggacggaggaggctgagcgggccctcactcagttgaaggcgtacctcagttctcccccagtcctggtcgccccggagccagatgagccgttgctactctacctggcggcaaccccgcaggtggtcagtgcggcgttggtcgtggagcgcgacgaggacaaccctcactccgcgcatgcctaccctgtgtcgactcgacccgggagagagcagggaggagaggcccccgagccgaacggtggcccaaggcccccgacggccggagttggccctccgcctgcttgtccgacggtgccaggcgcccccgacccccaggatggccccggggccactgcgggaaggccgcgcctgtcgccctccgaccccgaggtcgtcggcacagaagccgagtgcgccccgcgcggcctcttggatgcaagagcgccatggagatgcggcccctggcgaagaggatcggccccgccgaaaggtgcagcggcccgtccacttcgttagcgaggctcttcgggacgccaagacccgataccctcaggcccagaagatgctttacgctattctgatggcttcgaggaagttgcgccattatttccaggcgcatcgggtcacggtggttacgtcgtaccccctcggccaaatcttgcataaccgagagggtactggacgggtggtgaaatgggcaatcgaactctctgaattcgatctgcgctttgaaccacgccacgcgatcaagagccaggccctcgccgactttgtagcggagtggaccccagctcccgagcccgtctccgcccccgaggccagctcgggcccctcgcagttgcctcacaccgccttctgggtgatgcagttcgacggctccctgtctcttcagggcgccggtgcgggggtcacgttgacctcgccgagcggagacgtcctcagatagctggtccgcctcgactttcgggcgaccaacaatatggcggagtacgagggactccttgcgggactcagagtggcagctggactggggatccgccgcctcctggtgttaggcgactcccagttggtcgttaaccaggtctgtaaggagtaccggtgctctgacccgcagatggacgcttacgtgcgccaggttcggcgtatggagcgccatttcgacgggatagagcttcggcacgtgcccagacgggataacgcggtcgccgacgaactctcaaggctcgcttcctcacgagcccagaccccaccgggcgcctttgaagaaaggcttgcccagccgtcggcgcgacccgaccccctaggggagacggacgcgcctgaacggcccctgaggcccgtcggagtctaggcctcgggacccgaggggagcgctcccagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacggagtcctcctgaagtgcattcctcgggaacaaggcgtcgagcttctcgccgatgtccatgaaggcgagtgcggagcccactccgcctcacgcaccttggttggcaaggcctttcgccagggtttctattggccgacggctctcaacgatgcggtcgacctggtccggcggtgcagggcgtgccagttccacgctaggcaaacccatcagccggcccaggccctgcagaccatacctctttcgtggccgtttgctgtctgggggctcgatatccttggtccgttcaggcggaccccgggcggtttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgaactcttcggtgactactgcgaagacatgggcatcaagctctgtttcgcctcccccgcccaccccagaagcaacggccaagtggagcgcgccaacgcggaaatcctcaagggcctcaaaaccaagaccttcaacatcctcaagaagcacggctactcgtggatcgaggagctgccagcggtgctctaggcaaaccgaaccacgccaagccgagcaaccggggaaacgcctttcttccttgtctacggcgcggaggcggtcctcccatctgagctcaccctgaggtcccctcgggtcaccatgtattgcgaggctgatcaagatcagcttcgccgagacgacctcgactatttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctactcctagtgggggtcgggtgttatgtctcgggctcgggccaaccccgcgcctcccctgggcgtgcagggttggccgggggctaccacatgcatatacttatcttttttctcttccgtatttcaataaaagcattttcgatttcctgaggactgtgtctgtgccatcgtttccttttgaagaatcttggcttgaattagcacgctcgtgctcgaccctgccctcggtggcccgggccggctaaaatcgccaaacggggcccagaaccgagccgtgccccggggcgtggtgaactccgggggggaatcggcaaaggcccacaatcgggtcatccataaccctcggtcaccgcgctcccggcctggccagtctcgacacgtggatctccccaggcactagccccgacccgcaccgtttgaggctgggacctgggcacgagcccttgttcaagctaagacacagaaggaccgtggcacagaccatcctcgtctcaaacacacaacaaacagaactgacgcagaaatttcctccttacttgattacagattaaatcagtctatacaagaagggggcccgaaggcctcggaagaagaaggaaaagttattaagattggcgggggcctgggggctcactccgacgcgcccgggtcgccggcctcgtcgtcgctgtcgtccgcaccgtcgtcaccaccctcctcgtcggagtcgagggcgaacgcgagccgaggggccgtaccctcgaagctgtggacgatgtgatcggcggcgtcccggacctgcgcgcgcgcgccgtcctcggttccgggagggaactcttacagcgctgcccacggagagaagtcagggtccctggcctggtagcttgccagtacgagctccaccgccccccgggcgaggtccctcgtggataacttgatcgtctcctcgagctcctcggggagccgctggagggtcccggccatctctgagaggcgctgggcgaggcccccctggttggcggcgtacttcgcggtccgcccgccctagaggcccgcctgccgcccggcgcggtctagacgggagacggcgtcccgaagcatgccgggtcctacctcgctcaccaaacggagggcctcgacctccctggcggacgagtccagtgcgccctgcagcccggcgatggtgtgttcggcggctgcgaggcgggcggctaggtcgccgtcgcccgcggccgccccgccgctgtgcgctctcgcgtccagctccttcgcccgcgcctcgagctcagcggcccgctgatccagtgcggccctctcggcatgggcgccttccagattgcggcgcgcctgctcctcccgcgctgcttcgcggaggaacaggctgtccgccagccactgcgccgcggcctcggcctcctcgagagctcgctcccgctcggtgagcgcgtcctcgcggaggcggagtgcggactcctcttcggcgcaggcggcctcgtgcgccgccagtgttgcctcccgggtggcgacggcggcctcgcggtccgccaggtctttctccttcgtgtccagggcgcgggcgcgcttctccagcgccgtggcgcgagcctcaagggcctcttcgcgctgccgggacgccgcctcgatctccgccgcccgccgttcccgggcagcggcggcgtcaaggactccccgggcggcgtcgagcttcttctctagctccgccgcccggctcccgtattggaggcggaggtcgtcccgcacctcgtcgagcacggcgatggcgatgagggcagtctcccgctcctcctccacctccctggcgatctccgccaggtccctacgacgggccttgagctcggaggcgtgccggcggtgtgccttgcggcccgcctccaccatggcctccaccgagcgccgcccctcctcgacgcgcgcccacgccgcgtcgagctccgcccgctctgcctgcagggcctccatctgggcacttaacccgtccagcaccgtggtgttcgcggcggctaaggcctgcaggaggggctccgcactcagtggggcaacggaaggcagaggggagagccgcctcggtgtgggtgccgcgcggctcggcccgccgatcgacgtgccggacccaggggtgtcccccgaagctggctcgtcccaagcatcgcccgaggggtcgggcccgagcggcgcgtccgcggcctcgtcgtgggtggcctcggaagtcgtcgtcgcctcgggcggagtcgggtcgggggcttggcaggccgcctggcgtgcacgcgccgtctcctcctcccggacggactccccggcccggcggagtctggcctcctcccgagcggcctcctcagcctggcgaacccggacggcctcctgggcagcctcctcggcttcccggaggcggtccgcggcttctcgccggtcagcttcccgcctccgggcctccgcgatcgccgtctcctcggcctcggaccggccggacttggaatggcgggggggggggggcgacgggatctcgctgaggcagaagaaaaaccagaagacaaaaagaaacgggtgagtgaaaactcgccttgggagatgggagaatgaacacggccgcggtgggcgcggggacgaacctgcggggaggtcggctaaacgaccacctcgggagcgagatgaggttcccccggcatggctcggtcccccccatcttgcggagccgtttcttctttcgctccccctcaggctgtggcgtcggcacggcaccctccgggcgcctgctgctggcacgcaccgcctcgccctctcggggaggagatgggggggtcgtgccctcctgcttcctcttcccccgggcgtcggcagggcggctgccccccgggcccccgtcgcggggcccagaagcatgaccccctcccagggtagattgtttccccctgcggctcccgcccacgccatcgtggcctcgggggggccgctcccccgacgccccgaccgcctgcatgatggtcaggatgttggcgcgatctggatcgctgcagagggggaggacaccttgggggataagggatgcctccacggagctgagattcagcacccgttggaccaccatcctgaagtcctcagggacccagtcccatttgcgcccctggtgggtcctcatgtagtcctcgggcccggtgtactcccaggcgccccgggcgcgccgctggagcggcgcgatctggcgacgaaggtagtcgccgaacaccatggcccccgtgagcccctgggatcgcagacccgccaggcggtcaagaacggcgtcgtagccgtctcccagatctaccgtcgcccgccagctggaggcctgcgccgggggctggctcggaagtcggaggcgcgcttcgtcggcgaggggggtgtagaaccaatcgctcttccagtcgtcccacttcttgcggaggacgcagggaatgtagcggtgcagcacctgcccccgcggctggaagtagcagccaccgactaccgtcggcggcgacaccagctgtacggtgaagaaccactggaacagccggagagatgggcgcaccccgataaacatctcgcacaggtgcgcgaagatggccaacgtcattattgcgttgggggtgaggtgcgccatctggagatcataaaactccagaacatccatgaagaaattagagaatggcgggaccagcccggccattgcgaaagagaggaagaagacggaccgccccgggtagtgtggcaccgggcgtccctcgcccagctcgaccacctcccggccggtggcagattccggcatgaatcggcgcggcaacccggcctgcctctcgctcacgatgcgggaaggcggcagcacgctaccgtcgagcggtgcggagccccgtgccatgacgccggcggaggaggagcttgagagcgagcaagtgcggcgagggtagggcacaggaaacgaagagttagagcgcaagtggcgaaggcaaggggaatagtggcgagaggaaggaaacgaatctcttcctcggcgtctttatacccttgccaacgctatgcccggctcctcgcttcccgcgcccactatctcgccccctcgtttctcgcgcccacgcctccactaatcccactcgcccctttgcagcgcacgcggcagatgtgcggccgtggcggttgagatgggacagatcgtgcgcgcattaactacgttcgccaaccgagaagagcgccatcatcatgtctccaggcgaaacgaaccggctcgtcccgattcgcgcgctgctcgagtaatgtagcggtcttgaagagaccgctcattattgtcggtcggtttttcccttgccgatgcgcgcgatttgcgaccgctgggtttctgcccgcctgtagagaccggccccgcctgtcaccaggcctaaggagtggcgtcacgcccgagcgcttccctcgaggggggtgatcgccctggcgtaacgccggcggctactgtcggtgatatgggaccgggggtatcgtgactagaggcttgggcagccgcggtcacccacgtggcctgaccccctcgggggggtgggggggcgggcccgagggtgacgtggccacccctccctctgtctccccgaggg

SEQ ID NO: 62211 - DNA, 3588 bp, Oryza sativa
cgaacctgtctacgtcgcccgtgtcttgtgcgcttcctttctcgctgacattcctcagatcgagggcgaagaatctcacttagcgcccccggccgaaccggcaaagggaggcctgcgcggtctcccggtgaggagccccacgctccgtcaatatcatattataaacataagattggaaacatccaaaatttgaccaaaaatttaaaatctgatatttcagaatttttgcccaaattttggaagtttttgtttcaggggtagtcatttggacaaaattgtacattactaatgaaagctaatcggatggcaatggtaaatcatagaagttaagtaaaagttgatggtatattatagaacgttataaagtcagtggcaaatcgtagacatgtgacaaactcggtgccatataatggattctctctatgttataccatgtccggggcatttcgttgctatgctggcagggagctgctaggggcaagctagtatagtgcaatgttccgtagcatccaagattccctcattatttatagcgtgtatatcaaactactagtatatatagcatgtgccgcatccataatacgcatgtaagaaatcaagctacaattcaagtttatgtgcagctagctagaccactaatgttaccatcatatattttttctagaatcttttactgaaatatatgaatagaggcgcagccactgtggtgggatggggtctggccttccccaacagcccagtaacaaccagcccctcctttcctacaccccaatagtttacttttgcttttaaatactaccttttatcaacatataagtaaaaataaccatgtactattttctttttaaaatatatgacaccgttaacttttcgcataacgtttgatcattaatcttatttaacaatttagtataaatatgtaaaagtataagttaagattatattttatttgatgataaaacaagtcataataaaataaatgatatatatatataataaaacaaaatagtcaaacattatgtgaaaagtcaatagcatcatacatttttaaatggaatatattttttatatcattagttgtctaacacttcaaaggtataatttcacctctccaattaaatttcaatttttctaaaatattagttaatacttgcatgaagatgcgtatatagtttgtttctcattttactaaaatatagttttttttggattgcttgtcaatttatttggaattttagctcggatgatactatcaccgcttatgattgtctgcttaatactcataggctaaattgaaatgaataaatatattcggtatatcaacatacctaccttttttattatcatgtgctattttttagttgatacgatatattacgtacctttgggaaacattacgtatattttttacactatatttttaataatcataatcgctttgtgaagttcgtcttcctcgtatctaaatcctagcttcactacgttgcatgtacaaaatgaggggacgtacccttaactttaatgaacaaaacgacattttacgaactactgagctacgagcaaagacactccacgaaatcgaaatgttaacttatatattttttttttttgaaaactagagggtgcatgcagcggtcgaagatgtagtttttgctagtctcattatagtctcttacactcattatagtctcagttcttcacaatatatattgattactattgaattatattcccaggtttcggaggacccaaacttggtaaaccgaatcgttgcatatttgaaggagcttcagtttccgatatgcttagaggtaccgagttctactccttctccagacgaaacagaagatgccgacaccgtgttcgatggcctcattgaagaggaccagatggtcatactccagggagaagacgagctaggcgacgtcgtcgtcgctgagtgcgagaccaacggcgccaaccccgaaacgatcaccatggagaccgacgagttctacagcctctgcgaggagctggacctggacctcggttcttatcagctagtcccgacgtcggcacgggagacggtggctgcggcggcggcggcggctaacgatgtcgacggcgttgcatactctcacgcctcgtgtttcgtgtcatggaaaagagcgaacccggcggagaaggtggtggccgtgccgatgactgcaggcatagagtcacagaagttgctgaagaaagctgtaggcggcggcaccgcatggatgagtaatattgatgatcgtggtagcgtggcaataacgacgactccaggaagtaacatcaagagccatgtcatgtcagagagaaggcgccgagagaagctcaacgagatgttcctcattctgaagtcactactcccctccgtccgcaaggttagttaacttagcgttccatactgaaagttatataggagtagtattattcatcgagctgtggattgtccctgcaggttgacaaggcatccatacttgcagaaacgataacctacctcaaagtgttagagaaaagagtgaaagagctggagtccagcagcagggagccatcgcgttggcggccaaccgaaattggacaggggaaggcgccgtaagatcaccgggaaggaggtctatgagatcggtgtcagtggtggtacctcgtcggtacctcgtcaacaccgtacgtatatgatatgcatgtataagatcaccgggcaggaggtctctgagatggatgtcatacggtgttgacgaggtaccgtacgtatgatatatagttatcgttttcattatggaaaaaaaattccgaattacctcgtgtactataaaagacgcgaatattagggaagaatctaatatcaaataattagaaggggtgaggtttcgaatccaggtcgtctatcacaccaccttgtgaagctagccggaaaacccttaagcgtttctctacctccatgtactattggtgccatctgaattaccgcttactaatagactcgattctctccacacaagctcaatatgatttcagcacatctgctaggttttgtcccttttattaacgtctattatagctagggatgcatttacgagtgcatgcatgtgtaaacatcttttatataattgcaaatagaagaataaattccataaaactatagactgcgaataaagtatcgcaagttcacataattaagatgatgcatcacttttattacagatcgaactacatatataagatggagtgttagaaagctacagatttaataataaaattaccatgaaactacaacatttataaatccaacataacaatgcttttatatttaaactctaaaatatatagttttgtgataacttaattattaaatgtgtagttttgtgatactccgccaatttgatatatagtttcatgataaatttatactaagatgatacactgtctcaaatatatatttttctataaaataattttagtttcttaaattttacctattttaaataatataatggctatatcagttcttggagacaaaaggaaaaagccaggaaactcaagttggaaaagacctcacattttcataatctaggaaaa

SEQ ID NO: 62212 - DNA, 17228 bp, Oryza sativa
  unsure (1)..(17228): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacaatactaaaagctgcaactcgtctgctattccgatcttcctctgattcaagtgctaccagttccttcttcaactccaggccaggcaagagccgagaagggcttcccaaatttttcccgcggaggagggagaatccgcgagtccacgacctcctactcccgagcggcctctgactgaaaaggatcgaatttatttgagtttggttttacatgcggatctggaaatgcaagaggacctagaagaacgttgctccttagatgtatgcagctgaggcatcctaacgaatgaacgatttgaaccagttccccaacctgctttctccccgagaaagccttcctgagattaaaagaaaaaggtttgaaggttctgggatcagtgatagttcggaaccagcaaagggaggctgaaaagccgtagtgctaacgcacgccctgtagttttgaagcaggcttcgacagcagcgagctccgcgtcgaaaagcgaagcgagccgcgctagcgcgctacgattattccaaaattgccccttcgctttatcaacttccagttataagttgtaacttacttcaaacgatttgagacctcttgatatccaacattgttcttaccagaaccaaaggccacaggttattgctaatgccttccactatactcaacctgcatggcaattacttaatcaaagtcaagatgcctatccacataggaaaaacccaaagtcaaaagagcaattggcctgcaaaaataaaggatttgttctcttttgtaattagaacaaacataaacaaattggatagaaaaggagcggaaaccgattgattgtacacttgctgttctcaactgggcctctgaatctcctctggtttcacctttgcgagtcgaagtaatttccggaaagacacagaggagctctcatgcgtggaccaacagtagccctgtcctctcctctttgttggaagatgagtacacatcgggtaatccgcccacgagagcccaatcacaagaggctcatatagaaagcaatcagcccatagcccaatatcgagaccacagcctattattcaaaccacaaaggatccgtctttcatcgtccaatcttctcgatcgaacatattgacatcaatactcctttccatggccattcacggcccgcgaagatcaaccactcgtgcccgagatcactatccaatcaaaaaccagacttccaagatccatctcactcagacccttttgaatgtagcggataacaacggagcggggctatcgaattgatatgtattcgaatcttaggagctggtaatcactgatatgctcatattggtgacgttattgttgctgtaatcaaagaagcagtgcccaaaatgcctctagaaagatcagacagaagtaagacgagctgtaattgtacgtacatgtaaagaactcaaacgaatgtcaaaacaaaggaaagatgattatcttataggaagactgccaacactgactggggttgttcaatcttaagtggagtgagttaaatgacttggcttgctcaattccttcccggtgtaatttcataaaaggaatagcactcaaagcttgaagataagttttgtactcaattaatttctcagtccctctaatcgggtgggcaccggccggccggatccccctgaaaaccgtacgtgcgggtctcctttttgggtataaagataaaggagtcgagtttacaattgaataaattttcataatacatttgtcttgggttaaaaatattactattttttctataaaattagtcaaacttagagtagtttgactttgaccaaagtctaaacgtcttataacctgaaacggagggagtaatatgaatcactagctagctggggatgtaatttactaatttacataacatgtgattgacccatctgctgacagatgaactatgtacttgtcccacttgcggactagtttctatagtcttgctagcaattaatggtaaaactcagttattattcagtggacagtgatctattagcctcagtgccgggttgctttattgggttcaaaagaattaattgaattgttgcaaagaggaatagttttgatagtgctaagacaatgacttgtattgtaaaaaaaaaaagtgccacatgatggggacagcgcgatgaaaagaaatcagttgtaatgacgcacaattgttttgttcttagaatatgtattgttttatttttatttttatgttgaggacctagtagcaagtcttatgctcgaaattcttggtctgctttatgtagtgatcacttgacccatcttttctggcaatgctgatttaacctcattgactccatctggcagcattagtagaatatcatcgcacccaacagctatggctaccacacaagcctcagaagcagccactgagaaaggattgcctttggggatggatgtctccatggtggatgaatatgcttcccagtccaagctgctgcaggaattcgttaaaattcccactattggcaacgcttggatcttcaattccaagactggtatgtgctgttattgctatctggttttactgaacttaggtttcttactcttcttctcgtgttgtgcagaaaacacatctagggcgatagtttctgttggccaaacagatctgttggcaaacaaaaagaggagcttcctattaaattcccacatctcaaaaaattcctcaaattctgtggatttccagtggtctcccttcccaatcgaaatgagtggagtttcagcagtaattccatcgccatctgggagaaaacttttactaatacggaattctgaggatgattcccctacaaaactagaagtttggggcccctgtcagttggagaacgagattcacattgcacaatctgttcatggatcactctatgtcgacgaatggtaaactatcctgcctcttttagaacaactttcttagttttttgtgtggtagtgggtttttttttggaagaaagacagaggtaattagggacgagagattgctccattcgccactttttgtacttcatgtttcttaaatgcaggtttgaagggatatcgtggaatcaagaagagactttagtagcttacgttgctgaggagcctcctcaaccgaagccagaattcaatgattcaggatacaagaaggctggctcgtctgaaaaagactgcaagagctggaagggaaaaggggattgggaagaaacttggggagaaacgtattccaagaaaaggatacctgcattgttcgtggtcaacatttcaaggtgtgtttctggttgttctgaaggttgaatccaaaatagctttaaaagtactgcaattttgtgaggaatagtttcattgcagcggtgaagtgcgagctgtgaagggcataccgagaacattaagtgttggccaagtgatttgggctccatcatcatcacatagcctggtttttgtggcgtggtcatctgataatggttaccaaaagacaccaaggaaacttggaattaaatactgctttaacagaccttgtgctctgtatgctgttcctgatcctttcatggaagaagctgataagccatcacttaagtgagaacacctgtccttgatgacaatatttattcagttctatttcaactatgcaccattgtaggcttcctgttctaacatattaaggtattaattgtcacattttagttattttctagtgatcgtgtgacactgtaaattcttctctcagaataattgtagcagcatatttttttcaaggaaaaaaaatcttccatatatattttcactcttttttcctcattaatcctagtcctgagcagacaaatgctaaatggattgtatgcatcatgtctcaaaaaatagaaagtttatttctgatgtcatttctgtttattgtacagtgtcagtaagggtgaaactgcacctacaaccaagttaacatcagagttgagcagtgcttttttcccacgattcaggtaggactgcattcagttttctttgctcagtactgttattcagtttaggccatatgtctcaactattatattggaagaagtacaagctacacatcctagccgtatttctttaattatgcattataattgttaggcgtaatttttcttctatggtttaaaatattttaatcaaattcccttaaagcatgtcaattgattgttcatgcttgttatcatgtattttaacctaaatatttgaacaatcataattcaaatgggagtgaatttggaaagtggagcattttgggctgatgagtaggtgtctttattatttccttgttcctgtaatcctgtggattgactcagtagatattaatttactgcaacaccaatacattttatttgcacatctacaattgaagttttcatgtctagattataacttagtactggtagctgatgcatgtagatgaatgttaacaatgcgtcgcaaaaatgatatggaatctttattgtacagtccagatggaaagtatcttgtgtttatctcagcaaagagtgctatagatagtggaacacacaatgcgacaaattcaatgcataagattgactggcctgcagatgggaaattggagggcctcagtgttgctgatgtggtacaacaatgcctttcctttacttgttaattttttaatcgatcattttgtttagatggcttccttttatatatagcttcaaagtcatggcttggaaaaatacataaatctaaccagtgtttatttgagcacattgtttgcctgttggctatacttgattaaagatatgtatttctggactttgtgaagtggaacttcaattatttttttaattattgaagtatctaaattcaatttcagttaaaagaacgaagttcagagggtaaaatttataatggtgtgtttctttttataggtgctctgcatatccgatatcaagttcttaatgtcttagctgttatgtaggtacctattgtgatgtgccctcaggatggttgttttcctggtctgtactgctctggcatacttaggaatccatggcttactgatggacaaactatgattttatcttctatttggggaagtaaggaagtaatactttctgtaaatgttgtgaggtgattacaagcatttttatccatcagttagaatgatatggctataaagtttatttatttatgaaattacctattttcttcacagccgtgaagtttcaagagttagtcctcaggattcggattattcatggaatgttcttgcactagacaaggataatattcttgcaggtaattccgtaccgaagttacagttgtatcccatagttcctttggataagatttcatattcatgtgcctttcccaccttttccagtttcaagcagccttattacagttcctcaaatatactatgggtctgaggtttgtcagactggaaaaccaaaccaatgggagtggcaagaaattgcaactccttttccgagtccttctgataaggtataactgaaaaaatgcgttgcttgttcaacttttccccaaaaacactgacaaaaattttggcagtgtaaagtactaacagtttctgtgatgtatgtttggcagatcagtgcaatattagcagaccataagttcagtatactcaaaatcccgattagcaactcttctaacaaactcgctgatggtatgtgtacaacccaaagctcctttctttaatgaaatgacagacagctctcctgcattcgaggaaaaaaaaagcctctgactgtttttttttcctggaattggtactctttggtgccttgtgttttgaatacttctgttactgcattcttcagttgacgctatgtttttcttgagatcagctgtactgtctagtacttgtaggctgatatattctgaactgcgacaaaatctaaccatgttgcatttactcaaggcaacactaaaatgcatttgtaagaaagttctcaaagctcatggtagaatactcttcttggttgtttgcatccttaaggatgcatgctaagcttcatttgcattttaatgtttgaaaatgtactttagtagaatactcacatcctctccccttcctaaatttttatattttataaaattgattcaggtgctaagctgccctttgaggctatttttgtgtcctggaaggattctgcaacaagaccaacaattgttgttcttcatggtggaccacacactgtttacccatcaagctattcaaaatcgttagcatttctttattcacagggatataaccttcttgttgtgaactataggtgagctttatttttttttcttccagtagttcttctgttgaactaggttaaaataccctgtcctttctgaattctgctttggaaatatatcatattaaacactaacattaatgtccacgtacacaccattctgttgcctagaggttcactaggctttggtgaagaagcactacaatctcttcctggaaatattggttctcaggtgcactgttgttgatttatttccatgttttaagattattttcttaagttgccagaaattttatatgaactgtcattacgtacaattgtttaatactcatgaacaggatgtgaatgatgtattgacggctttggactttgttataaagaaaggattaatagatgcatctaaagtagctgttgttggaggttcacacggtggtttcctgacaactcatttgattggccaggttcttagcatgcctttgttattctgaattctttatctatgcaattattcattacatttgcagtttatatttcctttagggattcaattatttgtgcctaatcgtttgcacaaataatctagcacaattcttgttgtaaactgtatatactcatttggacataattgggaacagtgtcttttgataatgtgtattggtctatatgaaactcttatatttgagaaatgtgctgtaaacttataattttgggagggaggttgtaatttgtaaaagagagtagtaagtttaatataagtacccaagcacactaagttatggtcagtgaacttaaaggctcaaagctaaacttggatatttcaggagctctgtagcagtgcacagctaaaaattcttttaaaaaaatgatgacaccaatttatattagctattaaattatatattacattgcaacgcttaagtccagaataatatcctagaaaaacattcttacaagagttaggatcagcatttgtttccttttcttggaagtaaagcttcactgcagtgtaagccgagctgtttttaccttttcatgattaagaagttcacatgtgatattctcaagaatatttcctgattttagaatataattatttccttgacaaaaatagtgagaaactactgctgcatgtgggaactaggtctatacagtttctttatgactatacatgcaagacaataagagttcatgataggtctatacagtttctttatgactatacatacaagacaataagagttcatgatgcacaggcaatagcacatggattcttctatttatcaggtcttcttggattctgttgaccttatgtttcatggactgcaggctccaggcacttttgttgcagcagctgctcgaaacccagtatgtaatttatcattgatggtaggaacaactgacatacctgagtggtgttttgtggagatttatgggaaagaagggaaaaactgcttctcagagtatccttcatttgatgatctttgtcaatttcaccagaaatcaccaatatcacatatatcaaaggtatgtagattctgcatacttaaccttttacaaaatctatgcttgaggaagaaagtgtagttccctcatgcaaatttgctccttgaggactttgagtaatcttttcttgacagtttaagaaaatctgcaggtgagcacgccaacactttttctccttggagcacaagatctcagagttcctgtttctaatggcttacaggtaatttcttatgcacttctgtttcatttttatatgatgaaagggttgtgaaatgattactagtagcaatgttgcattcatgttattgtttgcgtagacaagttcagtcaattttcctgaaaaccattagtgaaagcatatgattcatattgttccactatatactgcttgtatctatttatttattttcacttttacaaatgctggtttatgcctaatcataatcgcaacatatgcagtatgcaaggaccttgaaggagatgggagttgaaaccaaaattattgtctttccagaagatatgcatggccttgacaagttagttgtactttttaatcattttacctttgttaccccgatcagtgtcttctgtgttgcaacatttgactaagtcaaccttgcgtcccctgtgcaggccacagtctgattttgaaagcttcctcaatataggtgtttggttcaagaagcacatgagcaaataaacaacatgcctctgttaccacactctcaccttgcttaataaatgcttgtaatttgggtcaaagcagcccaaggaaacgtggttctgttggcattctaataaattaagcctgctgtaacatttctgtactgggataattcttgaaaatgtaaatgcatttggttataaaattttaccctcgtggtacggaactatggattacaaatatgtgatgttagattatgctttactttgaactttgaagtacttctagttcacggttgctgtcctgtagcctgttgggcttgggcattccttttatttttatctttttttaggaaacaatgggatcataatttcttttgaatttcagtgagaaaaaaatacatgaaagttcagttcaagttaggcacatggaaatgctgattgagaccactgtaacttctgcttctttgcatcaagatcccttgaagttgccttctggataatctcattttcatcagatggtacaaagagctttgttgtttcatacgattttaaaaaggacaacaatataagttattgcaaaggcttcttgtgctgttcgatgctttcttcgtggatgcggacctgacgcaaccttttgtccttattgctgggttcctcttgtctcattgtctatggtggtatgtacgatcattagtaactttttaagattccttttgttattttgggcccattctttgagacctgacacaaaaagaaaaccaaaatttgatgccatctgatcctcaccaattgtttgttgttaggtttgttgggatcgttgctaaggactgatgatgttttaaagctcaactgcagtcttggatcaaccactctgccactagactccatttgcacttcactgcaaaagcagaaaaatatatgtaagtattctcctttccttcgtctcctgaaaggctaatacgatttataatctgattttattgttttgaggcttctaacttgctgaattttgttggtcctaagttgtttcctcctgcactcagtctggtcctcttgattattgctgtagttccagaagaatctgattttgttagtagaactagtcccagacttaacatccaggatttaatattttttagtgttcatcgtattttttagttatgtttatacttttgtactacatgaaaatcaaagcatttagtgtcagagttctccagaaaaggattttggtgggaaggaagaatgaaagatacttcattttattaatcttaggtagccattatagaagtttccatgttttgtttgtctaagtgattcaatattttttcttgaattggtgcattgacaacgtcaaatctgtccatggattgcaagatgaacaattgggactgttgttcttgagttgttaatggaatttatgaagtataaattaaaaaatagtttgtgtctgaactacattaaagtgtatgaaatctgagtcttagtacggtagtacctgaaatttttcacgggtaactgcaatttgaattatgaaagagttaaggtgatataggttgagtggtgtgctctaacctctaggctcttttggcattgaaatgtatacccatacatcatgaagttgaagtcaggaattcaggtttctcagttttcatcttatcagtggaattgacaacaaaatatacttgagcttccctgcagcttgtttaacatactatattcttgagtttcccttcagcttcctcagcatattaacctttgtgacaatgcagatttagcttaacccagtagattgtgtctttccaaccgaccttacaagtgatttgaatcttctttgagaaagacaatccattgggaatggatgcactggcatctgaagaatacgcttcacagtcgaaactacttcaagagttcaccaatgctcccagcattgacggtgcttgggttttccagaccaacaatggtagggatgattttcgattatacctcattagtaatcatcattttactattttccagaagtggcgtaaagcaactcttgtgtcatgtttgcagaagacagatccacagcaatgtattcgattagccaaacaaacctactggcaaacaacaagagaaaatatattttgttttctcatattatgagaaatggtactaaccttctggactttcaatggtctcctttccctattcaaatggatggagtgtcggctgtcgtaccatctccatcgggatcaaagcttcttgtggtgcggaatggagagaaaggttcccctacaaagcttgaaattgttgatcaatcacatgtggagaaagagatacatgtagctcagtctgtccatggtccactttatactgatgagtggtaaaagtacagcataatacctgcacttttcagtccattcaacctatctgtacaatattctggatcatgatactatttttgttggcacaggtttcatgggatttcctggaaccaagaagagaccttaatagcatatattgctgaagattcacctgaaccaaaaccagtttttgatgatactggatatagaaaagaaggttcttctgagaaagactgcaataactggaaagggcaaggggattgggaagaggattggggtgaaacttactccaaaaaagggagaccttcattgtttgtccttgacattaataggtctctcagcaccttctaattaatacataatgttgacctgaccatagatctgacaatacgacttactgaaaccgtttatttgttgtattcagtggagaagtacgagctgcaaaaggcatttcaagatcattgagcgttggccaagttgtgtgggctccaccatcttcatgtggaaggcagaagtatctgatttttgttggatggttagagcacaatgggtttcagaatactcctagaaaactaggcatcaagtactgttctaataggccatgttctctatactcaactctttgccctttcgaagaatcagatgttgataatgcaccagctaggtaagtaactgagcacccatcttcagatcatgctgtaactttgtaaagtttacaaatttactttatttatcactagtttgttgaaataagaaaatgtaaagctctgaataactatgcttatggggcagttgtaagttgatatttccatgacatttttccagtgattctaaattagagcctgcttcagtagcaatcaacttaactccaagcataagcagtgctttctttccgcggttcaggtatgcccgcattagtatttgcgtattttcttgaaggaccttaaaccatgctagaaaaattcttcacggaaaatctctaattattttcaacagcaaggatggaaaacttctggtgtttctatctgcaaatcgtgctgtagacagtggagcgcacaatgcaacagattcactgcataagatcaactggccttctgactggaaaatggatcaatacctcgaaatcactgatgtggtatgtcctcagatttgtcttgaccggtacttatctgctgtctgcagtcaatttatttaacttctgaactgtgccagattccaattgtaatgtgtcctcaagatggttgttttcctggtttgtattgttcttccatgctatcgaatccttggctttctgatcgatgtacaatgattctgacatctgcttggagaagcactgaagtgatattatcaatcgatgtgttgaggtaaacaaggttgctcacatatgcctttctactgcttcaaaaatcattgcaatatcccatgctatttccttaattcctcctgcagtggaaaagcaacaagaataagcccagaaaattcagagtactcatggagtgctcttgcagtagatggccacaatgttcttgctggtaattctaggtgcacataatcagttaacttatgcatcaaattttattattttgggtgtaataattttattttatttttgtttgttttctagtgtcaagcagtcccatcgacccacctcaaattaagtatggccatcaagtgtcattgaaggatcagacatgtacatgggtctgggacgaagttaataataatccattgatggcagctaacaataaggttagatggtgtacaatttgaagtatacttaggtgttctttgatgctttgaacaatgtaatttactaaatcaggcttttttttttcattctcacattaccatctgctgcaggtaaaggctttgttgtcacatcaccaattcagcatactaaaaattccagtcactaacccctctgatgacctctctgatggtatagtcatggacacaaatattttagactatcatatgtggcttatcatcattcaccaagcaaatgttttttatatcctgcaggcagtaagcttccatttgaagctatctttgtgtcctgcaaggacagttcgcacaaaccaactattctagtccttcatggtggcccacactcagtatctgtatcaagctattcgaaaacatcggcgttcctcgcatcacttggatttaacctacttattgtaaattatcggtaagtttgctgaaacatttctacagttctgatcaattaagcttatggcatcatctcactatcatctgaaaaaaaaagagggacaccgggttttggagaggaggctttgcagtcacttcctggaaaggttggatctcaggtatgtaatccagctaaactctgagtctttgtttctcatgaaccaacctaatttctgatgtgtgtcaaactgtcaagcaggatgtccaagactgccttacagctctagactatgtcattgagggaggacttatagacgcatctaaagtagctgtcatcggaatttcgcacggtggattcttgactacacatctgattggtcaggttagcatcctaacagattttagcctctcaaaggaaaagaagaagaagaacaaaatcctaatagaagttagtatatgtttcttgttcagcttgtaatttgttgttattttgtttcaggctccagatagatttatggtggcagctgctcgtaatccagtctgcaacctatcactgatgattggcaccactgacattccagattggtgttatgcagtggcctgtgggagtgaagggaggcaacatgcctctgaatctccttcacctgatcatcttcgcctcttctatcagaaatcaccaattgcccatatttcgaaggtgcatttctgttctcgccttcattcaaagagcaaaaaagaaatgttcttactgatcaagtcattgttcttaaaaacaaatgaaccagagaaatcaagtgattagctactcaaaaaggctcactgaactttgctgattttttttttctaaaaaaaaaaactttgctgatttcaacaggtgaaagcgcccctgcttatgcttcttggaggagcagatcttcgagtccccatttctaatggcctacaggtacatcaatagccgtttaaatttgcctcagtagtttccactttcaattcgttgtagaaatagtccataacaaaaaggctagatcctgaaacaacctaacaatcccgtgaaaagaaaatcaatcgacgggctacatcaaacagacattctttaaattcatctacactcgattaataacctaacaatcctgcatttgcttcactcatttgtcggatttggttaaactattcctgctcggatgatttcagtacgcaagagctctgagagaaagaggcggcgagatcaggatcatgatgttcccagacgacatacatgaaatcaacatgtaagcaagtaactgaaccgaatttcagctcatctgctttatataaaatgtcggcaacagccgttcggaaaaaaaaaagacattcagatgccattgtactattgcttttgtgcctaattttctccctcatactggaatccatgcttttgttcagaccacaatcggattttgagagcttcctcaacattggtgtctggttcaagaagcatcttagcatatcagcatcagatgcatctgcatgaagtcaacttgaagaaggggaggaagaaattacgtggtttaatctagtccaacaggtagatgccattgtaagccttgttcatggagctcgtccgtagacgagtgctccaaaatattagagacttccctattgaaaaaagtaaatggagactttaattggtttgagttctttccttttcccttcaattcacatgcttgatgattggatgcaaattcagtcggatttactaattactactagctactgctctgaccgtgattgatgatcagtccaacaacaatacttgcaaaatagtgcaatccaggagggtgttgttctttatgcacgttggcccatgatttttttttttcaaacaaagtcaacagccgcgcgagcaagtacaaacctgattcattaagtaaagtgtggttttgtgaattttactcttgcccggcgaaaaatttactgccccctgtgaattttcctcttcattctgaaatactttgcacaagccaactcacccatcaacatgccaacttaatgtaagcaattaaattggtgaaaaattaaacacgccatcagattgctacgttaaaactacaaagctggaaagcacaacaaggggggcgagagctataacaattttacaacaacaattgactatatcagatgtaccaaagaccatgtcagttcttcgttgaggcttgggcaagctgagatgctactttgtttgagaagaagctctcgagcctgcacaaaaagaaggaataaaaccaaatcaattagacaaccaggtgactgagatgctactttctttgaactctcgagtatgcaaaaaaggaacaaaaccaatcacttagttagacaaccaagtgactatggccttgtttagtacgcgaaaaaaaaatttttgggtgtcacatcggacgtttgaccggatgtcggaaggggtttccggacacgaatgaaaaaagctaatttcataactcgataggaaacagcgagacgaatttattaagcctaattaatccatcattagcacatgtgggttactgtagcacttatggctaatcatggactaattaggctcaaaagattcgtctcgcaatttccatgcaaactgtgcaattagtttttttgtttatctatatttaatgctccatgcatgtatccaaagatttgatgtgatgtttttgggaaaaaaaattgggaactaaataaggcctacgtttcaaacacggacgataaataattaatgccagatttcccccaaggtgaatcttctactggttatgatagaaagacattattgagtgcacataaatccaacatgagatgtaaccacccacgtttctattaatggttaggctaaatattttcaaagaaacattgacagatgcctgacttacaggtagatgaatatgcaaacacaagattgaagttcattgctcaccgtgaggcacacttgtaatagattgtatcgggagagttataagtttttgcattgctgaacattctcttcatgtcagctacaaacatctctagcgtcacataatactgctcagactcaactctttttgacattgtcttcaaatctgcagacaagcttagtgttcagaaactgaatagcttagatggcacaaaacatagcttcgccaagctgggaaaagaagggaaaataatcccctaaatcattccagcataccaataggatctttgataatgtcataatagtcaggaacatcacgtgaatccactggctctttgaatggccaagcatcaggatgctcattcatattctacaagacaaagctcttatatcagaattgataaaagtatgaagtatctttcgtaagacaacagtagatccaacacatcaggtcattgcagatctacaacatctttggaacataatcctttgaaaaaattgtctatagagcactgtacttggttgtcatgttaactcccaatcacaaaacaaaattagctatatctgctggcagatactcttttgttgccgatacacactaaaagatcaggtctgtttgcccatagttttgtttgctggtggccattgcaatccattagcatagtagcatatgcacatgactttaaggtgtgttttgagtaatgacatggatccttagtgttacattggtgtagccagttttgcctaatttctaaaccacactggactgatggttgagaatcactagtggctcacctgacaatcagcttaacgtttcaaaggataaatatgactaatgtctgaccatatgaagtagagttcacagtgaagtataccagaaatatttgaatattaaacttataaaatgtggccatttcaatcattgaaccattgaacagaccatccagctggtctggctttagaaaatatgcttgaaacagaaagggtgcaaaaaattcaaaagggagcaagcaaagtacaggtttatccagtgaggtcaaaccaaatggttgcatgtcatataaaaagatttgcgaagataaaagacttgccttcaacaatgaacgcattagattagtaagttgttgcctgtaagtactgtaatcaggagaaaaggctgatcttgatttggaatgcccccactgatctggcgtccacccagcttcccctgcatcacattgattgttctgatcaggcttgcatcatagctaaaccagtaaacctaacaaggcggcaaaacaa

SEQ ID NO: 62213 - DNA, 3031 bp, Oryza sativa
gccttggatgtcttctggtttcatcgttcttcttggaataccagcttctttctacaaataaaaaaagagaataacaggaataaacctgttaaatgccatgttttgatcgataaggttaaccaagattgtgtacagcagggtcagaaacaacaatgcaaaatacattatatgtgacttacaccagttatagtccatttgtttctgtcctatctagtacaaacccaaaatgaacaagataaatgtgacgggcactggttgccagtaaaattttttaaaaaaattcctttatttccctagatgatgccattacctaacaagatgcacactggatggattcctcgttaatcataccaaggtgtgcctcaaattttactaacatgattagttattccatttttgagaaataaaatgtgcaagtgacacaccaaaactttttgcaatggattcattggcacaaaattgaattgaagtctaacatataatagagacaaggcatgtttgacaaggatatcaactaaaacaatccttttttacctaagactagcagttttttctccaacagcaggttcatctattgcacatatcaaactgataatatttgacagaaatagattccaaaataagaaggaacaactaaccttttggaagtcaattccagaataaacaatatggcagtttgaaagctctctgattttctcatcaattgcctgttcagtcaaaatacagtcagttgccaaaacaaaaagaaaacttcaattggcttataatgatatgaatatcccagttgactaatgatttgcacataaagttatcaagtgctcaggagtcaggacagctgaaaaggagtaatattgcttccagtttatgtttaagcagcaattagccttttatgtcacctgtctttgacgcctaatcatcgttgccagatcaacatatggcaactttgatcaattctgcactccatcaatattcctccatcatagtctttaatgtacctggaatcagcaactattgagttcaacagataaaaacctgctgtagcctagtacaataatactctcagacaacaagtagtgttatcattgttacacttttattaggagttactgactcactttatacttcaaggaaatgataaaacaatataattgacaataaattgcttacccttgccatctttctttgtccaatgtgatctcctttgtgaaaccctacaaattgccagcagcaaaggacaataaaataaaccaaattattgtttgcaagacatatgctaattgatctcttttgtttaaatcgtcaagaattcttatgatcaagaaactactaagtacagaaactgttgctgaacatatgcctaagggaactaatttatagctgaaacaaaactgtaggacttaggagataagttgaactattaaagattcaaagttagtcacctgatacaatcttacaaagactgctagacaatgttggacacaacatgtttagaaataactttataaaccatgcattgaaacattctttttgtcgctaattctatgaagtcactatttcgttaggttcaagtgtatttcgtagctgccacttgagaacaatcacaaaacaatgaaattttaagaaagaaagcatataaaagagttcagtcaaatagtcaaacctgctttacaaaatagccaacggcattgttatctgcataagttaagaaatgagtgagcccatcagcatctcgggcatgttgcttcaggtgattcattaaccgtgtcccatagcctttaacttgctcatcagctgtaattgcacaaaatgctatttctccaaacttctggctacaatttcaaaacctatattaggacagaaacttatgctgcagcagaaaaggaacatctctggcatggtgcatggcatgacgcaacagaaataatcaattgccagacaaacagaagtgtgcatgctgtcctacaacataacctttactgctttgagatcactgaacaataaatagtagaatcctataacacaatctcattatcaaaaatcaacgttagctacaaaaacttaaaagaacagctcatagcttccattagatttcattatcaataactatcagatatctaaacaaaaaagtaccacaacttgatcattcatgcaagtgcaaatacatataacagatgtcaatacatcatacaagttctagcaccaaggtggaaatattaccttgtataaggccggtaagtaatgcctcctacaacaatattattcctgataaccatcattgatttgtgagttctgcaagacacatcacaataatttcttttataagcactaacgaagagagatattcttgtcctctgcttccaaaatacgtagtaggcacattacactgagaattacctatccataacaagacggacaatgtactctttgggcatgttaggaagctgccgagcaaagatattcttcaagcctaccaacctggggaaaaacatcagtcactaacaaatctgaggttgtttggaacaataattttagcatacaaaccaaatcatatgttcatcaactccatcattagaatagcatagaaatttcagcctccctgcttcttcctgcagaacaatccaccaattttagcagaagtcacattctaaaattcaagaaacagtacgaaatgctactccaatttgactgctccgatgtctaaaccctacaaacggcctatcaaatcgaaacagtgcaaaccaaatacttcacctcacgcttgaggccctcctctcgagcgctatacgcgccactggtctgaatgttgtcagtgaacaaccccttcgggtcctccttgccgtcgccggcggcagcggaagcggaatcgggcttgggagcggccgctgcagccgcggccgcggcggcggcagacacggtcgaggactcgggcttcggcgggcggccggatgaggacgggggcgcgccgtcgaggcgggcggcggtgaaggtgtggagggagtcgtcgtcgtcatcgtctgtagtgggaggagga

SEQ ID NO: 62214 - DNA, 15393 bp, Oryza sativa
cccgtccatggggaggggaggggggaggggggagggggcgtgattctagaagcttcgagagggttagggtttttggccgagatctgggatccagaagcttccgacgcggcacggggttcgaaccgggagcgaggaagatgggagagggcgagtaggattttctttacgggccgatttttttccgtggatgaattcagcccataatcaaattcggcccacttattttctatggatgaattcagcccatacatagataaattaagcccacttcttttcggcctaaatcgttttgtgaacatgtggatcgtgtgagtgaatgaaattggtcaggaactcaggatgtgaaataatttaaggagtgtcaaattatcaaatctctcgaacgaattcagcctgttaatcaaattggcccacctcattacgtggatgaattcagcccgtaaataaaattggcccagcttaatccgtgaaagaattcagcccataaaataaagcagcccaacaattttccatcagtgaattcagaccataaatcaatttggcccagatttttccatgaacgaattcggcctataatagaagctggcccatgaatgagctctgttcataaattaaatttggcccacctcttttcctggattgaattcggcctataaattaaaattggcccatctttatccgtggaataattcagcccataaatgaacttcacgttgggcttttgcagagattcagcgggctgcaattttcgtcttcgtggagcaaccttagtgggccagttcttctgtgggccaccttatgggcctttagtaggccgctttagttagtgggccataacattggtggcccgttgggccgtttgccggtgtctcgctcgctgttggaccatatcactggctggcgatagcttcgggttatgtgggcccttttgtcagtgggtgttctcgtcgagccaaagacatcctcttttacgccaacggagaaagaaagcgggaagcagaatgctaattgcggttgaagcctccgcttgcggcggcggcaggacaaggaggaggaggaggaggaggaggaggaatttggtaacgatttcttctctctaatccattctgctcaaattataccccgggaatgcatctgttcttgtccagatgtgcaaagattgggaggaaagatccgtcttcccttcgaatttgatcaccgcggcatgatttcaaagatgtgagaagtttttttgggggaaagtatggggggggggagttgattcagtctttctgggggatctttgagttcactcgaaaattagtgcgttccattccttcgttcatgtttaatttcagtactcggatactcagtttatcacgaaatttagtactatttgttgccagaaaattgcaatattgggactgaaagtcagactgtcatctgttccatagatgatatctttaggaattttcatgggctgcaactgcagaaatgctgaaggcacacagcaacttggaagagcagtctctgtgtgtttttctttttatctcttagattgattattgagcagttccactccgcatgcttgctgacccgacgcataaaaaaaaatcaaaacttttgtgcttgctgttgttgtccattgtctccatgtgtattatgtgttgttttctggtatatatggacaaggagctgaattgttaggcaatgtccaactacatgaataaatccacaagtaaagacaagaacgaattcacaaatgaagacacgtgttcagttgaaagattgcaccgtgtgaactgttaacagttgaatgttctccaaactcaagagatgcctgatcaaataatccaccgggttgttattttctgttatagttgaggttccaatgctgtgagatatctggctttctagtttgggaactttgcagataagtttctcatttggtgtatgggagcttatttctcatctttattgtataaacgaatttaaaaagactaattaaccagtatgaatatgctgcatgatggctgattggtttcctttaaaagaccatttatgtagaaaatactagtatcaaatttaagtgatatcaaagttgacaaaatgaccacttcatatatgaatatcagacagaaccccatgcctactgcaacatatttagcattttgaactaattgttacaggatgctaatgcaaacactactggtgataagtaaaacgatatcactggttacaaccaaaggagttgttaagttctgatatcgcactctctagtgtcgctcgtgtcttatctttgcatgtaataggtcaatgcaaacgtaatatctgccttgtagaggcattaccttgatgccggtagatgttatgttcattcttcattgcttattgaaatgctattttctaaaaacagcacaatgatctgtcactgacttgttcttccatcatgtgcagatgtagtgaagaagatctgctactttgttattcaatctcactgacttgccacatgcaacgatcatgggccttaatccccgccaaaaaatgtggtgctagtgggagggttggtggaagtatcattggcttatgatgacaactacgacactacaaatcaattttcacaatgaatctgctcttaatttagtgagagcaaccatgaggacgatgcttcacaggcaagtgctattgctctgctagcctgctacatgcagttccaattaatgtgtatctcaaacctttacagaacatgtattatttatgagaaaaagatgtccgcatatcctttccaacatatcggtatctcatctttttaagtcaaaattgttagtatcagaacagaatatctatcagatagcaggcctaactttctgacctactccttatatcttagttcagggttgttcacagaagaaacagcccaatttagcagctgttctttccttttctcctgtcactgtagcaagagagaaagaaagtgaaagattagccccactattcacaaactactgaaatagatccaagaagaaaagtatttcaaaaagaaaatttgaaaaagaataatgttttttttctcctgtcagtcatgccaaaatccaaatgagacagtgtagttgacctttgcagtcaaccagtttggcctctgtactagccctgctttggatcttctggaagctgtccctgtaaggtttacttcagtttgtggatttcaaaagttgggacttttctttgatatagttagttggaagagtaagacagaagtgtacctaataatcagaatattgtgaatttttttagtcacatattctctcttcacatcttaaagattatcctgcatggcaaatcaaataagagtcagccattgaggaacccttccaacctcatccaatcgaatcagttgaaaattttgaccttatctcctacattcaaaccttggttgagcagtccattcagaaggctctgtttcttcagcaccatttaatttttcatttgacaaaatcttggtggttgatttgtgagccacaaaacaagttataaattcagcgttcttctgaagattgcagcagcgtcctcaaccaatcaattgcaagcaatttctccatcacagaagtcaccaatgggctccgccaagctcattgctgtagtcctcctcccggcccttctggccttccaagctccaatggccacggcagtaaactccaacctcttccgggactacatcggcgccatcttcaacggcgtgaagttcaccgacgtgccaatcaatccgaaagtccggttcgacttcatcctcgccttcatcatcgactacaccaccgagacgaacccgccgaccccgaccaacggcaagttcaacatcttctggcagaacacggtgctcaccccgtcggccgtcgcgtcgatcaagcagagcaaccccaacgtgagggtggccgtcagcatgggcggcgccaccgtgaacgaccgcccggtcttcttcaacatcacctccgtcgactcgtgggtaaacaacgctgtcgagtccctcaccggcatcatccaggacaacaacctggacggcatcgacatcgactacgagcagttccaggtcgacccggacaccttcaccgagtgcgtcggccgcctcatcacggtgctcaaggccaagggggtgatcaagttcgcctccatcgcgcccttcggcaacgccgaggtccagcgccattacatggcgctgtgggccaagtacggcgccgtgatcgactacatcaacttccagttctacgcctacggcgccagcacgacggaggcgcagtacgtcgacttcttcaaccagcagatcgtcaactaccccggagggaacatccttgcgagcttcacgacggcggcgacgacgacctcggtgcccgtcgagacggcgctgagcgcttgccggactctgcagaaggaggggaagctgtacggcatcttcatctgggctgctgatcattccaggagccaagggttcaagtatgagacagaatcgcaagcacttctggctaatgccaccatcagttactagctagtagctagttttgtttgctgcattattgtttcacatttttaaacaaagatcacaagagctgtactatgaaaataagcaactcaaatttgaaatacgaatttgaattagcatctagtatatatctagccgtgcatcattccagctggaatttaagataaaaccccaaccgtgttatacgtacagacatgcttatgttgtgtatgtcattattggattgttcctgttttgttgaatttgtgtctggtgatgatctgtgtgttaattttaattgcttgctggtggagcatgcggaccttgattagtttgtctagataacctaccctagtaacatgtcttctgtcagttctgtggatgtggtgatatatatgtactatgagtatgtagcttcttcttcacaccattgttgacagtctgttctgtccttgtaagttcgttagtttgtccatttcctatggtcaatgcacattaagctaatgatccaacacctcttctaataaaagtctaagccaaacccaagttgtattaccttttttccatggcctcatcacagtacaatgtggaggatcagattgatgcatgttctcccactgatctagggtgatcaacctccatatccagggcatccaacaacaccatggagatcaagatcccaccaggatttcttgcaagtccatagaattaatcaggacacacacaaacacaatgattgattaatagccaaattaagccctaataataaaggcctatcatcatcatcatcatacataagcagcctagcaatggctccatattcttgagatcatcatatcgatcgacagaacaagaagtctactacttataaattataatagctatatagcctcatatatccccttattagtttgggatctggtaggaggtctcatcgatgggcgccaccttgggcacgtcgacggggagcatgtccacctccttcatccacgggttgtcgccggcgtcgaggcccgcggcgtcgacggtgcgcagcgccctccacacggcgctgttgcacttgaacccggagccgaaggcgatctgccacacccggtcgccgcgcttgatcctccccttggcctcgcagtaggcgagctcgtaccacagcgagctgctggacgtgttgccgaagcggtagagcgtcatccgcgacggctccatgtcccacggcgagagcttgaggctcttctcgagctcgtcgaggacgccgcggccccccgcgtggatgcagaagtggtcgagggcgagcttgaagtccgggaggtaggccttgacgtcggcgcggaagacgcgcttgaggacgacggtggcgaggaagcggagctgctcggagatggggaggacgagggggccgagggttgtgatgttggtcttgagggcctcgccggcgaccaccatgagctccttggagagggagacgccgacctcgccggcgtcgtcctcctcctgggtcacgcacccgaagctctggtcgtgggcgccgcggtgggtgcgcaccgtgtggatcagctggtacttggcgcggccgcggcggtcggcggcgcggttggagaggaggatcgccgcgccgccgacgcggaacagggtgttggtcaccagcatcggccggttgttgcccatgtacgcgttcagggtgatgttctccgtgctcaccaccagcgcgtacgtgttctcgtgcacctgcatgcgatgcgatgcagttatataattctgtgtaattaagagaacgtactacatacatttccactgataggtactacctccatcccatattaattgtcattctagattgtttaacatggattaaggtttgatgaaaaagaatgatggttggatgtgggaggatagttgagggtagaaaaaagaaaattttgaattagaagtgattgatgtgacaaatagtaccctatagtgacaactattttaggataatatttgaatcctaaagagacaactaatttggggcggagggagtagaagatgattagcagaagttatatgtctctctatctaattctgtctaattaagctcatttgctcagcaactccatgaaatatttgtgagaatattttgtctaattaaaccacgcacactccgatgcatcaacaaactgactaaacaagtaatggtatttcacaaattagttaaaacttagcagaattgatactaatatttcagaaaataatttacgattagcaggggctagctatatctctgtataaattcagcgaatattagcaactcaatgaattgtgaattaatattttttcccttggtcatctctaggaccacacatggagaatgagctggacctccatgaatatgcttactcatgcgcatatggcgatcgacagatcgattaagggcctgtttggtacagctccaactcctaaatataactccaggagttgagtctggagtggagttgtggagctgcctaaacccagctccacaactctagtacattttgtgagagagctccacccaactccactctcagttttggtggagctgaaactgtttggctgagctccagctccaggaggggtggagctggagctggagctgtgccaaacaggccctaaggtacaggtacccatcatttctctctcaaatgtattttttttgacttagcaatttagcatagacatactggcacgcacagttggacatgaacagtatagtggtactgtacagagcagaacaaatgctgaaatttattgcgttttgttgtgcactccatgtgcccattcacggcgctccataaccatatattaagtgcgtgtgtgttcttgcacattggttaaatgcatattgggacattgaaactttcctagttagcctagctgcctgcataaatgtagctctgtactaatcacaaaaagaaaaaagaactttttggtgttttgacagtcagcaagaatatggtatttggtcactaaatagattttattgtcaaatacataaaaagaactatgtatgttccatttttgactgtgcatgtagtgagacgaattacacaattcgacacattctatgctgatttttttttgtcctttttaccttgcagatgctatttccaaaaaagtaagcactgccaagtcttgtatacagtacatgttgcatttgtggagtagttactgctgccaaaaatacagcttggaatatgggaggtaaaataactactctactactggtatatctgaacctccaccaaaccacatttacatctctgctgggtcagagacggagtagttcttcaccggtcagatagtgtgtagtatgtatatatcatggggcactcatgtctagtacttgtcatgataaatcgatgagtccatgataagacactactcctacatgcgatgctttgtcagtgtcaaggagagctttatccttttttgatctgcatttggtatatactagctagtatctttcaaagaaatggtatgcagaactaattaattgagtgacattttcatgatatttttgatggtatatgcaatagatgagtgcatgtgcacttaagttgcaaattgactttcacaaaaggttttacaattaatgcctggtagtctgatggggaggcctttaattagtttgagaaaagtaagatttgaatctatcattgttgtttagtataggtagttcttggagaaggctcagttatgttggcaagtttcaactagtcctcagcattttgaagagctttaacttagtaaattcctacaatctagcctgcacaaaatgttgtagtaaatattattaattacatttcattttcctcttgcttctaaaaacagaggcattcaattatttcacatatggccaaataatatattgttccagtttccaaagataaagatattactactctcaatttgtgaaagtatatccagattcgcaaacaagtaaattcaatatgacttcaagaggtaaaagcattaagagaacatcatgctactgcatatctgcatcacaagggggaaaaaaaggagatcactaagctgtgccagtaagcagtctgctctaggagtaaattttgcaacatgcatgactgagcatgttatttaagacattaagatagtctgctccctgcaggctgaaacactgaggtcctactcaatgcagttcttgtctggcatctcatggtcagatggtcttggcatatagcattcacttgtcagctactactacaacactattacgtactaaacatgtagtctacacaagcatttagatgttaaatacctgaataatgatcgctcacaacgtcgcatgcatattttattctcaggaataaatcaaactagctactctggccataagctcatacagtttatctttgataattttaccattaacacaaacctgtgtatgtatctatcttgcatatatcataatattaccatcggatttttgttgcaatttattcgttgtgaaagtactttggttctttctatggtactgaaatggctacatatatagatctagtctcttgtttccaaaagatcaattgccgagatttatagtcacaaatgcttttacttaggagtagagagacgtatattaggggaggagaaactgatatgcaaataagcatgttactcctacttatgagtgagttatgactattgtcatttcaattgatcactattgtgaagtgtttgtggtggggtcagtctctcgcatgcatgccaagattctcctctcccatcatttaatattccatccatccgtatctcaacgcattaactgcctcggtattcgtgcatatgcaattgcattgcattgcatgagccatgcattaatagatattgagaacctacttgtatgcacggtgcttctgtcactaacatgtgggcccgatgatctttggaccatgtgtcagtgacaggcgcggtgcagaccgactccagaggatgcagtacagtacagtagtatcatcgatggtgtgtacctggaggaggcgcttggcgagatcaatggcgatgatgccggcgctgcatcccatgccgctgaggttgtgggagacgacgccggggcgcatcccgtagcggttgacgatgagcgaggtgaaggagggcgtcggggagaggaggctggagttgaagatgagcacgccgacgtcggccgccgcgacgccggacttgcggagcacctcgtcgacgacgccgaagatgacggcgtgcgactcctccctcgccgtgcggaggcacatgtccacggggaggctgatcagcgacgtcgggaagtgggtcgcctccccgagccccgaccgctccagcatccgcttctggaacgccatgctctcgccgctgaaccgcccgcaccgcccgaagtgggcgatcgtcttggcgcgcgacgcctcgtgctcccgcggcgccttgtagccggcgaggtcgatgaggtagacggggcgcgggcgggacgcggcgtaggtgtacgccgccagcgccgccgcccagcacgccaccgccagcgccggcgcgctcgggcccagctcgccggcgaggtcggaccacagcgcgcgcgcccagcgcatggtgcttccgccggccgccgccgccgccagcagcgtcgacagccgcggcgccgccgccaccagcgccgtcaccgccacgatgtgggggaggtggcgcacggcgcggcggaacagcacgccggcgtggttcttggtcgccagcttcaccgtcctcaccagctccctgtccattgttatcaccagttcacctctcacctcctctctcttctctagtcttcaatggaagcaaaggaagaagaagaggaggaggaggaggaggaaggtatgggagcaatggcgagagggtggattttatagggtttagaggggagagggggagcttagtgagaagcagctatcaaccagcgaatgcattaactgaatgcacgcatgtacatccaacgtggcagtatacggtactctcttcgtttcatattacaagtcgtttgactcatttctttgccaaagtatttttagtttgatcaagtttataaaaaaatagcaacatctataacacggaattagtttcattaaatttaacatcgaatatattttgatacaatgtttgttttgtattgacaatttgactatattttcctataaacttgatcaatttttttaaaaaaaataactaagaaaatagtcaaaagacttgtaaatcaaaatggagatactatgtaaatgggcagttctagaaaaatgatggatggctcttatcttatctctccttcttcccttcctcttctttgattctttcccgtcccctcttccttctctcaatggtgatccagcggggtaggggacttgaatcccctagcacccacgctggattcaccctgtactgatatgtatagtctatactacacaagtacacatgagcgtacgtggtttttttgggacatgtgcacacgtgttacaagttgatcaaaatggacttgttcactttgttgtcaattttgatcttatcaaaatttagcaatagatcaaaatttagcaatatatgctaaattttggtgttgctaaattttaatagcattgcattggatatgatgtatttagtttgatgcttttccaaaatttggtagtgtttttatgagaggaaagttccgaaactatcaaattttgataggacacacattgataatatcatatttagtttgttaacctaccaaaatttggtagggttgaaagtggcaataaagtgaatatggctgatgttccaatcctactgaaccaaaacgatattgatccgtcatatagtataaaaccttatagcactatgatactaagtaatagtttcatattggatcccgtaaatcaaatcgtatcattctgatcctatagtcgtacataagtattattcaaatataagtaaagtacacagatgatttttaatcttataggggtgtgccatctaggttcccgcaaactcttacaatgcaaatccaagtcccatgacttgtcaaagtacttatatttctggtcctaaattgtcacagctccgttgaagtggcatattcaccaatcctttattttcttttcttttcttcttccttcgaatacagagaggctggggagagagctcgagggtggttgctgaggatgagcttgattgacaacaactaggggcaacgtcgacggtgtagagagaccacaaaacagaactcaagcttgctcacttgcacgaagagactgaagggagctcgtcattgcgcgctattggatccgggtggaaggtctcgagctcggaatgactgtgttaaggcaagtggtggaagttgaagaccgaatccaggggctcatcctagctaggtccatccccaccatgtgctcgtccccggtccttccccattgagctcgagctcgatgagtctagcatcaaacgagccttggcctagagaaggcgatgatagtgatggaggaggggacagtcatttgggagcttgagctcgatgagttcaatgagggaggtagcggcacccaacctcttggaagatagcagcatcaaggaagaggtcaggcaaaggagaggggtgaggaccaggccatcattgtcgaggccctccccatcctccctcatctcctttgtcacatcggctagctacacctaggccgccgccgtcgaggccctaaaccttcccctaatctcctccactgtgctagctagctccactcgggccaccatcatcaaggccctctccctttccccatctctatcacgtcagctagctccgcctgggccactgttgtcgatgccctcccttttctcccatctcccccgccatgtcggctaactacactcaggctgccgtcatcgaggcccttctccttccccgtgtcctccaccgctttggctagctacaccgggttgtcatcaacgtcccccttccccttctcctactggtaaggcactatagtaagaaggagaagaaaggggaaaataaagaagtaggagaagaaaaaaaagaaaagaaaaagaaaatttttaagtgggtcctgtagtgggaaggagaagaaagggaaaaatagagaagtaggagaagaaaaaagaaaaaaaagtaaaaaggaaaatttttaagtggggttccatttattagtcaacgatgatgccatgtcaatatccatgtggtgtaccacgtcagtgcgacgtaggatcccggagaggacgtgataatttggaaccggaataacacacattgacaagttctagaacttggatatatattttcaaaatttggagatgtagataacacaaccctacaagtaaggaccacctgtatactttactcttaaaaataatataaacaaatatacttaagtttttgaaagctcatgcattaagtttatcataatattgtgaaccctctttttacaaacatacttactacaatactttggttcttctaagaaatacttatttgaaaatgatctaacctaataagtaataacgcaactaccaataaaacaataaataaaaaaaaatcataataacaatacaagtatatacacatgtaatagtactctaaaatcatttctatgggcaaattaaaatggtcaaactcccttatatttgcggatagaggaaacacgttttatagtaattaatacattacaaatttcatataagaatatgttttttttataaaattcaatactgttagaagagaaatttactactccctccgtcccaaaatacaacaatttttagccctcaggatttgtcctaaaatataacttctccaccaatattctctttccaaccaatcacaaccctctaccattcactttttcacctacctccactacttatccaaccacaaccctctaccattcactcctacatactttcttaataaccgtgttcaactctaaaacttcttatattctggaacggagggagtagctaagtaacctttatgttctaccatatacagtactttctctgtaaaaacccactcattaaacatacatatgtcgccagaagtgcttttttttttcacacagagggaatagtatatattatgcgagtaaatgtacgtaggacagccaggaaagggcagtaggtggccgtgagttaattcaattccatcgtgcagtgaaaaagtagatattggaatttatttttgtcctttctcgtggattcaacgcaattacacacactcactactagtcacttccctttacaggctttgggaaggtggtctggtgcattctggaaccccgaaaaaaaactagaatgttgcgttaatttgacagtgcgatcaatcaggaattaatgcaagaaatatcatatgaattttatgctagtattttcacacgaactgatgaaacaatttttcttttcattacacgaagatggaataaatttttcattatgttcagcgtgcagtatattattatgttttcagcttgagcgatttagtcaaatatatatagcagcatggaccaggcatgtgttcgagcagacacaacgtacggcatctccaacgatttgaagaaagaagaaattcaacaaagacattatatctagacgtgcgtgacaacgattgcagcatgcaaaaactgtagcatgaacgggccggatgtttgtgcgggccgggcaattaattaattactcgttcatatgatttcacaggaaacataacgtttaaaattatgataacttttagtactttttagaggaccgtcaattcgttttagctgagatattagtattaggccaatttttaggaataaacatagaacctctacaaatcgaacgttcgattttaaaataaaattcagatcgtcaaatatgttttaagttgaccaccaagtaaaacatgttaaattttaaaacaaattatgaaacatggtgaaaatgcacgttgaaacatgtcggtatcatccatgaaacaatgtattttaatggttatatgggtttaattacaatgaatataacattatgatcgaatcatatattggataagtagtttacgagaaacaaatattttgaagatcattacatgcacatgggtagagtggagagagaacaagtatatggtatagtagagagagtaagggcaggtatgtcccatactttcctagtcattggtgaaacattacattatacatggagaaataaatgaaataagcattgaagcatttcatttttttaaacacagtgaaaacacaagttgaaatatgttactatcacatatgaaacattaagttttaattgaaatgtatgtttttctttcatcagaatataatcatgcgatctcttgttgtaaatttaattataatgaatacaacgatgtggtcagataaaaaaaacagataagtagcttagtagaaaaaaaatatttggaagacagtcatatgaaagtattttctcaacctatatgacatagcacttagatgtatgtattaaatagttttataaaaatatataaaatttgacaagatagattatgataatataagatattaaacaaacatggaagtctaaattcgatctacacataaagaaacaaaaataacaaatgttatttgatctgtatgtataggtatgtgctatatattcattgcctgattttattatttttatttctctaattgtaaatcaaatttagtcttgcatgcttttcataaacttatatcatcctaattggtgtttcaacttttttcaattttttaataactattaggtcacatgcaaataactggtgccatggtctttagatgtagaaaatccttattcgacaattatacgtaagtatatatggaaacaatggtgagagagcatagtatactagtatggtactaggtagtagctgagctgcaactgagtttttt

SEQ ID NO: 62215 - DNA, 22524 bp, Oryza sativa
cacatctagagatccatttaattgtacacagggatagcacaatgccttcacatggagtagtacactcttacggactaacacatcgaaagccattattcagagggaagagatcgagaggtagctagctatgctgctatgctgcattctcaggctggtgtgttccgctgtttatggagtagtacagtggcacatgcattgcttgccaggccttcaatgtgctttcagaattcagactttgtaactgactgacctagctcttctcctttctctctctttctctatctctatctgcacttctgttattagctcatcactgccaccgagttaattgaatgatctaatttatagttagggagtagtatttactacggcctttcacattgagggcctcttcggttcatgggaatttccaaatcgccgtaatacgaaatgcagaaataataaaggaatctatatatgtacaaaacaaagtgttggagtacaactattttttccttcaatgagctgagcaaaagatgatgagcggatgttttcatttctatggaatcagtacattttggaggattggcataagattttctatggaattttttcatttgaatccgatgaaccgaatgtatgaatagtttttatttcataggaatcaagatttcctatggaatcaagtaacctccaaaccgaataaggccagttttgttggttatattaactggcggaagacttaagactgaatactgtacactggacactggccgccgctctgattgggagatcgatcgatcgatcaatcagtttgctgatgagttaaatgaccgagctggctaggtacttcagtacgtactttcaaataaggaaagtgacgaacttattaccaaccaaccaactaaaagagtgagcacaagcattaggatgtgtttagttcacgttaaaattgaaagtttggttgaaattggaatgatgtaacggaaaagttgaaagtttgtgtgtaggaaaattttgatgtgatagaaaagttgaaagttcgaagaaaaaatttggaactaaactcggccatagtgtaccaagtgcttgtcacaaagaaaacacactaggacaaatctggatagcaaaaagcatgacaaacaaattgtcaaagctgattaatctatgagaaaacatccagcctagctcactaccaaaacaactgggagaacatttttacaaactcagacagcaatgcaacaaaaacgtgttgagcatttagcctcatggccggcaaacgcattcaagagatacagttcatcatgctcagcgcggatgcccggatccaataaagctttgttcttttaatcctccatccaatccatattcggttagttcacaggatgaaagaattcgagcagatttatttcatatctattgtggtgtagaattgttccctgcgatttctccaatgaccttcaatcctctttaaatcgaataaagctagaggatctagatcgggatttggatgagttattcccttttgattcccttcagttcctttttcatggggactaaccgaataagaactaagggcctgtttagagccctgccaaaaattttacattatgtcacatcgaacattttaacaccttcatgaagcattaaatataggctaaaaaaataactaattgcatagattgcgactaatttacgaggcgaatcttttaagcctaattgctccatgatttaataatatggtgctacagtaaacatttgctaatgacggattaattatgcttaataaatttgtctcgcagtttactgatggattctgtaattagttttttttattaagtactcgatcaccccatgcgacaccctatataatatccgatgtgacacgccaaaactttacacccctacatctaaacaccactaaggcactaaggatagattagatcactgggattctccctatatctcaatatatagtactctctttgctcataaatattgtaaattttttggtaatttttttgaaattttgtctatcaaatcgaatactgcactttaaaattggcatgagcatatatttgacttgaaaagtattattactaagatttcacaaaattattttaattcaaagttaaaagtgtgaccgaatgttatcctaaatattaaatatttatgactgaacggagttacctcttaatctttcgtaggatgcacatgtaaactcttctttatacataatatttttttaaggtagtgagagacaattattatcaataagatgatacaactaatacacttccggcttttatatagttttttttttggaagaaagaaatcgatcgatcaatcagtttgctgatgagttaaatgacctagcaggctaggtacttcaaccaaagagtcctcacaagctaaccgtgagacaaaattacaacttccttccaaccagaaatctgaaagagattcagatctagcccaattggctcagatgactcacacacggctttggctacggtgaattttcttgatagctggctaggtactttaaccaaagagtcctcacaagctaattctgggacaaaactacatcttccttacaaccagaaatctgaaagagattcagatatagcacaattggctcagatgactcacatcttttggctacggtgagccccatcttttcgcttatgcttatacttatcagccaaaattgagttgattttagggtttttttttcatcaaaatttatttttcagactttgtttttaaatcgctaagaacacgtatataaaagctttatttacaaattatttttcgtttaaccatgggagccgtgaattcctcggcttttgtatagttagaatgcacaatctacaattattgaaataaaaaaaaaagaaaagatggacgacacatgacagacttgtgtatatactacctccataatattttaattttaatgcatgacgccgttgactttttatccaacgtttgaccattcatcttattcaaaaaatttatgtaattatcatttattttattatgacttgtttcgtcatcaaatattctttgagcatgacataaatattttcatatttacacaaaaattttgaatgaaacgaatggtcaaacgttggtcgaaaagtcaacggcgtcgtacatttgaaatatgaagggagtactctataaattgtacgtacgtgtctgtgtctgtaccctatatgtacgtgtacagaaggcgtacgtgttggttgcacacgcaacaatttcttttctcatcacgcaggggtaggcagtaacttgaagtcttcagcaactgattgaaacagtggcgcacagatctgctccgatcgaggcctgaacacacacgcgaacacacatgcagggccaaatcgctgcacgctatctatagcaggtgtgtgtcactgttctgatcgatctggccacaagttgacaaggagaagtaaatggatgccatctccatgcaaataatatggatccatgtagagcgtacctacgaataactgtacatgttttcccggcaaaaaaaaaaaagaataactgtacatgtttgatgtgtgtaccggcttgtattcatctgtcattagctataggttcttcagatgagcccatgcatgcacgcatgatactgtaccacctcttcggtgccagaatataacaactttagcatttaatttatctcaaaacataataatatctcgactaatattcccctctcaaccaatcataactcttcagactctagtcttccaccattcaattttcttacctagctacctccagttctcaacccatcacattttttttaccatataattcgatttattttcttaataatcgtgtttaactatataactttttatattttgggatggagatagtacatgataatatgaatatatgtatggccggtagaaacaaattaattaatactaaacggccacatatactttcctattgtcacaaattattgtaaggtatcatatgtgtatatgttaagaaatattataaattaatatataaaaggaaaaatattatactttctattatctcctaaactaattaggaggactagagggaaaataaatgcccaccgtcagatatatatggagtatatcttgaatgcgcagaaaatgatgtaacgagaacacaaccacttgcggacgcgctggctactagtatttcgttatccttgaaatttcatcatgtacagtagtggccaaccattttggaatgctgaaagaacatgctactacttttcatggatcatgattatctctttctagaatacgtaaaagaatatctcagagagaaatagatcactaaacctactatttcctcgtattgtcttaatgataaattaaaatattttcaaaaataaattgattaaaataagtgctttaagcagtacacactactacaaaaccacaaataagtggcaaacaaaaagagttttcacaaaaagcccaacaccccacctgcgatcaaaggcaagtgaaaatcaacaatcttcataggcgaactttcaccgcttgtgaaaattgatctttgtaagcgactaggttaagctgatcgcctgtgaaaatctaagatattcttttacatattccaactatcaaaaccatcatactcaagctataaataggattcactccctccacttcaacacacactcaagtaagaagctgctcttaatctctcttttaagtttagtttagtactctggtgccagtggagtagaatataatagttttcttagtcctcgagtcttcaggaaatttcgggtatggctctagcagcttttctcccttcttttgtaagactgatcaaattaatataatattcttctttatataccttcggtactttactttatcaaagtaccggctttattttatatttgtcccgatatagttgtgtgactagcttactagagaggtgcaatggtgtgggtttaataatgttcgtgcgaatgattactctatgtcattctacaggatatagagtactccctccgtttcaggttataagacgttttgactttggtcaaatttaaactgctttaagtttgactaagtttgtagaaaaaaagtagcaatattttcaacccaagacaaatttattatgaaaatatattcaattattgatttgatgaaataaatttactattataaatattactatatttgtctataaacttagttaaactttgattttgaccaaagtcaaaatgtcttataaccggaaacggagggaatagtattttaataatgtaagcgtaatgcttagattattaagtatcattatttcggcatatatgctgcgggacagtagaggtgggccgctgatggtgacagttccgtatgagtatttctccacgttagtatatattcctttgacactttcctagggtgggtactcctccgtatttgatctcagttggatggccatgatgggctgtagtaaggaactcgacaatcaggaatggtctctcgaaacatcagaagggcactgttaggggtattggttacatgactgtatactagcaagtgtaaactaaagataagtgtatattagaagtataggaatgatttcttttcttattcttcttccacacagcctagatttatttagtgagataatctgggttcttcttactttgtgtcactctacccagtataaatgaattaaccactgcttagactttgatgtatataagtaatatataaattattagtatagttctctcttataaatattcccttgggattaaataaatacaataccttggaatactttcgggtgaaatgctataatggtacatccatgcgcttgcgaattatttttgtaactataaatataccaggactatttctgcgccattgctgggaatttatatttccagtaatgtcgttaagaaataccaaccgttggaccgacagcttgtagccggtctgaccggtccaacggggggggggggggggggtggaccaaaggcgatcaagaaattcaacggtaccacaagagcttccattttgatcaaatacattaacaagggacattatattgctcctgtaacagagccaaagtaaaggtgaatgcctgcaaacttgaccgctactcgaaagagaaggttgcaatgtctttgtgctcaaaagttgaaagagaagaaagccgaagaattgagagatagaaggttcaacgagttgcggccgccgccaagacaagagtggaggcctaaaccaattgaagttgagaagccggtgattactcaagatgaagatgaggacaacttggatacaagtgattcaccggttattacgacgtcgggttctcctctcgccgcgcttctcctccgccgcagcttgtggaacagccacgagctcggcaatggcatcgtagctgctgctgctgcagtgaggcagtgtggtcgtggactgtgggggtgagctaagctgcagtgcgtgcagcgaggttgcaccccactttttattacggaaaagtttgccgcgagtggcagcaaagagatgttgcggtggaaaagcggcagcggcatcttgcaagaatctgacatactatacaaattctctcttatatttgtgcttctgaatcataatcaatactatgatttgccgccaagggagagcatggatatcaacatagtgtttgcattgcctatagaatttcgtgccatggatgaggtcggaattgcacaactttcaattggtccaaaagatgcttgagaagtgatatggctggtaattagattatcgttctaagaccacgtgttctatgcttttaggttcacaaagtttaccaaaaagacaagggagcatgtgtgtttacacttaaatttggcacgtatggatgaaatagaggaaaattgcaaaagtttgtaaagtgtcgggtttccttcacagggccggtcagaccaccggtatgtggccagtctgaccggctagtagggctggtcttatggcaggcatgtggccggtctgaccatcagagtctgagtccgaagcgaatttcgtcgggtcttgggtttctttgcttgggaaggaatgttccaggtttccattggtttatattccgagttggacgtggaggacttgtaggaggcaagaccaacccctatataagggccaaggccggtttgattaatcttcccaattcccaatatctgaatctctgtaggaggcaagaccaacctctatataagggccaaggccggtttgattaatcttcccaattcccaatatctgaatctctgcaatcgaatcgttctttttccctttacttttcagccatgttttctgtcgtaccctattttagtccatctttgtcgatttgtgccgtaagtcatccaccatcgctgtgagagtgcgattatctttttgtaggtttgtctcgtaaatcttccgtttacccacgagatgggtagttatcctcacatcgatctaaatcggcttagaggctgattttgatatctaaatcagcttcgctagccggtttagcctttttttctacaaaacacatcttgatttggcctttggctagatcggggtggttggtgactccatatcaccataaggcattttgctgtcttgaccgtgattgtcttcttgaaaaaaaaaagttgccaatagcacccacctacaaatttgccatcatatcaagccatatgctgtcgtctaactactgccaacgtacattccactccatttgcacactaatcatcgatcgatcgatatcgatcatgatctctcttttgcatgccggccggacctacgaaccggatgcgcgcgctgtcatgatatatctatagcaaacagcagctaacagtacggacgaatgccatctcgatcttgattggaatttctctccatttattattcgttgatctgttacactgttcttcatcagttagggtacatgatctgatcgtcctgatctgtactggacactgttactcgactactcgtacgtagtgtgtggggttcttgctgctaatgagtgcccatttgcttagcttattgcacgtatggtccaggcgcgcggcggcgaagcacattctggagttgtggacgaggagatgttgaaatgcactccctccgttcctaaatatttaacgccgttgaattttttaaacatgtttaactgttcgtcttattcaaacaatttaagtaattattaattcttttcttatcatttgattcattgttaaatatccttttatgtatacatatagttttacatatttcacaaaagtttttaataagacgaacggtcaaacatgttttaaaaagtcatcggtgtcaaatatttagggacagagggagtacgtgtactaacaaaaatagttcatgagttagcaccatttgatatgcttactgtgaaaatgctgtccattaattagctgcctgtgccacttacccagggtggactcaggccctggacgtacccctggtcaaccctaggctagctatggtttggagctgaaagtctataaatttaaaccttgattggcacactttcagatcctagctagatccatgctaaatttgatttttaatataacattatagttatttaaaattatatgttttatctaaaataggaataaaatgtttcacccaaaaatattatcaatctaatcgcatatcgagatatataaatttgtggtgctataaatgtcgagcttcaaagaatcttggatcgtgagagatataaacatggccttagattacaattctatgtaaggagcccgagatactgagaaatagctattgaggatctatctagcgagaatatgaaaaacatagattttcacaaaaccagagattctcgaagaagccagagctattagaagcacctttaaagagggcataattttcaaagtgtttgagaggagaggatttgagaagattgagaacatacgccaaacggggtaagccattagtgcatattattaattaagtattaattatttgaaacttaaaaataaattgatatgatttttaaagtaaactttcttttaaaaaacacactatttaacagttcagaaagtgtgcacgcgaaaacaagtaagtttgcaaaaaaaaaaggctaagctagcaagagttttagtctagctaggactggagattttggctggccagtttgtgggtgtgtaagggcaatctttagaaaaagtatcaactatagtttccgtacttattatatatgtaaaatagacattacgtatagaaattatatacccaattggtgatttcttaaaataaatttccatccaatcagcactcttatctttcctttcatccatctatcctatcgttttaattctttgttcttgtgcagctggtttgttacatgagaaatgatttatttatcttttctctctcttctttattaactctcttactatatcagttttttcttatctagcaatatatttaataatagtacggaaactagctaagttattggtttgggactgcccttaatatcatctcgtattaatcaacatctcataaccaattgcttgcgcagtgaataatataggaacctctctaatatatctttaatgtctttgtcattgtcattaagaaaaggaaaagcaaaatactactagaaacctcggacaacagcaatactctgggaaaaaaaattgcaaacatatacgtttgctggatagcaacattacggacgtccacaggataggcactgttcctggtaggaaacatcaaattcaagtgtcaccgctaacagttcattgtgtccttattagctacttcattcgttttataacataagtcctttcggaattttttatcaaacttttataagtttcactaaattaatagaagaatttagtaagaacactttagttgcattaaatctaacattgaataatatatttgttttgtattaaaaatgttatatatttttctataaatttgattaattttaaaagatttgtttagaaaaaatcaaaacgacctataatatgaaatggagggagtagtctaatgtggtgtttggatctaggtgagattaaattttagtacatgtcacatcgaatgtttggacacttattagaaatattaaacgtagactaataataaaactaatttcttaaatgagaactaattcgcgagataaatttttaagcctaattaatccataattagcacatatttactatagaatcacgtaggctaatcatggattaaataggctcaagagattcgtctcgcgaattagtccagggttatgaaatggattttgtcattagtctacgtttaatacttctaattagtgtccaaacatccgttgtgacagcgactaaaatttagtctctgaatccaaacaccactccaattgtgatggctaaggtgttgttgaccgttttgactaatagtattccctccgtcttaaaagtaatgtatttttagaaaatcagaggtatataaagaagaaggctaaaagaatattataccacttattaatgcagagagaaaatgagaaggaaaatcgagcactaatagttagatggctaagtcgagaaggaaaaaaaatgatatttaagaagtctaatgaaccttacagctaaaaagatactctttatcagaaaaattcaaaagctaaaagctaaaattgtagtaaggcatggcatccatggatgatgtggatgataaggatttttcaccacatcaagctacaactaaggagtcaatgatgcgaaggtgcagtcttcgtcaaaagaaaaaaaaactttcagggcaaaataatttcgtggcccgagggaagggggttggggggggggggcgagaataggtagtcagaaattctggaaatctcgaaccgaatttcaaaccccatctaaattaaagtatccgtttagcaattgtgattgggaaatgatatctcaacatctttcatattttatctcattgtagcactattcattgactgtaaaaaaacactatttactttcatatcctgatccctatcccaatctcatcgctcatctctcaataggcccgtaattttctccttatagtcgccggtggcccgctcggcgggctaggtcaacatgagcgatgcaggcattgatgaccatccgaaaaaatatgtattgcattgcctctatgcaatgcaaaccatatatctaatataaatataaaaaatggacgtttgagatacatccacatcacccctaagtacgtaggatcgaaaaatagacacatcagatacgtccacattaccctcgagtaaaaattttactcctatattttatcagagtagaagttttactgtgagtaaaaattttactcgaggtgatgtgaacaaatcttaagtgttcattatttttatcatacgatagtttttaactttgcactgtatatatgtgatttgcaccatatatattcccatttcgaggaggagaggaaagggggatcagcttaattaattaagctggctatcggcatcagtcgatcgaattgaaggcgcggccgcgcggcgccggccgtgcatgtgccgtcgaccagggccggccgggaacgcacatgtgccggctcagggcggcgcccctgcgcgtgctgtcttttcatgcgccaccgccacgacgagtacagcgacgacgacgacgacgaccacggcgatggcgacgacgtacgacggcatcaattcgatcgatctcgatcgtatctgtacccgcatatgagtgtacgtacgtactacctctattttaatgtatggcgccgttaactttttatctaacgtttgaccattcgtcttattcaaaaaatttatataattatcatttattttattgtgatttgattcatcatcaaatgttatttaagaataacataaatattttcatgtttgcacaaaaaatttaaataaaacgaatggtcaaacgttgatcgaaaagtcaacggcgtcatacagagggagtacgtgtctagggaccagctgcgatgatctgcctcgtgtctggcattctgactcgtgagttgtgcgtgagtcgatcgtcgtcccaggccggcgatgcctgaatgaattacagtaattcagacgcatgcagatgctgagatgcagatgtgtagatggttaaggccctgtttagatgggaataaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatgtaaacaccacctaagaccttaccgtttatttatcattgatatgtagataaaggatttgtcagctcatatgtcagtgataaaatgtgactttgaaagtagaggatactgattcggtacgtagttatgtacaagtccatcttggccaaacatggataatatgtcatacggcgtattggcaaaataataataatttatagataaaactttatatttttagcgacttaagcgctaatgctgaaaaataaacttcgatgaaaaaccttcaaaattaacttcaaagttaacttcaaagttaagttttaaaattcaaattttggtattagctgatgctgaatagagaaaacgattggggctaatctatatccacgtgcctgtatatgtgcggatatatagaacgaattaaagagtggagccatacgagaacgtttgacactgctctagctcccaactttaacttacctagaactggagtgtcgacggagtagatcgtgactacggtatttgcgagtatgggagatcgttcgtaccaggatatacgcgagattgaggtaaaaagacgggagacatagatttttatataggtccgggcctcttatctgtaaggtaatagccctactcctgttgaccgaagccggtgttgctcttattcatcagattcacacaagtctaatatttgggataacctatctagtcgttatcgacttagcggcatggaacaccacacgtagtcgacgacagggtactattctccctcgaatatgaactcggtgagataagagataacgctagattcctcttgtcggcctctgtggcaccaaatggggtatgtctaggattctcatctccgatgtcgatgtctggcggcatgtattgtgtctattatgattgtgcgtgtccttgtctctccctaaggggtcttgtatttatacccacagatatcccctttcccaaatataactaggaagataagtatggatacaatccgcttagtccttgtagttttcaacttgaactctgcttcttcttccttatctagaacacctttcgtatacgaggcatgatttcgtataggacctggtatatagtaggccccaccgagcttaacccaaaacttgggtatgccttatccataacactgacatggagttatgccaaacagtatagattctttttttttatcgttttttttagcggaataagcagagttgcttcactaaattgtggagctaggtttttgccagtccaccgctccactccatcccaaaagacccactaccctttatttttttcatgtatttatgcaatatgccactaaactaccctttcacacccctcactaccctttatttttttcatgtatttatgcaatatgccactaaactaccctttcacacccctctcctcctgttatgtctctccggtggtggcagccgttacgtggcgcggctgctatgtggcccgcaagggcagcagggtgacgagcggtggtgcgcgggccgagcattggcggcatcagcaaggtggcgcgcgggggtgtcggcctcaacatctatagggcagtgcgtggcgacatcggttgggtggtgcggctggtcggcgcgcgagggcagcggtgcagcgggtggcgactcgcggcttgagtgttagcgacattggcaacgctgtgcgtggggatgccagtgtcgatagggaagcgcgcgggctaagcagcagcgcacgacgaccgtgttggtaggatcgcgggacgccaactagaatttcgacgaaatggcgacgcaggacgtggtgatgtggagatgataaatctagccgaactctttcatacccacttccagctcctataggagtcagctctcaatgaaattagagtttagtgttgagagttggagtttggatacttatcaaacgggacctttgtattgtgaatagctcaacgttcggcctttcggtattggaccgaggtagttatctggggagcggaaaaatatatcacacgaatgcctaggcccaaaaatattgaagcatgaccaggcttaagcccagaccaacggtgagttgggctgagatgggctaaatttgggctctggctgggtagccgtgccattttccttttctactcatagtcagctcagcctacctaattttttttaacatattatgtagttgattttttaattcgtttggttatattcgtattctctataaatattagtgtgcatagacaaacatatactccctccgtattttaatatatgacgccgttaacttttctatcaacgtttgaccattcattttattcaaattttttgtgcaaacatgaaaatatttatatcatgcttaaagaacatttgatgatgaatcaaatcacatttatggagtcaacggcattagataaaaagtcaacggcgtcatacatttatggaggtagtatattagacatattttaaagtacttttgatgataaatctagtggtgttcttttcactttctataatgataaataattataaaatattgttagttgaagttcacaaggaaaaagtcaactacctaatgcactaaaaaagtttagtatgtcaataagcactgataataaaattaatggtccatataatagttccatgtaaaattgtttttttcttttgcgtttgagtaatgcagaagaaaacgtgcattgtcaataactcagctagtcatgtgtcaaacaataatagaacaagaacggttcgctaggttagccgcgtgtcaaaccataattcatcccacgtcggatccatgtcatcaggttgtccacatggcagtactggggcagccggtttgtgacgattttcactgaatcaatgacgatttggaacatcattaagttatgacgacgacaaaaaaatgacatccattttggtaaggatgtcctttttaatcatagtaggtaatccttaatgaaacttctacaatggcagccttccatcacatcacaaggtcgtcatagaacatgacttatgatggaattttgctggttctggatgaaagtgccttatcaagtaagaccagaaccattgtagagcaaattagacaaccgatgatacggtgcgtgagcaagaggcaacatggaggacgcgacggaccagttcacgagcgtggagcgtggagcgttatgtataggtttagtcacttatggcctcaaaggcttccttagccaataggttattgggctggacaaaggactgtagattaccgaaaattgctgggaaaacacagatttcaacaaagcatccgaaaacacatcattcctgttttagctaccgttttcgaaaagactaccatgttcatacctagcaattaccaagaatttccattactagttgaaacagtcagtataaaatgaaaatgacaaccgatacagttaggattttccatcccttattgaggaatactgattacacacatttatattaagaggaataaaacttatagagacgagatagataacaagagaaaggagagggaataaaaggaaaaagggaaggaagaaaaaaaaagaggagaaaacaagaaaaaaaacaggggaagcttaagcctaatctcacgacatcgatcgagcaggccacctaaaggtccaggctagcagcgccggcgacaaagaccaagcaagcttccaaagggcggcttcctatgccattgccgtgaccacttcgggccgagtttgattgcattgattgaagatcgggttgtacctctccttccaaatggaccaagtcctaagggtcaccatcatgtcgaagcctcgatgctgttcctttcggaccttgaggtggctagagcacaaccaatcgtgaaaagaggagacaccggtggagaagttttctgttccgttttcaatccttcttatgctagtgatcaagtggttcggacctagtgtaattattccaaagccatccaacgtccacgttaattaggacttggggaagcagtagggatatatatatggacgctttcaatgaacgagtacttttaatgaaatttcacttttaaacataaaaatggaatttatgtttgaaaaagaaaaataattcatttagtcgtactacaatagatcaaaagtattcacggacaggtcagtgtgtgcacccaccaagggagtactccctccgtctaaaaaaaggacaaaccctgagtttccgtatccaacgtttgaccgtccgttttatttgaaaaaaattatgaaaaaaattaaaaagacaagtcacgcataaagtattactttctccatttcaaaatataaggcataaccacccctaacccaaataacaagaaaataattattacttcctccggtttcattttaattgacgttttggacaatgacacggtccacaagatatatctttgaccttattttttctattataatatatataataaataaatgcatgtttacttttattatagtgctttaaaagataaatctatatatgttgttctagttcctttaaactaaatatttttaaagttattgatggttaaagttataaaagtttgacctcacccttgtccaaaatatcaattaatatgaaactggagggagtatcatcttgtagtttggattatcctaataaatacaatgcatgcatccaatagaattagagaacatgagtatataggatttaaaaaagtaataatttaatggagaaggggtaatagttaattgcctacatgcatgcatgccttatatatggaacatctagaaaaagtggttgtgccttatattatgtaatggaaggagtaatcatgttttatcatctcacaacaataaaaatactaattataaaaaaattcatataaaacggacagttaaacgtttgacacggaaacccaggtttatccttttgggacgaagcgagtatagctgagacttgccggtccattctggaggcatttggacactatgctttcatagtcaaacaattacgtctgcttgacagatcagaagattctaacgtatatactacatccgtttctaaatatttaacgctattaacttttttaaatatatttaactattcgtcttattaaaaaaattaagtaattattaattttttttcctatcatttgactaattgttaaatatactttcatatatatatatatatatatatatatatatatatatatatatatatagttttagatatttcacaaatttttttaataagacgaacggtaaaatatgtgctaaaaagtcaacggtgtcaaacatttaaaaacggagggagtatttatcagaaattctaccatccaccgaggtatttttacttagatccacttatagcatgacactgatattttacttatattaaaaaacggatggagtacttatatttttactaattttttacttacattgatgtatcagtgtcatgctataggtggatctaattttttttataacttttatctacctaaatcaaacagttgagataattgttagtaaaaatttaataagaaagaattaatacgtgtagcagtgctctaaataatattatatctttctttgtagaagcatggataccaatagaagtatctaatagcttaaggtgtaaatacacctgtaccttatttaatactagccattcatccatttcgcttttccaatcccacctcactttcatctagttaaatcaaacggttgagaaatttgttagtaagacttttgtaagaaaattttagtatgtatagcagtgctcttcgccaaacacaacctaaaaattctttccttctttcaccaagcttccatgcatccgggcgagccgcccaacttgatcggagtcaagtggccgagtcgccgctataaatttcggcagccaccaaaacatagccgccatgcgccgcgtccacagctcgatcgctagccctactcgctagctagatcggcggccatggtgaacggctacttgttccgggagtacatcggcgcgcagttcaccggcgtgcgcttctccgacgtgcccgtcaacccgggcctcagcttccacttcatcctcgccttcgccatcgactacttcatggcgacgcagtcctccaagccggcgccagccaacggcgtgttcgccccgtactgggacacggccaacctgtccccggccgccgtcgccgcggccaaggcggcgcaccccaacctcagcgtcatcctcgccctcggcggcgacaccgtccagaacaccggcgtcaacgccacgttcgcgccgacgtcgtccgtcgacgcgtgggtgcgcaacgccgccgactccgtctccggcctcatcgacgcctacggcctcgacggcgtcgacgtcgactacgagcacttcgccgccggcgtggacacgttcgtggagtgcatcggtcgcctcctcaccgagctcaaggcgcggcacccgaacatcgccacctccatcgcgccgttcgagcaccccgtggtgcagcgctactaccagccgctgtggcggcgctacgccggcgtgatcgactacgtcaacttccagttctacggctacggcgccaacaccgacgtggcgacgtacgtgatgttctacgacgagcaggcggcgaactaccccggcagcaagctgctcgccagcttcaagaccgggaacgtcaccgggctgctctcgccggagcaggggatcgccggcgcgaaggagttgcagcggcaggggaagctgccggggttgttcatctggtcagcggatagctccatggtcagcagctacaagtttgagtacgagaccaaggctcaggagatcgtcgccaaccactgatcgtccatcgaacggtcgtgataatacttatgaaataagagcaaataaattgcgaaataatggtcgtattatatatcgagcgtcattatgcacgacttacgtgctaaataagaaatggacttatgtgccgattggtaatcggcgatatatggatgtcagattttcaaaccggcacctagtaaacggtgtcggtttagaaacaggtacctttataagattcctaggatgaaaaaaaaggaggctcgttgcatcggttcactgagcgcatccaccctgcgtcatccctaagccttgcccttcgaaatcaatccaacgaacttccaacaatcagcatcatcgccattacagatcacaagtcataaaatcgatacaacaacaacaacaacatctaaaaacaaaaatgaaaggagaacaacaacattatcatcattgaaaggatccgccgcgggagaagccgccgttgaaggatctgccgcgagaaaagttgccgccaccggatccaccatgaaagaagccagtggggaggggcggcgctgttcttgccgctcccaagcaccggtgtgaagggggcccctcgcgccgaataaataagagcccgtggatagagcaagcgacaaaataagaagattgcaagtggaaccgtcgaataaaatggaaaaagaattggaacgttcgcaacttaatcaatggtagtcaaagagatataggtcaggcttcagctatcactccctgcagaagaactatatatatttccttcttatcatctgctgaaatcgaattttgcaatgccgaaatccaatttaatgttacgtcacttcgttttacatttctcttgacaccgaagttcattttcaaggatacattgtactgtattccgtgaaaaaggaaattcaggcaattgatttattcggcgatttcacatgcacacaattcactccctcacactcacaaccggaattgaagcttttttttttttatcatgacaatacgatagagctccaggatagaatcaagacaagatcttcgttggtctgtgactccgactccgtataaacaggagcggatatagaacgaaatgaagaagggtgccacttgtttaatttactttactttaggtcgagtttaagctgatgccagtgtctaagtttgtattaggggatacacacatggtggaaacaggtggtgtgtagctaaaatgttttcttgatcaggttcctgggcacccctctactatagctctgcccctgcgtatgaatccttctcctatatgaaatgatcaaacactgaactgacagttcaggcagcttttactgcgagaggcaaaatgtatggtaactgcttcatttcacaaacgaaaaaaaggtttagaaatataccattttatcaccggttttataggaatatacacgtttcgaagggattggcagaagtagaccgtttcgtgacgtgtgtttgtgatatctgcacgagttcgcatgttgttgaccaagattgagaaagcgcgaacctgatgcctagcagtgacaaacaagctccaatgaggaggtgggtgaaggcatcgcttaccgctaagggtgcaaacggacaggcccgttaacccacttgtactacaattaagctggtaacctgacgtgttacctgtttatttgtactataagtgaattggtgggtctgcctgtttgcaccagttactgccgtggccgagcatgttcctcatggtgaggaagaaaccatctttgatgcaggagaacacagtaccgcacgctagccgcagcaacaagtctctctacctagtccattctaaccctttttcaagaggtccatccaaacccaacccaacccaacctaacccattttcttctgatggcgtataaggtcctaatatttcgatcggcccattagatttagcatcccgttcagcatatggtggccaacggacactcgtcgccgtcatcgccgcggccgctggacgccgacgctgacatggaagtggtcctcgagctcaccggcgtgggcccaggcggcgacgaggtgagcgaggatgcacacggtggtgggggtggagccgcggatgcagaggcgacggaagcggcggacggcggtcgacgtcgagcatctggaggcggaggcgcgtcgtgccactcttggatctcggccaccacgccgagcacctcgtcgcggccatctagatcgtgtgttgcaggagttgtggagttcttgcaaaggctgtcgatgacggaagtgcgggtgcgatcggtagaggcggtgcgccggtagcctcctttgcggcggttgcgccgccgccgctgccatggccggggcagggcttccctcttctgcgtcggtggcccctccgatgcatcgctctgagctggccaatggggcccagcctccttcgtcgtcgcctcgcaccatgccgccgcaaccatccttccccttcccctcctccgcctcccccacctcaccgacaacgacgaccatctcctcttttgtaacgctccgcttttcgtgaggcgttaaaaactatttcggcaaaatcctaatttcaaaaatttcgttctttgagtagagtctaagtcgtgccatggatctcaattcaatctccatctttgttccctctcatcgccatcaaaatcgcccacctcaagattccaattccgactcagtctccgaaatcaaactccgaaattcaatcgcatcctttgaatccccaccaaatacttgtcctaattccacaaatatccgagtccacctcgaatccattccttgattcctccctgaaccctcgagttcggatatcaaatttgaatccaaatccaaactccaattctctccaaatcagcctcctctgtgaaagtctaaatcgccttcctcaagttttgtgggccgatcatgttcccctcggcccatctcccctctgcctatctcctccttcctcctcgcacgtgctgtgcatgtgtgccgcccgagagagcgtcgtctctcttcctctctctctcgccagtcgaccaccgccgccttgccgattcccgccgccggggtttgaaccttcccgccgccgccatttgattttcgccgccgcccatcggtttcccacgtgcgcgcgctcgatcgtggccagccgctcggtcgccgccgcgtcagccctgacgccgcccgtgaccgcgtgccgcccggccccgccgcttttgccgccaccaccgccatcatcccaagccgctccacactgctaaccaccaaaaagacgggagccagagcttgcgcttgcttcctccctcaccca

SEQ ID NO: 62216 - DNA, 16220 bp, Oryza sativa
ccgagcaccggaggagccggtgcgtgcgtggacgcgtgacggggagctccgggctgccccatcgccacctctccctccctccttccccggccgcgcaccctcggtgccgcgccgccccgccgtcgcgtccacctcgccgcgactccatccgcgccgccgacgctgtttctctcgtcggtgagctccccaccgaaccacttccccctgtcgcacgccgcgccatgccgccgccgttcgccacagctcgccgcgcgccctcgccatgtcccgggcatcactcgccgtcgccatgatcccctaggctagctcgtcgccgcccgttgcttgaaacgagttcccggagccgtgtagaagctccttccccggtgaattggactcccgttgccccggcgagttttccccttttctccgccggcgatggctgccgccgcaatccaccgccgtcggcccttctctcgccgattccttgcgccgcgaccctccccgtgtccccttgaaccttcccaggctgccgccccagtcgccggcctcccaacccgctcccgcgccatgccgccccttccgccgccgcatagcgccgccgccgagttcaaacgcggcgaccatcgggtcccgcttcaccgcgtgcgcgtcgcaacaccataccggttcggctaagcccgagcccgcgcgcccttcgctcttctcgcgcgcggccacgtcggcgtgctggcgagattggccgccgccgccggccgtcgttgcgcgacgtcttcccgatccgagccgtggaatgagttccccttctcctcctcctgcctccggtgcccgccgcccactccggttcgccgccgttcgccggcgcctctcggccgccgtgagccatccgatccgggcgagctcggcctccctctctcgcgcttgcgtggcagccacctcagccgtcggccccgcttgaccgggtcaagccggcacccagtcagctgccctactcctcccccccaacccctctctctctctccgcacgcctcttgggccgcctccttgtgcccacaccggccaaatggctcggccgagcctccttcaaccctttgggccgcaccaatgccacccgaaacaagtctaatatacatccctccttgatttcctttccaaaaaggatttaatagatcctttttcccttgttccacaaatcaattccttattccaaaattctatgaatcatttttccttggtcctgcttgtcagtgaaattcaataatattcttgagaatattatttctataaattccatagaccatttctcgtattccggaaaattccgataaatcttttcctcgtccagaaaatcaagttaagcttccaaaattcatatctcctgatctgtaactccgattgactccgttccacttccagtaattctctaaagttgagatctatttaatggcactaataattaggctaaataggatctttcttttgggtcttgtgtaggttttcgattgtttgcgtatagttgcggttaccggattttcgtcgattgcgggttttctcaaagatttgtgaagctccgtgaagaccttgagcaaggcaagtcacttttgaccatcttgcacctataatttaaatctaagtatttcttttccacaaataatgcatggataggattaacacaagtaaattggccgcggcttgcgagatagcctaccggccccaatcctaattgctgcaattaccctccttaaattattgaacacttaaacctcctttgtcaactgttgtacttcgatgtacgggccttcgggtacgcacgtcggagtcctcccctcaaatttaaaatatctaacgatgggtaaaacttgggttttgcaaaagactcggaaaaacccgacgcctaggtcggtgcttgcgaactaaatgaatttccaaaatcgcagaccaggggacgtgccgggagcacggtctcctattcttgcacttaaggaccgattcctttggaatttcatccggacatatatcaagtacgaccacatgggtggaatgggacacccctgactgagtaattagctaatcaggggagccttgatgccgggggacaagtggattcgccagggtggtgtcgggaaggacccctgggcttcctgacacagtatggtctgggacctaacctgttgttggtctgggacccctctcgtcggcatatggtaaacctgtgtcggctctcgaaatgccttgtcatgaaagcctcaaggtcaccagacgtggctgttctgcacgggctgagtgatccgggttagtaatgtcgtgtgggtaaagtgtgccccctctgcagaggttattaaactgttcgaacagtcgtgcccatggtcatgggcggatgtaaggtgattccttagcgtagttttgtttgactactgatttgtgaaattgctgttgtggacttgggttcgatgtttggaacatctgtggctgacgggatcagctaggcccgggtggccgttttaaagttgtggccgggtgccaatcctgattcaatcaaagactgatacattacacatactccgaccggacgagacgcactgtctcatccgtgtcgtttgagaagcactcacttagttgtttcaaaaaggagtttaaataaaatcaattgcaaaaacaacagcctttcctttgaagcctgcattaaacacttaattcccatggcttgctgagtacgaaaatactcacccttgctctatataaatatatatatatagttcctccgtcttgaagagaagatgaagttaagcgaagattagggttttgtcctggttcccagccgtcgcctgtggtgttgggtgttagaccgttggttccgctactgctgctgctgctgctgttggtgtttcctcgtccgcgtcgtcgattgtattctcgggctatcctgagctgcaacctaagttaaggtaaataagtcctctatttaatttaaggattacaatgattcatatttgtcaccgtgggtaccagcgctatgtcctgggactggtactatgatcgcggtttcgtaggaaacggtttgcgccgtttttcctacgacacgctcctatcaggtgccgttgtacggcagtgccagatttgggtgtgacatctttgccggtgccggtgcccatctcctctgcgccgccgccgacgcccacctccacggcgccgctagtcgctgcagcccgcaccctttgcccagagaggagaagagacgagaagagaagagagagagaggaggaagggagagagatgacgtggcatcctgacatgtagggcccacgtgggtcccacactaactcaactgccacgtaagataaaaccagggtcaaaactaccgaaggacctatttagttttgattagttaagggacgctgaatatctagttttatggttaggggacgattttgtaactcgatgacaagttgaaggacgttcggtgtacttttttccttttagtactggccgattaccaagcccagctaggtcgatcagatcaaggggatgatggaggaccagacccttcatgtagaattaaacttttttttttgaccggcccagttttttaaaagttgctcgataatatatgcgtacgtgcatttacaggtgtaagtgtgcagggtacgtattataaatatctgttttttttactgtgtttttaaaaagaaaaactttccagcttttcttttttgcatgggagccagcttgttggtgaacatcaccaccaccacggtagggtttcctaaaccgccggtgccggggttaccgcgccccaatagtaagcacggttaccgcgcggtaaccacggtaaccgtgaaaaaccatacaaaaccgtgtaaaatttatcaaaaattcaaattattttttaaatttatttgaatttaaggaggttaccgcggtatttatattaccgtacccccgcgataagcccgcgcggttaccggcggtaagggaaaccctgccaccaccacgatgacgacgacggtgtcggtagagttgaacatggaggtcaatcggagattatatctagcagctggctgtatacgaaggttgtccgggtaatagtgacataacgtgcaatagtagctcctccctgtatcccaatgtaattatcgcctaagagtcttgaggttttctccaaaaataatcgtcatctaacaaaatgtttattttgtttattcgtgcaaagagtacatatgcattatgaaataccctgcatacgactaatcaagattaatttttattagttcaacccatgcaacatttaagtatgagataattcttattggactcgaagcgacaaaacaccttatcgatgaggattaattttagaataaattatgtgttggtgttcttggtcttgatgttctttgttagggatgattgggatggtgggacactgttaaaaaagacatatacaagtcggcactataggtgtcagatcagctaaaaccgaaacatatagtgcttttccccttcaaaagatgaaaaaaaataaaacggcacctttaatacgctatagttgtcggttctatagaagaaccgccacctatactataggtgccgattctttttataaagatactagtatctttaatatattataggtgtcggttaattaaaaacgacaccctatcaaacgagccaagccgaattgagagacagcctctttttttcttttatcgcacggggaggcgaggaataaaacgccgagtgggaggtaagggagcgtccttatccacttgctcccctctcgtcctctcacccaccgctctctctttctcacaccctctcccctctgtgccggctctctctccttctctaccgcagtgtctcggtcgctagcacgcggtggtagcatgcaacagcgtgcagcggtgggagggaggcggtggtagcagcggcgggtggcgccctcccctccgctagatctggcaggaggggaggcaacggcagcggcggcgccccacgggtggcggcgggaggagaggcggcaacggcgggcggcgccctcccctccgccagatccggtgggaggggaggcagcggcagcggcgacaggctcccatccgccagatccgacagttccggcgagctcccatgtgtagttgttgattgtgtgatccatcaattattgattgtgtgatgctgatgtgtagtcttttttagatttttggatgattttttgggttgctttgatgcatcggctcgggtaaatttgtctttgcaaattgtataacttaaagatgccagttctaaaaccgccacctttaagtgttctaatatgtgtcttcttcatggtgtcgtttggaaaaaccggcactctttgtgggtttccatccggtacggatgaccttttctccgtggtagttgggagtaattaattaacgtgaacgtgtcgccgagtagtgaacaatctagtcacagttagttccgcgtgtacgcatgcatgtgccagcatgcatggacggtctggaagtcggtcttgtttttcctttagctatacttagagtgaagtgcttcagtggtctctaagcttgtgcgaatgtatcatctaggtatctaaattcttaaaatgtatttttatgtctctaaacttgtcttaggtgtcatataggtccaaacgggtaccgacccactccatccgctgacgtggcatgccacggtagcgcctacgtgtcagtggggactcacatgtcagtcatatttataaatatatgatatgataacaatatttacagaaagaaccttacatgttttaaacttactctaatcaaattctatacgtgctaatggagcggagcccacctatcataggcacagggagaacacagcagcagccgcagagttcgccggccggcgttccttcacgacgatgccgttggcgaacggcgattcttcggccgacacaaccacaagaagaaatgctgaggacttccttgcgatcctgttgaaggtggtctcgtcgccggggtggccggaatcgatgccagtggtgtcacgagcggcggtggtcttcaatacgcctgtgcatgtagagtcccagctcgatttagtgcaaaaagatgcatgcatacgagtctagcaggtccctaggtgctcactggaacttgattgcggcatggcgaggtctgggtaatagcggcaatggaaaagacagcccggcggtggtggataacgtcggcttcacggcgacggctcgcttgagcggtggaatgcttagagaaggtgcatgggtggttagtgaggtccctaaagagttgcatgcacgattaattagtccgtggctcaccggggagagagggattggcgatggcactcggtgaccggagttggagaagatgacggcgatctccctcgtctgtgcatgattcttaaaatttcttgagggattttggccatgatggtgaggcgatgactttggcacgatggcttggcttgagatggaccatgtcggttggaacagcgacgacttcatggcggcgacgcctggtgcgagttccggagctctcgtgggcaaggtcgcgtttccgttgctgcagtggataaaacgagatggggtcaaaaggagatttgctcggcatgatgtgggaagtttggaacgggaaagatttggcgatggagacaactcgtcggcaacagcgagcgtcatcttcttcgcgatcgacgacgagaatgtgggcgacggagaggcatagggctctctctcgtccgagtagttcggctccagaagaatgtagaagagaaggcgacacgtatgaggaataaaagggaggagctcagcgttgccacgtcccggccacgcgtgacgcgtcgagcaccgccggtgtctctctttcctgctctcgctctctctctctctcggctcccagggcggtggagatgatgcacagagctgacatgtgggtccccactgacccgtagacgctaccgtggatgccacgttagcggatggagcggatcggagcctgtttggacctatatgataccgaagacaagttcgaggactcaaaaatacattttaagagtttaaggacctagatgacacacccgcacaagtttagagaccgctggtgcacttcactcctatacttatatatgtccgatcgaattcccaatccaagacaattttgagtcgtgctgatctgcatggcttcataaatgaatccccgatgtgcacaaatcacaaatggttaccgtacgtaagatggtaaccttagctagctctccaatttcgtggcgtgcacatgtctaactctaggttctagctatatgtcactctttttcgagccgcgctcgggtggttacttggattgtatttagttcccttcgaacttttaaaaatttcgtcatattaaatatttaaatatatgtataaagcattaaatatagaaaaaaaccaattacacagtttgcatgtaaattgcgagacgaatctttttagcctaattataccataatttgataatatggtgctacagtaaatatttgctaatgatggattaattaggcttaatagatttgtcccgcaatttataggcgaaatctgtaatttgttttgttattagtatacatttaatacttcgaatgtgtgtccgtatacttaaaaaaaattattatgaaaggaactaaacacggccttggtcgcttatctaccatgaccaacttgttatattctcattaataaacaacagctgatgtgatgcatccaacagtaagtagatcagaacctgatcttttgcttgctcatctcccccaacatataggtgtagtcaaagctaaattaatcaacaattaattaaaccggttgctcacgtgtataaatagatagctagacagatagcagctaactcgagcaacaaggtcgtagccatgacgaacgggtacctgttccgggagtacatcggcgcgcagttcaccggagtccgcttctccgacgtgcccatcaacccaaacctcagcttcaacttcatcctctccttcgccatcgactacacgagcccggccggcggcgccacgccggcgccgaccaacggcgtgttctcgccgtactgggacacggccaacctgtccccggccgacgtcgccgccgtcaaggcggcgcaccccaacgtcagcgtcatggtcggcctcggcggcgacagcgtgcaggacaccgccaaggtcttcttctccccgacctccgtcgactcgtgggtggccaacgccgtcgcctccgtctccggcatcatcgacgcctacggcctcgacggcgtcgacgtcgactacgagcacttcaacgacgacggcggcgccggcgtcgacacgttcgtggagtgcatcggccgcctcctcaccgagctcaaggcgcggcacccgaacatcaccacctccatcgcgccgttcgaggacgccgtggtgcagcgctactaccagccgctgtggcggcgctacgccggcgtgatcgacctcgtcaacttccagttctacggctacggcgacaacaccgacgtgccgacgtacgtgatgttctacgacgagcaggcggcgaactacccgggcggcaaggtgctcgccagcttcaagaccggcgacgtcgccgggctgctctggccggagcaggggatcgccggagcgaaggagttgcagcggcaggggaagctgccgggattgttcatctggtcggcggacagctcaaaggtcagcagctatggctttgagtacgagatcaaggctcaggagatcatcgccaaccactgatcgctgatcggacggtcgagatatcgctgtggttggatttggtatgaatgaatgactgaataagcggatatatttgcccagtacagttctgggcacgcatggtgttctaatacttattgcgtatatatgcagtgagatggatattatatatatctacagaatataaataagtttcttcaacatatatgctatttctccaatctatgaattagtgacagacatatatctgtttcgagttcacttaactctcttgttttatttaatttcttctctgaaccttaaaccagataaagtaattcctcgtcttaaaaccgatatgatcaacgaacagcgatggtaataggacctgtttgttataaaaataaattaactcatgacgtccgtatacatgtacaatataaaaacagatatatataaaactatatcagcagcctatagtgatgtacacattagattttttaggtgaaagagagaaggattgttttgccgtcgggctacacactactccccatgttgtgggcccaattcttttctcatacatgcgtgtgccttgctaccatccttcaaacaacccaatttaatactagaaaaacaaaaggtgtgtgtgggagattgtagagaaaaatatataacttaattgctatatttactaagttttgaaactagctgcaggcctgcatgcagcaaggtgatatggctattagccttgccccttgctctaagtatgaattttgagtttcgaccatagtttcacgaagaaaatattcccaattccagatgttgaaatatcatggcggtaaacactatggatcaggttcttctatatatatgttcaaagtcaccataacttggtcactgatatatatagatcctgatcgtggttgacgtactatatatatacagacactcaaatggaatctgtgatcaattttgttttgaacggaaatagtgatcaaatttttatgagttgtgggaaaagtatcttgacaaatttctgacatcataaacaattgtaggcccagcgtattgtggtggggcacgaccaagcgtattggtgggcgaaggccctaatggatggtagggaaacggcccagcatatataaaaatttggcttgtccagagtttgctataggaccattcactccgcacgtactctctccatactcgtaaaggaagtcgtttaggacagcgacacggtctccaaaacacaaatttcacttcttatttctataaaaatatttattaaaaagtgatatatgtatacttttatgaaagtatttttcaagacaaatctatacatataatttttatttttagagtaaattgcactttgggctatctttcttaaccaatgtttcagtttggactagggataagatgactttttcactttgggctagataagtttgcaaaaggtttcaccttcaacctcctttttgcctctccaaactccaggctctagctcgctctctctcgttgaccttatgtgactgtgagtatagacatgttgaggtcaagcttgaactttcggcaagccccaacgcttgaactttcagcaattcagcaagccccaatgccccgtggagatcatcaaccttgagaccgtggcccctgtacagtcgtcgtaatgatggtcaagctcaccaagctagagcttgggacaaaacgggtcgaatcaaagctctcggatggcagataaaggatgacagcaatgagcaattgagcagcgctcaagggccacggcagcgaagcagctcttggcccccacgttggaactactcaaggactgtggcggccagtggcactccatggccatagtagcgagagttgcacgatgatggttgcgtaggagctgctcgaggatagtggctgcattacaaggcagcggtaggcggcactccagaagtctatgcttgagcttggcttcttcatcaacttgagaagaaagaggggagcatatagaaaaggaggtccaaattgaaacaattatgcaaagttatctagtctaatgtgaaaaacatgtcttacacctagcccaaattgcatctttggtaaaaagaggtggcctaaagtgcagtttactctaatttttacattttcaaactcaacaacttgatagttattcatgatttatattcccaaggtttaacttaaacattgtcctaaacgactttctttatgagtatggagggagtacgacagttcagagttcagacagatgatgatataggcagtgtttagtcccttcaaacttccaaatattccttcacatcaaggcctggtttagttttcaactttttcttcaaactttcaattttttcatcacatcaaaactttcctacacataaacttttaacttttttcttcaaacttccaattttagtcaaacttctaattttggcatggaactacccaaattattagacacatagaacattaaatgtggacgaaaaaaaaatcaattgcacagtttgcatgtaaattgcgagacgaatcttttgagcctaactacgccataatttgacaatgtgatgctacagtaaacatttcttaatgacagattaattaggcttaataaattcgtctcgcagtttatatgcggaatctgtagtttgttttgtattagtctaagtttaatacttcaaatgcgtgtccgtgtacttaaaaaaaatttggcatacgaactaaacacggccatacttcccattttttttgtttttgaacaatcaacatcagacagtgcgacgatttgatgatgaactcaaagcatgccttcttgaacaccttgcagctaggccacagatcaacgaacaccaacaagcttaccacacgcttctcttgtagtactccctccatattttaatattttaatgtatgacgctgttgactttttaactaatgtttgaccattcgtcttatttaatttttttatgcaaatacaaaaatacttatatcatgcttaaagaacatttgatgataaatcaagtcacaataaaataactgataattacataaattttttaaataagatgaaaggtcaaacgtttgttaaaaagtcaacggcgtcgtacatttaatacggagggagtacttgcttaacttctcgcgacgagcagaggcacagcagtgaccgccgataatctggcctactcatcggtaacgagccgccatacatgaagctgagcgcgtcgaacaacttgggggcttcatgccgtcgatttgtatgacacgatggtggtggtcgttgcattgctccgtctggccgccgccaaattgctccgccgcgaaggccggtgacggcgaccggccggcgacgaaccgccggttagccgtgaacttccgcttgtgccgacctggaacatcacgtcaggcggcttgatcttatgcagactatgtttttactgaaacagtggcggtaagcaccattttgtatacaccgggttcaccaccttgtcctcgatggtggtgggggaaaccatttcctcgctggacgacgatgccgcggcggcggcggccagcgaggcctctgtcgtcgtcgtcgccgtgcaggattgcgtgatgacaacgatgtcgcacctgatggccagcccatcctccacgatgagcccttccctctccagcttctccttcttcttgaacgccacggtgccccatccattcccttgtccgtcgaagtcgcgcaccttctcgccacgcatgtcggctaattcagacggcggcggcggcggcggcggcgtccacggccgaccggggttggacgacgcgtcgacgaagcggaagcgaagctgcacgttcaccggctcgcccgcgccgccggcggcggcgatgtcgtcttcgaggacgaggaagacggagacgtagtcggtgtgatcggcgtcgtagccgttggggtagtactcgacgtgccagctatggccgcccaccgcgaacgaggtggacttgatgctcttgccgttgggggtgatcgcctcgaggagggagtagtcgcggatccggaacacgtggtgcccgctcgacctggcggcggcggcggtcgagacggagtagttgatctgcggcggcggcggcggcggcggaggtggtggtggtggccgtgtaggcacgacgcggcgggcggcgacggcggtggagacggagcagttctgaggaggcggtggaggtggtggccgtgaaggcacgacgcggcgagtggcgacgccggtggagacggagaagttctgcggcggcggcggtggtggccgtgtaggccgcacgacgcggcgggcggcggcggcatgggcggacgacgccggcagcgccgcggtgcgcgctccggacggtgaggcgcctatatatatatagtgatgcaataatcgatatatatgcatgccaccgattagagtgggattagcttctggctaatctatcttgctcacttatgtagacgaagggtgtcgtggcaggcaggattagcatgatatatataacgtctcgattagaagagacagttcggacatcgatcgatcgggctccggaatcaagtcggactcggattaattgtttttttttataataatggaatgacatcctggcatttgcgcaagaactatagccaattattataagatttacacaaaaatgaactcacccaatgagtatataactaaagtaacaaaaacaaaagtaaaagcaaactaataaaaatcaaacaaggtaaagaccccacaactattgaattctcttggtgaatctccacccgaagttgataaaaagctgcatgattgtcgactcaagtttacgacacatatctcttattagtttgatatgatcatcatgcttttataattgagccctttcccggagccaatatattgcccagaaaagaaccaaataagattttgaaggtgatatatcaaaaataattttatttctagtaagccagagagctcaacatacagcggaatctccaacaagattaagttcattggtctttttattaacacccacaaaccaattcctaaatatatgagatatattatatggaggatataatccaaacgcgaattgtatagatttcgaaagaaatttggcaaaatgataatccaggaaaagatggtaaatcgatttattttttataaaaaacaacatctcaaattaccattccaattccttctagccaagttgtcttttttttaaaacaatccccataaagagataccacataaaacttttaatcttaagtggtatcttaagtttccaaataaacttatttctctctatatacccattattaattagagccaaatacatagatcgaactgaaaattgaccactttgatgaagattccaactaaatatatcatcctcctctgttaaattaacatgcacaattaaaacacacaaaataataccatataatcaagttctgaccaactaatgctctcctaaaacagacattaagcggaaccataactaaccacttatcctcccagaatctaacttgttcaccattattaataatccagtagcccatatttagaaaagaacttttagccttcatgaaactagacaaaaaaaaataggaatacccatgtttcctctcgacttgagtaatagatttagtaccaggatattttcttttcaaaagatcttaccacacaccttgttcatttattaatttaaacaaccacttaattaataaacattggttttggatttctaagttatgaacacctattcctccttgatatttaggatgacaaataatatctcatattgtcaatctatatttcttttttttcatcaccttgccaaaagaaatgggatctataataatcacttttttcaagaactctttaggaatctaaaaaacgaaatcataagcataactaaacttgataacacacagttaatcaaaaccaatctcccacctagtttaccattccaactactaagttttttctcaattctttgttcaattgttttttttataataggtaatttgattacccggcttttgggagaaagccaaacatgacaaggtctgaatacagaaacttaaaggaaaacagagtaaaactggggctgccagtgcccatcatgcgctagatagctaaaccccaaaagacttacagaccctatcaaggaagacatccaaacggctaggagacctcaaccccaaaagcaaacaaactgacttaaacactaatattgtccggtagcacgtccactagtcgtagagactccagcttagcctttagcttctcaagcagcacgatcaaggcctcgcgatctctttcttttgacagcagcaccttccatctctgcatcaaagaaattgccttgtacactacctgcaaaggtgatttcaccaatttattttcaaaaacaaggtcatttcttatcaaccacaaaccccagcaaagactagcacaaagaaaaagacctaaattcacccccagtttttccttaccagcttttataccatcccaaaaattggttggaattaaacccccttcaattacctctgttacagagcaccaaacaaagcaagcgataggacaagtaaaaagcacatggttactagattcagttcccaagcataatttacagaatttagtacccccctccaatttctctgaactaagatatcagcacaaggtattctccctctcccagccaaaaacaggaaatgcttgactttcaaaggaactttgcacccccaaatctcttgcatctctctgtccacaacacccccaaactttaacagcctatacatagatttagtagtgaatttcttattcttctcatgaggccaaattaagctgtcaagcaaatcatctagcctcacatcctgcaacaaacttttcaaaagatctaattgagccttgtcagattggtctagatttcttctaaaggacagagcccaattaggagcacccataacctccctaaccgaaagatgttgttgattattcaccatatataaggaaggaaacaaaatttttaggggaacatctcccacccaaacatcctcccagaactaggttttttctccattattaatcttcttaactaccaatttgtttaaccagactttgcactcatgaaggcctttccaaaactgggaccccccaacaacagaactcctgaaaaaactgcctctccctaagtacttgttcctaagaacaacacagctcatgtcttgagaatcgccttccaacttcatgatccatttactcaaaaggcaaaaattcatgatcctagtatccaagaaacccaagccaccaaagtctttaggtctgcacagaccctgcaatttaataaggtgatatttcttcttcttcccattcccctgccaatagaatctcccccttatagtttctaaatttttgtggaactcctcaggaagcttaaaaaaacccatagcatacattgggacactggacaaaaaggtattgatcctgatctccctccccccataggaaagatggccactatgc

SEQ ID NO: 62217 - DNA, 925 bp, Oryza sativa
tttcagaatcacattctgaagacaaatgggtctatattgctttattgtattagcatccttaatttttggaagcagagaaatcaccccgtaatttatcctatcactgtctaaaattcctttttgaagatcatcaagcatctctttgatcaaccccgtaaattcaggccagagtttcttatagaaacccactgggaaaccatccggtcccggggccgtatttgttttcatgctcttcatgacctgatcaatttctgacaactcaaaaggtttcatcaagctttcattatccccctcattcaaacttaatttgtcagcccaaaccccctgttccaaatgaatgtttctcaattcttccctcccaaacgactgcttgtaatagtcataaatatgagtctgaatctgttggaaatctgaaagaacctcctcccctttttgtatagagaaaatgtgactttcctattcctaccattagcaatcctatggaaaaaagaagtattgctatccccccttaacaaccattgttcaccccctcttctttgccaccatatttcttcttgtagatagatctgttctacttccttttctagctcatatctgacctcccattcttgagaaaacaaatccctctcctcagcaatgctgtcaatttcaatcagcttttgttctatctctttccttctctttttttgtttgcttaccatattagcactccacccccttaaccatctcctcagataaggcataagaagatgccaataattcatcactttgctctgtattctggcaggccacttctcaagcaaatctttcttaaaaccctccaactcaaactagcccatctcgaacctaaaattgtttcccctaactctctccccctcctagtatttaacagcaaaggaccatggtctgaaccaaccctcaaaaa

SEQ ID NO: 62218 - DNA, 6230 bp, Oryza sativa
ttccagatctagttgttcactgtcatcatcttcctctgccctcatcaactcaatgtctgagtcagcggggatagcacatttctccccctcttcatctgtgaataatctaacaccccccaattttaaatccacatccattcttttgagaaggtcaccacttttgtcctcctcctgtgaaacttgctcaaacaattctggttgtgaaaattcctctgacttccataacaccactgccttgtctgcctttttctccacggtaattgattcaataggatcctcacccttagcagtgacccccacctcattctccacctacagaattatggcgttttgcaagtttttagagttccttttaacaactggggggcagattgagtcttactgacaatccttcctttgctatctgcatccttagcaggttcctttttctttggactccctttggcatcctgacccccacctttctttcctcctggagggtaatcatcatccagatcatcagcatcatcatcatcattgtccccccccaatcaatagaccctgtcccctctgtatcaacctctgcctcccattttatcttatatccaatgtcattaatatatattatgacagaatagttgatagcactagggtccaagcatcccacttttatcctaacagctccttcccccttcaaagatttctcatccacttctttaaattcacccacaatatcagatattgctctaatgatttcctgctttttggcgaaacctggaagaccaaaaacttttacccagatcacaaagagctcatccacagcattgtcagtcatcttagattctattacactagctttgatggatgaggtcttaaacacaaaccccctgacttagtaacttgtcttctagcatcttcactcgggaaatcaatcaagaaattattactgctgatttgcttcacattccaatcccaatttttctccctaaatagatgagacatctcattggccaccttttgcactgaaccagcccctttctccacagttaggattcctctgaattgtgcccctttctcagccacacctaaattatctacatttaggctgaaaaaaccctgctcaggtatgccataaccttttagctttacttctagtttgctcaaattagagctactccccccaacatgaacagggcaatgagatgagatgtgtccaggattcttacagacatagcacagaggaggtttctgacagttcacctgatgataaccactttctccacagttgaaacacttgatctcttccttctgggaaggacctgatctcccttcctcccccagcttctcctttccacgagtcggacgccgatcccctccctcccaagcaccaccctccctgtttctgtctccttgccactgtttgttggccccccttctctcaacttgctgccacctcccttcctcgcgctgttgttgttgccccatcaaccgattccgaagttcacgttcctccctttcctgcaaatttcgattcccccaattcccacctcccccctcctcttcgaacgctcttctcttattgggaacccattgatcaggacgttggaattgaggtttacgatccatacttcccttcgctacctcgaggaaggatctcccgtcagtgagtctcgccggagctctccagatccgcctcgtcgtcgccccaaaacgcacgacctctcgcctggtggctggaaaccctagatgaggactcagagaaccccctttcggcacccacacccagctcgcagacaaaaaaacctccttaatcgggctcgggagcagatcacgcatggaccatccatggcggattccacgagccccaccactccagcccgcgtgaatagtgtcgggcccttgggctaacccatgggtattccaacaccatttcccacctatcgaaacgtctcgattacctcccctcttcggcgtcgctggcgagggaggtcgtctctccggcaagcacgcacgccctagcgccgccgtgctcgtcgccttgctttccgccatgctaacatacttctggaccaacaccttcaattgttaactaatctttattactaagctttctaaaatgcataggaatgctaatatatctaacaggaaaatttcctagtttgcacccaaaaatatttaaatattgctcatgacattcctttccttaaattttcagactagaaaatttatcttcagactagaaaatttttcaaaagcagttaaaatcaatttcatatttttagctttttgcaaatcatgcttaaaaatgatagtatcatcagcatattgtaagatagatgaaccatcatcaaccagatgagggaccactccagaaatttgaccattaccttttgctctctttattaatatagctaacatattagcaactatattaaaaagaattggagataatgggtccccttgccttaaacccgtatatgtttgaaaatttgatcccacatgatcattcactttaatgtgaacaagtccactttggataaaagaagaaatccaatcacaccttttttttgcgagaaacccttaattctcaacgtttgttgaacaaaagaacattttactttatcataagctttcttaaaatcaaccttaaaacgtacaccactcttttttccggcacaactcatgtacgtttcatgaaaaataacaaccccctccataacatttctcccaggtataaaagctatctgtgtgggactaaaaaaccttctgagccactccagaaattttatttgtagcaattttagtaaaaattttgaaactgacattaagtaaacaaataggccgatattgttgaatttttagaggctatttgcacttaggctattgttgaatatgtgggtgtcgttttaagactttgttgagttaatcctattataaaacaaatcccttggagaaaagtttttttttaaaagataaatttcttgttggtcaatccgaatcaggcaagaaataagatttatctcctatatttatattggggtagggtttgaggttgcttatactcaacgaacgacaatagatctaatagagagagagttacaccctttatctctgtacattattgcttgtgtgatattgtcgagggtaaaggaaagtgcacgggtgttttacatgttctcacatctctattactgtcgactcgaaactacatacatcttctcgcacctctactgtttttttgaaaggaacggattcgataatctgctaatatatgtgttggcctccaacaaatcccacccacaccctgagctcgttcaatctcaagcgtaaccaccactacccaaccggcaaccgcctccatcgtcgcgctgaccgagagagacacaaggtgcacgtttaaactgagtctcgccttcttcttcttcttcttcccccaccaacgccaagaaaagccagcaaccagtcaaccacaccatgcacgaagcacacgccaaacacgtacaccaccacctccgtcatgtcaagctctccgaacgatcttccaaccatatataacccagccatcgcccgattccccttcgaaatccatctttccccgccgcccctgcggccttgcctcctcgcagctgctcggagaagaagaaaatcaattcaagatcagagtgagccggaaatcgtatcaggagatgtcgcggtacgtggagatgctggacatgggggtgcgcgtcgcggcgaggttccactcccactgcccgcacacggcgcgcatgtactacaagccgccgcagaccacggcggatcacggcggccgcggggacggcggcgctgcagcaggcaagcaggtggcggccggcttcaggttcgaggcggtgacgtcgtcgtccgccggcgccatggcggtggcggcggcggcggcatgggaggaccgcggcttcggcgccaccgcgccgtcggggttcgacttcgagtttgacaccgcgcaggccgtcgtcgtctacgaccacgtcgccgtcgtgtgaggaggagtttcgatcgatcgtatatatagtagctttggccggagaggatttgattttctcccggaaacaattttgacacaaagggattgaatttgattatgtgaatgtaatgtacctatgtacactccgttttattgttatttttgagatttgatagctgaaattaatggaagaaacattggttgatgcttctccgattttgacgtatacaactactgtctcatacttaccagcatatttgcgttggcatctacgattgtatagaaatgacgtggattttgataaatctcaaaaaaaaaatcttatatgaagatactccctctgttcgggaaagccagtcgttttaaggttggccggataaattaaccggaagtaaaatttaccatattgctcctatttagtggttgcatttgtcacttcatattgtaagaaaaaaaagttggccggataaattaaccggaagtaaaatttaccatattgtccctatttagtggttgcatttgtcacttcatattgtaagaaaaaaatacaacaagtaattaagtaatcactagtactagcagaaatattgtctacacctaagtgccatggcaactaggtgtatgcatataatttaaacagttgtataaaaaattcataaaatttgataagatagtccatgataatataagacagtatgcaaacatgcaagtctaaattcgatcgatatatgaagaaaaaaaataacaaattttatctgcactgtatgggtactattcactatctgattttatttgagtcgcatgcaaatgataggtgctatggcacctaggtgtagaaaatccttgtccctagtacttgtactgctatctatcgcatggtacatgcatggtactagtagtggcactgttacacagggaaagagtaattattactagctaaaatcaggagggttagaatgattccatggaatagactagatgctaagttcagtgggcagatgctagagcgacaaattttacgggacatttcttcaacacagaatgactggctttttgggacggaggtagtacttttcaaggtaacgcactagctccgattatgcgtatagctctaaaatctgtatataaaaaaatttggatggtgttcactaaatacccggctacaaaaactcataggaggttagaatgaaaaataggattttcgcagacgatcgattttagcccgcacatgacaaggatacgtcatttccctctccttttctctgctccgtccccagcgttaagtcctttactcctctccctctcctaacttcaattcatcattcctctctcacacatttcctctcccctaccacctctcctccgtattttcacccttcttctctcccccatcacctctctcacccagcggctagcgatgagagcggccgacgtgcgcctcagctccttgtccaccagccggtggccttgcgatgatcggatctggtagaggctccataggctcctcctccttcattgctagcaacctcgcgacatgatctccctcagctccacctcctccactgccagtagcttcgcaacaactgagatggtagcctcgcgacggccagatattggggagcctctgtcggctcctcctcctccaccatcggcatcctgtaacttcctctccctcagctccacctccactatcggcaacctctcaacgtcttctccctcagctcctcctcctccaccgcagacagcctttcgacggctagatcagatgggggctgccccaagacgagtggatccacagccggtggccactgtagcggtcgtagcggggtgtggtggctgatcgatctagcttagggatcgtgctaggatttatgtacttgttttcttttggaaatttgtgttcttgttttgctaaaattcttttacaagaaggcattttaacatgtttgtctgccaaaaataatgttttatttggttgcattgtccgcctgccataatcaacatttctaccagcatcgggtggcaggcggtcgttccgtccatttctccagagctcacgaggttgctccgttgcaacgattaatttctagaggtaagatggaagatggattaccgtaaaagggctatgtttatactccctccgtttcgaaatgtttgacccgttgactttttagcacatgtttgaccgttcgtcttattcaaaaacttttgtgaaatatgtaaaattatatgcctacataaaaatatattt

SEQ ID NO: 62219 - DNA, 19444 bp, Oryza sativa
tttcgaaacggagggagtatttttgtcagggttacgggttaggcataccctctacccttcgatatacgttacatatcgatatggcatatccacgtgcatgcggatatttcctgtatgttctaaggaaacctttcacgggatttacaaaaggaaagaatcctactcggacagaactgggtcgttgacgtatcgtatagggtctgatacctccgagttctacttggagacctccagatccgcgatataaaaaggaccccccggggagggctcaagggatcgaatctcagagccaacacaaccaacacagcctacgaagtcggaatctgcgaggagccaagtcatcgagagctagtcgaatcaactcgactacgatctcgtcggatccgataagttccattgtcctctttgtaacctgtgttttccaccatataatcccatatcaactggattagggctattacctatcaaggggcctgaaccagtataattcttgtcttttgattgcttgatgtcgtactacgtagatccttgtaccaacgtaccccaataccctctatatccggtctacgggtatcacccgtcgacaattttataacaaaaacaatactccatggaatttcttgattaattcacgatcagacaccattattaaaagcgttgagcttagaattgcagtcagttaaaccaaaaaagaggaaaatccaaggaaaaaaatgggaccacctatacatttgtcgataaattttctcctaaaaatttgacagatgtaattatagtacaatcgtaatgtaattacactgtaacttgtatgtaattatactgtaatttgcatgtaactatagtgtaacttgtatgtaagtttcacataattttgaatcgttagatatattacaagatttgttctggtgaggaagaaaaaaaaaatcacagcacacatatatgtgaaaggatttgttcccacgatctctattttactggaacaacatgttacggagagattttaaaagttacattatacttatagtgtaattacatgtaagttacagtgtaattacaccacaattgtactgtaataacatctgtcgacaaatatatagaaaaattgaaaataattaaccaatagtactattactgcacctgcatgtccattcaaaactctattagtgaaagctttgtatctacaataattcattccaacacaacacatacgctcgttccgcgcatgcgcaagcgcaaccaccgctacccaaccgcctccatagcctccttctgagtgctggccgaggcgcaacacaaaggggcacgtttaaactgagtctcttcttcttcttcttcttcttctcccacacccacgccaagaaaagccaggaaccacaccatgcacaaaacccacgacgaacacaccccaccgcctccgccaactcaagctctccgatcgatcgatcttccaaccatatatataacccagccgccgcccgcttcctcgatcgatcccagcgctcggagcaaaaaaaagaacggaattgcttagatcaagagcgagctgaacagagccgcgtttgcttgcttgctttggaaggaaatcatatcgatcgatcaggagatgtcgtcgcggtacgtggagatgctggacatgggggtgcgcatcgcggcgaggttccactcccactgcccgcacacggcgcgcatgtactacaagccgccgcagaccacggcggatcacggcggcgctgcagcaggcaagcaggtggtggcggccggcttcaggttcgaggcggtgtcgtcgtcgtccgccggcgccatggcggcggcggcggcatgggaggaccgcggcttccgcgccaccgcgccgtcggggttcgacttcgagtttgacaccgcgcaggccgtcgtcgtctacgacgacgtcgccgccgtgtgaggaggagtttcgatcgatcgtatgtatagtagcttctgctcggagaggatttgattttgtccgggaacaattttgacacagaggggattgaatttgattctgtgaagtgtatatatgtacactccattcttttattcatttttgagatttgatagctgaaatcaatgaatgaaacatgggctgagatgcttctccgatttttatgtatataactactgtttcataccagcaagttcgaaattgtctttagaacccgcgcattgcgtgggcatgtattttatactgcgtttgaaaaacttatataaacgaaatatcaacgggataaaactaccatgtttcaaaagtactatttctctataatttttctcatcggcatttcttagataatttattcaaactttttgttaccttttaaaatatataatatttaattcattcgtataaataattatctatggtccatataaaaacctgccatgtttcaaaagtatctatttttaatttgtttagaaaacaatctacaaattaaacgtaaattaaaagtacaatgttttgtcttgtttaattgaatgtttagtggtatttttccacaaatcctaaagaactattgttgttagtaaataaaactatttgtaccatcaagttatttctgtttttagttggttcagattcacgcaagttgttacatacttacatataaattaacaaacacatatcaaagatcatcgcttccttgtaatatttatgatctatatctataagaaaatatagtcaatatgggtccaaaaaattaaatttaatagtagcaaatatgtaagcattaatatgtataggatagatgcaaggccattaatatgtaagcatttaaaaattattataaaaatgaaacatgtaatggttggtccaattttagtgcaaagtacaaacttattttatttttctccaaatagttcaatttagtgcctattgatatgttatttttttagttttattttataccagctcaaaatataggggttatggatctttaaattattggtttagttatgaatagagcaatagttagattagaaattatatgtgcaacttaaaaaatatgcatgttggtccttattttatcaaatttctgatttctgatttttctaaattttaagatgcaacacatgatggcttaagattctaaaattatatctattggttaaaaataatggatccacctattaaatgaaacttacgagtagatatcttttcttacagtttctaaggttttgtttttaattatgatgtacatgtgatgtacgtcttaagtgcgctacagaggatatacaatgatttgaggtgatatattacttatttaatttttcataatgctttgtttcttctatttggttatgatgcataaaggataggtgtgcaagctcaggtggtgtttatttttatacagtgaaatatgaataatatagatcttaaattatttatttaattatgaatacattaacaattcaaataaacttttaaaaatcatatatgacgtaagaatcataattatttagcttttgtaattattgattatttttatattatgttgttaattagttaaaaattataagacggaagagttgagcgagagaaaagaagaagagaaagtacgcacacatataattatgttttatacattttatagtgtttatttatatgttatagttagctataaatttagtcataaataaattgaaagatatgagcggattgaaaattagtagtataggccgtgtttagttctttggccaaaacttttttgaagtatacgggcacacatttgaagtattaaacgtagactaataaaaaacaaattatagattccgcatgtaaactgcgagacgaatttattaagcgtaattaatctgccattagcaaatgtttactgtagcatcacattctcaaatcatggcgcaaccaggctcgaaagattcgtctcgcaatttacatgcaaactgtacaattagttcttttcatccatatttaatgctccatacatgtgtccaaatatttgatgtaacatttttggctaaaaatttttgggatctaaacatacccataatttagatgttatagctgttgaattgtttaacagaaaaaaatattttctaactaataaagtatgataataggagaagaaatatgtgtaaaaatatgaagaaattgagagaagaagaggtgaaagtaacgtacgtacgtattatccttaaaacaaacgtgcatacataatacgtacaggccggcttaaggtggaaaaaaaacggttcgtacatacatatctataactaatataaatattcgtatttttccggtcatcacatcgtccgccaggggattttttgtccctcccccacccccaaaaaatcccagtcagataaaaaaaaattcatgattgttcccaaaccttttgcccccaattctcaaactatatgaatcacaaaatcactcaattgcaatcccaaatcaaaaccatcaatctcgacaaaatcaatatcccaaatcaaaaataaaatccaaaccctaaccctagctgcctaccggagccgccctcctcatggtcgccgtcgtcgctgccattgtcgccgtcgtccgtcgtcgtcgtcgatatcgccgccttccgccgcgaccggctctcgagcccaccgccgctcccagccgcgtcgccacaccggggagggggagcagcagccgccgagcccacatgcggtcggcgtcgacgccaccacttccgtcagatccaccgcgggagggaggcgagaggggttgaagggagccgccgccgccggatctgtcctcggccgccaccaccacggccggatccacccacggtcaccgccgacgccggatccgtcgcacgagggaggcgagaaagagggggtagaggcgccgctgtggagggcgagggggagggggagcggcgccactgtggagggggaggggagaggcgccgccgtggagggggagggggagcggcgccgccggggggggggtggaggagcggcggttggagagaggcggtgccactgaaagagagggagggggtggggaatgtttttagggttagggcttgatctttcaacttttatatatagggcgcgatcaatcagtaccatccatcagatcgaaccgctcagcttctccctcgtcgggccttcccaggccgcccacactattgggccgcttgtcacagaataagtttacttaatgtccctaaagctgtcccgaatttgttctactccgcatggaataagttcacttgaggtcccttaaattgaacttttttttatttcattaggaatagattttcttaaagagctcatatcatgtaaaactaaatcctaatcatctaatatttttatatttaatataattttagtttactcgttgcaacgcactggcattttttctataatctataactaatataaatattcatatttttcctttcgtcacatctattttcgtcccattcgtccacgtgctcaatctgattcggttagcaatagccatggaaaaaaattgcaaaaaaaaagggcggccgccgacgccaccaccgccgccgaagggagcgccgctgtcggatccgcccgcggtggccgccaccgctgatggatccaccttcggacgaagccgacgtcgctgttgacgccgacggggagagggagagggacggccgtcgccgccgtctccgccgcaccccgccgtcgctgcgtcgtgtcggcgagatgggaaggagagccaccgccgccactgccgctagcgtggtgaagggcgccgccgccgctcgccgtgggggaagccgtggccgctagcatgggaaaagggcgccgccaccgccaccacagctagcgtggaggatgggagccggtggtgggagaggcggccggctggggggagagggagaggcgggagatggggagaggtagcagcgccgccggaggcgaggggaggggaagcggcgccggtggggaaagggggagggcgagaggcggcgtcgggagtgggggaggcggccgactcggcttgggggggagggggagagttagggttacggttagggttttcataaggtcgtgggccgaccggcaacggacggaaataagtctatttcaggtccctcgggccgaagaaaaagagaagaagttcatttttagtaatttatttttttcagaagcattacaaatatagttattatgtgtttattttgaagcaaacctaaaaggaagtattttctttctttttctaattaaataattgttaaatgatgtttgtattattaaaattagcaatttagctctcaaaattccaataaaatttcaaagagcgcaactaatcatggagaatttaataaaattaaatttaaccatatcattttatttctcacacttgctttacttgtaaatttatttaattatacacatacctacttaaaaataccaaatatttcagcgaatctgtattttaattaattgcatatttttctgatctgtacgcttcccggtgcaacggacggacacttttgctaaaccaaacaacacttttggtcaatatacacactccgtaatcacccggtgcaacgcacgggtacttttgctagtagtaatataagtacatgcccaaggtggacctggtctggggttaggcaattttttttttgataaatctaatggtggtaaataatgggtccacctaatttaatgaaaatcaattgctagggaacttttagaaatttctctaatttattatagtgccacgtggcgacttaggaacgtttataagatgacacgtggcgaattaggagcgtttgtaggaagtttaatggacttttagtatataatagatagatatttacttgttctctaagctgttatgagaaaagatcgagctctgggtaatagaagtgatcaagaaggccctaaatttaacattagtaatgatttctcccaacttgaaccaaacaataattacttttactaattattcatcacacatgatttcacaacgtgacttcatctagggatgaaaacggtcggaaatggtcggaaacggtatattattttattattttttcgaaaacgaacggaaaagatcgggaaatttccatatttataaattcatctatttaatgtcaacttcaatgctacgctgatagaaattaaaaaaactaaattttgaaaacggtaacatcggtaaaaatattattattatattagttttgcggaaacggtatcggtacggtcgggaaatttcaataccgtttttaccccgtctcttcatcgcatcagttttgcagcaatgaatcaatgaccaaaggccgtcctatatccagatttcctgttcagttgtttcggttcaattagtctttgcgtccggccacccacactctttagctgtgggcgtgttaaagatgaaatgcactacgtatcattgattgacttggtgtacatggtatgtgtggcattacttaaaaaacattttttgcgaacatttccccttttgtttttcctagactagttgggttaaaaaaaatattgtatgtaaaaagatttagataatgtctactctctccgtttcaggttataagacgttttgattttggttaaagtcaaactactctaagtttgcctaactctgtagaaaaaagtagtaatatttacaacaccagtataagtttcattaaatatataattgaataaattttcataatatattgtctttggttaaaaatattactattttttatataaaattagtcaaacttagaatagtttgactttgtccaaagtcaaaacgtcttataacctaaaacggagggagtagtaaagatcgtttgtgaaaattcataagagatctacatgcgaagaagggatttttgccggcggtagattttggcccgcacaagataaggagacgtcatatccctctccttttgtctcctccctcccaacgtcaagtcctctactcatctccctctctttacttcctcactcatctctcaccatctcctctcccccaccacctctcgtccgcattttcacctcccctctcccccaacacctctctcaccccaacggctagcgacgggagcggccggacacgctcctcggcgttgacgagccggacttgacgcacttggtgttgggggtgatcgccttgaggatggagtagtcgcgtatctcgaacacgtggtgcccgctcgaccttacagcgacggctgccgagccggagccggagccctcaccagcgtagcgactggtggtggcggatgatgacgacgacggcgacaatcacgaccacgccgtgccgttcggtctggcggatgaggagtaggcgcccatgtacgtaacgctctcaaagtggggaacgatcagggttttaaaattcaaaattgctatttctatcggaggcattgaaatttcggaaattttgaatttttttggccgtaattatttgaaatttgaaatgaatttgaataaaatttgaccaaattcataaaaaattgcaaaaaaaaaaacaaaaatttcgggcgagatataaacttgccggtggggggcgaaataaccgaaatttcagaaatttcgaaacgaaattccaaactctgggaacggtcgatcagtacaactagttttgtagtagaaaatctttctcgcttatgatatctaggcaagttaaggatttactattgtactattcaaaatctggatgacaacctggactctttgggggagctagagattatgtaagaaactgcagctgttaggaattccaacaaacgtagtcttgaactgtttgggggacttgaagattctgcggaaagttgcagctgctagaagctctcccaaataggccctctaactcccttcaaatataggtccgatctgattcatatttctcgatccccaaatattaaaactggtgcaaaataactttctcggtggttttcactgatgtggcttgttgacctagtccaaccggctaagtcagcatgtgggacccaaatatcatcctctctctcattcccttcttcctcctctctttctccccttatctctctcccctttctctttccaattcgggccttcctccctgctcggctcatcatgtttctcttctccacactggtggtggtgatggcaactggcaagtcacgaggggcgaggggggtagcggcggctggtgacgagcactccccctcccccgctctctctatctctctcccaacccagggcaggcatgtccctggggctttgcggccagcacgcctgcatagggcccccaattttcagggcctccttggcccaaaactccaacactatatatgtatatagatgtagcccaataagtaatttggtagcccaattagccctgaaaatctgttatttgtttcttcttttgtttacgttgttccgccttcgatcgcggcatcgcacagaaaacgaaatgacgcctcgcctctctctctctctccgttcacatcctgcacattgccgcggtgtcatcgctaagtcctgacgccatgtcgtcgtcgccgcctggaggatagaactgagaaactgacgcctgtcgcctgtgacccatcgtcggcgagcctacctgcctatgcctgcctactccctccgtcccaaaaaaaagacaaaccctggtttccgtgtccaacgtttgaccgtccgtcttatttgaaaaaattatgaaaaaattaaaaagataagtcacgcataaagtattaatcatgttttgtcatctaacaacaatgaaaatactaattataaaaaaatttcatataagacagacagtcaaacgttggcacgaaacccagggtttgcctttttttgggacggagggagtaagtccttgccggctgcagcgcctgacggcctgagtgccgacgcccctgtcccctatgcctagtcggctactggctggtcgcctactctaatcagcaatctggtaatgtaatccactaatccctattctctaattttagtgtatcatgtatagattattaggcttttaggttcatctactgtatacattaaatcaatttttttctttacatagttacatcctgtattttaattttgaagacatgtcttgaaaaatcggaataggaaatatgactccgactatgaaaagcgtaataagaaaaaaaagaatagaagatctaactcaatctcagagaggggctatgtttaggtatattacaaaagaatcacaaggtccatccggtgatcagacacttgatagtgatgttgccaatgaacctaatgatggtgaaacagagatagaaaccactgttgacgatgttcttagtgagagcacacatgaacaagtggaaaatcatggtgatggtgataatgttgatgacagtagtgtccatatcgatttggacagttcagacactgcttttcagcctgaaatttttgatccaaggtgttgggattctcttgatgctaaacaacttgacattcttgctcaattaggtcctaaaagggacttatcaattcagaaaggtcctaaagatagattgtttaggagatctgcattattatacaccagaatcctatcaaacagagagaagtatgatagagattggcttgtttattccaaggaacttgatagagtattctgtttctgttgcaaattatttacaaaaggaagagagcatcgctatcaaaggtcagttggcaaatgaggggttcaatgactggtcacatttgagttctagacttagagaacatgaaacaagtccaaatcatgtttcaaatatgaccaattggtatgaattgtgtaatagattgcagaaggatcaaactattgataaagctgcacaacgacaacttgagaaagaaaaggatcattggagaaaggttttgttaagaattcttgtaattgtaaaattcctagctaagcataatttagcattccgtggttctaatagcaaactgtatgaagatagcaatggaaatttcttgggcatggtagaaatgttggctgagtttgactcggttattcaagaacatattcggcgtattacaaatgaggaaactcatgttcattttctcggacctaggattcaaaatgagttgatacatttgcttgcttgtgatgttaaggttgaaattatgaagaaaataaagagcgcaaaatatttctcggtcatactagattgtactccagatgcaagccaccgagaacaaatgtctttaattataatatatgttgatttatcttaaggtaatgtttccattgaggaatccttcctaggttttttgaatataaatgatacaattgggcaaggaatttttgatgtgctagagagataactaaaggatcttgatctagatattgatgatatgagaggacaaggctatgacaatgggtcaaatatgaaaggaaaacatcaaggggtacaaaagaatcttttggatataaatcctagagctttctattcttcttgcggttgccatagcctcaacttggcactctgtgatatgtcaaagactcgtggtaaggctaaagacctttttgcaatcatataatggatctatactacttttgctaattctactaagaaatggcatattctaaaagataatatgacaggattgattctcaagtcagtgtcaactactcggtgggagagtcgtgttgaaagtgtaaaagctattagatttcaatgtgcaaagatacgtgaggctctactccaagtatctgaaagtgataatgaaccattaactagtagtgaagctaaaggtttggcaaataatgaacttggagagtatgaatttttggtggcgatagttatctggtatgaagttttatatgcagttaatttagtaagtaagagcttgcaaggaaaggatatgcttattgatgttgcagttgagaaagtgcaggggctgatttctttcttcaaaggttatagagaaactggcttcttaaatgcattgaagatgtctaaagaaattgcacttgaaatgaatattggtacaacatttcataaaaagcgtgaaattaaaagaaagagacattttgatgagaaccgaggtgaagaaagtgttgcctcacaaactgcagaggattcatttagaatcaactattttattcatgttattgatcaagctatttcctctctcaccaggagatttgaccaatatcaaggttatcaaaagatttttggcttcttgtttacttctgacacattgctatcaaaggatagcaatgacttgaaatcttcctgtgatcgtctcgaggctgcacttaaaaaggatggaaaatttgatattgatgctactgaattgcatgtcgagttgatttttctccaaagtttcatttcccaagaaaagttgggccctgttgaaattttgaagtttttgaagcggcatgattgttttcccaatgcaactattgcatatagaattttattgaccattcctgtgactattgcatcggcagaatggagtttttctaaattgaagctattgaagtcatacttgcgatctacaatgtcacaagaaagacttaatggtttggctatcatagcacttgagggtggtatgctggggagaatcaatataaagctatcattgaagattttatttcaagaaacactaaaagaatgtcgcttttcaagtgaatattatgcacaggtatattattttagaccattttacattgctatcaaatatattatggagtataaattattgtcatattatatcatcaattatcaattaagtttttatccttctttatgacttcgcacatggcccccaaatttgacgggacggccctaaccgagggtgtagcaaaatcggggatgacatttagcggcttggacggcagggatgcagcctcgaagtggagcgaccaaggaggaaaaggtgaacgtgtccccgccagccttgaggtggatgacactagccttcctagatggagaggcggagacaaggcggcagtgaccttggtctcctcctcactgaggctcacgacaacaggctctagcaccgcctgcttttacatccccctccctgcccattagccgttgccttctcctcaacctccctccacccaagcatcgcgctggccattactggtgccgccaaagccagaagtaggggtgggcagaaaaagaccgaaccgaaatgactgagaccgagaccgaaaaattcggtcagcactttctactaaccgaatttagttcgagcaattcggttttagggctcagttaaccgaattgaccgaaaaaaccgaaatatagcattggcctattaggcccaatacctcctcagcaaaaccaaccttatccacccacaaccttatccaaccaaccaccaccagtatcctcctccatccatcgagcccttcccatccccatccccttctcccccgtgctggtgacaccgacggcgacggtggagctcccgcagtctgtcacctccgcgcagctgccctgtgcgtcgtctccgcctctagggccccgccgtgtgcgccgcctctagggatgaaaacggagcggatacggacggataatgctcataccatattcgttttcatatttttttaccggatatgaaaacgaatacggatagctcgaatacggaaacaaatatggattatctcgaatacgaataagaatcgaatataatcagacacgaatacggaaacaaatttttctcggaacacgaaaaccaactcaacgtctaatagaaataaatatcaacatatataattagctcattttatataaaatgtggtataatttataaatattttttaaaatttaaataatattaatagtatggactagtgttaagagataaactactattaaaatctataaaggtatattgaaggttatagagttagaaagaaatggggtatgtctcatgggtactgcggatatccgaatagcactgttcaccggatatccgaattattatctatatccgacggaaaccctgataccatattcgtattcgtatccgagagaaaatatccgtattcgtatccgtatccgaaatatccgagaattatccgatccaaaaggtatccgtatccgtttttgtccggagcggacggaaactatccgctccgttttcatccctagccgcctccgccctccgccgcctccgcctccagcaccggcgccggtgccgcctccgcctccgcctcggcgtcgcctccgtctccactctccagcggctgtgaaaaaaatcggtcagatcgagaccgagacagaatttatcggtcctgagatttttttggatgaaattcggtcctgagtttccaatgaccgaactaaccgaataacggaagaccgagaccgaatttttcggtctgaccgaacacccacccctagccagaagacaagggattgagggagagagaggggtggaggagagaaagggggatggcatgtgggccccatatgctgactcaatgattagactaagtcagcgagtcacttcaatgaaaaccacccttaaaatcattgaggagatcgttttatacctattttaatggtggggagtcaagatatgattgagtgacatgaatcagattgaacatatatttaaggagttgaagtggacttactccccaagtttcttatggttgatgcaacagccgagtcactggcccaacaagattagggaaaagggatcacaagaatacattctgatttctcaattcctcatcttgtgaccattagtccattacacgttacagctctcatcgccccattgaaccaaccatgcctttagaagagaatcactagatttcttatcggaagtgatccatcattcccgaacaccaattgattgttatttttcaggaggagaacaagtatatatcccttgttctagaaaacattcagaagaagcatgcctcgtatcttggcaaaggtgttcgtcaccatgaaattaattaacaaactaattacccaggaacgaagaacttgcttgagaaacttccacatggaacacaggaacagagctagccattaattaattaactaattaattgcattgcgctatactaattatacttttggcttgttcaatgatcgtgcatgctacgatagggactgcttctacagtacatgtcaacaagctgctttgcaatcattcaacgcttgcctctgcagctggaatctaccactgctacaatcaaagttgctgtgtgttgcagctctgaaataatctgaatacatgtgcagtcaatgcatcaaccaactccaagacaaataatgatacatgggatcatgcacttccactgcactctaataattctcggtatatattgttaattaattcaatcaagattcgcatgtacaccctgtttcgttttgttcaaccaataaccaggttttcaaggcggtatacttcagcagtgtgcacgttcgttagttttgatatgattcgtgtagaaactgaatgcatgtggagagaagctagctacgttgacaggtcacttcaccgatcagtgatctggatcgagaattagatattactacgtggattgtgacggttaaaatggtactcttaaaccaatggagatagtaaatactccatccgtctaaaaaaatataaacaataggttaaaaaactatagtgtccatcataaaattgaaaaaaaatgataagagagataatacgaggaagaagtgtacattaggctaaaactatggttttttttctcctaacagagggagtatctatttattcacctatccatcgtctcaaccaattaccactatttttcttttatagttttttcacataatttcattcttaaacaatcataatcttttactgtactttcttaatttccctaaaaaccatcctaggacaaagggttacttagataccatgcaaaattgaattaaaaaacttcgcccaacgtaatacattaaaattcaacgttgacgttttgaagaaggtagatctggtcaggggctttgtttcctctgtactcctaccccctaataattagttaattactaactcggttaagtaccacttttgaaagacaagacgcaaagtatccgtggttgagagttgagacttaggatgaacaaaaatgacaagtggctctatggcatgcgagattctgggctggtagtagtactaaatataaaccccagatgggctaatttaacccagtcggcagcaactgtgaaaacaagtttcccacgaacttacagttagtaattcatctccatgaagtagtaaatgcattatattccagtgatatatacttaaataccatatctgtcctatattaagtgcagttttagcactcaaaatttttctcctacagtgtacatttgtggcattgaattgttaaaaaaaaaacctacattgagatcaaaacgtgaaagagcatcataaaaaatctaaacatgacgatacttagacacaatatttattaacgaggttttagttgaagccaacatccccacatcctcgaagcattgattatggaagctcctctcttaatataggccgttgaccaatcgacgaagtgtcatgatcctcgaccggctaggccgttgaccaatcgtacccgcacatatgctaccgtcaccacacatttataacatgtgtgtatgttttaaaagagagcaagaatagtgtttgactctaattttattaaacacatactacctctatcctaaaatataatgatttttagttacgaaaatagagaaataattatgtttgggaaagagggagtattataactccaatttataagttgtagtacatatatttgacaaaaactttactaggaatcaacaaggtgggtcccaattcatatggaatggaggtagcacgtcccaaaactagtaaaaaaaactttagacgtggcaaataagtcctcacaaacaaaatgtgagatgaaattacatttatcatccggccagaactcagtaagagattcacaccgggttctattagctagagtatggctaacattattttgatttcgctgaatcttcgcgatgatcacttccctattccctgaaaacaattcttccaatgcccgtgacgatgaatgcgagctcagagcgtccttgcaccgcagactctatgaggttcttcgccaccaagcacgataatctaatcggtgccaatgccaatgctcttcatcctacctcagtttcggtggtcttttcttcctatttttattactccatccatcctaaaatataagggcacccgcaatgattatctataggctatctacaagagatctatgtcagcatatttttctacttggaagagattaaatgaagagagagagcgcgcaaagctatctactaacctggagatagtctatagagaaaaacgaggcaatggattagagagctatagatacccatgtagacatactattgaggtggtttactattaatctagtctattgctgagatgtacatattttatagagagcaccttattttaccattgtgggtgtcctaaggtacaactactcctaacacaaagaccaagaaagaatttaatcacctccttgattgaatcatatctatatattcaagcaatgtgattggaataattaatgtatgcatgtatacacgcacgccttatattatgagacagaaaaaagtggttgtgcctcatattttgggatggagggagtagctttgtcaacctctgctcgctcctgtagatagtaactaattgccttcggagttaatgttgttatcaatctagtttttcattttaatgaagccatttaaccctacccatataagcatcttttgaaaactggaccgggccggcaaatccttgaggatatgtcacctactattaaaagcacaatgccattaaatcttggaaaattcgctcccataagaagtcaaacccaggacctcaggtgctactgagtctcttgtaaccactaggctacagcccctttcacaatgtgattttttatcatttgtcttattaaaaagattatataaatatcatctatttgttatggttttttatcatgaaagaaactatactcttaacttatacttttaaatatttacactaaatatttaactaatataataattaaacgttacgtgaaaagttaacagcgacgtgatacattaagagcaggtacaatagcaggctataagccagctataagcatattttaaagatataaaggaagagagaagagcagcgggctacagatttgtaaccagctgcagcacggactccaagacgtaatgtaagtatgacaggtgggactagatattaatagtatagtaagcatctattgtataaattggttattacgttgtctagatgacttggagccagtagtggactatactattaaacttctctgtaacctgaatacccgcgtcaactcaaaatgagtacgtgagctgacccacacccaccactccatcaggcaggcaccaggcaccagccagcgccacctacccaccgccgccgcacgcgcacgggcttcctcacgtttgaccgccgccggccgacgtgaggcccacctcgtgtcacgttacttccgccccgtgggcccggcccagcccggcccgtctccaccgctcgctcgcacgcgcctgtctgaccctgcctgcctggctcgtctcccgaggaggctctgagggaaagtcaaccagaggggtggttgctcacgaattctctctcatttttccggacaattaattctttattcttttccggagactcacgaattgttttattttcttttctactcagctggatgggagtgttggcactgtgacgaatgcttttttttttggtcgagaaagggattaatgatatttggacggacgacatatgtccacggttgattggaggagcctagctggctccttccgtttcggaaaataattaaagctcttaaccataattctttttcaagaaaaactttcggtactcatccgatttttttttcgcaatttttagcgtctccttttttttcacatatcactaggacgtgtgatagatgttgggcttgttggcttgggctaaattgcaactagtcgtgaatgtggctggatgcagtacaatattatctttacaaattttactgcatttgttgtaaatgctgtggctgtacagccgcagctatgtccaccgaacacacccattatgtaagagctaagatgtggttttacacttctcttatactagcgtagattttctattattaaatcatatgttctagagaatattgacgtaccatataaatataggctaaccctttataaattttccgttagaattatatagatggcataactatacggagcaaacaatatcatcaaacgcgagcgacttccccatggtcaacaaatttaaatttatagacgtcaccatactgaaggcgttggtgatgaagctaatccaagctgcactatcgtatagggtaaaccagaatcgtaatactacacagtactatcacgttcaaaaa

SEQ ID NO: 62220 - DNA, 2123 bp, Oryza sativa
  unsure (1)..(2123): unsure at all n locations
tgctccatgcttgaacaggctgatattgccctgtataatctttttgctgtgtttttggagtttgtcttgtcaaaaaggcagtgctcaaatggttggttggaacggctaccatgatgtggggaacgatagaaatgggcttaaaaatttcatccatgagtgtgctgtcatttttcttttttcaccgagagagagaaggaagcattgcttttcagatagtaacatcttcttgtcttatttttggtagtgagggttcatgttcttctccatatgctaactgttggaatgagctggatctacaggaatatttaacttataaagattagggactgagtgcatgtgaccattattggccgttgacgtgctggatttattttttttttgttcatcattagtttcaaagattcctctccccgagtagctattggttatgcctttgtgttctctttccatgaattatgtgtgacatgtgagaaaagaatcagtgattcactctttcagaaattggatggacgtgtagaattaataaggcggcttgtcatgttccctttatcattctctctgtcaaaaaaaaaacggtgctactgatctttcgattgacgtatccttgtctgaattttacgcttttttttctcatgtggtccatgaaaaaaaaattattttggtgctaaacttagctatcaatgttttggccaactcactaaatttcttgcatatatatcctcttttgcatattgattcagattccttctttgacagaatggggagctcggagaagaacggaactgcttatggcgagtacacctatgctgaactggagagggagcagtactggccgtctgagaagctgaggatatcgatcaccggagctggtggtttcattggatcccacattgctcgccgtctgaagagcgaggggcattacatcatcgcctccgactggaagaagaatgagcacatgactgaggacatgttctgccatgagttccaccttgttgaccttagggtcatggacaactgcctcaaggtcaccaacggcgtcgaccatgtgttcaaccttgccgctgatatgggtggtatggggttcattcagtccaaccactctgtgatcatgtacaacaacaccatgatcagtttcaacatgctcgaggctgcacgtatcaatggtgtgaagaggtccggctctctcttttttttttacatatttttactgttatatctcagcttagcctgagcttgttttatccatatcaattcatttgttacaactaatggtcctacaggttcttctatgcctcaagtgcatgcatttaccctgaattcaagcagcttgaaactaacgttagcctgaaggaatctgatgcctggcctgctgaggtttgtccatcaaaataattttaggctttagtgttatgttttagtaaaaccagaagttgatttcctactgttttaactactgtccagcctcaagatgcctatggtttggagaagcttgcaactgaggagctctgcaagcactacaccaaggactttggcattgagtgccgtgttggccgcttccacaacatatatggcccctttggaacatggaaaggtagaagtttaaccaattctccaagttattgaactgtacttgtactggggcatccttaactcaatttgtcaatggataggtggccgtgagaaggcaccagctgcattctgcaggaaggctcagacttccactgacaggtttgagatgtggggtgatggcctccagacccggtccttcacattcatagatgagtgtgttgagggtgttctgaggtatgcagctacttgtcacattattatctagatagaacactaaaccacacctgattagatgagaagctggtctaatatgatacaaacaatttctaggttgacaaagtcggacttccgtgagccagtgaacattggaagcgatgaaatggtaagcatgaacgagatggctgaaatcattctcagcttcgaggatagggagctgcccatccaccacatccctggacccgagggtgtccgtggccgtaactccgacaacaccctcatcaaggagnnnnnnnnnnnnnnnnnnnnnnnnnnnnnnnnnnnnnnnnnnnnnnnnn

SEQ ID NO: 62221 - DNA, 1498 bp, Oryza sativa
cgctgccaagaccaacgccggcgccgccagcggcaaggcgcgcgccgtcgccgccgccgccgccaacaacaacaacaacgctgtagccgcgaccaacgctagcgccatgttcgccgccaagaacgctgccgctgatgctgcgaccaacgccgctgccggggccagaggcaaggggcgggtgggcggcggcaagaaagctgctgccgctggcgcggcgaccaacggcggcggcgccaaggcggcgcgcggcggcgtgaggagcttgctgatgagcccgctgagaggaggaggagcgtgtgggatgggggaggtggatgtgagggcggaggtgttcatcagaaagttcagggaggagatgaggctgcagaaccagaaatccgccgaggaattccaagccatgctcgcgagaggcctatgacacatcatcatcttagtttattattagtcatttgtataataatcataatctaagcatgattattaagagttattgataggtagctatggtttggagtttggaagatttttaggggcttaggtaggaggagattatgtcgtgttcttaagattgctatagtttgaatttggagtcttttcgtgtaaatattagttttatgtaggattgttgcattcattggttgcatggatgtatattgctgggtgtttatcacaattcacaaggaaaaaaagaaacagggatttccggcttgtttagatcatcagtttgcatactctccaggggaaaaaaaatcttgcatgggtaacggtgatcatccgtcgcaggagaaagtataaaaagagtctgaatcatggtaaatacaatcgagtcacttacacacaaaaattagcacttctccatcctgctttgtacattacgtatccataacttcggcatctcaaataagcatatgcaagtatgcaactccttttttccatatcatttatagaaagatcagcaatacaaacacaaccatccggacaagaggatggtaacatctggaagagaagtagagagctcttagctctaaattatcactccagttagaggaagacatagccacagctaatacattacacaagtgacactgcaaggcagagtgttgtgctcatatatgagcaactatggagcatacaaggcctaatggaggaaatccctcataggatcatcatggtgaattctcttcatgcggtaagcctccatgtcttccgcggtgacctcatcattccatttcacattgtacttcctcttcctttcatccatctcctctttcctcctcgcaccctcctgcaaaaaaaatggaactcagtgtcagcatctacataaataaatatattgacagaacgaaacagataatataagatgaaaggtgctaaccttctttagggcttcatcaagcagcttcttgtcaagaacaatatcattaggcacatcagttccccaggtggccagtcgcttttcttcatgtcgtacaggctcatctgcattggcaatttcagg

SEQ ID NO: 62222 - DNA, 2333 bp, Oryza sativa
attcctgcagcccagaaaaacaaatatgtccgacaaaaaaaaaaggaaaaaaaaggaaaaaataccgaaacgaatccgactacatcgacgcggtaaaaagagtttaaaaaaataaaaagaaaactgtcctattccaaagaaaaatgaattatatgtatcgtggagaaaaaaaaaaaagaaaagtccgataaaaaaacctgggcggaaaaaaaccgggtggaaaaaaaacaaatctgtccgacaaaaaagaaagcaaaaaaaggaaaaaaatcgaaacgaatccgactacatcgacgcggtaaaaagagtttaaaaaaataaaaagaaaactgtcctattccaaagaaaaaggaattatatatatcgtggtaaaaaaatcgaccaggcgaaaaaagaaaaaaatagtccgatccgaaaaaaacaggagaaaaaaaaatgggcgaaaaaaaaatttgtccgataaaagaaaaggaaaaagctgaaaagaatctgactccatcgacgcggtaaaaaaaggcgaaaaaaaactttccgataaagaaaaaggaattatatgtgatgcggtaaaaaaaataaaaaaaccaggcgaaaaaaaagataaaagtccgataaaaaaacggggcgaaaaaaaaaaaatctgtcctatccaaaaaaagccaaaaaggggaaaaatcaaaacgaatccgactccgtcgacgtggtgaaaacagggcgaaaaaattccaaagcaaagggagaaaaaaaatcaaaacgaatccgactccgtcgacgcggtaaaaaaagggcgaaaaaaatccaaagtaaaaggaattatatgtgacgcggtaaaaaaaatcgatcgggcgaaataaaccgggcaaaaaaaaaatctgtccgatccaaaaaaaggggaaaaaatcaaaacgattccgactccgttgacgcgataaaaaagggcgaaaaaattgtctatttctaaagaaaaaggaattatacgtgatgcggtaaaaaaaatcgaatcctattatatctagaaaggtttgacactatgtgaaagtggtgaaaaaaacccttcgtaaaagaaatgcacgagaaaaaaaattaaaaggacggaaaaaagcgcggaggaaaaaagtcaaatttatattcgtcgttttttagtccatttatatatcttctttatctctaatctaatctaatctaactataaaaagagaagtttctatagtatattaaaaaaggaaaaaatgagcgagaaaataaaaacggtttaaaaaaacacgtgagggaaaaatgtcagaaaaaagcacaaaagaaaacgcgctagaaaataaagtttcgtagttctaattttctgattgttatcgacatggttatgcatgaaaaacgtatattatcattacgttttttcacccgttgcaacgcacgggcatatttgctagtatagtactaatgtataaattaaataaaaaagaaaaaaaagaagaagacaaaaacactcgattgggctacgtatccagcccaaattggatttgcacatgcgagagagagaaaacagcccgagttcatgaaggagacctccatgcagtcacaaaggagacccatgtgaagcatctcaaattgcaaataaataaataaagcaacgccgcaaaatcatcagatggtaaaagaatattttacttaatggaaaaggggggagcaatgctctcctagttcaaaaaaaaaagagaatattttacttccctgaattatttcactagatcatttaactccctaaataatttctcggttcattttacacctcgagcggtatttttcttatttctctctctatatgtcgtaatttgcaatgaaatttggtattatcaattttttatctagtctttctcacaaaatgtcttttctttctcagatttatagaaacattaaaagataactgattgagcaataatttaccatatttcatgataggtaattctgtgataatgcgatcaatatctggatggtaacttatctcaatctcagtaaatatataattcgtctcgaaagccttccacgagagctggatcgctcgagcagctcgagcatgtcgtgctcgcgtgggtggtggaacgacctcccgtcggatctcctcgcgctcgtcgccggctgcctcacgttccaggcctacacccgcgcccgcgccgcctgcgccgccaggcgcgccgccctccccgcgatctcctcgccgtcgctcctcgtcctccacgacgaccaccgcgaacgctccagcttctccgcatggttcttgtcccccaggatctccatcgctagcttggccaccaacctgatctctactgggagggcgcagcgct

SEQ ID NO: 62223 - DNA, 3076 bp, Oryza sativa
cgcctccccgccggccgccgccgccgccagcgaaggccggcgtcgttcgagccactgttcgacaaggcgagcgccgtgttctacccggcggccgcgttcgcgccaccgcacagcacgggcgacaagtacctggtggtctgcgatgacggccatctctaccagatctggatggacgaaaagatctcctatggcagtggcgccatagcatccgttctcaggtactaccctcgccgccggccgtgctggctgccggcgaaggatctcggcgggcgctcgttcttcgtcggggtgaacaacgcggtggcgctgcgcgtggatggtggcggcggcggcgcgtcggggctgagaggcaactgcgtgtactggagtgccaggtgtagtagccgggccaaggtgttcgacgtggagtccggcaagtcggcgacatgctttccggtggtcgacttggagacgggcaagtcggcgccgggctttcccggcggcgcggaagctcatagagccctctgctggttcttcttggctgatatgcgtagcagcagcagcaatacgagagtgggaacgtcggctcatcagcttcagaaaagggctcgtcatgcatgaattatcggaccgagttttataagactactctcgctccgcttcagattacaaacccttgttcattttgaaggattcctaaagtaaatctcaattcctttggaataagcactatttatacattccgtctgtagaaacactatgccaatcctccaaaatatgctaattccatagaaatgaaaacatccacgccatcctcttttctttagctcagtgtaggtctataggaaaaatttatgtgttccaatcttttttttcacgtgcatttctacattatttctacgtttttattattactgtgatttgatcaaagtcaaaccccactctaaatttgatcaagtttgtagataagtatagtaatatttacaataccaaattagtttcactaaatctataattgaatatatattcataatatatttgtgttgtgttgaaaatgttattagttttttctataaacttagtcaaatttgaagcagtttaacattataacttgaaatggatagagtaaatgatatcccgtacgttgctaagaaatgacgatatcccgtactttgctacgaaatgactatgtatatatagatagctcgacaacatatgcaagctagatagatagctcgacagcatatgcaagttatactaaaaataagaaggaatgaacaaaagaaaattaaagaacttagaacttttcgattagtttggttgtgaagatcaattgtgttctcaatagaaggaaacacacatgaataaagaaaaattcaaaaggtttttaacttcagtttgaaatgagctgaggctgagctgagatattcttctagctattcaatggtcaaaacttttatggtgatgtggctcaatgcatgttgaacttgtggttccaactataccgtatttgtagctaattagtagattagttctaatgcaacaaaagttcataattttaactttgatcctctttgacatagcttcaggtctaaaaatttcatatacctctaggtattactaacttcacaaatccatatatttatatatgcgattatgttaataacatttggataaataaattttattctcattttaaataaaatttatttttaaaaatcactataatttaatatacaaactccaaatctaacgtggatttgatatctagagctgcgcttgtatgatctaataacattagttttacttgtgcttagagaataaataaatttccttaaaccatgatacgtttttcatgagcgcgtaaaaaacgaatctttagatctagttgatggtatctagttggtgctttattaataattaacaaaggcacacatatgaccaggaatgtttcccgtcgcgcggccgattccatctgacgctttccatcatttcctctgcaattacaaatatatagctatcaatctacattgttataatacttaccacaccgataaagaaaatcttttctttctcggattaattaattgattactacctccatattttaatgtacgacgccattaactttttgtccaacgtttgactattcgtcttattaaaaaaaattatgtaattatcatttattttattgtgatttgattcatcatcgaatgttctttaagcatgacataaatatttttatatttgtataaaaattttaaataaaacgaatagtcaaacgttggtcgaaaagtcaacggcgccaaatacggagggagtaatttttaagattatacagaataatagtttacccttttgccctctcttatacttactacggtagttttgagataatccgatgaatatctttaactaacttaatcacccagatttttttcttctggatgatcccaatctcaatctcataatagttaattttatccgaatattttgacgagagagcaagcggcggtcgagtcgatcgagcttggccgccatggcgcgtgggtgggaggacctgccgccggacctcctcgtgcacatcgccggtggcttctccatccaagcctacacccgactccgcggcgtctgcgccgcctggcgcgacgccctccggccgccctcgccgtcgctcctcgtcctccgcgaccgccacgccgggcagcgcttcgccgcctggtgcgtgtccccgaggatggtctccaccgcgctccacgagacgctcgccgcgaggctctccccggcgagccgctgcgtcggctccggcgacggctgggtcgccgcccacgtgcccggcggcgccgtcctcgtgaaccctcacaccggcgacgagatcccgctccactctttccccggcggcggggggaataatgtggtggtgttcaaggtcgtcttcgcgccgaacccgacgccgagcgagttcaccgcggcggcgatcaccggcggcggccgcgttgtctacacgacgaacgggaacagcggatggaccgacttcaagtgcccccgcctcggcgctcacggcgacgggggcagcatcgccgacgtggtgtaccac

SEQ ID NO: 62224 - DNA, 8047 bp, Oryza sativa
agtcgacgttgtgctttcctggcgcagaaggtcacagtgtcgtctgctggtaccacctgggtgacgtgcgcagcagcagccgtacgagtgtggcaacgtcatcagctcatcagcttcataaaagggctcgccatgcatgaatcagcccaagcttttttataatggttttgctatttcactcgcgatagatttttgaatttctatgtttcaatttttagtctgtaggatttttcatcaagattcgtattcctgtgtattcaatttgcagttacattctgttaacatttacgcttagttatatagcacttacactaagttaaagtgcacaaaaattagatttttacaatagtttatttcctctagatttacaattttgacttttctttttatgttgtagtttcatttaatacgggatatattttacagtgctttaaaattgttttcgaccatccaattaatgttgatccaatgttcattggaggtaatgggattggatatgatctgtgatccatgcttgactttctttttccggtgcttgcatagaattatcttagtactatttcatttaagtctactctgcttttggacccaagaatttttttgaggtgaaagcttttggacccaagaattcagactccacacccgcgtattatgcaaatctattaatttcaacactggtttcaactgtacatgattcaaatgttacttatctgccaaatgaatttaatctttgtcacgtcagaaacctagctgtatgcctgtatctctgaagcataacttgataagtttcagccaaagttatgcaaacgaatcttagaaattaagcaaatggtgacttatctgttgacttttccactatcaactcgaaaaaaacccaagaaacacagcaaaatctgatgcaccgtaggggagtacttggtttggtgaaaatgcgatctaatgatgcactcaaagtttttatctgttactcttgcaaaatatcaatgcaatcaaaacaagacaaatcatttacagaaagcaggaaataaacatcgaaggcaattttctccattactgatgataagtacaaatgggcacgctctgctcatcttgtcaataggaatatcagcaaaggttctgcttttttttttcacccttgtaaaggtaaaggccagtaggccattataccctaaaaaaaagaagataacactaaatatgtaaataataacatgccttattctaggacagtataattagcatatcacattgtcccctattccttaattatagtcaaactgcacatctatatctcaagtttccaccattgtaattcttttgtaactgtccttacctcttgcaagctagctactgcaccatgtgagattcttttgtaagctgttgtttctgtcctcttctaaagtataaaatgaacaccatgtgtttatgtgcctcctaattattttttttcaaaaaagatgtgcctcctaattatgaccagtgagattttcttctgccttccttctctatctacaacaaaaatattgttgctttttgttgtctcctcctgtgtgtgtatacttatgttactcttggaccaaattaccatcaaatgcctaaaggggcacctgaattccgaacccaaggcccaaaagtctctttgtaatttttttcctcctatataattgtggatatgctgtttccagcaggcgctgatgcggcgaatggactctcaggcagcagttcaatctggttactgcagttagaaatcaaatgaagcaatccagtgaacaaagaggaactagctcaatgtcaggtagcaacatatatgcaagaaattggctgcaaatatgtttgtacctctcatggtcatcataaatgttgcctgcctgtgtaggaggagcttggctgtttgaaacgatctccagtggatcaggggatgcaagggatggattcataaggtcgagttgtttcgaatctgttcacaggaaaaaaacgccgcataaaaccatcaggatatttggccgtgcactattcagtattcactatactattaaaacatttctccacgcttcaaaaaatatgttttggtaagaaacaccgttcttctactgcacttattaacctaatcattaagttcattacttaaattatttaatttatcactataatcaagtagataatccttgagccactaaacaaacttcaaccagggagaaatggaacaactagaggtataattctggcaatgaccaatgaatgacacaacacacagaccatcctggagagaatggaggggactggcgtcctcaatgctgcaatcgaagtatgcaaactgtggcggcatggattcaagcctccgaactgtggcgcgccgcctctccatctccaagagcatctcgcgcttctctgccaactgcttcctcatcaacctcgaagcatcatactctgctgttgcacaaaattgaagcaagatgaaggttgagaattaatcggtgcccattgtgatgatgtgtgcatgcaaatgctattatacctgtgtagagctcttgatcaaactcaaagaagcgtggaggacagtagggaaccatcgatttgatgttgtccacgcacgtcctgcacgtgaaaattgcaatatttataaaaactttaattaatttaatttgctcgtcacaaacacaaaaaagtagtaacagctagaagtactaacaagtccatgggaaacaccatttttaataatttgaaaactctactgtgaattgaactatctgttggcaagaaccaagaagggtaatggttacctgtcgacgcatttggatttctccctgtagggcttgacgagaacccgcgatccgcagatgaaatgcgggttgcgccgcatcaggatggtgctcaccgtctccgggctctggaagctgacgaacccgaacatgcgccgctcttggcaggggatcctcacgtcgcgcaccggcccgtactgcctgtcaaacgcaatcaaacaagcgaaaatggccatgtcatttaagatttggaaagaagcaaacaagttgcggtttatacatgccgaattgcagacccgaagtagttggcgacgtcgtcctcggcgaaggtactctcggctgggaaggtgaggtatatctggtgcgagctcgccggaactgagcccgtgtcgccgccaccaccgccgccgccacctctgaaatccatgtacttggcagcgtcctccgcgagaaccaccgaatgctgcccgtgcggcctgttcgtcagacagtaaatcaatcaatcaatcaaattgagaagaaacaatcaacaagattgatagagaagaaatggaagattattttggcattacctttcgatgacccgtatcttgttgaggcgagagagcagcctggtgaggctgtatccggccttgccatggcgctggctctcggtgaggtagccgtcggcttggagtcccttgccgtacttctcgccgtagagcgtcggcagcgaggcgatggacaccggctgcccgcgccgcgagttgagcagctcggtgatctccatctccagcgtctcgagcgagcccggcgtcacgccgcctggctggtggttgtacacgtcgccgttgatggcggcgccggcgagcgcgtcctggtacacctggtggtgcgagtagtggcagttctggccgttcttgcagatgcctttggagaagtagtggcagggacgtcgagtggacagcccgttcgaacgccgcgccctcgccggcgaccccccgccgccacccccgccattggggaaggcgtcctcgccggccgggtagtagtacccgccgccaaagttgttgtcgtcgaggacgtgttggccgccgcgcagcgggtacgggccctccgcggaggcgtcgacgacgagcccgggaggcgcgaactcctgctgcgccgccttagtcggtggcgccggcggcgagtccggccagtactgcggcgactggacctggtatccaaaggcagccgcggcggcggcggcgggagagtagtgatggcgaacgccgccgcaagcaggtaccggggggcgggagaagagctgctgcggctgctggtgatagcctccgccgccgccgacgccgacgccgccgccaccgggaggtccgtgcgcggcggcggcggagcagcgggcatagatgacggtgagcgcggctttagtatcctcgatcttggcgaggagcgtggcctcgggaccatatgcgagctgcaccaactcgtcctcgtcgggctccctcagcagcattacgccgaatatcttgccgacatgctccggctccaccctctgcaccctcgcgaacgccagcttcactaactccggcacctccattgccacccaccaccaccactggtggacatgaaacctaaacctagcctacctcgatcgatcactagacgcccgcaatggaagaatggaattgaaacaggaggaacacgaagaacaaacctgggcctccttttataacaacaaaggaggaataaaattcgagatcgatcgagagcgcgcgattcgatcgggtggatagtatcgcgcgcgcatcgatcgcatcgcatcgcatgcggggggatcgagcggagggctcgctcgccgatcgaagcctagtcgtcgccttggcccagttcaaacggggcgcgcgactgcctgcgtgcgtgcgtgcgagcgagagagaagaaggcggagaggtttgatgagatggagtggagtacgtcggtcgattttttgtcatttgcatgatatatttgttgataggggaaaacggcgatctgatcgctcgctgatccatatccatattgccggttcctgattggcccgcttatcactattagaatttaagataactcttggaattataaatggtaaaaaaaatgagagagaaaacgagaaatgctgcaaataggacaaacctcgtcactgtcatatgcatgccaaactgtttcttctccttcttttttttctctctttaaatttttttctcctaaactacttatccgatctataatccgatcacactgttgtattttttgtaattaaatatttacaacaagatatcatataattatattatgtcaaaagaaaaacatatattttaaaccattaaaactcaatgtttcatacgtaatagttatatgtttcgatgtatgttttcagtgtgtttcaaaaaatcttaaaactacctgccaccactctctcttctctctccacctcatctatgcatgcatacatttgagagcttcaaaatgatttttctcctaaactaattattcaatctacgatctaattacaccattataattaaatctttacaacaagatattgcataattaaattttgatgaaagaaaaacgtgtgtcaatccgttaacattagttatttcatatgtaatagcgatatgtttcaacgtgtattttattatgtttcataaaaattttaaatgtctggaacatgtttcacacgtgatgggaagattcttccgaaagaaaaaactcccagcgctgcgctgctctacttcttcaattcccctctttcttgctacgcacacacattagtctttgacgtgcggaatgaaagcaggttcccggtccttccaatggaatcaaagaaataaaatctagagctttccaaagtactactcccgataagaaatcacaggataacattaaaaggaccaatgaaaagtattgcaaatctgaaagaaaaatagataagaaaaatataaacagatctgaaaaaaaataaagtacacgttcagttttaaaacttgtttgtttgtgtcctccaagtctctaaatttttaaaatatggctcccatcggatggcctattcagccaaaaaaaagccaaaatttaaattttcaaacttaattttgacattgattttgagatattttcaacgcagtttctttttcagcattgccttttaagtcaccgagaacacatatataaaagttttacctaccaattcatttttattctctaataagccaaaataaaaaaaccaaacgatgaggccctatacttttaggtcccttaatttgctaaagtgtatcattctgatcctaaattgccatgacctgagtgatcgttggactatttttccttttttcttttttctcgcctttctattctctttcttcctttccgctcgtgtgagaaaaaatacaaaagagaagaactaatccaagagaagaactaatcctccacatgtgcaaaacaaaggagaggggaagaaaaatattgggacaggaatgtccgtgtagcatgccacgtcagtgccacatcagtgtatgttaggaactaatcctccacatatgcaaaacagagcataatattagcgtttgataagtaagtattagcttaatagatttgaaaaatagattaatataatttttaaggtaactttttaatataaggtattttttttagaaaacgtattatttagcaatttgataagcgtgcgcgtgaaaaagagaaaatagaagttagaaaaggacataaaagaacacaccctaaccatgaaaaaaaaaagatgatgagagtgataactaagcagaaaaaggtatatatgcaacaaaggactaatggaaaaaaaatacaattctaaattcatgcaaaactgatcggtataaaagaaatgggatagaattaggaaagagaagatgggagaaaaaactagggggttaaatacaaatagatttgtgtcttgattttgttagatttttgttttcattttttctaacattcatctgactgaaactatgtattgctaatactcgatgttacaagggctaaatagcaagcgcaccaatgtgcgctctgattttctagtttactttaattggcgcggtgatggtggagaggacgatcccgtattgttcgtatgtgtgaacacacaaaaaataagtgcaaaaaaattgtttttttttgggggggaggggggaggatgagtgatccgctcgactccctacatgcaagcaagtgatttgtcctccttacattgttagtactgtttggtgtaactatttttttataacaaaatctcatatgaacatatgactctattatgattaaaggaataatatgtggtaatcgttaaaacttgatgtttggtacgtaaaaatattgaatggtttcactagaattcggctgtctttatatattctggtttattttatgtactagtcattgttacttaatgttcatatagttttattaacgatgttgcaactaatatttttgaaggaaaaattccaattaaccccctaaactttagatggaagtctgtttagcaccctaaactttgaaaccgggcattcaaccccataaattttacggtacctttatataacccctaagatgatttttcataatggttatatgaactagaaggagatggcagctgagttgggcttataacaactggcaagccaaggaaataatctgtcttctattcttcgtgttccttttttgaaaggagtgaagggattctttaactgtcaacgagtgcctatcttcaatcagctatacctatgtatacctatgtgcacagtacactataagaaatgtcaattgaatttctcgaaaacacgatcgacaatctttccaatggtatataacacgatcatcataaaattctatatacgaatttatattaaactgaaattgttggatgatcgaaatggaattttcagtttcagacgagattccggagaccctcttgtccacgaggttgacaattcgacgccccacgtatggcccacttgcaggccagccaaagctgggacccaccacctgacggcctgaccccaccattcttcttctccaagcaaccgtcgacgaaaccccttctctccctatccattcgacgagagattgatcgagcagagcaccatggctgccatggcgagctcgcgtgggtggggcgatctcccgccggatctcctcgcgctcatcgccgacggcctcaccatcaaggcctacacccgcgtccgcgccgtctgcaccgcctggcgcgccgccataccggcggcctcgccgtcgctcctcgt

SEQ ID NO: 62225 - DNA, 9155 bp, Oryza sativa
  unsure (1)..(9155): unsure at all n locations
tcgccgacgtggtgtaccacgagaaacgcggcggcggcggcgagagggcggtgtactgcctcgcgacgagcggcgacgtgcacgtcctccgcctccacgacgccggcggcgcgttcgagccgctgttcgacaggggcaacgcggcgttcgacgccgccgccgcgttcgcgccgccgtacgacacgatccgccactgcaccaatgccaagaacctggtggtctgcgacgacggcgacatgtaccagatctggcggaacaacacctgcaccaggatggggccattgcccggcgggggagagtaccgcgtggagtacaaccagatgttcgttctgagataccaccctcgccgccggccgtgctgggtgccagtggaggatctcggcggacgctcggtgttcgtcgggaagaacaattcggtggcgctgcgcgtggacggcggcggcggcggcggcggcgtgccggggctgagagctaactgcgtgtactggactgacatctgtccagctcgggccaaggtattcgacatggtttccggcaagtcgacgctgtgctttcatggcgtagaagaccaccgcgccatctgctggtacttcttggcgtagcagcagcaagaagcccaactctaggttcagcttgtcagcttccggaatcggattgagaaagtttgattgaattggttatgtggtattggaagtttaggctgaattctgtgataagagacagaagttttggctgtcttcgttgctgtcattccgatggtaaaaaaaaaatgagatgcggaagtaaattttcagtgctgtgaaaattaaacctgtttttcattgtttcagattaaaatagtttccctgtttttgagtgtatctgattgttgcttctgtgatacaataatgtagctgatcgaagtttctgaggccaaaagcatggccatatggtttctgatgaattctggtggtgtagctagcaggtagacttgtggataaacttttcttttctccaacaaaagttggataaacttttggatacttgtggcatgcttttcaaactgctaaattgtgtatttcgtgcgaaaactttatatatgaaagttattataaaatatcaaattaatcaatttttcaagtttgtaataattaaaactcaattaattacacgttattactatttcgttttgcgtgaaacacttaatctttatcttcatcttcatcttcaggatattcaaacaccacctaacagtgatatattacagtagagttagatgaactgcaaagagatgtgctgatcagggcaaagccaaggaaataattctgtcatccattcttagaggcatcaatctttattgtagatgaaaaatgcagtgtccatattcaggcagatgtatctttgtgcggattgattttctgaaaatttgatcgactatatgtagcattaccacgagagcattcatgtatgaatttatcataagctgaaaggttggatgatggacaaggatttttcagacgggataagattgattgttaaagaaggtgtcgtgcaacaacgaaatgcagagaccagtggatggatgggttagttgtactctctgaagattgaaaattttcagtgcaagccgctggcaaatctttgtgcgtgaattaggaaacggagggggaacaaaatttcatgcaccgtgttcacatcatcatcaccctgtcatctccggcatcctttgagccactgttcgacaaggccagccgcagggtgttccaccccgccgtcgcgtttgcgccgccgcacgacatgatccgcgcctcctccaccaattccaagaacctcgtggtctgcggcgacggccatctataccagacatggaggtgcgacggcgtccacatactcgttctccggtaccaccctcgccgccggccgtgctggctgccggcgaaggatctcgggggatactcggtgttcgtcgggaagaacaacaatgcggtggcgctgcgcgtggacgacggcggcggcgcaccggggctgagaggtaactgcgtgtactggatagaccattgcagtgatgaggccaaggtgttcgacatggagactggcaagtcggcgccatgctttcccggcgttggcgctatctgctggtgtcatatgcagagcagcagccgtaatacaactagtgtggcagcttcagcttatcagcttcagaaagggctcgtcatgcgtgaatcggcctgagttctccgagactctctctacacctagcagcttccagttcgctttatataggattacatagtactccctccgtcgaataaaaaaccaactattaaatgttaacacattctattacaacaaatctaaacataccatatatgttcatatcctgtgctaggttagagtttttttaaaaaaaaaaacagagagagtagctattaattaggggtgttaggatatccttaatgcattttcagtgagtggataataaggtgggacctactccctccgtttcaaaatataaatatttttgaacttcgacatagtatttgagatattactttgaccaacaatatctataataataataataagatgttttaaataaaaatagttgcatatttaagatagtttgtttaattataaatctagtaatatcaattttagattgtttttatttatttgctattaatagtcaaaatttaaaatgtttgacttgacactatgctaaaaatgattatattttgggacggagggagtataaaattaagttatactctcttcatcccaatgtaatctcatcaaatcctaagttattatgggatggtttggtttgtggcataaatatgtattaccaaattttgtcaatgccaaattttagcaagttttgacatggctaattttggtaaggcaaagttttgtttggattgaagccaaaatagcctaagttcactattgaaatggcctattttcttagacatgccaaaatttggcttcaaaccaaatagacacagaatactattgaaattgccaaatattggtaagtctaatttagacctcaaaccaaaccagccctatattttaggatagatgatgtgttcatttaattctaagttcatcttatagacactcctccccaaccaacgtagcgtgccacacccccaatcctctccccaaccaacgtatacattgtaatagtctatttaaaggattgccagattacaaaagttctgactcgaacttcacctattcaatttctaagtccaaccttaaccagattatttgaaatgtgtttggattattacactaccaaatttagtagggttaaaaattagtagcgaagtgaacaggtcctgtgaatttcgtagcacaaaattttgttttgtgctaattatagagggaatgccgattgatgatttcatagtacaactatctttttgcgccgaacacaagatggaatgtcgattgatgttgtagcacgaggaagccggcggcacgaaggtggacctctatagagatcaggaaggtgttaagacaaggagaccggcaaagtcggttcagtgttctcccagtttgccttttgcattgaagaggtagcataggtagaggtagcactaaccattaacattgagagcaaccaacaaaatcctcttctagctgtcaacacaaattcacaatcaaccattaaccagtatccaacacaactgaatcgcaaaggccacgttattctggagtaataaacattgagagcaactacgaaagagcaaactaagctgatcatgagacgttgccctacacgaccaaacaaacaagcagaagtgaagaggtagcacgaaccaaacacaaagcccatatatgcaaccagcataacaaaattacaactgcactggacggcttatattcttcacaagcaaaaaagtagactcaggtccatatcatcagcatcgttacaacttacaagtaggtagattggaaaacaaaatgcaactcattatcccaactagcattaacagagggggtgggtcctgatgaacaccgtccacgttttattctcagcatagacaaagcataccggtatctccggctcggcggccatggaataccatggcaagcaaaaggattctactgggtcttggccatgtggcggatcaggtcgatgacacggttgctgcagaaaatagttcaaaaaagaaagatcagtaagagcaaattgggcatggagtattgtacatggttaatagtttgaactgcaagtggctcacctgtaaccccacnnnnnnnnnnnnnnnnnnnnnnnnnnnnnnnnnnnnnnnnnnnnnnnnnnnnnnnnnnnnnnnnnnnngatgctcgacctgagtcaaagatgagtacagagaatgaatgatagcatacaggagatagttcgtccgtaaccacttagtttggagcagatctgcattacagatttcttacagggcctctcaagacaaaaaggcatacctgctgtcaccaacaaagtcagtagaaaccaggtcttcctcaacatatcctatgattcccttgagctttccctctgatgcagacctgtaaaacaattagcatattctcgtcagggacacactactaacttaaggataacttgtgcagttctgcgcccaccaacacacgtaactacacttttctaggaatccttcacatgtatgtttcagtaacatacatcactgagcggtatcccctgccacaagatgcagttctagcaacagtgcgcaaaatgagatgtacattccccttgcgttggaagctatatacttacttgatagcactcttgatagcatcatatgaggcagccttctcgattctaactgtgagatcaacaactgagacatcgacagtgggaacacggaaggacattcccgtaagcttgccattcaaatcaggaagaaccttgccaacagcctgcaatgcattgatgttagaagtcattaaggctgcagtcccattttactaacaaaacatgctttcacaaccaaaaactaccgcccacatgcacccccttttccctaagcaggccagaaacaactctgaacagaagcatgaacagcaagcaattcgtcataggacatgagagagaattcatacttgaataaagacagcgcacatgctcatttatcaacaaaaactctagggctgaaatcagcaagcgcgccatttgtgcagttacttgctattatcactgggtcttctacttaacattcccaaataaagtcaaaaagaaaactatacgcagccccataacacaggagaatacaaaattattggaactataaagaggattttgaactgtggttgtgcatgcacaacattgaagttcatgacgtactttggcagcaccagtgctgctgggaatgatgttaaaactggccgccctgccacccctccagtccttgctggacggtccatcaacggtcttttgggtggctgaaaacaagtacatcagcgttagctattacagaacatctagatgttcatattagctgccaaaaagccaagaaagtcttaccagtgatggcatgaacagttgtcatcagaccctcgataataccaaagttgtcatgaatgacctattggatgataacgagtcaattaagaaccaaaccaaaagtccaactgaaagtagaaaattgtcactcggaaagaaaaataccttggcaagaggagcaaggcagtttgtggtgcagctagcatttgagacaatatcaatatctgaagtgtacttgtcctcgttgacaccgcagacaaacatcggagcatctttgctcggggcagagatgacaaccttcttggcaccaccctgttttcagaacagccatgtaagcataaaaaatgcaccgaaatagctaacttatgcaacaagggagatgcacaacaagtacttttcagagtaaaaataaacaaggcatcaagtaataaaaaaaactaaattgacaacacaaagccataagttatatatgctaatacttaagaaattaaggcaaaagaattaggagctgtctgctttgtgatgcatcatcctaactttagaagacttaggtagtcactcttaactttgcaggccaaatctttttgggtaaatgcaaagaccttgacatatatcactggggttcataaacttcaaattttaatgagctttccccttgtggcacatctctgcctacatttagttatgcataatcaaaaaccatggattgcttagtttcttttagttagataatgatgcttttacacaaaggtgtccatcattagcaaaatcgtgtaagattttgtaatctaactacatccattaattcttaaaaataaccatagcattatttacttgcttgtatgcaatcccatgggaacaatatgtaacaatatgccaatttgttggaatgaaaagcaacagtgataataccttcaagtgagcagcagccttctccttgtcagtgaagacaccggtggactccacgacatactcagcaccagcctcagcccacggaatctcgtcagggttcctttcaaattgcacaggatcaaacatcagttccacgctcgctaccataaacaagttactttcatctaagctgtaatatcaatatcaagttacctgatgccgaaaacggtgaccggcttctcgcccaagagcagagtcttggagtccttgatcttgatgtcgctgtgcttccattggccgtgcacggtatcgtacttgaacatgtaggtctgcaaatcacacgaccaacatagaattcatcaatcgtgagcacaccacacgaaaatcaaagccatatgcagtagcaaacagcataattcagcaactaaacatgcgaaaaaaagtactcagatctgggaaaattaactgccatatctcaatcaaaacaactcccaaccactaaacatctctttgagcgagcacgcaaatgtatatctgagctaaaaccactgtagaaccctacaaacgactagatctgcacatgaagacggtgaaacccacagatcgaagagcgtaccatgtagtcggtggtgatgaaggggtcgttgacggcgacgagctcgacatcctcgctctggagggccaccctggccacgagcctcccgatccttccgaaacctgaacaaaatcacaatcccaaacacacaaaaaacccccactcaaatcaccacaaatccaacgaaaccacacccagcacagcacaaactcgtagtaattcagatagcaaactcaccgttgattccgatcttaatcttgcctgcgtccccaaaaacaccaccagaaaattcaccaaaaaaatcagaaaaaaaaaacatcaatcagatcaggacgcgaagcaccagcagtaatcaaacgggggaattaattcgattcggaggtgagcataattacccatggcgagtggagatgcgaggacgacgagacagagacttgagattagaggaggagagaagcgtctggaagccggatatggagaggtggagagggtttaagcgctctcttttataaagccaagaggaaaaagtctaattaattattaataaagccaaatggaaccgagaaagcgtgaggaaaaaaaattaaaaataaaaatggaaacaaataaattaagcgcgaggtgcgtgggtgacctgtctttctttaccttttctccagaaggcgcagccggcgcagcgcaggggcaggcaggtgaggtgtcccgctgacgtgtgggcccgggcatgggcgaggcccacgtgtcattagctagtgacgcgcggcgggtagagtagagtacgtggcaggttgtggtttgtcgcccaagaaagaatcaggggaggtgaaagaaatagaaaagggcatatttgctccttcttgcttctgcaataatgcggggtaaagaaaaattgatggaaaaggatgtgaaattttgaaaaaagagaaaaaaaaagttgaactgatcgtgttgtggtgtggtgtgacatgggggtgttcgtgtcgaggtgtttctggctacgtgtcgtcgtttggtaacatattttaagaaaataaaataagaaagagaagagcagcgagctaaagatttgtagccagctgtagcatggacttcaagagacagtgtatgtatgacaggtgggatcaggtattaatagtgtagtatgtaactattgtatgaattaactattaagttgactatatgtgatttggagttagtagttggctaaacttgggccctgtttagttcacagatttttttcctaaaaacattacatcgaatctttggacacatacatgaaacattaaatatagataaaaacaaaaactaattgcacagttagggaggaaatcacgagacgaatcttttgagtctaattagttcatgattagccataagtgctacattaacctacgtatactaacgacggattaattaggctcaaatgattcgtctcgctgtttccagacgagttatgaaattagtttttttattcgtgtccaaaaatctatttcgatatctagttaaacgtccaatgtgacattcaaaaataatttttttttcttgaactaaacaggcccgtgctctaacagaaagtagccggcggcggcgacgggcgatggcgccgcatactgtttgtccggcactcacctgatcgaatccggatcctctgatgggtgtttgtctctgacctattggctattgccgattattaagagctaataatattcataatgacgtttaagttttgtccgaacattacattagtgttgttttgcagtatattccaaaaagaagaaacagtagtactaatattctacctcaatcaatatgcaccgtccattttatatttactttgtataacttataaataaaatcccaattcctaaaccgaggaagtattcatctacatcggttgtcaaaatagtctgtaaactttttaaatactccctccttctctaaatatttaacgtcgttgatttttttaaacatgtttaactgttcgtcttattcaaaaaatttaaataattattaattatttttctatcatttgattcattgttaaatatatttgttttacatatttcacaaaaaattttaaataagacgaacggttaaatatgtttaaaaatgtcaacgacgtcaaatatttagggacagagggagtataacgaaaaaggttacaaacattcttacaatgca

SEQ ID NO: 62226 - DNA, 9288 bp, Oryza sativa
gtgaacttatccctcgaaaattagatagttacggcccaaacatgctttctccaaaattcgcagactcacgtgcccaaatttgatcgccagccgaaagcccgaaaaaagtaataagtctattccaccttcctcaaaattcttgtgtacgccaagatacactccaacaacatggcagggtacatgagccccaactatcaataccatataatacttttgagatggaatttcatatttgacttgaaagtttttatgatttttgaggtgaaaatttcaaatcttttagttggaagttttcatgcttttaagatgaaagtttgcatactttgatttgaatgttttctggctttaagatgaatgtttttgtggttttaagatgaaagcttgattcgagataaaagttctctgattttttatttgaaagttttctaatccgaagatgaaagttttggactcgggatgaaagttttcagacttcgatttgaaattttcatgttaagacgaaagtttcatatattttcaggttgtgttgtgtgtttagttcgcgccaaaattgaaattttggttgaaattagaacgatataacggaaaaattagaagtttgtatgtgtagtaaagttttgatgtgatggaaaaattagaagtttgaaaaaaaagtttggaactaaactcagccaaacttccaatctctgatttttagttggaaatcaccaattgaaagtcttgacttcggagtccgatttcccctgatggagcacagcgttaaacgtctggaaaaagtctacaaaaagtagaatggacttataaaaaatatgttgcctaggcgtcttcttcaacggtcacggagcaaaaatgggtactgtagtccgtagacatcttcggtctacgcatcgtgcttctatgcagatgtcttgtttaagaaaaagaaatcaatttccgtttccggtacaggtagataggcgtacgctacgcgtcttttgtccaataataatacgatgttctcctaactgacttccatcgttccatgattagcgttaagctcaagcaaacgcaacgaactacagtagctagtagtactattgtgttccaaaatgtagtaaaatatacagaagccaaattagcagttaggaaacatagagtcgaaatgtcaaattcctacatgtccttagccgcgtcgcgccggttgaacgcacagttttcaacttgacaagaatgttaggggcatataaatttggtttattgttagcataaatcttatcaaagttcggtctatagttattttactccctacgtcaaaatatctggacacattactagctattccctccgtcccaaaaatatataagcatttttagaatagtaaaaagtcaaacatttttaactttaactattaatagcaaaaaaataaaaaaagatcaataacgtaaaattgatgttacaaaatttatcattaaacaaactatcataatatgcaactccttttatttaaaacattttacttttatagttattgttggtcaaagtagtatctcagagaccgtatcggagtctaaaaaatacttatattttgggacggatgtagtattatgcatgtaggtaaaagaatgtgaaatgattgtttgattttgagagttgcgagaaacgtctagtggtattccggctagcttcacaaaatggtggcctagatggcttgggttcgaagctcacccattctaattatttgaaaggcaaattttgctacaggacatcgcgactttgtggaattagctccaggacactgcacgaagtgagttttgggggaagacactcccaaaacatggctatttgccagaggacaccgcgtctatttgtttagtatatttgcgctgactaggcttgagggggcccacattttgacgtgatcggaccaaattgcccctgcacatattctccatcctctcccctcgccgtgacgctgccctggccacattgctgcggccttgcctggccggcctccttcccctcaccttgctttgcctccgccaccatcaccgctcaccgccgaccccgtggtatggcggtactgccgccacccgcccttgcccaccacccaccgtcgggttcgccgcctcccaggctatccctctaaacccaatcccccacttccccctcctagcaccgacctcccccacccctaccccgaaaccttaaccctcaccccgcccctcgtacccccaagctttgtcgtcactctgtaagaaaccgcacgcgacttttcttcctgacgtgtgtgcgccaattataattcctgttccatgtgatcttaagagtacgaggccacacatcataatgatgcctgtgtaaatttgtgtgttacagctaatagaaaattttgatagtacaaaattcagtacaactcccttcgtttaaggttgtaagacgttttgactttggttaaagtcaaactattctaagtttagcttacccttaaaaaatattaatatttacaacactttcattaaatctataattgaataaatttttattatatattttaatattttttttacaaaattaattaaacttaggttagtttgattttaaccaaagttaaaacgtcttataatcttaaacggagggagtagtaattattatgtggacaaaccgacaaacttgcctataaatacagatcaaacgagcagcagacgcacagaccagccattcccaatttcccattgcattctgcaagatccaactatccaagccaagacgccaccgtccgtccgatccacgataccatggcatcggcgggaggccgctgcgacggctgccacggcgacttcggcctctgggagcctcccttgacggcggagtgctcgcacaggttccacctccactgcgtcgtctccggcgccgacgtctgcccggcgtgcaacgcgcgatggaccaacgcgccatcgaacccgccgccgcaacccgccggaggcagcacgacgccgtttggacagacgacgggctttcccatgcgcgtccggccatggtcgtcgtgcgacaaatgccgcggcgtcatagaccacagccagcccaccgtcacgtccgagtgcagccacacgttccacctccgctgcttctccgggagcgtcatctgcccggcgtgcaacgcgcggtggcgcgacacggtggccgtgccaaacccttcgccggcgccgccgtccaccttctttcccgccggcgttcccgcgccgccgccgaccttttcgcccttctgggtgagccaagagtatgacgacgacgagccggtggagccgccggtagcggcacacggtggcggcgtggcaccggcgagcaatggggcgctcgtcgtcaggacgcactgcgagcacacggccgtggcgaggagcgtgatcagggacaatttcgtcgtccttgtccatgccaaagctcctagcatcgccgtggcggaggcgacggcggcggcgcgcgcgccggtcgacctcgtcacggtgctcgacgtgagcggcagcatggaaggctacaagctcacgctcctgaagcgcgccatggggttcgtcattgataagctcggccccggcgaccgcctcgccgtcgtgtccttctcctacaatgcgcagcgagtgatccggctgacgcggatgtcggacgacggcaaggcgtcggccaagagcgccatggaatccctcgctgcgggcggcggcacgaacatcctcaagggccttgtcgaagccgccaaggtgttcgacggtcgccgctaccggaacgccgtcgccagcgtcatccttctctccgacggtcaagacacgtacaatgtcaacggcgggtggggcgcctcgaactcaaagaactacagtgttctcgtgccgccttccttcaagcgctccggcgaccggcgcctgtcggtccacacgttcggcttcggcaccgaccacgacgcggtggcgatgaacgccatcgcggaggagaccgggggcacgttctccttcatcgagaaccaggccgtcgtccaggacgcgttcgcgcagtgcatcggcgggctcctctcggtcaccgtgcaggaggcgcgcatcgccatcacctgcccgcaccccggcgtccgcgtccggtcggtcaagtccggtcgctacgaaagcctcgtcaatggggacggccgggccgcgtcggtggacgtcggcgagctctacgccgacgaggagaggcgtttcttggtgttcgtggacgtgccagcagccggcgccggggaagacgtcacagaactgatcaaggtgagctgcacataccgcgacaccgcgagtcggcagcagatggtcgtcgccggcgagcacgccgtagtgcaaagaccagtggaggtggccaccaacacggagccgtccattgaggtggagcgcgagcgtttccgcgtggaggcaaccgaagacatcgcggcggcgcaagaagcagccgagcgcggcgcgcacgcggcggcgaaggcgatactcgaccgccggcaggaggcgctcgcccggtcggcgccgggtctcgccggcgacgccaggtgcgcggcgctgctgtcggagctgcgcgagctgagcgcccgcgtggcgagcaggcgggagtacgagcagaccgggcgcgcgtgcatgctcgccggcatgagctcgcacgcacagcagcgcgccacgtcggtgcagctgtttggagcggcggcgccgacgtggtcaatgccgatgtgtggatcggcggcgccgccatctctctctttcggggggtttggagggttcgcgacgccggcgatgcggagcatggtggagtcgtcgcgaaagagaagaaagggcggcgacggaagcttaagctttttggatctggtccgaactgaggaagaagccggcagctcagatgacgagaaggagaacctgtaatactccttccatctacttctgatagtcatatttcatcttgtcacatagatcaaggataagtaattctacttatcatccatttaaacatgctactagtcattccttgtaaacaagcgattcattaatatttacatttcttaatgcctatgtagccaatcatgtgtggaagaatggagagtcatgcattaaatccgaaaaagtcattaagatgatagattgttgtattgaaatatgtctattaaaaataaaattttcagatttggaaatatgattatcaaaagtagatggagtaagtatttcagttgaatttactcatgcattttactaccgcatggtgaaatgcttcgaaatttggtttgtctactatgtcttgcgtttgtccatcgttttgcgcaactttggatatggtataaagtaataataagaccatgtatagtggagaaaatttgttataattaaattctcgcatgattatattctagagaaaataattatgtgttttaacggttgaatttagatgtttcacatgtaaaaaacaaatgttttaagtgaaactaaattgtgttgcaacacattttttttagtgttgcacgctttgtaatttggatgtttcaataagtccttttttaatgtttcacttgctcatttgtaaatgtttaatattgttctttagatattatatcaagtattttgtgatattttagtttttataacttaatgttttatgtatttttattattataaataatataatgataagggatattgttgtaaagattcaattgcaattaatacaacaatgtagttagataatttaggagaaaatttggtttaaagtttgaaaaatatgttgttcggagaaggaggtaaagtaatgatggctaatgccaaggagtagaatgcatgcatactccaggcagctagtgagttgacggcattgccatctttgagcaaccgatcagggaccctaaaagttaggagtttcaatttgttatattttaatctatatattgatatatttaatgacatcttatttcattttttaaaagtttcactcttacttattttatgatttagcttgatttcttcagctccaataagtgttcgatggtaatcatggccaactcaaagggctatagctcatgacgatgatttgagcgtgtgttctagacattaaatattttagtttttcgcctaataaaaaataaatcactaaatcatgacataacattttagtaacattttttttaaaaaaaatctccttccgacttaggtagagctccaccgctgatttattctttattctttctcatttttctgggcctcaaattgtgtttcgtaatggacctcaaattcctaggtacggccctgggtgatgaaatatgaggagtgtgcaaatgggccgatccgtttgcacttgaatctgggcaaatttaattgttttattttgagatgaagtataagacatgcacagacatgaaaattgcatgttttagatggaactatcatcaaaatgtataattttctgttcagtcaatgtattcagctttaataaacaatgtggtacttgcttaaaggggtactgttaactaaatataatttggtaaggaggaactggaatggtagtttgagatgttgtttctgtatgaaaaatgaaactattcaatatcttttttatggaatgctattttgcaaagtttatttggagagcagttcggttttcttttggtctttaccctcctaatagcatatctcatatttttgatgattggcttctgggggtggacaagaaaaataggaaatttattctcataggagcttctattatatattggattctatggttgagtaggaatgacatggtttttgacaaatcaccatctgtttcatatgtgtaggtaattttctcggcgacatatttgttcaggtcttgggcactgctacaaaagtgtgatgaagagggcgagtgattaaaagttgcatgtcgtaatcttgagataacaattatgcaacagtttaccaattttgaatggagattcacaaacagaattcaataattgtgtactcattatctttggttggtagtctttagtttgctttttcttcatggttagtgttttttttgtgaactttatcttttttgtgttatactgtaataattgactgtagcttgttgagcaaaggacaagatattctattccattatttaaaaaaagacatgaaaattgcgcccaaataaaatgagacagcctgagccggggaacgcatacctttaattgaacaaacgtatgaaatgaaacacatgttaattcagactcaaacgtacttgaccaaaagctctagacaaagacaatttaaaatttcaaacttaagattgacaaatccaaaccaaaaacaacctaaacttaacctaaaagcttcgacgccttcggtgttgtcttcttcttcagcttcagttgcccccgctgccgctctctcgtgccttccgcgacgactccaccatgctctgcatcgccggcgtcgagtaaccaaatggcacggcgccggaggaaagcgccgacgccggcgagaacagctgcaccgacgtggcgcgctgctgtgcgtgcgagctcatgccggcgagcatgcacgcgcgcccggtctgctcgtactcccgcctgttcgccacgcgggcgctcagctcgcgcagctccgacaccagcgccgcgcacctggcgtcgccggcgagccgccgcgccgaccgggcgagcgcctcctgccggcggtcgagtatcgccttcgctgccgcgtacgcgccgcgctcggcggcttcccgcgccgccgcgatgtcttcggttgcctccacgcagaagcgctcccgctccacctccatcgacggctccgtgctggtgctcacctccgctggcctttgcacgacggcgtcctcgccggcgacgaccatctgctgccgactcgcggtgtcgcggtatgtgcagctcaccttgatcagttctgtgacgtcttccccggcgccggctgctggcacgtccacgaacaccaagaaacgcctctcctcgtcggcgtagagctcgccgacgtccaccgacgcggcccggccgtccccgtcaatgacgctgtcgtagcggccggagttgacagacctgacgcgcacggcggcgtgcgggcaggtgatggcgatgcgcgcctcctgcacggggaccgagaggaggccgccgatgcactgcgcgaacgcgtcctggacgacggcctggttctcgatgaaggagaacgtgccgccggtctcctccgcgatggtgtgcatcgccgacgcgtcgtggtcggtgccgaagccgaacgtgtggaccgggaggcgccggtcgccggagcgcttgaaggaaggcggcacgagaacactgtagttcttcgagttcgaggcgccccacccgccgttgacattgtaattgtcttgaccgtcggagagaaggatgacgctggcgacggcgttccggtagcggcggccgtcgaacaccttggcggcttcgacaaggccctcgaggatgttcgtgcagccgtccgcatggagggactccacggcgctcttggccgacgccttgccgccctccgacatccgcgtcagccggatcactcgccgcgcactgtaggagaaggacacgacggcaaggcggtcgccggggccgagcaaccccatggcgcgcttcagtagcgcgagcttgtagccttccatgctgccgctcacgtcgagcaccgtgacgaggtcgaccgacgcgcgcgccggcgccgcctccgcggcgatgctaggagccttgacgtggaggagaacggcgaagttgtcccttggcgtgctccgcgcgatggccgggaactcgcagtgcgtcttgatgacgacgagctccccatcgtttgccgcggcctcgccgccacctggttcgcccccccccctcgacgccggcgactccaccggctcgttgtcgtcgtacgcgtggccctcctccgtgaccctcctgaagggcgtcgcaaaaaccgatggctgtgctggataggccaccggcggcgtctggactggtactggtgatggcgccggcggccagcacgaagtcagtggcctccttggcaagctcgtcgccgacgagctccacggcggcggtggcccagatcgtccaaacaagccgctcgtggtcgttccatgggcgggctgtggcggcgcgttcacggatgaggacgtcgcgaagggcaaggtgctcgacgccgacgacgccgcgggcggcgggttcacggatgagaacgtcgcgaagggcgaggtgctcgacgccgcgggcggcgggttcacggatgagaacgtcgcgaaggacaaggtgctcgacgccgacgacgccgcgggcggcgggttcacggatgagga

SEQ ID NO: 62227 - DNA, 21724 bp, Oryza sativa
gcgaagggcaaggtgctcgacgccgacgacgccgcgggcggcgggttcacggatgagaacgtcgcgaagggcgaggtgctcgacgccgcgggcggcgggttcacggatgagaacgtcgcgaaggacaaggtgctcgacgccgacgacgccgcgggcggcgggttcacggatgaggacgtcgcgaagggcgaggggctcgacgccgcgggcggcgggttcacggatgagaacgtcgcgaaggacaaggtgctcgacgccgacgacgccgcgggcggcgggttcacggatgaggacgtcgcgaagggcgaggggctcgacgccgcgggcggcgggttcacggatgagaacgtcgcgaaggacaaggtgctcgacgccgacgacgccgcgggcggcgggttggtccatggccttttgcacgtcgagcagacgttggcgccggcgccggcgacgcagaggtcaaactcgtggaggcaggcgctgcaccgaaccctcgtcgtcgccatgggggacggagcaaagcttcggcggcgtctcgatcgtcttcaatcttgcaagatgcaatgcgcgatggctctctgtgtctcttctcaaatatctcgaactcgacgaactttgtttgatctcgcatttataggcgagtttggtggtcagtacgttgcaaaagaccctaaaccgacatgcaatttggtgatggtttcggtaagttcgaatcgtgaggtatcaaaatttgatgaaatttcatcaatttggtgtgatttgtgttttggtaataaaccaattaaccaaatatacctgacatttgcttctgtatatacggtaagtttacaaactgtgcgtacaaccgacgcgacgcggccaggaagcttagaattcggaagtggattttgatccctcaagaggatatcccctcgttgtttgcatgtcactcaaatagttatgaaaaaaattaaaaaaaattaagaagatgtattaacatgtgatatatcactccacaaacatgcaagtaaaaattcaacttcgacatctcgcaacgaaaaaacaaatttgactctgagtatacattaactagccgcggtttaatttgtttttttattacgatttgtagaagttgaacttgaacttgcatgtttgtgaagtgttatatcacatgttaatagacattcccaatttttttaaatttttttataatcatttaaatgacatgtaaataacaaggggatatcttttcgagggattaaaatagtttccctaagaattcgactctcttgtagtttgtgggtttcctaactgctgttgagtttgcttgagattgacgctgtcatggaacgatacagggcgtcgcaggtgctgactcagcgacagcggcggccaacttgacacgttagtaacaaccgtttccggaggagtcaatttgctacgaatcaagagcaagagatgagggaggtatagtagacttatttcaactacaataaatgctggcccaacagatcttccggcccaacagatctttctctggccaagcggcccaagatcgtgaataagcgatcagaaaggcccagagagaacagatgaaaaagaaataattaggagtgaggcgtcaaactaaggtcggctaatccactatctcgtagtcttagagctagccggaagaccatggtggtttctcagatgaagatggagaagactaaattcggtctatctaatctaagctagaggcagctaggtgagaaagcatcagtacaggcggcgaggcaggcgaggtagaagatggcggcggcggcggcgtcgccctgctcgccgccggccaagtagctccgcttgaacctcttcccgccgtgctgttccttggcgctgctgcactgcagcatcttcctcttgatcgccatgatcgcctccccaccacctcgcctgctcctcctcctgctgctgctgctgctgccacccgtgtcttcttctccatcgcctgcattttgcctgaacctgcactgcaccattttgcctgaacttctagtaatttttatgtgctctgtcactgaaggtcagatggccatatgcatggctctagctagatccttttatagagatgagagcagcagtgcagctgcaggggcggtttctgaattctgaataaatatagctggaccagcagggagcagggcgaccgttaacttgggatcgagcaatatttgcgtgatatatttaagtgtgtgtatagctgacattgatggattattaaagcattttttgcgaacccaaacgcaggagcagagcacggaacggtcaatggtcggtgcgtgctgatgcataaaattaggtgagattcatgcacaaatcgatccggtagtttgcatacttgcatatatatattttgcatgcatccgaagtaacagcagtagtgcatgtacatgttcaggttgaaaagtggattacttgcagcgcgtacaaagtgccccaagtgcccagcaacgcacataaattaattagtctgtgcttaatttagcatgcatatcctctacaagtttctgttgtctgtgacagcctttttatctctctgtatcccacgtatcctttcgatgacctagcttctaagagtgttgcagatgacctagcttctattgacgtgcaaagcttctgcattggaagaataaaaaagcatccatacatgatcgatgcatcaatccttacattttatagatttgctccgatacagtaaaaagtatctcgagttaccggtacctcacggtactaaatcgtttccgattattgaatctaactggataggatgagcattgttaaattaaaaagatcaaaaatgatttgataccgtgaagtacctgtacctctagataatttttattggataggagcagatatctacattttaagattccctgttgtgtacacgagttacggccggcaggcagcatgttcaattccgttctgccaagatcgatggcagctagtgacagaggaaatgaaatgcacctccagttgaatagagttaaaagggcaggtcccggtggtcttgaagcagtagcagtacacgcccctcgtgtgatcatggacgcgtttcgtgatttcatctgctactgctagtgctagtgattagtgatagcttaattgaggagctaagcgccattggtggccagcggcaagggcatccataatgtggattaaaagtgggtattagacattaaaatatctttactactgggtaagatacatcgtggaagtagtaaatagttactattagatcatatagctactaccgggcaacaaagaataagttatgttatttgtacagtgtcaatgagtatcaacgaattgttttctcgcagttggagtcatggcagctgatgattggtgagtttttatagtgggccccatgttataccctaccgtcctgcacatacaatgtggagttcatatgctgctactaccgcctgacgtacgggcccacgttactgcctaactcggtcataaacattgctgttgcccaaaatgcagtaaaaagttcgggactcattgggttctcgtactacctccgtttctaaatatttaacgctgttgatttttttaaatatgtttgaccatttatcttatttaaaaaaaattaagtaattattacttatttttctatcatttgatttattgttaaatatactttcatgtatacatatagttttacatatttcacaaatttttttaataagacgaacggtcaaacatgtgctaaaaagccaatagtgtcaagcatttagaaatggagggagtattttctaataattcaaaacggtttattgagaaatacaaattaataggtaaaacttttacatatttattcgtaatgacttaaacaccaacataaaaagaaattatattaaaaatataaaatcatcttctatatatttattcgtaatgacctatttgttcccgctcttcttttgtgtggttgaatgatataaattaagtccgaccaatatttaagagagttaaattggactttttccttatctgtgaaatctgcatctatctcatctcgagcacagttggttctgctgatcaacaccgcatcagatcagatgcaggtggtctaaattgctgagacagacagagagggaaacagacaaatagtgcacaagaaacagcaagtgaggtgtgattactcgatggttggtcctcaatttcttgatctaacgttccaaccggtgcaacaagaagtgaaacgctatttattactggagtagcaacattcagagacttttccttattatggagtaatattacatatggcctttaaataagttggccgggcctgtttaaatcacactaatcacctggaatattataagtacagtatttttaaaaatcgcgaaagtgaaacacgcccagcagaagaacctcggtatcttcttcagatgttttttttttttttttttttttgaggaaactatcttcttcagatgttcacccttgtcttttaacacctgccaccactatctgccgacgtatttttgcataaacacgagaaagtctccagaagaccagaggatgagcagaaacacgagaaaaggtcaaaggcggaggtcagcatatcgctcatcagttctactccgtagtccgtagatgaacaaacatgcagattaatactcgtattagatagcagagagactctttccatcacgccaagcctgggagcaatttaattccgcgtaattttcgatttcttttctaaacctgaccgcgtcagtcagtgtagaccggtcgctgtttcagattaattagcctctggttcttgacctgaatgtgcgtggaattgcagagaactgcaagttttgtttgctacaagtagtaggtgtagacttgtagtagctgtgttctccggctgattcggccgccggcgatggccgctggtgagctcgtgacaagatcgtccatggctgctgcttctgcttctgccatagcctgcctgctgttcttgggattcttgcctagcctcgctactgccgtgtcgttcagctactccaccttcagcaacgggaccaagaacatcaccctccagggcagcgcggcgatcgccggcgatgggtggatcgagatcaccaccggcagcaacctgccgagcggcggcaccatgggacgcgtggcgtactcgccgccggtgcagctctgggaagccgccaccggcgaggtcgccagcttcaccacgcgcttctccttcaacatcaccccgacaaacttggacaacaagggcgacgggatggccttcttcctcgtcggctacccttcgaggatgccggacacggcggacggcggcgccctcggcctcaccagccggaccttcgacgccgtcatgtccggcgacaaccggttcgtcgccgtcgagttcgacaccttcaacaactcgttcgatcccagcgccacctacgaccacatcggcgtcgacgtcaactccatcgtatcggtgcagaccgagtcgctgcccagcttcagcctcaccgggaacatggccgccattgtcgactacaacagcagctcgagcatcctgtcggtccagctggtgaagacatggacgaatggctcgactacactttacaaccttagcaccaccgtcgatctcaagaccgccttgccggagaaggtctccgtcggcttctcggcggcgacgggctcatcccttgagctccatcagctgcattcttggtacttcaactcctcgttccagcagaatccaccaccggcggcgcagccttccccgaccacctctggtcccggacttgccggagttatagccggagccaccgctggtggagcactgttcgtcgtgctcctcttcgccatgatagttgtcctcgtgcggcgacgtcggagcaagaagagaagggaggcagaagaggcagaggaggcgagacacgtagggttggccggagatgacgacgatgacgatgacggcgagcccatcgtggagatcgagatgggcatggggccaaggcaaatcccataccacgagctcgtcgaggcgacgaagagctttgcggcggaggagaagcttgggcaaggtggcttcggcgccgtgtacaggggatacctgagagagcagggcctagccgtcgccattaagaggtttgctaaggattcctccaagcaagggaagaaagagtataggtcggagatcaaggtgataagccggttgcgtcaccgcaatctggtgcagctcatagggtggtgccatggccgcgacgagctcctactcgtctacgaactcgtccccaaccgcagcctcgacatccacctccatggcaatggcaccttcctgacatggccaatgaggtcagtaactgtcctctctaacttcatctcaacttctttggtgatgtcaaattaatcgacatgttcttgattttaacttgtcacagggttaagattgttcttgggcttggatcagcactgttctatctccacgaggagtgggaacagtgcgttgtgcaccgcgacatcaagccgagcaatgtcatgctggatgagtccttcaacgccaagctaggcgacttcgggcttgcaaggttcatcgaccatgccgtggggatgcagacgatgaccgccgtctctgggacaccaggctatgttgatcctgaatgcgtgatcaccggtagagcaagctcagagtctgatgtttatagcttcggcattgtcctattggaagtggcatgcggaaggaggccaatgagcctacaagataaccagaagaatggcatcttccggttggtcgagtgggtctgggacctgcacggacaaggagatgttatctcagcggctgatgagcggctcaacggtgactacgacgtgtcggagatggagcgtgtcattactgtggggctttggtgtgcgcatccagacccaagtgcacggccgtctatcagagcagccatggccatgctccagtctagtgggcaactaccggtgttacctgccaagatgcctgtgccaacatatgcgccgccggtggcctcagtggaggggctcttcacatcgtccactggaatgttgtcctcaagtgcaacacaatcatcatcgacaaccagtggctatattacccacacctcaagttcctctaacacatccacttcagctggttcaaaggactcgtcttcgttgctcaaacatcaatacttatgatgttcaattcatttgcattgttactgattttgacttgatgcttgaatgggatgtacaactcgtgagccattgattttccttttagagtagtctaattgccaatgtgagtaatgtatgtgcatttatgccatgatttaaattttactcccattttagttattctagatagatttatcctgccattttctctctaatatctgactactataaagtgcatacctggcttgtctcagtgaatatcctagtctttagagggcctggaattgtgaattgtcgaagttggaagaacttgttttaaaaaaaaaaacaccaagagaagataactcttacacacttcacatatagtttgcatgttttcacttttcggtgaataacgcaaaggtgtaaacaacaggagctaaatataataagctaaattcaatagagatggaatatggcctctacagactggagacaatagtacaaagactgcttattttcagaagttcttatgcagttgtctcaaatcgtggatatttatgttggatacttcggtggtggaatcaagaacatccaagcaaaattgttaacactaaaaaatagtaacagcataatagttcactcactatgatctgtagcttttcagctggttgttttgccctgtttttcagcttttcaaccaaaaggttgttctcccccaaatcttaagaaaaattcgggcagcactctttgtcggcccgaaaaaaaaaagattcattaaattagacattcatgaaataaacatatcacctaggattgacaactctgctacctcacggatcgatcaagacaaatttggaaacaaaagagtggttctgatagactcagtaatgggtttgctgctgcaaaattctcaacagaatctgatagaacaacccattggacactactccttccagaagaaagggaagatctggaaacattatatcatggcacagtagcaagtgacccattctctttcacattatgtccttagccatgatcagacgcgcttggtcaaacctaccaagatgattgacagaatagtaatgagaacgaattttgacaaagagaaacagttccagtgatttacgcattcggaattaaaaaccactacaatagttacagcaatttttcatccataaaagtccatgcatagcctcttttgaatgtccaagttagctattcaacattgatgcaggattgtgctgacctaaaatgaggttgaagcccttacattcttttgttaaggggacatcgatcggaagacgttaagaggctaaactaatactccctccgtatttttatgtatgacaccattgactttttaatcaacgtttgaccattcgtcttattaagaaaatttatgtaattatcatttattttattgtgagttgatttatcatcaaatattctttaaacataacgtaaatatttttgtatttgcacaaaaaattttgaataatacgaatggtcaaactttcgtaaaaaagtcaatggcgtcatacattaaaatacggagggagtaaatacgaacatacccaaccttagaggaaagttagtgttggacaccaaattgggcatttatcacatctaaattatctcaataaaaaaacaaaagaaattcacattatacaagacaaaataaaaaaaaacagcagtaccaatgtaccattgtgaccaatcaaccactagcatttctcacattaagttgaggttatgaggtaaccctcacctagtcacctattggaagaggaacctccagtaggacaagtcggcggcgatgcactgtcgcagcctagcgtccaccgccgcgctgtgcagcaccatcagagaatcagccctcgccgccggcgcgaagtgcctgacaaggtcccgccattttgggattaggatagttcccttccagacctagctagcagcaagaacacctgcgggggcgggaggcgtggaggagctacagtatactttgccgaccggaactgctcttcaccggagatctcggtcggcgcgcggccgacgactcgagtatggtggcggcggcggcgcggtagaagacgcttcggttgcggaaagaagaaaaagcttaaaccgagcatggctagttgggccgtgcaacgtcgggagaacattttttattgggctaaactcaagtcctaaaatgggccttgggccagagtttttggaagagcgggggagtatgttgggcccccattgggggtgggacaagtctattttgtgtcggagccatgaaacttggaggcccgtttgatctggcatgggaggacgacgatgcgaaggaatgggggaaggggaagatgaattggggagacctacggtgagcgttgccgccttcttcccatagtggaaaaagccggaccggagaatgacccagtgagctcatctattcaccggttcaccggtcggaccgccggttcatggctaactatattttaagtcataattgactttaaactgttaaataaaataggtattccattctgaatagcacatatctcttgcccagttggttaggtgggaaagtacaaggcttgtagcgcctcaagcatgtggtctggggttcgactccccttctgctcatactagaaatttatatttttccctgccggtcttttctgcaaaccgaaccgtggcatgcactggttccctttttttccggttgaaccggtggctgaccggttttttgtactaggcttcttcctgttggcggagctaatgtggtaaggttgggacgacggatcgttggcggagctcacggtggttccctttttttccggttgaaccggtggctgaccggttttttgtactaggcttcttcctgttggcggagctaatgtggtaaggttgggacgacggatcgttggcggagctcacggaggaggagctaggcagcagtgcagctctccgacgagatcgtaccagcctgtcgtctccatcttcgctgtgaggaggtcgtctcgaatttgcccacgtcggctcgagtactggccgtctcgagctcgccgcagtggacgacattggtgatgctgatatggggaaacaacaatacatggcgtcgctcgagacccctatgtcaagggcctattgggtccactaggtcttttgtttttaaaatttttcaactcaacgacatgcaggtcccgttaagtttttattcttttattgtagtgccatgtaggatgaaagaattccacatacatacgtgatcttcgctaccggcgccattgccgtcgccaccaaagccccgcaacttctgagcctgacgctgccgttgacgagctcctgagcgccggatccactgtccttgtcatcaccactgaggtcctgagcgccggatctgcctctgccgtcgtcatcgccgctagatgtccctgcagctcccaaggctagcgccagattcgttgttgttgtcatcgctgccgaggttccgagtgctggatctgcctccgctgagttcccgagtgctggatctgccggttcctgagctcccagcccgcacctaccattgccactgccaaaagctcatcaccgccttcgcaagcccatcgccccactgctggctcccgtcgcggcgccccgccgaggcctaacttcgccagtggatctagagggggagaagtagaggtggagaaaagctaagtgagagagggagagagaaggagaggatagtggatcacggtggggggatggttataaagaagagggttggctggaaagttgtttttgcatacaattcttttaagtggctctgtggagattatggttaccccatatctgcatgacggttatactttagtcggatatacggcactaaatatagatagaacatctttatgaggattcgggttggattctaaacttgtatctcaagaaaatacccgggatcctagtcggttacgattgtattctatctgtaatcccatgttccgttaggatatgggctgtactttgtaatacggatcccttcccctatataaggaggggtccgggttcctctcgggacgattcttttttctcccaatcatacaatcaataatacactcggcggaatcatccccggacaggagtagggtattactttttgaataagaaggcctgaacttgtataaaatcccttgtctctaaacccatccactttcctaacttgatagccacccccttttattattgccgaaatcttgtttcgacagttggcgcgctaggtaggggtagcgtcaagttctcgccgactaagtgcgatgggtttcgtttctggcatcgacgacttcgccttccctcccgggcatgcgttccagttcggcagcctcaacttcatcaccaacgacttcggcaagatctctctccttgactcggatttaaaccagtcggggagagaccaggtccctgtgccattcggtatcccgaactcggccgaggcctactccaagatcatctctcccgagtcagcttcaaaccactcggatgagatccaatctactcttccgcgaccagatcaagacgacgggtcctatcccccaatcctgatgaaacttcctgatgatttggccgttgtcttcacagtcaagacatcttccactcgaagatctaggcgagctccggcttcggccccgatccgatccagatccagggaggttggcgttatactccaacctctcgggacagtctcgacggaagagttggatggctacctcagctcccccggcgtcagttctcgaccaaccgagatcctcgactacgacgatttcggctaccactacgaccacggcgacctcgacaacttcgacgatagctatgaggataactacacgcccctctacttcggcgtattcatggctgacaatgaaacggaggaacagcgccaagcccgagaagcggaccaagatcgcgcacggcaagaagctgaacgtcgccaactggaggaagagcgacagcgacaagagcgagaacgactacagcgtgagcaacaggatcacgaacggattgcaaaggaggctgaagatcgacgacaacacgccttggaatctgggcggagagcgagagagctcattgggcaacaagacgtcgatgggacagcagtctttcgcaccccccagcagaacgcggttgcagcaatcactctcctcgacaccctcctcaaggaagacgcactcaaccaagccgatcatgttgtcaacatcttgaaccagacgaagaccatgatcgctgcctcggttccagccaactccacaagcacccgcaccccgactggtagccgagtcccccacttccgatctcatgattatcatcagccaagcctcagcatcatcggcacaggatctagtcgcaggagcaggggtcacgacgaacgatctgttcactcgcctcccgaacgtcacagggagagccgagtcgaacggcctcgctctccacctcaccgacgtcccgtcgaccttcgcgacacgatcaaccagcgccgtgcagcacgaagtcaccgccattcaccagatcgctacgacgacgacgtggacggagtagctgccttcactaatgacctgcgtcgagtggattggccagccggctttaagccgactggaatcgagaagtatgacggcaccaccaaccctgagtcttggctcaccgtatatggtctcgcaatccgcgcagcaggaggagacagcaaagccatggcaaactatctacctgtggccctagcggactccgcccgatcttggctccacggactaccctgtggcacgatcggatcatgggcggaacttcgtgatcacttcatcgccaacttccagggcacctttgaacgccccggcacacagttcgatctctacaacgtcgttcagaagtctggagaatccctccgagattacatccgacgcttctccgaacaacgcaacaagatctccgacatcaccgacgatgtcatcatcgccgccttcactaaaggcattcgccacgacgacctagtcggcaagttcggacgtaaacctcccaggatggttaagcagatgttcgaaaaagccaatgagtatgccaaagccgaagatgctatcaccgcgtccaaacagtcgggcaccacttggaagccaaagaaagacacgccgaccgtaggagggagtggaagtaacaaccacaaggattgcaagcgtaagcccgaagaacttgtggcgaccacctctccatcttcccgacaacattcccgcgtcaacatcttcgacaagataatgaactcccaatgtccgcatcatcccaactctaaccacgtggccaaagattgcttcgtctacaaacagtttgcggagcaatacgtcaagaacgcacgcaaacctgcagacggagatcagggcacatcaaagaagaaagatgatgaagacgatgccccgactggttttcaagatcatcgcaaagaacttaatcacatcttcggcggacccctggcttatgagtctaagagaaaacagaagctaacagaacgggagatcaatgcggttcagcctaacacgccccaatatcttcggtggtcagagacagcaattaagttcgaccgctcggatcatcctgactgagtggtccacccggggcggtaccccctggtactagacccagtggttcgcaatgtcaagctccgacggactctcatcgatgggggcagcgcacttaatatccttttcgctaagaccctggacgatatgcagattcctcgcacggaattaaagctgagtaatgcacccttccacggtgttatcccaggattgtcagctacaccactcggccagatcactcttccagttaccttcggcactcgggagaattttcgcacagaaaatgtttgtttcgaagtcgctgattttgagacagcatatcatgctatactcggacgaccggctttagccaagttcatggccgtcccgcactacacctacatgatgatgaagatgcctggtcctcgaggggtcatatcactacggagcgacatcaagcaagccgtcacatgtgacaaagaaagttgcgagatggctcaaacccatgagactactctcgcccgcgaagagatccgactggctgcgaccacggcaagcgagggagaagtgcctgcaaccaagctgacgaagaccaaagaaagcggtgccaagatgaaaaagattcccttagatccctcggatcctgataagactgctgtaataggcgctgagttagattgtaaataggaaagcgcgctcatcacctttcttcagaataataaagatattttcgcgtggaaaccatccgatatgcctggtatccccagagaggtgattgagcactctttacatgttaaggaagacgccaaacccatcaagcaacgactccgccgttttgcacaggacaggaaggatgcgatcaaggaggaattaaccaagctgttagcagcaggcttcattaaggaagtccttcatcccgactggctggctaacccagtcctggttcggaaaaagacagggcaatggcgcatgtgtgtcgattataccgacctcaacaaatcttgtcccaaagacccttttgggttacctcgcattgaccaggtggttgattcaacggccggctgcgagttactcagcttcttggactgttactcgggatatcatcagatccgactaaaagaatccgactgcttgaagacctcgtttattacgccctttggggcctactgctacatcaccatgccctttggattgaagaatgcaggagcgacctatcaacgcatgattcaaagatgtttttcaactcagattggtcgcaatgttgaagcctacgttgatgatgtagtcgtcaagaccaagcggaaggatgacctgattgcggatttagaagaaacttttacaagcattcgtgctttcaagatgaaactaaacccggaaaagagcatctttggagtaccgtcagggaagttgctcagatttatggtatctcaaagaggcatacaggccaacccagagaaaatcaacgccatcctcaacatgaaaccgccaagctcccaaaaagacgtgcaaaagttgactggttgcatggcggcgctcagccggttcgtctcacgactcggcgagcgggggatgcctttcttcaagctgctgaagaagactgacaatttccagtggggacccgaagcacagaaagcctttgaagacttcaagaaactcctcaccactccaccagttttggcctcgccacatccgcaagagccgctactgttatatgtgtcggcgacctcccaggttgtgagtacggtcctggttgtcgagcgtgaagaggaaggccatattcaaaaagtccaacgaccgatctattttatcagcgaggttttagctgactccaagacaaggtatcctcaggtttaaaagttattatatggtgtcttaattaccgtcaggaaattatctcactattttcaaagtcactcagtcacggtggtcacatcgtttccactcggggatatacttcataatcgcgaagcaaacggacggattgcgaagtgggccttagaattgatgtctttggacatatctttcaaaccacgaacttcgatcaagtcacaagctttagctgatttccttgccgagtggaccgagtgccaagaagacatgccagaggagaagatggaatattggactatgtattttgatgggtcgaagaggcttacaggcactggagctggggttgttttaatctccccgactggagaaagattgagctacgtattgtggatatatttttctgtgtcccataacgtggcggaatacgaagcgctacttcatggactaaggattgcaatatctctaggtattcgccgactaatcgtccgtggagactcacagttggttgttaatcaagtcatgaaagagtggtcatgtctagatgataatatgaccgcttatcgacaagaggtgcgcaagttggaaaataaattcgatggactcgagctcacccatgtcctccgacataacaatgaggcagccgacagactggccaattttggttcaaaacaggaagcagctccttctgatgtgttcgttgagcatctttatgaaccaaccatgcccagaaaagaagcaaatgaagccatggatactcgaggcataggcatgattgaagccgactggagagaacctctcataaaatttttgaccaaacaataactccctcaagacaaaaatgaagccgagcggatttccaggcgcagcagactttacattattcatgagactgagctgtacaagaaaagcccatcaggaatactgcagcgctgtgtgtctttggaagaagggagacagttgttgaaagatatacattctggtatttgtggtaatcatgctgctgcacggaccattgtcggcaaggcttaccggcaaggttttttctggcctacagctgtgtccgatgccgacaagattgtgcggacatgcgaaggttgtcaattttttgccagacaaactcatttgccagcccaagagttgcaaaccatcccgttgtcctggccatttgcggtctgggggcttgacatggtcggtccctttaaaagggcagtcggcggttacacgcatctctttatggccatcgacaaattctccaagtggattgaggctaaatcggtcatcacgatcacagcagataaagctagatattttttcatcaacattgtgcatcagtttggggtacctaatcggatcatcactgacaatggcactcaattcactggcgaagcatttaaagacttttgtgaagacttcggcattaaaatttgttacgcctccgtggcacaccgtatgagtaacggacaagtcgagcgcgctaatggcatgatactgcaagggatcaaatcacgagtttttgaccgactacgtccctatgctggcaagtgggtagatcagctgccgtccgtactttggtctttacgcactactcctagtcgggctactggccagtcgccgttctttttggtttatggagcagaagcaatgttgccgagtgaagtggaatttgaatcactacgatttcggaacttcaacgaggagggctatgaagagggccgagtagacgacatcaaccgactagaagaagcccgagaagcagctttaattcagtcgactcgatatttgcaagggttgcgccgttatcataattggaatgttcgatcgcgagcctttttagtcggcgacctggttctgaggaaaattcaaacaacacaggatcggcataaattatctcccttatgggaaggactgttcataattgctgaagtcactcggccgggttcttatcgactcaagagcgaagatggtactatcatcaacaattcttggaatattgaacaccttcgtcgattttacgcttaggcatttcgtttgtatctttcctctttgactgctaagttcaagttttttcctcgaagttttcagtcagggggctactataataataatggagtgtgatttatatcaattcaatttgcttacttgatgtatcattgccctgtttgatttcttggcttagtcaatgaggactgaaagttttttaacaacttttgcgggttttaggctcaacaaggtttgacaaaaacttttatgaaatcaggagctaagttaagatatcaagcacaacataaattcatcagtattgtacaaattgtgcctccatcatcattaatcatcaaaattatcggtacattaatcagtattagtcttttcatcatcagaattatcaggaccagtcggtcgaagatcggtatcttggaatctctcaactacatcagcagcaattttgtcagccactttctgcgcatcactgatgaggtcaagagcagcttcttcgctcgtcccgtctgcaaagccatcaatggtgtcaatatcaactctaggataaagggatttagtcttcgccaacgccagacttgctcccatacttccagcttctttgatgttcttgaaatatgtatccggagcaactctcagcttgtcgaaaattttagaagcatcaagtgcactcgggccattgttattgaagaacatcgcttgaacgattggggcggcagcgttagcaacctcatcccgggctccttcaagttttttgatcttgccaaccaggacgtcgaattgagcttgagatttgatcttgcggtctgcatcaacaggttcacattaataagtcagtatatggaggataatggcttttgaggtattgattgttgataccttcaacttcctttaaagccaggtctctttgttttgccagttctgccttgtcattttccagaatttgaatctgcttctccaactgagatatcttggcagcttgtactacattgattacggttaatcaagatggcaaagataacagtatgagtcagttgagcagagtttgtgcgtaccttttgatgagccactcagttcaaaatttgattcctggagatcagcgatccgatccctcagatcatgttcattcttcctggcaagttctttcgcttcgtgcaattgattcctggtggctttgagggtcccgagatgaggaactaacctctctaaggttactgttttggcttcgttcctaagatgaatcctctgcaagacagtttaattagcgcatgaattaaatggcaaacaagatggttgagatcaggtaccagagaacttacatttacaatgcgggttgcctgaccaagtgccttcttcagtaggcataactcttcgtcctctttttgcttatttatcacgatcccttgaggctgcatgttgtcatcccaccacttgaccagaatcggagggcgtgaatcctcagctgcttgtatccggaggatctcttcttcatcaccaattattggccctagtgtatccatgaacgaagatgaagcagccaaataaagtttgttggatcaaaatgatttcagatggcatgtctaactgtgatgattcccggtcggggacgaatggatcttggtgccttcataggagatctggtttctgattcattgtcagcatccttcccgagaggactgttcgtttgagcttcaacctcgggaatcttttggcttggccctgcatccgactggtttccagtcgggggctcctggttagcaccgacttcagcttcgactgactggttcccagtcgggggctcgttgctgggttctacattataggttgccggctgattttcactcggatgatcctcagcagttggtccggtttctttggaagagcttgtgtccatgttagtcgggtcagagtctttcccagacgggtctatatcagatggtttcctgcaaatttgattatcagtattatcgccgcaatgggtgtgcatcaatacaagaggaatcgttacatgagttgcacctggaagacttcctgatctttggcgcagggcgactggatgttttcttccttggagtagcctgttttggtagtttcttggtcgtctctcagtcttcaggcctcctggtggtatcgtcggcttcgtcgtctcttagaaccagcttcctctttcgagaatctgactggccgactggatcagaagcacttggttgagtttcagaccgaattcttggtcctccgctcccttgcccagtttggtggcggggagatcggcgtggagcgattggtggattcgacttcatcagagcaaattcctgggtgtaatatctttcattgttaattgattcaacaggaagacaagatcatattttgaggaaggttgaagtatatgaatacgcaccggtggaggaggattgaatgcgttgaacggtacgactggcagcaagtgtgagtagctgacaacgatggcgtttgagaagatgttatacatcctttccttcatgaccttgaagtcaagagaatccggatcttcacggtttgggtcatgcttgccgtcaaattcgaaggctgtgcgagatctttctttgattggagctaaccgacacttgataaagtgccgggtgatctgttctccttgaaggccctgttctttcagctttatcatcctctccatcagttctactgcttgagcagcttcatctcccataggcaatgagttccatgtatcctggtaaaccggaggaagacagcagtactcggggagtgcgggctcaggattctgaacataaaactagtttgcgtgccagcctttatttgaggtcttgaagggcatggagaagtatttttggcttagtgttcccctgagttggaaaccaacacccccaacgacgtatggtttgctcttatttggctggggcttgaggaagaagatgcggcggaacaaggcgaaatgaggcctaatgcctagaaaagcttcgcaggcatggataaaattggcaatatgcactatggagtttgggttcaaatgatgcaagctaatcccgtagaagtttaggatcccccggaagaaccttgaggttggaagagaaaatccgccatagaagaaatgcgcaaataccacgatttcgtgtgtgtcgggggtcgggaatgcctcgccgaacgccggtcgccacccgataatctcctttgtcgggagaacgccgtgcgccaccatctccttcagattatcttctgtcacatcggagggcgcccactgactctcgaagctttctctttcttccgccatgaatgtgaactagatgatttgatttagttcgagatacggctggaaagggatggggaatcggagcggtggatgcggggagaaatttcaggaagtttttgaggatggattggagcggattgatgaaccctagctttgttggcgcggttctgtactgtagcacggagtggggaatggcgagagtctcggcggggaagacgaagcgacgtttggacttcggtatttttagggtatcgggagtactaatgggcctaggcctgtacagtatttcagcccaattatgttttcagcgtggcccgttgtgatccctacggacttaggtgctttttgctttggcaatatgtgctcacaatggcgcagcccgatgctgttaaaatcctttttaacgtgattcaataattctttagaattattatgatgcacatgaaaaggtgcccgacagaaaggtgttataccatttttgtaagctttttaggctacaaaagctgttgggttcatttgagatgactggtttattaatggtcattcttttagcatgttatatgcttattttaattatggtaagagttatagcctaggctaatgaacttcttaattaccatgatctttatcatatttggtggatcattataagagtttcttactcggattcctaccaaatatatctatttttggaccttttgagtgtttatcactcggcccttctcgtattttttgtccttgatatattcagattgagaagcagttggctgggtatcttactaagtaccatgcgtgcttcgctataaaaccacttggttcttgactatctgtttagtttttcaactaatcacatagtcggggggctacacctaattaggtgcatctactcgatgcaccatgttttcgcccttcacagttttttagtactcgg

SEQ ID NO: 62228 - DNA, 8796 bp, Oryza sativa
ctaaagtggggtgcttcctagtagtgaacctctccgtcttcaggtgattttcccttcagcttcctaaataatcctgattatgatgtagattcaaaggcacataaattacagaattcatgaaaaaaaatcacgaatgcgcaaaaggattgtacatcaatatattagaagaaaaagaatttgttacataacgcaattagctagaccggcctatgccaagggaagggagaaaaagcaaaacaaaagctcaagctggaaaagactactacgacggctaaacacaactctaaacagcggaaaggggtagagccacgctaacgctacactcccgagaaatctccaaaaacggcaatgctagctaaagactacatatgaccttctgagaggaaggactctagaaccactccgacagaattcagaaaaatgaagcagtagctttcagattctcactagctaaagctgcttcttaaacctccagctctttaaacagagccattgacttggtgctccaagctagagctcagcatttcggtcttcagtcccatatgaccatcaaacaatcgatcgttgattcagcccaatcttttctgaccccgacggtcgaaaactatggccggagcacagaaagaagtgccattttggcacaattaatacaagtggaagaactaatattaccaataaatcaacggcaagcttgtgttacaattccttgttagaccgagccggcttctcgagtctctgtttgctagtggtggctggcacaccagctgctcgagtgatatcgtggacatgagttgaataggctaatgggtagtagaggtgatccatccacctgtgtaatactccctctatcccataatataagatgtgcacatattttaagattttactttaaaaacatttgaccaataattattataatataaattttattttatttgctaaaattaatatcattggattgacatttaaatttactttaagatgattataattttgttgcaataaactttataatatatgagaaattataggtcaaagattagttttgaagactgtgccaagtttgactatgccttgtattatgagatggagggagtattaattattaaaaccattggattgttacacatttaacattttatcctttacttaatgagaatgttcttgaccatttatgccaaaacgaagtccatgacgaacattatttaagaaaaagagattaattatgtggcatcacttgtagtgttgctgtctgtctcattgtttagtgagtggcaattcttgttaccatttcttcaaactagttttgatgtcacatggttggagacctatttctggacatcaccttaccgggggaatgagaatgatattgccaatttatttaagtttttttttactatcgtcttttgctaccaccatatagttgttttgtgatacatctcggtctcttaactcttagaggcatgtggcaacgtttcttgaatgtgatcgaaatagttgagaaaaacaaaagctgacaacgtagattaggtttctatcaataacaaaaaaaaaaaaaaaggtagaccataaaaagtacaattggatttggattcacgcactacaacagatctagacttccctaacggattccctttgacaaacagggaatccgtcttgatttgtgataaattcgcaaaaacaaatatcgttgtaaagttcaccttcaaccgatcctagcgacaactagaagtcttggtcctaagatatgttctccgcgacaaacaggattgtcaagaattatggggatttcatcgttagcagctaggttatcatacgtttagatttgttgggagtacctttgtttctctatctagacaaaaaaaaataacttgatctattttttcgctataggaaatagtaagttacgttatcaatcactttaaagagttttataacctgacaaaatttgctctaggtaactctataattatgacattcactctaagatatagttttgcggtttgccgtatgatggtacagttttgcttctctttgccaaaatacattttggccattgctttgacatatcctcttcaaatgagagattttctaaaagaagaaattgcccttcaacctaccaagtgagcctgagggcaattttgtcttttcaaaagttctctctttccaattgaagaggatagggaaaaataagggactacctatataactcctgacgaataatttttagcgtacttataaatgtcaccataactataatataaatatagtgtacttatattttaactatagtgtatattagatgcaactgctatgtaaattagaatttgctttgtaacacagtgggagatcagcacgttcccacactagcttcgcatcacgatttcgacacgacgacacctacccacagcgcacgctatcaactttttattcttgatcatgcgcacgaatctcctagccaatccaacgataaaaatccaaaagtttttcctccacttttctacagtagtaaaatagcaagtatgtaaagtaataggtcaagtgtcttttggcaaaagaccgcaatcctgtgataaaaccgtaaaactagagtgccttagaatattgagaaaattggaaccatgtcattataatttgcaaaatttgagatgtaccatcctgactcacatgtcattgactcatgtgggtcctacatgtcattgagataccgatggcatatctcaaattttgcaaaattataatggcatggttccaatttaccatagaatattttatcttaggttataggctaactataaacaaatgtagaaacgagataaaaaaaaatagcttggatacatgcattaattaaatatataagtgagataaagattgtggataagaaaagcatggacaatgaaatagcttgcttatttatatacattaggtctaatactatttttgggtggacttagggcctgtttgtttagttcgcgaaaagaaaatttttaggtgtcatatcaaatgtttaactggatgttggaagtggtttttggacacgaatgaaaaaattaatttcataaatcgtctggaaaccgcaagacgaatcttttgagcctaattaatctgtcattagcacatacgggttactatagcacttatggctaatgatggactaattaggctcaaaagatccgtctcgtgatttctcctcctaactgtgcaattaattttttttaatctatatttagtgctctattgtatgtaaagaattgatgtgatgtttttagaaaaaaaaaagaactaaacaaggccttagtttgcttacgagacgttgtatcataataaggacgaaacgagtatacgtactagctagtagcgtttagtatccacatcatctgcttacctgtgttttgtcgtactcttctttcgtcacttatttacaggctggcgcaagcgcggtccaaatccgtccagaggtaaggccctctttagttaccacataaaaaatttacgtcttattatatcgaacgtttaagtatccctgtataaaatattaaatatagaattaaaaaataactaattgcacagattgcgactaatttacgagacgaatcttttaagcctaattactacatgatttgacaatgtggtacttgctaatgatggattaattaggattaattaggcttaataaattcgtctcgcggtttagtgacggatgttgtagttagtgtttttatcagtgtccaaacaacccatgcgacaccctatataatacccaacgtggcacaccaaaattttacaccgctgatgagggctgaccggttaccttaaatctgcgggactcccgactgcattgtcacgtaggaaggctgtaagcattgtctctcgtttctctccagctggtcaagccgatcgatcagtactggtagtatcgttgtcacccttgcgcgccgatcgatcgacgccggcggcgatggccgatgtttctttgatcagttgcgctgtcggcatcatcttcttctccgccgtttgctacctgcctacggctcctgtcgccgccttgtccttcaactacaccaacttcaattcaaacaacccgagcatcgaatatgaaggcaacgcctctttcagcgtcgggtatatcgacatcagcttgaacgaagccaacggcatgggcaacagcgccggacgggtgtcctacaagcagccggtgcagctctgggagtgggacgccgccaccggcgaggtggccagcttcaccacaaccttctccttcaacatcacgccgagcgataggaacaacaggggcgacgggatggccttattcctcggcagctacccatcgaagttaccagaccgcgccggtggccacaacctcggcctaaccaaccaaacaatcggcaacgtctcgaccggtgacaagaggaagacaagaggaagcccagcccagacgatccatgcgagatcggcggcccacgagcaagtatgtgtcgagtgagtggacccggtagctgtcgaccgggccactgtcagagagggagcgagatcttttggcacatcgctatataagatcggcaaagtagagagagaaggaatcgaacattgtagaaacaactaaattcccaattcaattcaaatctctctctctctctctgttctattgcttcctctgttcttcctctgtttctcttctcaattcacgaattcctcttcgaattcccatggtttcgtcatcgtcttggcgtgaattccacaagtgccgtgacatttggtatcagagcagcgatcctggagaaaccaaggtacacttctcgtttgcaatcgcaggttgaggcaatggagaagcagaatctcgatttcggcaagttgctcggcgacatccaggagtcgctggtggcgttgaacaacaagcaggcggagatgcaggtggcggtggcgaagttggacgaaggggttagtggatggcgaccccaagttgaagccgcgatcaaggacttgcgtgctgaggtcgacgaacttcagcagcagcatgatgccgccaacaagggaaagcaagctccatcagcggcactttcccctcgggtcccgttgacgggcgaggaaaggaaggtgccattgttgccgactcctccaccatcatatcagttgggcgcggcggaaggcgggggcaaactggccggtggccacggcgttccacaacatcactggaggagggcatctggagtggttaccactctgatcccaactccgggcaagggtacgttcaatgtttctcctgtgcctttgcattcctgtgaaaattttgattcgggatttggggaatttgatggagaggttgaggaacgtcagtatagccatagagtgcctaagttagattttcccaaattcgatggtaccgactcacaggattggaggatgaagtgtgagcattatttcgatgtgaataacacgtacccggggttgtgggtgcgagtggctatcatctacttttctgggagggctgcatcttggttgagatccactagagctcatgttcggtttcctaactgggaggatttctgtgctgcgctatctgataagtttgatagggatcaacatgaactgttgattcggcagatggatggaattaaacagtcgggaacagtgtgggagtattacgaacagtttgatgaactcatgaataagttgcttgtgtatgatccagtagtgaatatgcgttatctgacacaccgtttcactgagggattatataggaaaattcgtaatgctgtttacttcagagaccccgagacctcgagtctgctttggctgttgctttgttacaggaggaagtgctggagacagctgatgaagtgcctggaaaagaagttaggaagagtgaaggaaattctctaggacgttcagttgcaaatcttaaaggggcatatcctttgccaactcctccaatgaggtctgggggcatcaacatgggcattaaatctgaagaaaggaaggagtctgaagtaaaacgttcatcaggaatgaatgagagattatcttctcttaaggctcaacgtcgtgctcaaggtctctgttacatctgtgcagagaaatggtcgcctacacataagtgttctaatactgtgcaactgcatgctgtccaagagttattcacagtgttgcatgaatcagcagaggacgggttgagcacaacagatcatgttgttgagcaaacgttaatggcagtttcactacaggctgtgcagggatctgaaactggtggttgtatgagaatgctggggcaaatccaaagcaaagaaatcttgattttagtcgactcaggcagctctgccagtttcatcagtaaaagggtggcaagcagttttataggggttctagagcagcctgtgcatgtgcaagttaaggtggctgggggagcaatgttacattgttgttctgagattctgaattgtgaatggaccactcaaggacatgtgttctttactaatctgaaggttctggaattgaacaactacgacatgattttgggcatggattggttgatgcagcacagtctaatgacagtggattggaccacaaaatctctgataattgcttgtgcaggaactcagattcagttacatggtgtaaggtctgatactgagcaatgtgcccacataagttccaggcaacttagggaacttaatgacagaacaacagtgtcttagtccaattttgttcagttttcgcgttggagcaccaagagcagattcctaatgtggtgcagacagtactgacagagttttcttcagtttttgatgaacccaaggggttaccaccaatcagacaatttgaccatactattcctttgctgccaggagctgggccagtcaatgtgagaccctatcgatatactcatgtccaaaagaatgagattgaaagtcaagtgcaagagatgttgagtaaagggataattcaaccatgttcaagtcctttttcatcacccgtattacttgttaaaaagaaggacggttcatggaggttttgtgtggattatagacatcttaatgccataacagtgaagaataagtatcctttgcctgtgatagatgaactattggatgaacttgcgggagctcaatggttttctaagttggacttgcgctccgaatatcaccaaatcagaatgcatccagatgatgtgcataaaactgcttttcaaacccatcacggtgactttgagttcagagtgcttccttttggtttgactagtgcaccggcaacttttcaaggagtcatgaacagtgtgcttgctaccttacttaggaggtgtgtgcttgtattcgtggatgacattttgatatacagcaaatctttagaagagcatgtgcagcatttgaaaacagtgtttcagattttgcttaaacaccaattgaaggttaagaggactaagtgttcttttgcacaacaagaattagcatatcttggacatataattcaacctaatggtgtttccacagaccctgagaagattcaagttattcaacattggccagcacccacttctgtaaaagaattacgtagctttttaggtctctcaggatactacaggaaatttgtgcgcaattatggcattctcagtaaacctcttacaaatttgcttcgcaatggtcagctctatatttggattgctgaaactgaggatgcttttcaagctttgaaacaagcgctcatcacagctccagtccttgctatgccagatttccaaactccttttgtggttgagactgatgcatctgacaagggcattggtgcagtgttaatgcaaaataatcatcccctcgctttcttaagccgagctcttggactgcgacatcagggactctctacttatgaaaaggagagtttggccataatgcttgcggtagatcactggcggccatatttacagcatgatgaatttttcattcgaactgatcaccgcagtttggcatttcttactgaacagcgtctcaccactccctggcagcacaaggctcttaccaaactcttggggcttcgttataagattatttttaagaagggggttgacaacaacgcagcagatgcattatctcattatccaggctctgatcaggtggaactctcagctttatcagttgcagttccagagtggatcaatgaaattgtggccggttattcctctgatcccgatgcctgcagcaaggtacaaactctctgtatcaattctggagcagtaccaaatttttctctacacaatggggtgctttattttcagaacagactttgggttggtcacaatgtagaagttcaacagaaaattcttgctaatcttcacacaacggcagttggaggccattcgggaatacaagtcacttatcagcgcgttaaacagctgtttgcttggcctcgccttcgtgccactgttgttcagtatgtgcaagcttgttctgtttgccaacaagcaaaatcggagcatgtgaagtatcctggaatgcttcaacctctcctgtacctgaccatgcgtggcaaattgtctctctggatttcgtggaaggccttcctaagtcggcttctttcaattgcattcttgtggtggtcgacaaattctctaaatacagtcattttgttccattgactcatcctttctctgccttggatgtggccgaagcatatatgcaacatatccatcgacttcacggcttgcctcagtctttgatttctgaccgtgatcgcattttcactagtacattgtggactactctattcaagttagccggcactcaactccgaatgagttcctcttaccat

SEQ ID NO: 62229 - DNA, 717 bp, Oryza sativa
attcctgcagcccctacttcatatggtcagacattagtcatatttatcctttgaaacgttaagctgattgtcaggtgagccactagtgattctcaaccatcagtccagtgtggtttagaaattaggcaaaactggctacaccaatgtaacactaaggatccatgtcattactcaaaacacaccttaaagtcatgtgcatatgctactatgctaatggattgcaatggccaccagcaaacaaaactatgggcaaacagacctgatcttttagtgtgtatcggcaacaaaagagtatctgccagcagatatagctaattttgttttgtgattgggagttaacatgacaaccaagtacagtgctctatagacaattttttcaaaggattatgttccaaagatgttgtagatctgcaatgacctgatgtgttggatctactgttgtcttacgaaagatacttcatacttttatcaattctgatataagagctttgtcttgtagaatatgaatgagcatcctgatgcttggccattcaaagagccagtggattcacgtgatgttcctgactattatgacattatcaaagatcctattggtatgctggaatgatttaggggattattttcccttcttttcccagcttggcgaagctatgttttgtgccatctaagctattcagtttctgaacactaagcttgtctgcagatttgaagacaatg

SEQ ID NO: 62230 - DNA, 20302 bp, Oryza sativa
  unsure (1)..(20302): unsure at all n locations
agaagaaaaacgatgactggatcggagatttggtctcggagacaaacccgcaaatcacggcgacttttgtggaatagctcgtggcactatggatcgcagtccatggcatgcatctggatgaaggagaaccagaccaaatcacatggaagttcacaactcacgggtagtactcggcttcgtcagcctacaaagcacagtgcattggcacgcttgacacgacctttgacccattaatttggagagcttgggtgtctggaaaatgtaagcttcatgcatgctcatcatctagaatagagtatggacctctgaccggctcacaaacaggggatggcagaacaacgggcagcgccccctctataggggagaggatgaaacggcgtttcacctcgttgcggaatgtcgatattccaaaaggatttggagactggtagcggactgggttcagctcaatctctggcattgggagatgacccagacaatcaaagattggtgggaaatgctagccgcttcggcgggcatccccaagaaggggttacgcaccctgatcctccacattgtttgggaaatatggaatgtgcgcaaccggcgaatctttgagcacaaagaggccacaacattaatgtacctcattgcaaaaataaaagaataagctggcatgtgggcgttagcgggtgctaagagattgcgcgagcttatcccgcaccttgtatagtgtacagtttttggtttttgccttttctttgcccctaggggctgtatttttctcccactatattcaatgaaaaggcacactctcgtgttggttccattaaaaaaaaagagcaagctagctgtgtccattttctttcttctttcttttaattttctttcttctttctttttttctgcggtgcatgttaacacggccggtcctaacttttcagggccctagcgcgaaagtaaatatagaggccctttcatactatataataataatcaatagatacatatactgaattattaatgttaacatttaaattgcatttagaaataatatttatataaaaaacatatgttacctcaaaagttattatagtactttaactcatataaattacactacaaaattacaaatctaaatttagaatcttaccaaatagtttatcgcgagcgtccagatgcgcaccgcaaatgagccggaaacacaactagtgccttcgtcagtttgtccaactatcgggacaactgaattgccctaatataggactatacatcagtacacgggcacatatatagctatttacatgttaacagatataatcacaatgttacaaaattagtgatgatgtattgatgtattggtgttgcactcacctgaatagaatcctccttgtccaatctcgagggggcagccgggagccggcggcaggcaaccggcagcggctgcaccagcacctcgtggcctactggctactgccgtcgcgcggagcagcggaaaacgggaagccgtgagccgcggagtcggcgccgatgcgtggcctctggacctggggattgcacgcgatttcggcgccgtgaggaggaggagatcagaagacgtgggcggcaggcggtggcaatcgcggcatggcgcgtgcgccggtgcgcgttctggtggcgcatctgttcgccttcgggcctacggccttccgtattgggctaggcctgagcctgaggacccggccctgctgcatgttaatgatttgttcatgtatgtagattattctaaaaaatgtaagaattttgagcttgtaacaaaccaaccaaccaaccattttctgtaaggattagacatagataatgtagattaatgtaagcaatttgaaagcatgtgaataaacagcccactcggttaattactcttatttatttatccgagtaggaaaattaagaatgaaaaagatgaacaggattaaaaccaagctttcgaaagggccatgtgaatattcatattctccaatccaatattgcagctcctattntatttatttttggaaaaagtancgaatatcgccccccctgaactattgcggtcgaccgaattacccctctaaatccgaaaaccagatattactcactctaaacttttaataccggacgaattaccctcctcaatactgttttgagcggttttgaattgacttgcacacgtggcgccaacatagcaatccagtcagccaaaaaaaacccttcttgggcccacctatcataccccccccctctcctcggatgccacccagccacagcgcgagcgccaccgtcgtacagggcagcgacgaccctcgccgcccccatgggcctctcccccactaccgccgccaccaccgagtcgttgccgttcgcgcccacaccgcagagaggaagccgagacggacgaactgtccacagcaggcggtcagtgggcggcggcacgagacgaggaggaaggaggagcccgcgccgctgcgatagaggggaaggaggatcccgccaccgcctcactccacgtcccaccgccgtcctcggttccttgcccgtcaccctgccttcgccccctccggctgccgtcctcggctcctcacccgccacccgcacccgcctccgcctcgaccggctgccatcatcggctcctcacccgccacccgcagccgcctccacacccgcctgccgccggcctcgactcctcgcctgctggtcgcggccgcctccgcgcactcgctccgcgccggcctcagctcctcgcccgccgcccgcggccgcctcctctgttcaccgagagagaaaggcagagaaggagaggaaaaaaaacactgacaggtgggtcccagcggtttttgctgtgtgtatcgccacgtgtgtgccacgtaggcttaaaaccgctttgaatcaagttagggttataatttatccggttttaagagtttggggtgtcaaatgtccggtattgtagtttagggggtaaatcgtactaccgcaattgttcagggggagggataattcgtacttttttcttatttttttaacgactcgcataagacggtgcgaaattttattgatagagcagaagaaaaattataagattaaaaccatgggatgtaaaggaaaagattacagctcctatttatgggccatctaacttaagaatgagctagctagcggagattgattcacggatcgccacccaaaatcctgacaaatcgaatcaggatataacaaagcaggcaagaagattgtttttcgtctagatttacactgctagcagaaagaaagtaatcaatcaacaaatcatctatcggcagcaggcgtgtggagcaacatccagcgatccttcgagtccgggaaggcacacgccgagggcgaggtgaattatatatcatcgttttgattgattactgcactttttttttattgttgttgagctagtgatggtggtggtgtgaggtttgtggatgcgcagtaccaggcgcgacgtgcggtggaggcggtgacggacgccgccggcgccatccacattccattcaaaattttcactgttatacctctcaaccacctttctatcatcaaccataaattattttataaagtttatagtaatttgttcttaaccataaattattttataagggtattatagtcatttgttttaaactttaggatatgccaaacaaccttaaaaaatactccctccatccacaatagttatacatattacttttaacaccaagaccaaggagaaattaaatcacctcggatgttgtaaaatcaaggagtgaatacaagcatgcaaccaatgagtatttagatgactccttgggttctaataaaacatttaatttatctcttcatttaagtcttgaatgcataaagactacaaataggaacaacttatttgaaaaaaatcaaatgtgaaataggtgtaacttttgtggatggagggagtaaataatttgagacggagatattacactgcaatacggcccattggtgactcgaatttcttggcagtgacagcctagggccgtgggccgtatgcaagtgctagttgtaaccatcaatcagggaagtgtattagagcaagtatcatagtaggctgcaagtcacttataaatatatgcggaaaaaaataagtcaaatataaacacatgcggaaaaaaaataaaagatgagaggactacagatttgtagcatggactttaatatgttgtgtcaatggcagatctagcactaaaatttagctatggtggatcatcacaccagaactaactgcatggtattttaaaaatgaagcaacattttattatacacaaactataatatgtcagcacttattagaatatatgccattaaggatgattataatcctaaatttgtcatgcagtttttacaactgaagccttataaattcgtcgtataacttctacaactaaactacatttccacgagtgtttctctgttttgttttctaggtgtgtttattcataataagtagacattcattgaagttacacatatattctttaacattcaatttttaccgattaacattttgttgttagctagatttgttcattcatttgtgcagacacaaggcagtcccactataggtctttatctcctgttaattaaacgaataagcttgtaccaaatgaaatacaactaactaatcacataattagcatctgaaatcaaggctgagatggccatatgctcgaatactctacctactttgggcatggcataggtatgactggtgccatcccttgccacgagagaacgccgttgtgttgtgtgtgtatgaaagatgtaatcatatattataatagtgtaatatacacttataagtaactatattttatggataagctattagattgactatatataatttggagctaataggtgactattctaaacttctctaatcttttctcgtgagaatgtagactggtgagcaggtggcgcaggcggcacagaacgcggcgaccgccaccaagggatccgccgtccaggcaggcatccatccgtatgaaaatctgaatatatcattcgactgagcagtgaaggtgaagcattgcctggctgaagctgcattttacgcgccttcgttctctgtttcatgtttctttcgactaacctggttgtaacaaacatatgcatttgtttgctcgaagattccgaaatgttgtcacgctgaacaacattccacatccgtgataacagtttatcgcatgacttgcactgtaatttttagcttccgccaaactgtatttcttggggtacattttactccaagtcagttttagctgataactgtatttcacatgctagatgtagttacatcctagctaatatactttcaaatttagtttttgctaatgaacgcaacacttcccgaagcaactttgttagtaaaattacatttaagaaattagtaaaattggtccagttaaactggaaattgaggatggtagtcaggttttacataccgtttcgagatgaaaaccagtcccattctgcttttaactaaaacaaaatggctttcaaaaccgatcgaaattgtgaatcctggtgtcagttcccacgagggacaacaggagatttcctaagggcctatttgttagagctccaactcttaaatttagctctaggagttaggttagggtggagttatggagcagcctaaacccagctccccctctggttcattttgtgacagtgctccacccaactccactcccattttaggtggagttgaaattgtttggttaagctccagctctagataaggtggtgccggagttggagttgtgccaaacatgccctaaaattagttgaatggcagcagaaaacaagcggagacaccatggaacaaaataaaatacaccgctaacatggacacttgcagacatcaacgaacatggtatgaaacaaaaatacgagaggttcaactgactgatatttcagatgtcaagttttcaagcaccgtaacaaataaaatcagatcagtacatcatattataggagagatggcacaatccaggcaaaagttcttaaattctagtttcatagctgctttcatagcaaaacggatctagttggccacggcagctctcttccttggggtagcctcagtacctgaatcgatagaacaaaaggaacataatgaatccaaacaactttgctatttttaacgcaattaacatttcccatgatatttaaaacatcagaaaagtttcagacaccttctctgaagttgctcttgaacctcctaggcacatgtcgcatgtacctcatccttccggttcctgtggtcttgcgcctaatggccttcacgctccagttgtctgaaatgacatcgcagaaattaaaactaagcaaatccaaaaagacaaaagaaattcaaccacagaatctaactagagatttagaggctaaccacaaacaatacaactcaaactaagtatgttttcatttaatgtgtatttggtattaaatgaacgatgcaaggaaacatatatgcaatgatacgaatttaaatggttacattacaaaccaaacaactcaaccaagtactggctaccatacattaaacaaggcagcagcaggagcaagttgacataatggtgaacagaatgacaaatagaattgccatatgtttgaactgaaggttgaaaaagagcaaatataataaaattgcctgatctcagaaaagaaaaagaaaacagaataaataaaatataaggttagaggatatgtcgaaagaaaacataagaaagggaaaattgagtacttatagaaaaaactatgtgcattgggtacatcagagacttaaatacttaggaatcacaggagcatatctcccatcatattgttgcagtttttctctcatcacttgagcctgcctcatgacagaagcaggcaacatggaaatacataaacacagtgaaggtacaaaacttcaaagtgttacaaatttccaaaagtctaaataaccactgcacaaatcatttaatcaaatgtgatagcctgaataaaatataagctcagaaaatgaaaacatcttctcattgatgccatggcatctctgaagtctgacatgcgaaagttttcatgattcctcatagcattttttttgtaagacagcaaaatcatttgggaaatcaaatgcaaagaaaaaacatagtatttgtgatcaattacgacatatgagatatatcagtgcttgaattttgtacgttaatactgaccgttttcaagagcctttcaaaaggaaaatatgtttgaaggatcatcagagacttaaatacataggaatcacaggagctaagctcccatcatattgttgcagttaaaacctcatcacctgaccctcataaacagaattaagttttcatacgaaaatggtcatccttatgttttccaagcaagaattttagcttataatcatttgtgaaaaaaaacatgtgtacaaacaacacattaaattttgttcagttaagatcaacgcagccgagcaggtaaatcacttgtcaggaccacagatcaaaagaggatggataatgcccaatacatacaataaaaataaaaatgagaccaaagttttcttcatttccatcaaaatgccggaaatgccacgctctacaaagagggttcaggtaggagaacgcatctcagcttgagaagccccgatttctacccattaattggctcatctaggcgcagtataatcatcatcaaatctacatggcaacccaaaagcaaatacaagatctagtggggaaaccgaatcatgaggaggaggcttacacttgcggatgcgggcggcggggtaaccgcaggaggagcaggtgctcttctggaggtggaagctgcggcggccgcagcggacgcagagcgtgtgcgtcttgttccggcgcttgccgaagctgcccgtacccttaccctgcgagccacaacaagatcaccacgttagagctatggagaagccatgaggaggccgcggcggcggcggcggctgcgaggtttaccattgcttgatctgctcctctcggctagggttggagaatggggcggctgcggcggcggcggtggaggcgtgcgccgtggcgtaaaaccctagctatttatagggagcaagggagcagcaatagtgggcttccatgggccgttcagaacaaacgcaatcgattgggccgcacgtaagtccaaatcgtaccgcgcgtaatagaaatatgtttactttacatccctcatgtttgacgttgagtttgaatctcttcccttaaccacagcaccagatataatgtgtccctcagtttgtaataccttatctccttttctgtttcttttaacgtgaacatgtaaattgaaagatatgttatatccggtattacggttcaataatgtattattccaatattaagaattttcggttaatcttacagaccttgcgattgttgagtcgtcgccacggcgacggtcggctattaaaatatacgagcaactcgagcttgtcagagttacggataaggtataccctctatccttagatatacgttgtatactgatacggtatacccgcgcgtatacggatattttctgcgtacgttaaggaaatctatcacgtgatagaaacggagttcacagatggaaggagtcctactcggacagaactgggtcgttgccatatcgtgaggggtccgatatctccgagttatacttggagaccaactgatccgcgatataaaagggaccccctgggcaggactgagggcatcaaatctcaccgccaacacatctaccacagcctacgaagccgaagcctacaggagccaagtcgccgggtgatctagtcgaaccaactcgattacggtctcgtcggtatcatcgagttccattattccctttgtaatttgtgatttccatcatataatcccataccaactggattagggctattacctatcaaggggcctaaaccagtataatcttgtctttcatttgcttgatgtcgtattacgtagatcctcgttccaacataccccaatactctctatatccggtctacgggtatcccccgtcgacagagctgcagtgtcggattattggacactttatgccggaaacacgaacaatgatctaaggtagggggcggctaaaataaccgagacgcctacaaatcgggcacccattttttttcaaaaatcatgcacggctccaccaagtagatcggaattatttcactaagtagatagaaaatgtttaaatcgtttaaaaagctgaaatacaaccaaatcacctcacgaaatattttgctacaacatatgaaacaacggtttttgaagctgtttcaccgtatataaaacacaatgtttcagcaaatagcgaaaggatgtttcaattcaccgcaacacttgatctatacataatgaaacaacatgagtatactttctgaaacattactggtggaacaaaaaatgaaacggattcacttaatatagcgtttccgtgatatgtggggtgatttgttgcaacggcacatgtggtggggcgcgtggtggggacgacgcgggggcgcgggagcgcgcacaggaggactgttgcccgattttttcggcgtggaggcgcggtgtaggcacgggcgcccgatgcatgcgcgcccgcatcgggcaccccgatttaaagaatttttggttaatcttagggaccatgtgattgttgagtcgtcgccaccatgacggccggctattaaaaggtacgatcaactcgagctgcagtcagattattgcacactttatacaaaaaaaacacgaacaatgatcaaaggtaagctacacgtaaagccagtttaggtaggtctgccgagagataataatattattatccccgaggaggatttcacatagtgcgagacgcctacaaatcgggcgcccgatttttttttttttttttgcaaaaaccgggcgatgttccaccaagtagatcagaattatttcactaagtagatagaaaatgtttcaatcatttaaaaaactaaaacacaaccaaatcacctcatgaaacattttactacaacgtatgaaacaacggtttttaaagttgtttcaccgtatataaaaacaatgtttcagcaaatagcgaaaatatgtttcaattcactgcaacatttgatctatacataatgaaacaacacgagtatacttgctgaaacattattggtggaacaacaaatgaaacagattcactcaatagaacgtttccgtaatatatgggtgatttgttgtaacaggccaacggcacgtgtagtggggacagcgcgggggtgcgggagcgcgcatggtaggcacagcgcctgattttttcggcgcggcgttttgaaagtttttcataaaataacactgattttttactttttgaaaaacctttcctcgttagtgttgcgtgtccatttgtataagtaacaagcatccaaatgaacaactcatcggagtgcttgacgtctccaataaccaaccgaccaattgtgttccatcaaattcatgtgtaatatacactatacttaaaagtgtctaatacataatttaaatataatatatcctcatgtacataatatgcactctgcttaaaagtgtaatacataatttctacatgattatatttatacgtaatcggaaatggaccagcgcagctaggcaccacacatgggaatggtgcaaaatagaccctaattgatacacatcacgagacctgtatacacatctaagcatacactactcctagtctgtgccagacgctcacataagcaaaggctatgaataaatatatgaaccttgatgaatcctcactaaaagttcactcgtgtacatgattgtagacactagattttaaacccagattagaggatcaccacacagaacatgtttccctaagcaaaactaattcatttcatactatttttcttagataatgattcattttatactatagccgaacttttatatatttgatcaattatccaaatcctagactcacgcgggtaagcttttcattcgaaaacaacagacattaacttctaccccccccctctccctcctctctctctgacttatttttgataagaaaaagtaatgttgcctggatcaactgttatatttggtggggcattggatttttagggatgaagataagaaattgagggttgaaccaatgaactacttgctttttaatatctgtttagttcatcggatggagggtgacgacaaggtgaggtcaacaacgacaacagatgccccttgagcttccagatccggaatctgatcgagccctccctcctcttgtcctccttcctacctgatttggtcgagcttgagctcttgggtgccagatttgccacgtggcggtgctcgtgacctcagatccagctcatcggagttaacaaaggtggaaggagggcaccaacaaaccctagtttttggtttgggggagaaatgaggaggaagacagggtggtgaccggtgacccatcgcaaccccttgcccacacgagtgtaacgtgagttgcgcaactgcacgcatcgagccagaacaagtatccaatcttgattcggtcattcctgctcaagcaggatgcgagggattctttcatcagctaggcctagatctgggacatgtgtaggtaaccaaacaaggagccagttgcacctggaagatacaagccaggttgatacaagcaaccgattatgcccttaagatctagtctctagttttgtactccatgtcaattcccactaactctaccaaacaagatattataattatttttttcatattaatatcgttacctgttcctcttttatactcctgccaaactaagcggtagaagcctctactatctaccctatatatgcatcatttgtgtaatcttagaaaaataaagtgccccaatagtaaccccacacatgggttgcgcgcctacacacgtcgatccaggacaagtaatgaagttcgattcggtccttcttgcttagcttagccatggggcttttttttcatcggttgtgcttgactcagatacgtgcaaacaagcaaacacacccttaagatctagtctttatactccatgccaatcctcgtgtaaactctcattcctcttctcccgagttaccaaactaatccgtagagacctctaatctctatcctatacaggacgtacacgtgcgtgggtacacggtgtgaatgtggttttgtgtctatatgcatcctctgtgtaaaccttataaaaagaaaagcgccccaaaagtgccccctttgtgtgtaaccttaaaagtgtgcctggtccacacggctggaacggaagcgtacgaccgcaccggattgtattgaccgaccccgatcccacgcacgcacgcacgcacccaacacgacaaatccccacgccgcagtggtgcgccaccacccaaccccaaccccaacacatccccacgcccacgccacccacccctcttctctccccccttcccgcttccctcgtcaaccgaatcaacgcctccgcctcccatccctcgccgccgacgagctctcccctctcctccccccctccccacctcgccgtcgcggatcgccccgggccggccctgaccgctcgatcgcccgccgcgcgccgcccacccccaccccccgggatggttcacagggcggcgtctcctgctcccgcggcggcggcggtggcggaggaggaggcgtgagccgagggggaactggagctcgagcgagatggatgccgccacgcgccccgccgtcgtcatcgacaacggcacagggtaaggcggttgttggttggttcgtttgtttgtttgtttgccccctctcgcgttgtgctctcctccggttgttagcttcgctgcgtgatccgtgcgcggcgtgcgcctagctagggtttttccgcgatgggattggctgtgctgtggattcggcgaggcgagcgtatgtcccttgtgtgttatggcgatggattgcctgtaccgttgcgtgtatctgtggcttggattattcagtcgttcagaggtttcccatttcgcgtccttgaggttctagtcaatcagtaggaactccacttcatatagttcagaacttcggatcattggatttccgagtgatgctgtgttggattggagtgccttttttgtttagttgcattagttgcaaatggaataggattgggttcatgtttggggtgtggggatggaacatttaaggttaactccctaattagccaggacatgatgcagctctcatgactgacgggtttgatttagtgtctgaaaatatgtcttacttgaagcatcctgattcctgaaaagctaaaaatggtagataccagaatcgggcaatacctgaagatactgaaatagagtaaaacatatataaatagtttgtaggataaagatgtttcccctgaagctgtgtcttgatttatctgcaattgcttgaaggccgcacattgtcaccccagtaaggttatgtttgattgttttcttacaccatcttgcatgatcttatgtttaggtatagcaaacttggattctctggtaactctgagccatgtttcaccatccctactgtagtagctgtgaatgagtcttttctggaccagtcagagatgtgcagtagtgcaaattggatagcacagtacaatgcaggtgtcatggctgacctggatttttttattggtgatgaggctctatcactatttaaatctagtgggctgtacactagaaaacacccaattaatcatggtcaggtatgtttatgtgttttctgtttgtaataacaacaattgtttatatttctatgttatacgactatagtatgtcccttttacccttttgcaggttgatgactgggatacaatggaaagattttggcaacagtgcattttcaactatctacggtgcaatcctgaagagcactacttccttcttaccgatagtcctgtcagtacacctgaaagtcgtgaatgtgcaggggaaattatgtttgagactttcaatgttcctggactatatatttctgttcaatctgtcctcagtctttctgctggatatgcctttctgaaaagtatttctgatgaggactcggtttctgtggtaggttctgtaaacatctgcttttcatgctttttatttgctccagtgagacatttgtttccacatggactgcatctccttgactgaaaagaattttctgtattacaaaattattgtaaacttgttttaatgacatgtagccctgctatgacaaactctgtttttgctccctttctttaagatatttaaatagccacatttcaaaaaaaaaaatccagtctgttcctgccatattatccatagatatttgttgcctgtgttgttcctagaattcctattcttgtatgcagttttgttttgctattcccttgtatactggtatgcaaataaacatgttctgcatattgtgttatatgcgaagagaagtatatatttaagcaatatgaaagacagataatactgattgaagcactatgagaaatcaacattaatacaatatgactgtgtaaatttagtcttttagttgccagtttggttgaggataaagatctgtagttcctagcaagccagtaccaaccttgcaaaagtttgaacacccataattcatatctgttgggtctattcatgctcccttttaattacatgcccttaaaatttctggtacaccatgctacttattattgttaagtttgaccagtatattttgtcagtctgatatgacaggtgtagtagttgatattggggatggagctccacatgtggtgccggttgtaaacggctacgtaattgggagtagcatcaagtcttttccattttcaggaagtgacgttacacagtttgttttgcagcttttacaggtatttcatcttctcctcataagtcatgttgttcataaacaggatgtgtgtgtgtatctagcattcatatagtgcaaatacattgaaaggagcatcgagtagtttttacagtactaaattagaacaattgatactattctcaatgttctactcagttttcatctgtaatttgagttatgctgctcccagatctttattgcctctataattagttgtggcctgtcacataatgtttttagtgattaatggcatcttttgttgtgcaggaaagaggtgaacttattgcacctgaggattctttggatatagctcgtagggtgaaagaaatgtattgctacacttcttcagacattgtcaaggtattatgctgcttggtttcggagctacttactcaataataccttatgttttttagggtaccttgttgtaattttccaacggtgtacataaatacattctttgatgaaatagttgaaagtgatgtttctgttgaagtatctgtatatcgactatcgagtcaacacaacaaattccatgaaaggaatggtgtgctgtatttttttttcagaatacgcaggagataatggcgtgctgtatcatcctttgaattttaaatgcgaaacaattatgtttgaagaaacaaaaaaaatgccaactttgttgtgaattgtaatttgttttgttatgattatcacggattagttaatgcctggagaatagcccatgggcaagttgcagcatgattcggatggcagagattaaattttttgtgatgttacttttgtcatggatttatctgctggctaatatatactacatatgatattattattctggttctaccagcaagattgaactgtagtttagacttatcttgaacagataggttattatgtgtttccgttacaatttcaggagttcaagaagcatgacaaaaagcctgataagtatatcaaacactggtctgctattaagcccaagactggagtcccatacacaattgatattggatatgagcgttttcttggaccagaggtttgttcccatttctatcatctagtttccatgttcttttagtagtgttgctacaattgacatgataccaatcatgctttgaacaggcgtgctaccctactgacgtgataacatttttacagcttttgatgttataattgattgtgtcctgtttgtttgtctaatgtgctactccatgaaatcatgtgcattgttggaatgaactgaaagcccatgttatgattgaacatgtatgattagttggaagagtaattctgttctctagggcattcagtattagtgaaagtccaggggcttcaacacaaaaaggactaataagaactatgggtcaaatgtaaattttgtgttgatctgataaatgcttcctccagaagtcattttattgacatttggactcttcaccttgaaatgacattaaaaggagaaaaacatgaatttgatgtaatttactaaccttctactagcgcaaatgcagatcttcttccatcccgagatttactctgccgacttctccactcctctacctgaactaattgatagctgtgttcaatctgcgccaattgacacaaggagagatctgtataaggtgctttgtttgaactctgggacacatctaagaatgtgacatatattgattatgtgatatttgactatttgcagaatatagtattgtctggtggatctacaatgtttaaggacttccacaagagacttcagaatgacataaagaagatagtagatgagcgtgttgccgcaactaatgcccgtcaccatgtggaggtgaaagtaagtacaacgatgattggttttgagttcatacggcaatacttgaactattccatttgtgttttgtctcaacctgttgtctcaggagtctttgttgacaattaattgagtgtttcgttcgtctaatgttttggttccagcctgttgaagtcaatgtggtcgcccatcctatacagagttatgcagcttggttcgggggttcagtagctgcttctaaccctgaattttatgaggtgccttccactttacactctttgagtcttgacacctcattctgcaaatttaataatatgacatattctgccatataactttgttaataagtcaataatatgcttcaggtcaatgcaaaccatatgcactgcacacgtgaataaagtgataagatggaatctaaagtgtttgtatgttctctttcagagttgccacacaaaggaagaatacgaggagcatggagcaagcatctgccggaccagcaccgttttcaaagggatgtactgaattttttccacctgtccaaatctctcagtaggagttcgtttaggtttcaccagatagaaatatgtagtcaaaattgattctttttggcccatccaaagcatcgccggggccatcctgattagattggtagctcaggttgttgttagctctctctgtgttcatgctgtgtatagccagcagctgctgttcctctgtttctgttcgaggtgcatgtttgtagccaaaaccttgggcagcgaggccttttcccactttctacatactcctatttcacaacattttttttctacacatctttttttccagatatatattcatgatgaagaagtttttgctaataagaattcaggttatgcattggactgttgttaagctgaggtaattgttcgttgatgatattgaagactttgaaccgtatgacaaaataccctttctgatcaatcaaccaagtgcatgtatgttacggttgcaacgagccaataattaccgagagacgattctatcagaaatgcagatgtgcataaaatttgcatctgaacaatccactcaaccataaacgaaaactttagattcagttgtagtatcgatcatgtggtctatacccctaaattttaaatcttaatatgcacaacaaaaaagacaggagaagcctacagcaatttacatggatgaagctggctctatgcacagcgcacagcctagagtggagtttcagtgatcaactgttcaaaattacatgatgttctctctgtttctcatggaaaattggcatgacgtggattagcggcaaaacagggtgttcatcaggaaatcctcaagagagaccaaccttgtagttctcagatccagcagatgattttaatcctcagaagatcagattttctgtccaccagatcggattctggcatggtggcaataggagcctgatgtgtatcctcaattcaccatatctagcgatccggaccaaattcagatgtttgagatgtgatagcccccatcatggaaacctgatgtaatcaagaactaatgttttggccggaaccacaacggtcttgctaagcacgaagagcacaagtgttaattcgagcatcagaattgtatttaggaatgtccgatcaacgatccagccaaatatcgtgatgccacctgggttgcccagaagatacagcactgcagtgaaacacagaagaataaaaaaaacataagaatcaaacaggacacccaaaaaaaaaatctgtatatgaaatgttagctttaacacttaacaatataaaagaaaagaatgtcttgtaaagtaaggtatgcattaattccaagttatcacaatgaaaaaagattaagcaatgcaaacttcaaatggaagctttagatttactaaccaagtgattccctcttgtggtatgaagacatgtatgaagccaattgagctgtgccatgagaattgccttgtactgagccactctccagagactccaaatcactttctgaaaagtctctcaagaacatatgtgctggaaaaggcacaaggttcccagaactgtttggtgtgcttacataagtagaatcactagagcatgttactaaggcatgccatcgactagccagtgaagcaatgttttgagctctgtgagaaattttagcagctgcatgcaaacaaaggacaagaccgacaacttgaacaacggaagagacctgcatcataagagaaatctatttatgatctgttttgtttttaaacataaccagaagggaacattatgtgatttttaatattgtactcacagctatatcaccaccattagtgaaattgattggtccagtatatgctgttgtcttgaacagaatggcaaactggcttgctgtaacagaaaagaagagcagcaaaaggaacatgcggaacctgtgactgattttggagagattatgacgaagctgcaggtgctcttttaaatagaccaaaggatctgaatcttgttctagaagttttccatagtcatcgaaatgaataacttgtaggttgcaaaccaagttgaaaagcatgcaggaggttaatataattgtggtcagatacatccatgacatgatggaagcaaacagtacagcacatgatctccaagtcgactcttggaagatatgggagaaacggaacatttctcgtgtgaccttcacaacaaagcatggcaatatccaccacaaaattgtgctgaagaaatcctgccatagagattgaaaacacatgtcaatatggcaaacaaaactctggcatatcaaataacaaatgcatggttattaccatcctaaacattaaattttgcaattaaaacatccactagaaaaataaagcatgaagcatcacgcaaagggtgatagcagtttcagccagaccatagacctagcaggacacagctcatttttatttttaatttgtcttctgttccaaaaagaaaaaagtacagaaatcagagtgtgcccatttcctaaccaaacattgtctattgataacaaatcaagtatggctttatgcttcaattgattcctcccattagaactgctaaagacatatctgaagaaatgtgagtcttccagagcacgattctttgttcagcccctaatgacgcgtcttcatgtaaaaaaacacaaacaggtttgtcggcacagacaaaaaaagtgacctcccatgcacatgacatcaactcacatgggggcataagtagaagtagcaacatgcaaatgcatatataactgagagaatcaatcaccgcagttcacccttcactgaagacaatcccatgaatccaaggtgctaccataataaaaaatgtaactccatacaaaagatctcgtactaaattacaacctagatgcaagcacaagcttacaaccacagcctcaaaatcctccaggtttcctcaatgctaaacaatctgaacatcacattccacctgagtccacaaatttctccttcaaatgcacaagttgcagtaaaatgacacctactttcatgccataatctagtagtggagtagtaattcggctgcaggaa

SEQ ID NO: 62231 - DNA, 7284 bp, Oryza sativa
  unsure (1)..(7284): unsure at all n locations
ggccttcccgagcgggctcaacgccgcgagccccgccgccgagaggaacgcctcgagccgccgcagccacttcgccagcggcgccgcgtcgcccgcgcccgcccccgcgggctgcagcagaggcgccgagatcgctgtatggttctccgacggcgcgggagatcctctcggaggtagagnagccggcggaggaggaggaggaggaggaggcgccgccgccgccgccgccgcagctccggcgaggcggttgctgggcgccatgagggcgggaaagggtggggctcgccggaggggcagaatggtaaataccgggcgggtgagtaggcggagacgagaggtgtggggcctatttattctagcgacttcccgggcccacacgagtggtgggacccacatgtcagtggacccggggtagagtgctcagcgagcaaagggatctctccactccacggccaggatcgcgtgttgcccgcgccgtccggggaggggtaggggacacgtggcgtgatcccatccgttcgtcggtgacgtggcagattcgagtggaaggctcgtggagtaattacgtgtgagggatgccagaaagatccgcatgactggcaaagtgaaagcaaagtcgaattctaaattttataaaatttggatcaatatcgttttcaaattaggggaaaagtgtatgttcgtatttctatagatgtatatccagtagttgatcattttgtttagttcgtgaaaagtaaatttttaggtgtcacataggacgtttgaccgaatgttggaaagggtttttagacacaaatgaaaaaactaatttcataactcgcttgaaaaccgcgagatgaatcttttgagactaattaatctgtcattagcacatgtgggttactgtagcacttatagctaatcatggactaattagcctcaaaagattcatctcgcgatttctcctctaactgtgcaattagtttttgaatttatctatatttaatactctatgagtgtaaccaaagattcgatgtgatgtttttggaaaaaagtttttggaaactaaacagggcctttaaatatgcgactgtatttgtgtggacaattaattataaatgaaatccagaggctgagaaatttgttctattataaaaagaaaggaaaacgtgtggttgcattttgtcatatgctggatatatgttaggccataaacaacctcagctcataatttaacccctgttgacatgatttttgtgctaaaaaggtgatcatgggaattggggacagtaagaaaactctagaccaaaaaagggtaaacacctttagattagttacatgtagttaaccttagattagttagatgtagctactagtaactagcagctgttgcaattagacgtaacctctagataaaagttggttaaccactagatgtagctagcaactactgcaactcgcgactacttctgaaaccattttgtgtgtgtatgtgttttgattgatcctagtcatcaccttttttcttgacatgtgttagagccactgaatcattggccccatgccgatcaccatatgtccatacacaaatggaatcgaattagcacatcaccatcaacacaaatcccatgattggctgttttttctcctgtgactttgtggcaaaaaaggagcaacacacccaggcaaaagaaaatagtccaggagaccaggaattcattagtaaaaataatgaggctacatgattatgatgtagcttagaagccatgattactaaaaagttttcatatacaacacaacagttctatgatatctaattttcagtaacaagaacagctacattttttaactcgaaccaaatttaatttttgaccctacttagtatcatacgatgatgtgagctttcagaaaatatatatcggcatgcatggatttgaggtggtagtcggtgaccgggcgagcagctcgcctcagcggcgacaacgacggcgagctcatcgccggccgcccatccgccaccgccagaccgggcgtccacggagaagttgggcctaattaaatcctactaaataagacgataagaccaagtcagttccatgcggtgatgattagccattgttaattgtgacaggtcccctgtcaatgccggcaaagtttaagctacacaaaggaagaagaagaaatgactgagtcacaatcatccagcagagagtgtcatcagtaatcacccaacagctggtcatgatctgcaccagaagaggagaaaatgtatcatgaactatattataatggggttcaataattcttgcaggagaaatgattctttcttgacatcaaggcaaatgagaagaaaatgggggaggaaatagttggtatatcttggaattaaattgatgaagtctatttctatctctaataaatatgcaaataattgcaccaatgctatcatgattagttaaataaataaaataattgtaactcgacgtggagcccttttgtacatgaaaattatatatggtagaagaagaaaaggtaggcaaaaaatagattgaagcatagtcataaaatatattaaagcttatctgctaaagctgctacgtgcaatgaaacttgaaagaaacatagtagctaaatcagccgcaactcaatctagcagaatattcgtcacaagcaacgtaggaagaaaagaatattagcgcagaatggttcacgtttcacagtcaattagccccttgaattgaagccagttaacataccaaattgtcaaaggtgcaaacagccatgcaacatgacaaaaatggttgctgcataagtaaaccatatacttatatagcttaacagaatgacaaagcagaggacgacaatccaatttcgatacagtagatctatattgattccttgactgctgctaccctcaaaaaaggttggaaatggattggatctataaaatactgttacagaagttcatttgggttgtttggagatatgcctagattctggtattccgattccaaacgtgagaatgaagacaagcaggtaaacagcattaaaatcaggacacaagttatcattcagaacacaagtagacagcatcaaaatcaggaggaacgtcaacattcagaacacgcaacagaaacttcagttcgaactctgcagatacagtccatggtacgaccaacaaggtgactatcttacataaggcagcaagaagtggcaaaatgattgtgttaatatattatattctggccatttagaagaacatggcaagaaattcatctaggaaatgtggatgcacaacaatatagacaacaaggacactatgaatcagaagtcaatctatcatacaaaatacaggacaaaaatagcttctggagagcctagcagttagaaaagggaaacagatactgacctataatctacagtaacaacagctaaaactttccacatcaaaggtgtagttttgttctccacgtgcaaccaacaactttctttggagcaggattatcaggccccctatctcgctgcccagaagtgaaatagagccaaccatcccagtaaccagctagggccgtcttgattcggaaaggcatgcggccaatgacttcccatgtctgaaaaaggagcattccagatgtttatctgtcaaatcatttgactatgcttgggagaatataaccatgaaaggtgcatataactgacataccagtgtatccaaatcgaaccggaaaacttcaccgacaagaatcatctttttggtaataggatgcttttccgtagttccaccaacaattattacagagttattaactataacccatgcacactctatgtgggaatttggctttggcagtggagatagttgcttccatttatttccatcatctagcatatacacatcaccgtacacaacctgcaaaagtgcaaattgtgtttatggcagaatcaagctatagccataaacggctagaacataaaaatcaaaatgtaaacagagactactaactagaattcttatatggaagttcatgtcacttttttttttaacaatgataagtactcactgggtgtaactactgttatttttgtttagaatagttaaaaacatcaagtgttaatatcactaagtggccaatgcaaactgtagcgttatatcttgtattttgataataagggaataaacatcaggtgcaggtaagtaatcttcaatttgtaacatcaaggagttacataagcatacatacctcatgcctccgtacacatttaaatatcggcgagcctggttttgccatgaagtctccctcttgaccgccaatgacaaagagtttatcattagcaacaatgcatgccctgtaaaaagttaagacaaaaatgaagtactgtcaatattctaatcagttgcatgtgttctcactaataaaatctgcacatcaattagcaaactgcataaacggcacaactgacaacaagtacactcgtacaaacctatgaggtccaccacggggtatggctatctcagttcgccactcattctccaatgctttgccatccttgacagctaagctccagtgctctaatccaggttcatggcgatcttcttttccaccacccatcacatggagccgtccacgccaaagttgagtagcgggtgcatacctaaggggtgttacaacataagtttgttttgtctacctgattgtttatatggtatagcaataagatcattacatagctttagaacatcttaaaatcatagcagaaatagcagcctttttcagatcaacaaattctattggcctgatatttgctcagtaatcattactaggctaaggttgatcgataattcaatactaaaatcaacataagtgcatcaattgcttaagtgatagcagcctaagaattaaagatgatacacaacaacacataacataagcaccaatggtaagtgatgacagactccatagagcatacctaggaactggcaaagggggcagttcatgccactcttttgtcactgtgtctacaacgaagttgcggtttataggtgatcggcactggggaccgaattgcccggtcagcgcgtaaatgtacctcccatctgttgctattcctagatgtgaatttgccatctccttgggcatatcaaacctccccgtccatgtgttggaagtgaaattgtacacatcaacatgagaatgcacctgaaattgaggtgaacagaaagcagaaaattagtaaatgagagaatgcatttttgcaaagagagtgtggaattgtaagagggggggattctcacatggtcgaggttctcgtaccctgcgaagacgtagagcaggtcgccgatctggacggagtagccgtcgaggcggggcacgggcgcctccggcatctcctcccagtcccaccgcggcgccggtatgtcggcgtacgtcgcatagaggtagccctccgccgccggcttcttcccgcgcgccctaccgctcttcttcgccgttgcctgcataggctggtagagtaagctgcatcacggcggcggggcaggccgcattgggcggaatcaagcgcttaccgtcctggaagcggaggcgagctggccgcggccggaggtgccagaggaggaagatgatgaccagaggaagtcggcgacgaggccgagggcgaggaggagagcaatggcgagcgggacggcgaggcgcggggacagtggcttgggcgccgccatggcggattggagggaggagaacgcggcgacatggtcgggggtaggggggttaaggagcgaggcggtggtaccttttttggtggggggaaacggtgggcggccgccggagtgcagcgggcggtttcggcggccgccggcgccggtggaaatggaggaatcctggtgctgtgctgtgctgtgagcctgcaatcttgggctgtacgcattgtaaataagtctgttgttcctccctcctctcttgctcgcgaatcgcctccttgaaccgcaaaagtgcaaaatgagtgtagcacctacttcatctttgaaaaccggtacaaatcaactcatttcatggttttctgctgatgtgggagtttgatcgtgttgacttgttgagttagcaatcctggtgctgtgctgtgagcctgcaatcttgggcagtttagtggacttgggccagtattctgtacgcattgggaataagtctgtctttcctcccctatcttgctccccagttgaattgtctccttcaaccgcaaaactaaaaagagtatacctttttcatctttgaaaaccggtgcaaatcaactcctttcatggttttgaaaatggcttctactgatgtggcagtttgatcgtggttaacttgttgagttagcatgtgatttccacctcatcttgccttcttccttaccccctcccccctctcctctcttcctcctcgctcaccttccagctagggatgtataagtgggccgacccggagaatccatttatagataaaattagtgagtaagccacagattgatttgtgtattgcctactagtatttttgacatataagtagattcatgggttgactcaattacatccataaatacagtaagttagaccacgacacatgaacccgcaggtttactacttgtttgacctataaacaagttcacggtcacccgcctacgtccctacttccagcaactacacacgatggttgacgactcctccctcgagctcatgtaaaactaatattatggctgtgttcgctaggggaggatgggaacctgcataatgggcgcggaaaacggagtagtttattagcgcatgattaattaaatattaacttttttttcaaaaatagatcaatatgatttttctaaacaactttcgcatagaaaacttttttttaaaaaaaatacaccgtttaacaatttaaaaaacgtgcgcgtggaaaatgagagagatgagtgttaggaacttgctcttaagaacacagccatggatagattcatgcgctgatcgaccgacaaaatttcggattgttccacagttaattcacagtttaagccaaattttaattgataaagcgaaacgagctcttaattaacacactgcactttggtagcagcagcgacttcatttattctagatcgggtacaccgtacatgtacgggccaacatacggtgcatgcagtgcgtggcacccttaacggaaaacgtgcacattattagtactacatgtacatgcgcacgtgcgctcacgctggtatctacgtacgcctcaggccggggcggcgagcacgccgtcgtccctgtggccgggagag

SEQ ID NO: 62232 - DNA, 4353 bp, Oryza sativa
attcctgcagccctcaaacaccatcgattaattcgtgtctgttaattaatcatagaagttggattctaaactctcaggtgaacgtctactagtttcttatataccacctaaataattataaaaaaaaattttaaaaaattacaagttagtaatatatcattttacaaatatgcaggttcaaattcgacttttacaagttgttatttttgttacaacttgtataagttaaatttcaatttacatatttctgaagtgatatattatattttaacttatcatgttaatttttttgaaaattttttttaaggatttagatgccatgaaaaaaacgggtggacgtccaccaactgtttaaaacagtgatcgttcgtcgtctcacccggcgcatgacgccgcggttgacgctcatcttgatgagcttgaggacggggagcttctggctgttgaggacggtgatgcggccgccattgggggtgtagaggtcggccttcatcgggtcggcgacgttctcgcggagcttcatcaagcagacggcctcgtcgatcccgttcccggcggcggcggcggcgttggcgcccctcatcatctcctcgtcggtcacccgctccgtcgccgggcggagcatgcggaggccgccgcggcggacgcgcacgatgttgccgcgcttgtcgctgcggccctgcagcttgcgcgcgatgtccgggctgacgcgcatcgactcggcgagcagctcggtgtcgaagccgctcaggatgttgtacgactcctcgccgccgcgttccgtctccgactccgacgactcgccctcaccgtacctctgcctcccctcgctcctcgcctgcccgccggctagccggaaacgctgcagaagaaacattgcacgttaggtgttcgaccgatggagtccatcaattaattaatctcgagattgattacgcacgtacgtaccctggaggtttggtcgagctggttggcgttgttgctgacgtcgtgaacggagatggcgacgagcggggagtcgccgtcgttgtggacccagaacggcgcgccggcggggatggccacgacgtcgccctggcggacggtggtgatcctctggtgctcgtcgcggatggactgctcgaagctgcggcggctggtctcctcttcctcctcctcctctccctcgctcgatcgccgtctctcctcatcaccacggcggccacggcggcggcgctcgtcgtcctcctgctcctgcgacgacgacgacgaggtctcctggtacgtctcggggcagccggggatgacgacgccgacgatgccacggccgtggacgatgtaggcgaggcggggggagttggaataggaagggaggaggaggccgttgcgctggatggtgatgcgcgcggcggcgacgccggcgcaggggagctggccgtcgcggtcgtcgtagagctcggtgtggccggcctcggagtcgacgcggcgcgtcggctccagcgcgcggatgcggcggtcgatgcggtcgcagctatcgcgacggccggcttcttgctggtcgctcacggcggaggcgccgcgcaggaggaggatgcagaggcagagcgggatgagcagcgacgccgccattgatgccgtcttcatggtggtgtgttgtgttgcagtgttggtggtggtggtggtgagacatggcgggaatgaggtggtgataatttatagtgggaggagggggagtgcatgcatggcagctcagcgaggggttttggatgcgtttgggttgagtggtttgtagctggacgcggctcgcggcgtcatgacttgtgacagattcatagaacgtacacactcacatattaaaaattttgggttaattagatacgtgccactaaaaaattgccggttttaaaatataccattactatttgtgtatttgtaacaatgccactgctgcttgttcgtaatctcaatggtgccactaagatacgtattttgcatgtattggacgaaaaatcccctcatcttctatctctctctcttcactcatcttctacctctcttcgcctgcgacatccgtcgcgggagctcggagcgccggacagaacaccgcaggtccgccatctgccgaggctcttcacgaaggccgtcctcgctgcatcgggcgtcgaggtggtggaggcagctgctgaaccggagaagctgcgggtgcggtgagggagggagggagggaggtgcaggagcttgccagagagaagtggccgctctttaattctttggtcatcgccattgcccagagctcctcacacggcgaggagaggcgactggatctaggacgcgctgatgcacaagaggagaccggcggcgggtcgaggtggagggagatgacgcgcatgaggaggccggcggcgggctaaggtggagggagacacgaacgaaagagtgctagagaaaggaggaggtgtgactgtggtggccaccatcgccagtcaggtcacgccatggaggagaggcggaagaagaaaggggaagaagggagaaggaataaggggaaaagggtagtttggtccagatttttgtaaatgcatccaaagggtagtggcatatcttgaatacgtgtaaaattataatggcatggttcccgatacgtgaatactagtgtcatatttcaaaaccaacatatttttaatggtatggatccaattagccctaaaatttttgaataagatgaagggtccaacgtctgcctaaaaattaatggcgttatctattaaaatatagaggtagtatcatcagatattatgaaagtttcaggtattatgataacttcaataaatataaaaatatcggatgatacctaaataccatgatttctttgggtatcatgaaggtatcatgtatgatggtaccattaaacaggtacgagtagtatatagatatagatatggatgatacctaaatatcataaatgtatcaaatatatatcatgatatcttaagatatcatggtgatattaggtataatgataattgaaccattaggtaccaaatgtcatagtacaagtatcttggtatcttggtgtcatggagatcaatatcatgatacttgaaccttttggtaccaaattttatagtacctatgaatattatgggtgtgatacctccatctcaaaaattcacttatatataaatatggacaagttttttttcagatccttataaaaaaaataaactctttttcaattagaatgaagatagtatcaattattaagtattgtggagttattatgtatcataaaagtatgggaaaattagaaccataccattataattttgcaaaatttaagatatatcatcctgacccacatgtcattgactcatgtgggtcctacatgtcattgagataccgatggcatatctcaaactttgtaaaattataatggcatggttccaatttaccctaaaagtatcgggtatcatattttattttaccaattgatctaaaagtaagtactaccattcttgccacatgcgtgtaccatgcctggttaggtctggtttctatcgtcgcacactttctttttccaatgaaacaaattgtaatttttctctagtaatttggccgcgtttgtgtttagagaaaaaaagaagattaagaagatacgtgaaacgagatgaaccatactgattagttgagtattaattatttaaatttgaaaaaaaagaattaatataattttataaagaaattttcctatagaaactttttgcaaaacgtaccatttaatagtttggaaaacgtgtgtgtgtggagaactagagagatcttctctaaagctgccgaacaagagaaatcttctctcaatcttgccttgtcaatcttgtcactctcacagcaattggaggtgtaggatgggtaacaccacagataaagtgagataagtgatgcatcttagattagagttacagtactactctattcgtctcagaaaatgcactcagtcttttttttttgagaaaatacacttaatgtaaacaaggatatgacatcttctattataatagatctggataaagagttaattatccagattcattgaacaagaagaaagagtcacatatccgtctagattgagttttttttgagaatggtacaactcaggacgcacacacacactacactcacaccacaacacacgcgcacacacgcgtgcgcgtccttaacacacactaggaatgagattggagaccactaggtctcagtgcacgggaaatgtgcagtcccactaaacacgcacacgtatgtaccttatttctagtcgagactgccccgaaggacagtcccgaagaaagacggggaaaaatcccgtcgaggtgaggt

SEQ ID NO: 62233 - DNA, 1385 bp, Oryza sativa
agagtaagagctaaaaagtggggtgtgggataacctcagcaataatataagcgaaattccgtgggagtattaagtatcccgtccagacgaaattccgtggtgtagtctctttttaaaaataatataagcgagaatctactctgtttagaaagccagaaagcttgagattgtaataaaaaactgcaacaaacttcttaagatttaaaagaaactacaagctctctaaacacagtgaaaaggtcctacgagtctatccatatgaccatatctgaacaattttgttaaactttacacgaactgtaagtctgtaacagcgtacgtgcattggacagtagcggtaggtgaggtgcagggcatggacggacgggagaacgcgagaggttgcatgccatgccatggatgccacgcgcgcgccggagacggccgtggcgccacggcgacgcacaagcgcgccatgccaaacccagcgcgcggcggccatgcgtggcgaagcatgtcagacggtgcgctccagcgcggcgggggcatgcaggcgacgacgacgacgcaattaatcaacctaagcggcgggagtcccgagctcagttaccaccatggaaacattggtatcggacggatcgatccacgtagggacgagggggaaatagtcgaaaacggtgtcattattttattattttatagaaacaaataaaaacagaaaaattttatatttatagatttaattatttagtgtcaactttgactccacattgatagaaataggaaaaaaactataccttatttagaaacggtaaccgtggtaaaaattattattattatattattttttctgtcgctcgtcgtgaaattttcataccgtttttatccatcggtctggtgggctcacgggttgggttgggccgccggtcgccgctgcacttggaacaggcctagaaggccaggcagcaagacaaatatgtgagccttatgagattaactccttgggctgttttaggcatcggatatgtttcacttacatataggtctcatgtgtttttttttgtttttttgcttattgttctatgtcactcaaaatagcctttaatactgttttaggactgaattttgaataataaaggatgtgttcatccccattttgcggtttagggatgtgatttaaaacttaacgtaaaaaagaagggacctaacatgaacttattcttccacttgttcccgtgtagcagcccagcccaattatgctgatcatccatgcagaaaagtgaactaaacattttcgtcagatcagcactagaaaactgtctgacaaaaatatagcaattccgaaaaattaattaaagctctctgtttacaatcccaaagaaaaccagtcttctgatcgggtcgaa

SEQ ID NO: 62234 - DNA, 1656 bp, Oryza sativa
agttgtgacctgtgaagatgtgtatatatcttccttcatgtgtgctctactggattgtttgctttggcctttggtgcttgtccctgtgacttgagacagctacccagaagatggggccttgtgtatccacactttcaagcgatccaaaagggcaagaattattaagcatgcatgctgttagcatggttatcttttctgattaaacaatcattaatctcaggttctagtgatttatagcacatcagtgagttaatgttggtcaagtctcacttgctgcaatattagtcaagtcaagagaatgttcattttggtttcagatagttttcggtgctcaagtggggtacttccacaccccaaaaaagaatcagataccaaagttcagtcattttgattctcagccaaatgctaattaagaccatctgatcaccttgacccaacagcctaatcatttggaaaattaatagaacacatcacactgatgagtaaaactgatattagtggatttgtcatatattaaataaacacttccatataattaagtttatttctttttctaaatatgtgataaagagaaagtcccattggtttttagtggctagcaccacaaattagtgggttgatcagcctgggtttgggactcactccgtgcttaaaaccattgatataaagtccttcctttcatatccagatgaagtcttacggcctcatcgtttgtcttatttggggaacaagtcaaacagcatatttacaaatgaaaaataatttgtgaataaaacttctatatacgtgttcttaacgatctaaaagcaaatactgaaaaataaacttcgatgaaaaaaaatccccaaatcactaaggttgaaaattcaaattttgaatgataagcataagcataagagaaaagataaggctattagacaataagatttagaaaataacatatattaaatttcctgaatatgtgataagaacataagaagattatggattgttacccctaaaagaaccccaaaagactgaattttaagaacaggagaatatccctcaaatcctcaatacaaacaaaaaaaaacatcacattagaaaaaacacccatcacattactggagtacagtgacagtcgacagttgacactaatccagatctcacaagcccagcaggtgagaaagcctgaaaaaagcagtagcagtaaaggcattggcaagctaagctaagcaaagagaaacaacctataggttgcagacttgcagtgacctgagtagcaccctaaagttttaaattcaaatctctatataagcacattttagattgggttatttgagggctaagtttcatatttaatatgctaagtttctaatataaaagattgtatatatccagttagatatagagaccgaggaaaagaataccatttaaggcgaaaaaaaaagagaagcagccagccagacaggttggagctaggcagctgctagccaactgccattcccacaccaaccaaccaaagaaggaatgcgcagtcaaccacatagcgtgagtcttacccgccaaaaccgccgaaagccatcccccgcctcctcctcacgccaccccctctcgccatcgccgctataaagctcctctcctcccatggcggcgtctcctacttcgatctacacg

SEQ ID NO: 62235 - DNA, 7172 bp, Oryza sativa
gaaagaatttcagctgcacgtttccaattatccacacaaaacatcattgaacaagataagcatgaagcaactgacatctgaggcctcccgctatcataaataagacaactttgaggggaatacttttctgaaaacacattgatatgatagctatgcaacccacgaagacatgtttttatcccacataaactaaactggcaatatgaatattaaatcatgtgtagtgtaaactgacaagacatacacagaaagccaaaatatctctcaacagcttaccttctgcagcttccttgcgggccatatttgccttcatcaaatcagccgatgcttcagcagcctcaattccagctaagccagtgcagtagctatttcggatagtctgcttgcagcatttgtagccccactgatgatctttccaccatgagccccatacggttgtatggttattaatgaaaacatcctcttcatatttgctcttgggaagggctacatcctgtatgaaatgaactttgagaatccatgaactaatacatgcaaaagacaatagataatgtgaacaactgaaaagtattaaagtaatgacccagaaatggatagagctaataggaaaaactggtataagagctccacaaaacctacactcgtgtggagagttctacattcatgtgctgttccacatttcttaagtttcttgcagttgtaatgaatggtctctataacttgcaactgcctaagtgcttagaacaaaccttaagcttcttgtcatctgatgcgatatggaactagttagctaaacagcgttctcagaaacagattattatgtgtagttagctaaacagcacatcttatatggtgtagagttctatagtgacaggttacggaaatagactattaaaggaagaactatgacaacattacactggcaaagaacaaaaaaaaaacacttgagatttgaaggatgacagaagattaggttgaaaccactacatcctagcatcctaggaagaaataactattgagcaagaagctatagaagtgtaatcgacagtaactagtattgtataccaacctgtcctttgattattcgaccagttcggtcatattcaatctctttttcactttgtccaagaagaagctcccgagggattggttcttcagatgcagcattcccatacttctccataatcttatctttgttttcagatttcaatttctcctttttgatcttaaaactcttgaatagaagttcagcttgagatggggcagcttgcatgtgaatatcctgtcccttatcaaaagcttcccacgcatgtatgttgagttgcttgaactccagagcttgtccgctaagtcgattttggttatcaccctgtgaaaaacaacacatcagaatactgaacctagtagtctttgcaagataagaaatcaatatgggccataacacagtgtaaagcattaaacttgtagggtgtctcatacttaccacatagaatttatcattggggtctgcatctggcaatggatcttcacgcatggagcgggtttttggatcatagtatgcagagttcacatcaaggttcagaagatactttgcagtgtcttccctaatacgcaaattcctcacagttccagtgcttccaccacctgttgtacgtacacgcttctctaccttagcaaaatccatttgagcactctcatcaactttagcctcatctatcttcaaaccatcttcttcatcctcctcctcactagccacgttctcgtcaccctcctcaccatccttctcctcaagtttcttgagctgttgctctttcagatactttttcctagcctcttctctagcttcataatctgcaataacacgggtgtacgtcgatgggtcgtaaccgttccagcgatcacgctttccatcataatccagttcaaatgactccactttctcatctggtgctatattgatgttagtccatttagctcccacactgcgaggtcgttccatgcatgacttcttgtcatgagtcatggctccacagctggaacatacagataattctccgttagacaatctgggctgggaatagaagtaatagaggccaaaaaaaacttaaatatggtaaggctatttggaatcaaaacaacattcaaatatattctgaataacaagacaaatcaaattctacatattgatgcatcctgacttaataaatagattgttaaaactttatgattaaatgctgattaggattaatggcataatgaaatgaacaccgcacttacttctcacaagctcctttcctgtacttgttagcctgaaaaagcttagcacccctatcgtaccatgacttggtgtagttcgggtccgatttccaattccgttgatgcttcaaactctgaaccccatcaaagcaacatgaagtcagaacttccactaaccaaaaatcacctgactcgtacagagtaattttttttcgttagagcaagcgtcaacttaccggcttatcagcgttaagataccatggggctgaggacatgtactgggggatatggggattgatctcctttccatcctcgtcgacctcggcgggcgcgagcccagccttcctcgcctcctcgagctcgagctgcttccggtgatcctctctagacttaaacgacactgcagcaacggagaaatcaccgtaataagagaatcatccgcggaaatctcctcgcatcaaccaatcgcaacagcctcgatccccaattcaggcaacgcagagaccgtacggatccccgcgaaaccctatttcccgtcgaatcgaagcggaatcacccgtttatcaacgcccctagatccaaaaccagcgaaatctacaccaaatccacgcggtttttgcgcaggatcgagctagggttacggaaaccggtaaaaggacgctagcaaaaaacttacccgaagcggtcgccatggcgctgctcttcgcctaggcccgcttctccggcaggagaggagtggacctcgggggagcgcgacgcggcggcgaaaagtcggcgaactgcggcgaggtggggatcgctcgcgaggaggacgaaacggattgggggagagatttccccacgcgtgctgggccccctactacgtataccccctcggcggcggctaccgccattaacatgggccgaaagcccagtaggcccattatgatgttgggcctaactcgttcgggtccatgaggggtcgcgtggggcccaaccccaccaccttccgcgagacctcccagagagatagaccttgcgctttgctctcccatggcgtcgcgtccgaggctttgaaccctagcgcaccaatggcgacggcgacggcgacggcggctgcggccgccccggcggcggtgcccgcgctggtgtcccccttgtcccgccgcgccttcttcccgctccctcgtcgcgccggccccaaatcgcttcggtaaattcaccttgccgcttttcggaccggggttgttttggtttgtggataagtttgagatttttttttttttggcatggaatgaagggtcttcgcgtcggcggcgaggcgacgtgggttggtcgtggtggcggcggatgcggcagcggcggcaggtggcgcggagttcagcgacgaggagaacccctacgaggtggaagctgaaatgagcagtttcccctaaacttttattcgctcggtggacttgtgttttgattttttgcgctgttggattgttagattctgggtattaccccgcttgatagcttcgaccacatgaagctggcctacaagaggaagcacaaggaagcggacgagaatggagatcagtactacctgtcaaaggttctgtattgtgcagagattgtatttttgggcttgcaatgttactgttattttgttgctcggcgctgatgatatacttcttgtggtttcagttggagaaggcatacgacactgtgatgatgcagcagctgcagtataggaagaaaggagtaacatatggttctgttcaggtcagatttctataaatgcagaggcacccaaaactgcaagattttagagtgctttcctacatatcctatttgcaaaagaaacaagttttgtgagtattcggtttactagtgcttatcacaggattataacacataagatggaggcaagtaactaaacactaaaacacatgctatgaatggcaccatctcgcactggtgtttatgaaaattaggggaccagttaccactgcattgaaaatatataaagaactttggaaatggatagaggatcaaacaaggcaacagttgttattatatccagacataagtcacctactacagttagtttatccacaaacattttttgttctattgataaactagtagctcaaaagtcgtctacatcatttcctacaattacaattatattatccagttatgattttattcaccggtgccctggtttttgtttccactgtcaggtgtcgaaggatatcaagtatgctgatgaccagccaattgttccttggggacctaggtacctttttaatcaagtttattattagaatactatatttcattagtccatcgataatctctttgggtgtatgtcaatgattgatgtgatgcatgtttatggaaaataacaagcttctatctttcatataaacacagccatgaagatttggtagagatcataagaaatttgaattgccctgtttctcttgcgaagtggatgaggccgctgaaaggcaggcctgtcctacaagctttgccctattcagttttgctttcctcagctggtgttttgttttcatttccatcttataggacaagcattgtacatgagcagtgaaatttccaggcccccatcggatggcctattcagccaaagaaaaagccaaaatttaaattttcaaacttaattttgacattgattttgagatattttcaacgtagtttctttttcagcattggcttttaagtcaccgagaacacatatataaaagttttacctacaaattcatttttattctctaataagccgttttggcttattacgaaaaaaagccaaacgatgaggcccccaatgttctagttctgcatggacagcgaaattgttgagaaggatatgcacatagaatgcttgttatttaaattaaacagaaacatccatttgaatccaataactagtggttgatatattcttcttgcagatcctccaaatcaacagtaaaggacatgcgcatcaatttaggaatatcagcagccattgtatgcagctcttctcttaatatttagcacatgcctatatcaactagtgatataattctgaccttttttttccttttttgcaattttgtggcactgtcttccatatctgcaagggctctatatcataattgttataacaaaatctatctatttttaaagatattgattctttggggtttacttataagttgggagcatgcttctgtgtggtataatgttcttgtaatatgttagtttgaatgcatgcactattatatagttctatcgttgtgctccagtccaaaatagatgctgtcatgctgctttagcctaaacaagtttttgttcagatacttcttgttttgatttatctaggtaatgtttctgcttgaatgcccttattaagagcccaaaggtatataagtcctattggattatctataaccacgcggctaggttacttttgtttaaaaccttcatatgtttccgaggtcaattaataagagtaaacatgttgtttctttttgtaaagctagaattggcactatttagacaatgcgagtaacactcctatgtttttgttctagacaataatgctttgaggatacctctatctcaatggttacgattttcttgcaaaagatttttatttgtactaccctgcaggttgtttggatagctatcatgggcaatgcggactggaagccattgcagttcctatgttttgctttcttctacagaatacttcaaaagctaagggctactgaaccaccaataacgccaatatataatgtgagaaaatatttcttagtcacctctatttacctttttatgaatcatgatactgtaatttgcacattttactgtggagtgccatgctgttgtttgctacttccataattatcagttttttttgtcaaatataattaatgtatttttactgaacctgtttcatcatttgacttcgcttccattacctgattctgttgtaaactgaaaggcaattaaacaaaagaagatgcgcagaattccgtcccccaaaagcttttgtaacttttcaaatgggggtggttcttactgatgatgggtaccatcatgaatttattttatattaatcttatgaccgttatttgaaatgattagacaatggtcatatgatcgcatcctggtgttttctgcaggagtatggtgaggttgaaggacgtggaatacgaatggcaaaacgagtagtccgtgctttgggtttgatatttggatgtgtatttgccgcgtcattggtaagcaatgctggaattttcttgatctgctgctgccatgttatctacctatcataatatttatcagttgccttttggtttggttttctttgtatgaatctttccagggttatacagcagctgttaacgtgattgagttttcatggcagtatactccacgcattgtttattactatcaggtacaaaagaatatgcactttctttttatcaaatgcaaagatttgtagatctatcaactctgttcagaaccattgcctactattatatataaaaaagggaaaaactaactacctggtgatttcttccaggagttgattgttacagcagctaccgctgctctgctgtacatcacagcctcatactaccggtaaacagacagtggaattacagtctggctaagagaaccatgagatgttaggatatgagctgagattcggtgagtggcacacttgtggactggtgttacctcaggcattaatggagagtcaagagttcacaaattttgaagtataattgggccggcttttgagttagatactgttgaatatgcgcttgtattgcacagttgtgaacctcctcactgggcgtaaggcgtcggctgatgaaaaaaaaatagtgtgcatattttaacagaaatgtaatgtatgagattatatcaga

SEQ ID NO: 62236 - DNA, 6464 bp, Oryza sativa
caacaaaataacttgacaagtactttcaggcttcagcggtatgctaagcgttaagttttgcgcttatcacacttctatgttagctgcatctgtgattaccatgtgccagaagcaaaattctttccatacaagtactattaactttctaagaaaaataatttgatattatcgaataccatgtcatttagacaaacttgtagcatatagagatggcagccccattgtttggctgtttggtggaataagccaaacggtatattcgcaaacgaaaagtaatttgtgaaaggctaaaaaataaatttcgataaaaaaaaccctaaaatcagctctaaatttaagagtgaaaatttaaattttggttgataagcataagcattagtaaaaagatgaggccgtctatattgtcactgttcaccggatcttatcattcctttctttcttgtatacgcacgaaagctgcgtatcattccattaagagagaagaaaaggaaaaaaaaatcacggcaaggggagctgaaacgccaccactcatatcaaacacaataacacatacaagctttcaccgagtctagggactaacctatctaacgattcaattggtttccaccattgtcagttaaattacggaaatttagttagcagaatattagtgcctaatggctgacagtactgaccagtgaccaaagatcacctggtaatggtcgatcaccatcaaatttcacctcaagtaggagcacttgtgattttgtgaatacaaataagctgattatttcttagctacaaaagaatgacatgagttttctttctcacatgagattggcttacgaattccacaaaagaaaaaaaaaactttacatactcctgtacgcgacccgaaaacgcataaccgatttggattctaacacttcaacaaatttggcgtgaagctacaaatatcgccaatccggcagtcagggcaatgaaccagtgttaccaagcccagctatcatgcctgtaaatgtggccactgcaaatccaagcaccccaccagcaaaaacctgagaaatgcatcttgaaatcattaatgtgtttcacatatgtgctagaaatcagaatatcatcttatgcaataacatgcacaattgactttctaaattgctaacatatacattcaagcaacagatcaaacctgagctggtgtgtgtccaaggagttctcggagtggtcttgtttcagccagtggatgctccgatgggagttcatacacaatttgattcaagacctaacatgttaaagtagttagaactggaatgcaatttaagcatccatagaattaaagaaattatggagatatccaacagaaaaatcgacaacatccttctcaacatatgataaatactaggaataacatgggctattaattcagactatcacaaacataagcatgtgcatatttcaaatagaaccacacccttccttctctctccagcaaatgactcgtgtccttttgcttttaattaaatggtaatagaaacgtgaaatattcaggtcatacctctgcttgcttccctgcatgtagcctgacaccaaaagcatcatacataacctgcaagtaattgccgaaaagttagcagcttccaccaagtgaaaagaacaatataatccatgatgaaaatgcagcatactgcatttctgaagcagatgactgtaaaaatccataagaatcacaatcaattatgtgaggatgctacattgccaggtgcgggacaggtagggtgagagctaaatcacaggacacttgcaatctttaaggaagaggctagctgtcagctgtttgtattattgcgatgtcctcgactgatttttgtagtgccaatataagtagaacaatcatagtgctaacatgctattgtccttccttccactagtttaatcaactaaacaaagaaggcctgatcaattataatctcaggatacatcttctcttccatattgcaataaagcgagaaaaaaaaatgcaaccttgctgccatgattatcagagaaaattgattgaaccagttgaatcggatcaagatttaaaatggattgaaccagttaagagaactgtagaaagaacatagtaaatttactcgttcccgaccaatcaactactagtaatattccaaaaaccagtgatcagatccacaccccattaacaaaagcctgaacattcggatgaagaactaaccacggacgcgaagatggcggcggtggcgaagagcgagctgccgaacccttcctggaggccgacggcgacggcgagcgcgacgacggtggccgagtgcgacgacggcatcccgccggaccccaccagctgcttcgcgtcccaccgattctccttgtacctacaccaccccccacccacgccaaggtcaggtcaggtcagatcccgccacggggggagctcggatccaggtcagtgtgacgtaccatgtggtcaacaccttgatgaactgcgcgatggcgccggcgaggacggcggcgacgagcgggcagttgccgagcgcggcgaggtaggagaacgacggcgcgtcaccctcacccgctcccaccggcggcgccagcacggaggcggaggcggaggcgttgtcccccattggatggagcgggcgggttctagaagcttctggaagatctggcgcccggcgcggtgcggggaggggaggcgagcggcggccactcgtcggcgtcgtctgccgcgtgtgcaggtggaggtgagggttcgtgggtgtggccgcgcggaaggtggaggcgagggccgaggggaagaggaattggtcgggtccgagctggcatgtgggcccggctagttgctgacactttgtggctggcattttcttctactctcaagtctgaacagctgcgtttgagagctgaacatggtggttttagttcgcgaaaaaaaaatttaggtgttaaatcagatgttgatcggatatcggaagaggtttttggatacgaatgaaaaaactaatttcataactcgtctggaaaccgcgagacgaatcttttgagcctaattaagccgtcattagtatatatgagttactgtagcacttatggctaatcatggactaatgaggataaaaagattcgcctcgtgatttccatgcaaactgtccaattagtttttgtttttatttgatgtgatgttttttttgggaaaaatgggaactaaactaggcctctgtatttggctgcctttaagagttgaaagaagagtatattttcacgcacatatttcccgaaatgttaaacggcgcatttttttatgaaacattttatagaaaaattgctttaaaagaaaaattaatacactttttaagtttatttttttttgagaaacacgatacaaacgcatgcgtccacaatacacacccactcacctgtacggacatcttcgaaggactaggcccacggatgtctcactgttgacgggtacgtcatctaccactgaaaaaataattagctataaatgcgagcacccgagtcaaatctacggttggatttgaacctggatggactggtttcaccacaagaaacctaaccagttgagttagttcacttcgcaagtttaaaataattaattatgcactaatagcttaccttgttttttatatcttctttattcctctcttttcaaacacagaaagctaaccagatgagttagctcacttcgcaagtttaaaataattagtacttaattaattacacagtaatctagcttaccttgttttgtgtatcttctctattcctctcttttcaaacacagccaatctttgcagttacaaggatacctgatagatatatggtggcatttgaatttgatgaagaggaaatactaagttggtgtatgtaaaacgagaaagtcattagcacataataattaagtttaattattataaacttggcaaatggatatatatttgatattttaaagcaacttgtatataaaagttttcgtatggaacataccttttaagtagtttgaaaagcgggctaagtaaatagaggtaattaaatctgaatctcaatcataaaaaaacagggtagtaggttgaaaagcgtgctaacacggaactagtctctttttcttttttgaaatgttaaaaatttctcaatgagttgaaactgattactgaaaaaataatatggaagaaactcatgtatttctctacctctttttttacacggtatttctccatctctaacgctttaacaacgcagttccgtccatatgtcctcccgctcctactgaagcattccagttctttgaaagaaccataggcatgaggaaacaaaaaaaaataaaccggcttcagaaaaaaaaattcgttttgctaacccatgagatcattatgattctccatatgagaaaacaagaaaaacacatatgagaaaactagttccggatcaattttggttacaatgcgcgagcaattatcatatcattagaagaacatctatatatacatgttgttctagaattttctgtgacatttgatacctattgtgcatcggaattttatgtgtataggacatatttcatactatgaaatgttaaacccgtatacttgcatgagcatttggtaatggagaaactataatcacatgagatatgtgcattagtagacccaacactaaaatttagtccgaaaaagtgcaatgtactttttattaatgaaataaaatttattatacatgaactgtattacaattatacttatcagaatgaatggtcctaactgcaatgcaatatcaacaattataatcctaattttccatgtaattatataattttacaattgaaataatcttcacagaatgtgttccctatttcacagatgtcgtgcttgatcatacccctttccctttgttgctgtcattgtaattgcattttgcttaggcggccaggacaatcaacagttaggcgttgcatttttcttaggccgtcgagacaatcaacaattaggcattgcattttgctcaggcagtcaggacaatcaacaattggtctgaagaaataaagtactagttaaactagtggtcattagttaacatcacaaacttatatttagtatttgctcttttagtgaccaatattttgttgttaggcacttaggatctttgattcatttatgtagaatctttgttcatttatgtagacaagtttcaacgaagcctttactctctcccttatagtatcaaacaattaaacttctaccaaaccaaatggccaattaatcacttgggctcactcctcgccctacgagtctcgattgattgcgtccatgacccaatcaagtcggacaaataactaataacaggggtagcgagatgtgccttgcgtccttaagccaattgttgccatcatcaagttgtgggggcaaaaccatggcttcttcattttctcgggagattaggggtaaagaagaagagggaattatagcttctaagttgcttttccggtcatgtcatacgccaatgtcatggcataccataggagtaagtataccttcggatatgtgcaaacctactttcaatgaatacattttaatgatgcactaaaatcaataaaactctcaataaataaattattcatatatacctccggatatatgaagcttttaaaggttctttttccactaactaacatcggaccactaattgttatccacttaaaacatgcattcagggcaggtttgttttgaggcttaaatttggcttattaatatttgtgaatttcaatagtgtttagtgtctatttggtttgaagccaaattttgatatgcctaagaaaataggccatttcaatagttaacttatgctattttggcttcaatccaaatacaactttgccttcccaaaattaatcatgccaaaacttaccaaaatttggtattgtcaaaaaattagtaaggccaatttaggggcctgttcactttgatgctattttcaaccttaccaaattttaataaagttgcaaaaaaagtgactacatttaatttactgccaaattttggtaactatataagaaattctgccaaaatagcatcaaagtgaatataccctaggtcacaaaccaaaccagccctcaaccttttatcatcaaaaccttgcggattagcattagcttatccctggaggcctttttttaatcagaaaaaaatctcatcgcagaagtttttttttttgggcaataggtgcttctaacaaatggtaaaagccctagctagccccgaggacacgcaaccgcccttaccaccgtccacccgaaaaatccaacggccaggatgtcccccttcgcaacaagccgcgcagcccccgtcctagtcactgccacgtgggtcccacagctcagcgaccgagcagacacctaaaaccgccgcttacaaatgggcccccacccttggcgattcgagcccccaaagctcgcgaggtcg

SEQ ID NO: 62237 - DNA, 5922 bp, Oryza sativa
cccggtggtgccaatcgagctgcttcgccccccggattcgagggttttgtaaggggccgcccctcatccgtggcggccgtggaataataagctgggcctcctccccctccttgaggggttagggttaggtttttgaggaattgcgggtggattttctttggtccggcctgacgcgtgaggggggtttgcgcgcaatgatggggaagacgcagaagttctccaaggggcacccgctcggcttcgtgccggattaccggcacggcgtggagacggtgggggagtcgaagggctgtatcgggagcccggagcggatcgtatcggggagctcgtgtgctgtgccgaagaggaaatgcggaatcctgaagacagaggatggaggggagcttccggggttcaatgtgccgcgggacgtcttcatgctgccgaggatgtcgccttcggataaaaaggacctcgagatgaggctccgcaaggagcttgagcaggttaaggccctacagagtaggctgtttttgaggccggctgcggtgagcatgaatggcggggcggcgtcagcttctggagacgtagttgcaaagagaaacgatgcgaagcttaaacggagcaattcagtgcagtctggcagaggagtgccaccatcagcagccacacctgtggtcaggtctgcaaactacgcagaagcttttaaacaatgtggcaaccttctgaagaacctcttcaagcatcagtgggctggtccgttccttgcgccggttgatgttgtacagttgaacattcctgattattttgacataatcaagaagccaatggatttgggtaccatcgagaaaaagttgaatgcaggcatgtactctacaccttgggattttgctgcagatgtgaggcttacttttgacaatgccgtgacttataacccagtcggtaatgacgtgaatttaatgggcaaagctttgacatgtatttttgaaactagatggaagtttatcgaaaagaagcttccttcactagatgatagattctctgtgagaagagagccatctcaaaagggtgcagttaagaaagataccattgagaaagattacccttctgagaaaaagcactcgacaaaaggtgtacacaagaaagatatgtttaaaaaagaggatgcttcaactaagccagctttgcaaccaaagaagagaaaagcttctcccttggttcagggttctcttgaaatacctgtagtagaagctgataaggtcattgatgatgctcaagtggtacagccttctaaggtgattgatgatgcccaagtggtgcaggcttttaaggtgattgatgatgctcaagtggtacaggcttctaaggagattatgacggacagacaaaagtatgagctaagcgtaagacttcaatcatatggtgggttgattccaaatcatgtagttgatttcataaggagccaccttcctgatgataatgagggtgatgaagatgagttagagcttgacatgaatgtcctaagtgatagtacattgtttgaacttcagaagcttcttgatgactatgatagggtaaatcagtcaggaaaccctacaaaagatgagcatcgtgaggttgaggtgggtgctgttgtattatagttatctttttcatcggttaattagctgattactgttttccaatctgtttggcagtttgaaagtgaatatgggcttagcaactcatcgatgcatcatgaagaaggtgtacatctcattctttgattctttatgataattattgcttttgtggttttgaacttttatatgcatgtttgtaggtaatgagctcgttgaagaagatgttgatattggtgggaatgatcttccacctttgacgtatcctcctgcagtatttgaaagtgaaactgcagaaagaagcagcaagcatagcacttctagcagttctagtagtgattcagaatcatcctccagtggtatgttgtttatgcaatctattattgttttacagtcgctaactttctgtcttcacttctcttctgatgctgagttcagtaacatgttttcaacagcctgggctttataaccttcttaaattctatgccatgttgcgtgatacaaattgatggccttgttgatactgtcatccttattctgtgatgctgttttagtacttggtctgtacatgtatatagtttacaaagtagatagaagttcaaagtcttaactttgagatcttattgatatgtctggactgtttgattcttgtttagttcagactcatcccgatgtttaatatgccgagtgttatttattgcaatcctgtattagctattggactgcaccaaaaagaacctaaattctcatgcgtatgtgctgcaaaagtggacaaacaagtcagctgaacattcatgtcagtgggcaagtattgcaatttttatttggcaattgacattgactcttttgactgtttcctttaggtgcaagttggtaatcatccttatacagtatttagattttttgaaattctgtgtttcttttataatttatttcgcaactctatctctcagattaatatggtatgttcatgatctttgctctatgagagtccttcaattcatgtttctttttgttcacatcgatgatcacataccttgaacatatatttgcttgaatctagaccataaggcctggttatttcctccttgtttccccttctgtttgcctgtgcaattttgtaaatgctatcaaaccacaccattgtgtaaatcatgttagtcttgaacaagtgattctactccctctgatctcaaatataagtcgttttagccttctcaactctttactaaatataagtcattttagaatttctagataactttcgactacttttccttgttttcccttggtaaataaatgatatctccctaacaaaataaagcgattcatctttcccaatgcaatataaatggagagcaacaacgtcatttgattgttttcttaattcttgtgcccatgtctaaaacatccatatagtacagttcccgtgcgtgcagctattctgaagttaaaaaaaaatacaaatataactatccaaaacttaatagattgcacacgtaatattcaattaaccggctgtcaatatatacacatttcaatcaattgaacccttattgtttcccccttgaagggaaattgtattttattttatagtttcttgtatatcctgtctgtcctgatgaaatgtatatataacacttcattttttgttccatttaaatagctaatctaaatagtcattctttaccggaccaacagatttattgatgtctttatgactgattattctggtgcaagtttactgaattcagctctgaaccatcaaaatacaaaacttcgattaaaatcatatattatatatatggaggtgcctaagcgtctcttgttatgattctccctctagttacaatattgattgtttggacattgacatggcctataaaatgcaacttcgtccagtagcatctgttggtcaaatcctaggataccatggtattacggaaacacattttaagacaaatctacgtatatcatcttttataatcccagtatataaatgtccatataaataccgatagttgaaaatgtttgactgcatgcaatactaaaaagacacatgcctatgatcccttgccccttggcgcatgagtcatgacatcattctttttctctctcttttcattttcctaccctgtttagactttcatgtccaatgcgtttatgttttccttttccttctttacctcttcagattcagattcaagtagctcttctggaagcgatctggatgtcaatgttcctccatcaacaagtggggccaaggtgcttatctcaaaaatcttggggacagtgaatgtcttagaattttgggacatgagttgaatttctcaatggttcctctctttttcacatgcaggacaacacgcaatctgcggttaggttggatcaggaaaacggtatggtgcttaccctagtattccccccgtcccaaaatataattacctttagctatgtagctaaaggggctatattttgggacttgagggagtattttggagccgaacgcatacacttgatacagttgcacagtccatcctttaaaaattaacaccaataacctatttatgttattttgggctgaacaggcaaacgaaccgttattttctactatctcaagtgatcctaagtgctacatcactatgcatatatactggatccatgctggccaataaaatttgttgagaaaacatgtctgtctttagccaatttattcagacttgttttaacacaccaaatatcaaactgatgtggccagcttacatgctgggtacattattgtgacccaaacaagtctaactcctaaattcattttaactatcacatgtcaaacaattagaagtagtagttgatatagactgcatttcatgtgttctaatgttgggtgtagtcgggtaggacagtaatttaacctttcttatcccaccaaatatcacactttctgggaaatgatttatccagatatcattacacaggctgatcgttggatgtatgtgttacctttggtcaattcatttaaatatcttttgtaaaccatttgcactttgatgtaactgtcatagatattggagcatttataggaacagcgtgagattcagcaggccccatgtctgcttaactttttatgcatagttttctttgaacttctgcaattctagaatagctatttgtgtcttgtgtacttcaacgtcttcctcttatgattacagatccactgagctcgaccaatctaccacaacaaagtagtgatcctgtacctatttctgccgaagatgagggtaagcatggaatttcttaatggtctcattaaatacccaaagccttatatatatattcatctaaatatttcaggggagaatgtgtctgagaaacaggtcccccctgcaaagcaataccgagctgctgttttgttaaaccgctttgctgatacaatttttaaggctcgtgagaaaactcttgatcaggtatgcattggaaacttttgattgagagcactgttgcctgggcagctgatgacattgttagtaatcttcacatgatattattaatatcaggtcgcgaaaaaggatcctgagtgacttcaacccgacatggaggagcttgaaaggttacgaagagaaggtgagaaggaattgataacttttggctgataagccaagtacacttctgtgtattgaggcgcggtcttccttacagagagagctcggatacaagctgaggcaaaagcagctgaagatgctcgcaagagagctgaggcagcagcagctgctgaggctgctgcagaagctaaacgccaaagagaacgtgagagggaagcggctcgtaaagccttgcaacaggtaaatcatggatgagattctggccagaagcactatactctgttaacgtacatacttagtgtgaatgctattgaccctgcagatggagaaaactgtagacatcaatgaagggaacctctttttgaaagatcttgaaatgcttggaactgttacatcaggtgaacagtttcccagctcggttggtgagacgagtccaactcatacgcctgaaggccttggatttcagctaggtagcaaccctttagaacagcttggtttgtatatgaaaaatgatgatgaagaggatgaggaaggtgagtctgcagatgaaccaacgattgatgttgaggagggcgaaatagattgacatcttatagaccatttttggatacataaggaggtcaagcatgactggggcggatgcttctaacgtttcctgtctgcacagaaatttgtgaactgcactaattttgggagccaaatgataggttggcaaatgtgtgtgg

SEQ ID NO: 62238 - DNA, 6855 bp, Oryza sativa
cccattatgcatgcactagcttttattcatccggatgtatgtgccatcctactactgcccaaaagcttacccttgtgttactgtggaaatcaacctttttctttttttggattaggttagaaatatatttggaaggtcttgttggcagtcagtgatgtgagtggctagtttctgagaaactttcggggttcaatgtttgagaatggtacgcattctcttcatccaaatgttggttggatccatgtagaactttcaatttattttgtattacaaacttaaaaccaaaggcccattcagcttttttttaaaaaaacccaaatttcatgataactagttcaactgttggtaaaggtgataagagtaaaactggtgctagtttcaactgttggcacttggcagtatccgatcgattacggtgataatccgaagttgcggttttagggcagcatgccaagattcagggtaaaaaatcgcagcatgtggtaaatatgtacacgcagtagacttgaaagcaaaagaatcaaccagtaattatccatccctttcatctttctgcacacagtttccatgtccagcctacaatataatagtagattgaaatataaaaacacagtatgattaacccagcgacaatgcacaaacacaacctctttgtttttaattaagtcacataattaacgactgatgcatgcatgacacgtctcaaaagatcatcgtcgtagtgacaatgtatgaacttggtgttgaactttcttcttcctttgttggctaaaaaaaaaacttttgcagtaactggtttcatcatgtgtgcctatgagtagaacttgaacttgcagccacatgagattactatgatgaacatgtaatctacgagtagaacttgtatgtcttggcatctatgatgatctgccggagtcctccgattggtgacaggatcatgagcatcactccaagaatgatgcagatctgaaagagaatcagttgaaaaaaacaaatcagatcagaatgcaagatcaagcagaggcattttcatttcagacaaaaacaggggagaagattgaagaaaaacagagcataattagtttgtgtgttcttacccagttggtgaaccatgagagactgaaccttcttggcttgtagattgctagccacatgatgcagggaagctgccaaagaacacagaaaaaaataaccgtcagttctgaactctgatcatctctcagactctcacccatcaaaacgaaatgatcaatggaaaacttacgaagtaagtagttggcgcgaaggcgaatccaccgaagaacccaagcaatccaccgaagaacgggaaggtgatcgcgatgaacatggtgaacgctgcacagattccagatcagtttcagccatgccaagatctaataaaaaattcagttaagttcagatgatgaacacttgaacagtgcttaccaacgtagagtgttcttgcgatgaggcgaagcgtgaggccgggagggaatctgagcttcttgacgagcacggtctcgatcatgtcgaacaccggcatggcgtagatctggtagctcccgatgacatggatgacgaccatcatgtttgcgagcgcgatgagccatttgggcctggagagcgtgatgaggatgttgtcgtcgacgtggttgccgaacgcccagtatccgacgagcgccacggggaagtagcagagcgcgacgatgatgtaggcgacgacgacgcccttccacatcggcttcttggacggcttctccggcgtcgacgggatggtcgcctggatctccagcaccacgttgtgccccgcgtacgcgaacgcgacgtcgcccagcgcgctgaagaagccgaacaccttccccgtcgacgtcgtggcgcgcaggtggtagtcgacgtcggccaccttccccttgtccaccgacgcgccccacgcgatggtggagtagctgagcgacatgacggcggcggcgagggacacgccggagatggagttgaagtttgggagctgcgagaggacgaagtggacggaggcgaagatcatgatgaagtaggtgagcttgatgttcttgcagccgtggccctcgcagagcacgtcgtggaacttcttcagcgacttgccgccggtgaccatgtacacgatgttgacgccgacctcgacgacgagctgctgcggcaccacgatccagaggcccagcttctcgccgaacgcgtgctgcccgagctcgtggtacctgtcgaaccgcttcccgggcaccatctcgtgcatctccaccatctgccacagcgtgtagagcgtgatgatccatgacaggatcagcaccgcgatgccaggtcccctgcaaaaattcaagaattcagttagattaatttcttggttcgttcgtgtgttcttcgttcagatgaagatgaagaagatagtaggactgaccagccgagctcggacatggcgtaggggaggctgaggacgccggcgccgaccatggcggtgacattgtggaaggcggagtaccaccacttggcgttcctggacgacgtgatgggaagccagtcgtcgatcgccttctcctgcgcgctccggccatcctgccaccattgtttcgccattgattaattcaagcttgctactttgctacagatggttgatctcaacagtactagtacagactacactctatgcaagaaaggtttgttcttcttcttgttctgaagaattcggctcttctttatacatcaatatgtacgccgaatcgggaaatttttcccaaattgtttcgcatttttcactttcggtttttagcaacatggaaaagtagcaagttgtcccataaacggaatatctttgttgggccaataattcgccatttcaaagtttctattcttacgttttttgaaaatcgagatttcgaatcattcgagtaatgcttttaatacttttcaatgtgctataacgtcgtcgccaattctgtaaacctttaattcttgaatgcctggctaagtttagaacggataattatgcgcgttcatgctttctttttctgtctgatttatcaagcgagactttgcaaatttatatatttgttttcaaggagaacaaaaatggctaagtttagaatggataattatgtgttgatgctttacttatcctatagtagaattcctataggataggtgttttgtataaatatttgtagaacaaacatatatatcatttgataaattatggagtatgatttatcagttgagactttgcaaatatatttttttatttttaagaagaacaaaatatctaagtttagaatagataattatctgtattgatgctttctttttttttttcaatgatttataggttgagactctgcacatatatatttttaaggagagcaaaatgactaggtttagaatggatacttatgtgtattgattctttcttttattttgtcggatttatccattgagagatgcaaatatattttgtcagaataaaaaactcactaatcaaggggcatgattttcaaagctccaccatggactgtggaggcaagttagattatcttaaaaaaaatcttcatacaatcacaacactaatagacaagtgacagatcagtggcaggacttttcaattcaatgacacgccatgtttgaaaattataatgcaaacatgagactgaactagtgatttattttcttattggcagttgactttatcacatggccactttgcaatagagtcaatgctatgagctatctgatgcttatcaatgacacctcaggaggatagaaattttttttacctaccacgccaagctcacctaacgacagtaatacttttatatcaagtagagcacacttagagtgatgcatgattatctaataatgatttggggatacaaaactaggctgagattacaaagttttgattcttaagacaggacttgaaaactagagcagagaacaccaaatttcttcagactagtaacaacttgcttctaatatacccaatcttttaactttttattttaagataacacccgatcttttaactaacatcttgcagccttgttattggagtttgtgtccagccaatctgtttgggttaatcaatttgtcgtgctcaccatatgggtaattatactaatccagcttgacccctcgttaactgtaatttttatgttatcagaagtttgccagaaactgatgactattccaatgtactccatagaataaaatagtcttccaaaataatgctttcctatacctttttgggctatggaaattcctaaaaatgtctctctccatcatctggagttaatcctaaaaatattatatatatatatatatatatatatatatatatatataagaatccgcgtcccagatgggctacagtgtcatacagtatggccacggacagatcctagcatgggcagctgttatttataacaaaaaagaaaattcattgccagccaaacataacaatttcttggaaaattttccatgtgataggtgttttttttctgataggaattgctggtcttggaagctaaagcgaaatatagaactgtcagtgtactgtgcagtaacaaggatttctcaataggccaaacaagacagcgaccatgtgaaggagacacttttatttccagttagtacctttctatgtagtgcatttaatttctaaaaggctaaggaaaagaaatttctgcaagaaaaaatagtgcagttctgacttctgaccatggtaagaaattcagtgagaattctgactcttacagctgaacactgaagaacagagtggtagggatatagtacaaacagcctgtaaacaatatcttttcgaaaacagaggatttttaaaaacaattctgcagttaaggcaaagtactgaaaccacaccgatcctatgatatgataggtaaatatatatactgttcctcatatgtttgtgttcaatgaagaagaagaaaaaggtgagaaaaaggagtgagaacgagctgcaatcgatctccattttcacatgaagaagatgaactaggacaactagacaggtgctgccaagaggctgcaaggtggggtcctccgattggtgttgcgatgccggcaaaggagagaatcctccatgaaaaaggagtccaaaacaacactttttgaactctacctttctcgtgtgcaaaggtatctcaaaaatgttcccttttcatcaactgaatcaacgacggcatgaccaactctttgcttgtccatttcatgccctcccggcttctcgcagctcgacatgaaaactcctccaaatttaatttgatctttaattctttccgtttatttttgaaaaagcaaaacaacgctgccgatcatcttttcatagagaaacggtcctagaaagaaagaaaaaacccttttggttgttgttttttcttcttcttttatttggataaattaacaagactaccgacgaaagatcaagatgaagaacacaaacaacaagttcagaaacacacatcgatctccaatggagacagacagagagaaacagagatggatgctgatgaacaaacaaataccttggccggtgggtagttatctgccacctgagtccccatgatcacctgatctcctcctccttcgtctacctcttcttcttttgcagcaatggaggatcagaggaagaagaagaagaagaagaagaagaagaagggttgctgcaaggaggccggcagatcagagtcgccaagtctctacttatagaagaacaagaggaagaagattattaagcccagaccccagtgagttgtgaacgtgaagaagttaacggcaatggcgactgggttagttgaccgttgactccagcgcagcagctatttttgcgtcgtaatttcacggatattggggaggaattaatgctctcagtctcagatgggggttactattattaaatcgggtggtgtgtgccgtccgtcagatccaggatagacggtccagatgatgatggtgattttttttttatgtctcttggagggactcttgttttgctaactcacaaaaaaaagagaaaaagataatcagaattcataacgcatggcacatggaaccacaggagctctggagtttataaacagtagtagcgtgtgccgaaattctctcggttaggtccagcacttggcgtgtttaaattctgtttggagggttgactcgtaagaaatcgtgttcgaattcatagtatattcgtcaaaacatgtactactctataaaaaaaaatgcaatcttagctatgaacctagacacatgtatccaggttacttggtaggattagattttttatgggacggagagggtaagcattatgaatttaggtaaagcatttttgaatatgtatagggataagagcttatcttttatccagatacatatcttaaaatgcctttttttttgtctagatacattgtaatgtccatatacatagtaaaaaaaatattttcttcaatcttatccactgcatatttgccttctacataaacactcatcttccgactagtaacatgtttagacaaaccgtctgttttctttcttttttgagagggtcttgctttcttttattttagaaacattgtttgctgcagttgttactgctcaaacaactaatatcacaaattaaatgacatacaagctatccctccaattacaaatatgagtaataattatcgatgttttcgaaattgacaaggtctttgaacaattttttgactagaaatttatattgattcttttacaaaagtggcgtatccaacatattttaagaatacctttaagacaaatctacattatacatattcataatgccatcagggctgcaggaat

SEQ ID NO: 62239 - DNA, 3864 bp, Oryza sativa
cgccaggtttttttatcggacttttctttttttttcgctcggtttttttctcccgttttttgacggacgacagaagcacctagagaagtgttttttttcttttctccaatccaatacagatcggatctcttccagggaaatcagattttttttctccagggaatcggactctttttttttcgctttttttattcattaaacggtttgtctctcggactttttttccctttttaagggatcgggtgtttttttgccagggacgggtgttttttttgcccggtttttttttcactttttttttggatcggacttttttttcgtccggtttttttatcggacaaacttggttttttctgcccggttttttttcacccggtttttttgacggacgatggaagcacctcttattttttaagtagtccggttttttttttcactttttttttggatcggactttttttttcgtccggtttttttatcggacaaacttggttttttctgcccggttttttttcacccggtttttttgacggacgatggaagcacctcttgttttttaagtagtagtagatacgaagtttctataccaaatgtttctacttaaaaaagtttatatgacatatatttatatgtaatatactccatccttttcaggttataagacgttttgattttagttaaagtcaaactgttttaagtttgatcaagtttgtagaaaaaataataacattttcaacccaagacaaacttattgtgaaaatatattcaattattgatttgataaaaataatttagtattataaatattactatatttatctataaacttagtcaaaattaaaatattttgatttttacctgaaacggatgaagtagtttctataccaaatattttgggtgtaaaatttgatattacggagtgtttatacggagaaagtaatgctggattaattcttcttccatgcatgtcattccctcatatagttagcgtgtgccattacgaaatttctaattcttcgcgaacgcgcaaaaagattgtacgaaatttccaattcgattgcaccgcctatcgaaatcaaatcggtaagcgccgcgatgacgatctgatggcgcgaacaccagtgcctgaaattctcttcttgtgcttggtggaattaatagatgggctaaggcccattcgaaaattaattatttggaaaatcacaaaagcctacctcatgggatgacatacatgtggagtttagtttagtaccaccttacttattctagaagagggggacctccttaaaaggaaggatgccctcctagccacttgaagcatgtatggtggagagaagagggggaacacgcgcgctcgctcgcctagcagggcaggcggcgcgcgcatgacgtacgcgtcgaatggtccgcaaaattggctcctcacccttgagcagatgcagcctccttttgcaattttgtttaaaatccggtgcgtgaaaacggcgtggagtccggataagttacgcacgaaaattcggatttgttttgttgttggaaacattccgaaaaatccggtgcatgaaaacggcgtggagtccggataagttatgcgtgacttatctggctcggttacgcagagtggagatcgtgcgggcgccctgatcaagcgacctatctctatataaaccgtgccgccgccttcacgcaacacacgcgaaattaatctagggtttgcctcctcctctgtgttgtgtcgtcgctcgtagactactccatcccgctcgccagcgtgcaccggcgatcgggagagcaggtctccggaacctctgtcttcgacgtcctgcatcgggagaagacggcaataaggtttttgggaagcgtttcgcgcgactgctacctgttcatccgtgacggctcgccttcctctccgctcacgtgctgcgccctttgtcgacgctcgcaaccgcgagtagttcctgccgagcaaccggtctttccgccaactcggtacgtgttcgacatattgcgcatatttgatctgttcatgttttactgcttagtttacatgtgtaaatctaatgatgcgttaatactagtatacatctgtaatgtcatgatttatttatggaatatattaaatcattatatgcctatattttcaacagttcttcggttaatttccgcacaagtgcacaacctgccagctgaatttggcagacaattaacgaacacgacatacggattatgcactttgctatcatcttctggaaaacacttctgcatcttactgtcaaaaatctgatccctgatacacgaacctggctgcctctgaattcttcggtccaaaaggcagagtagacttaacgaaagtaacaagatgcttttacataagcacattaatttcttcctcgtagaactttatggctatacgcatgaagaattgaagataggagctcgatcacaatttcttatatccatcccgataatttggagaaacatctcccattcactgggcgagagctgagctagtgaaaagatcgcgttcttgtgcgtgtcctcgtcattgggctctagcctagccttgagcgtagcgagtgatcgatcatctcgcgtgcttatgtaaaagttacatccatggaagttgccgaatcattatatgtaaatgttattttctttttcaatatactagaatataagccatggttaaagtttatttaacggtaaaacatatcaaaacaaataaataacatttatataaatattttaataggatgaacgatcacatgtcatataaaaagttagcatcatatattaaaaacagaggaacaatttttttttaataaaagttgcataaatatacatgtcttcccattggacagacaccagccaccacgatggtgtcgcgatagggacgggcaacatgcgttttttttttaatttcgatagaacatgagttagggcctgtttagttggtgaaataaaaattttttggtgccatatcggacgtttaatcggatgtcggaaggggttttcggatacgaatgaaaattttcataactcacctggaaatcacgaggtgaatcttttgagcctaattaatccgtcattagcacatatgggttactgtaacacttatggctaattatagactaattaggctcaaaagattcgtttcgcgatttacatgcaaactatgcaattagtttttctttttatctatacttaatgctccatatatgtgtccaaagattcagtgtgatgtttttggaaaaagtgtttggggaactaaacagcctcttaggccgtgtttagttacatttcaattttttttaaagtatacggacacacatttgaaatattaaacgtaaactaataacaaacaaattacatattacggctgtaaactacgagacgaatctattaagcctaattaattcgtcattagcaaatgtttactgtagcaccacattatcaaatcatggcgtaattaggctcaaaacattcgtctcgcgatttacatgcaaactgtgcaattggttttttttttcttccacatctaatgctccatgcatgtgtccaaatatttgatgtgacggaaaagttgaaagttcgaagaaaaaagttggaatccaaacacagccgcagcctatttgtagtactttttatagataatagaaataggttacatctccggtctctttccgtaggcacacagcaaaaaaagttcagaaatgaacagaaaaaagctttaaaaagacgagatggaacaaactcccaacttctgccgataatatgatttactaaaataatattttttaaaatcacgtagattctatcacgaaattctgtaggtactacgccatccaagggctgcaggaatt

SEQ ID NO: 62240 - DNA, 1861 bp, Oryza sativa
cagcaacaccaaattgaccaacaacaggaaatattaaatattaaaaactatatcattacgcctatatgtagtactaaattgacaaaatttagttcacaccaaaattggaagtttggtttaaaattgaaacaatgtgacgaaaaagttagaagtttgtgtgtgtaggaaaattttgatgtgatggaaaaattggaagtggaagaattattttggacctaaacacggcctaatattgaaaaaaaaaattggaagttgccgggaagctgcagcgtcaacggctgggcgactgaccgtctgcactggagctgtgcatgtcactgtaatgtcagtttcatcccatatatatcagcatctcaaccgtgtgccgttcatggcatgttcttacatgtgtagtatcagactttcaaggccattgctagcttgaatcgtacgtccacgcgtttcccagttaattatgatgtgtaatggagtacaattatgctgctaatcagctatcaccgattgacagcagcatctggagtagtagtcctggccataattcgattggtgtatgcaagactattactagcgattttgatggtctccttctgagaaggacaagagcgagaagatggctcttgaatcttgactagtagtaggagctaaaatcgtctcagttattcaccatcatcttgaaatttttgcgccaaattaattaagatactccatttttaccatctctgaaagtctgaatttatcggataagctctcaagacgtagcttcttccatcgtatcttctcgtcgtcgtcggagtcgtcttcttctctaagcatgcgaggctacgcgtgcagctagctggcctcctaaattccaatcctacaaacgattggtaactccatgtgctattccctatcaattagggctcatttgaatcgtaaaaataaaaaaacaaaaaaatataaaaaaatacataggattctgaatcgacatatacgtagaaaatttactataggatttcaattatacaaaattcttttataaatttcttgatttaaaggaccctcaatacatgataaaggcgttctgctactatttttaaccggcgataagctaaaactaataataagtcataaaacaacttgataataattatatagtatcattagcaattataaaaccaacctaaaaaggccgagtttagttacaaactttttcttcaaacttctaactttttcatcacattaaaactttcctacacacacaaacttccaacttttccgtcacatcgttctaatttcaaccaaacttccaattttagcgtgagctaaacacacctaaaaagtacgataaaacccctaaaatcatctctaaaattaaatattaaatttcagctactgtttataagctgaaaggtaaattaatgatggggacgttacactcaatgtacggttcacctgaaagtctgaaaattcaccagttaagtacgtacgtcctctgcttgctggtagtagcaaatagggatggcagtattgtccatgggttcgggtatccgtggatacccggcccgatgggcatgggcgtgggcacctttttttacccgtggacacgtttgacccgatgcccgtgaagttagtgggtatatgtaggttttagattttacccgtggataacccatatccgacccaaaaatttttagcccatgtatatcttttataccttcagtagtttaacctcccctcgaggcccaatagccatttagcccatttgtatatacagtgttcactcaatgaaaccctagccttatccttttccccaccaccacctctcaatcctctattccctacgcggcggcagcgcacgggaaagcaggtggctggcggc

SEQ ID NO: 62241 - DNA, 1500 bp, Oryza sativa
tctcctagtgattgacaaggatggatatataggtggtgtatagatttagggtgtaaagttttgatgtgttacagcgggtattatagggtgtggcatagggtgttaaggtattaataaaaaactaattacagaatccgtaagtaaacaacaagacaaatgtattaagcctaattaatccatcattagcaaatgtttactgtagcaccacattgtcaaatcatagatcaattaggcttaaaagattcatctcataaattagttataatccgtgcaattagttatattttagtctatatttaatactttatgtaggtgttcaaattgaacgttcgatgtgatagggttaaaaaaaatttttgtgggaactaaacaaggctatacttatctgccatgctgatgtgaacacggctgagtgaaatttcgcgccatttctagttcgttttcaacggagagattctcagtgcgaaacctgcatgaaacttctcttattgcttcttcagggttcagagttatctccgcttgattattttttgcgatcctagtctgctctgacaagcaatagaaatttgtttaatttgatggataagtaagatacggttacactttattatattagactgagtttgttttagaaattaatacaagtgtgattaggaaatctttttattcttcgcgcacatggaactggggtcccttgagagcctctgaattcttcagtccaaaatgaaaaatacaaatgtattcaaaatcaaataagcatgcttttacataagcaaatttctttcctgaaaaggcaaaagtgaagaaacttaatggccaaatgggccagatttatgcctgaaaaatatgcagaacagctataatttccgccgatttcttgactcacccggtatctgcgttcaattggattgcgtaatctttaccaaagtctacgctgatagcatcacttgccgcaaattctcgttcaaaaagcaagatcaacgtcagcaaatttcaaaatcaatttttacaaaaaaaaaattgtatttgacatgtcaacacgatactagtgcgcatatatgcttggattttgcgctgccttattatgattggtcaaatgttcaacacgtacttatcaagatatcaactaattaagcaagaagccaactgattccttgcaacctcttgattgctaatttgcaaaattgctgctgcattatagattcacacgttagaagttgaccagcttgcaattgatggcaacatatggatatcttacactaaaccaatccttaaaaacaatagtgtgatcacactaagttgattaggacaatcagggtgaattaacatatggttagatgaagaacatactgatcagtcagttgctatccattttatcctactgttgttcttttgtggtaaagttacgtacggatgagtaactaacagacacggacaatacaccctgattagtctgaaagtctgaatagaatttggtgaagggagcagagtaggcaagtt

SEQ ID NO: 62242 - DNA, 1542 bp, Oryza sativa
catactatgagacaattattcacttgaccgatggtgaatgcttgatcgtatttcacaatagatgtaaagacgaatttgttgctgcaatccaaacacaagtgaacaatacgttgtaatcacgcaaaaaactgtagcaaacaatcttgaacaccaaaagtcaagcagaagatggaacagaattgtccgaagtgacaagtagtgacgctatgtagtacgttgtaccgattgtgattagtgaccaaagcgtaattcgtctagattttcaagtttcaacttttttcacatctcaaatgataccatgggcaaaggacaagctgtcactaactagttcgtttatttcaccgcagatttgaagcgtacggcaccaaaatttcatgctgcctgatcataaattatacagccccatcgttttcgagcactaagctaaacaacatatttacaaacgaaaaataatgcaataagccaaacaacatatttacaaacaaaaaataatttatgaataaaaatttttatatacgtgttcttaattatataaaaataaaggctgaaaaataaactacgatacaaaaaacaaaaatcaactctaaatttaagttgatcccactttaaggaaaacgagcgaattaaacaagtcactgtcataaacagcaagttgagtagagttgtactcctcctccttgactctgaatctgaattatcaggcgtggccatctttgctgacttttgggaggtgcagacctctgaccaaatcgtcacgcggattcctcctcgtgcgctctactagtgggctacactgcataaactctctatatatttccttaatttctcttgccagaatatttgttaatacgatgaaaatgatttatatctccgatctctgttagcgctggccacacagccagttcccgcttgcatacggacgccgtgtttagtttcgaaatatttcttcaaacttttaacttcttcatcacatcaaaactttcctatatacgtaaacttccaacttttccgttacatcgtttcaatttcaaccaaacttccaattttaacgtgaattaaacacagccggagtattgctttatttttcgaccgtcacactctagtcctcttgtattggtactcctacttacccttctcttttttaaagaaatagatgatcggatgaatgagcaagctttccaaactttttatgatgaatttcttgaaatgcaggtttgaatctatttgtcaacttcataataagttgattttatttgcaaacgcataataagttaatttattcattgtatccttaaataattatcacaagtcattcagctatattcaatacaagagaacacacatggtgtttgttttgattagactagtagtaatggaaggtcttcagagttcaaagccagcaaatacacaccgtacagagatattgtgcatgcatttctattggccgacgacgatatggaactatattatatgtgtttactttgcctggaatatcggggagaaaatctttcatatatataattttcgaccaagtggacatat

SEQ ID NO: 62243 - DNA, 1658 bp, Oryza sativa
  unsure (1)..(1658): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgtctatgcgacgaccttgttcaagtagtagctttggattctgaccatacaaggagattttttttttcagtcagtgtaatgcacatttttaatctgccaagccagaaattgacatccaaattccctctcaatgcatctgcagtagcatttgctgcggcaagtgtccctatgaactgcatctgcatggcaattttcttcagatatttgtactaatcgtggatggtccttagggttcgcacttccaaatgcgagcattttgaagaggtagctcaattcttcatctgaatggttgttaagaaacattggctttacagttccaagtttctctgattttctaagtctgcttatggttaccaccttgcttccctcattcatttgtgccacggatttatagaattcctcccaattcatctcattcacatctgaaacaaactccacaaccatcaaaatgttccctgccaagagagtatgattgtgtgctattcccaaaagatcaccttcattcaaatgcaaaatggaagaaaactgtgattgaaccctctcgtcggcgcatacatgcgcaaccagagttttcttcccaactccaagagcaccaatgattggaagaacagcaggctgcacaccaggagggttgtattccaataggaaattcaggagcctctgcttttcagaatgacggccaaacatgaagttatctatgtaaagataggtatcatatggtctccttgacatccgatcgcatccacccaaaagaacaacaaattctgccatgtgatcaacagcagtttctaatatttccaaagttctgtgcaactcaaggtgcctggccttgtcctttccagaagcatcaacaattttgcaaaaacgtttgaggggaggaaatgggttgctaacctccttgatgggatcctcctgaattagggtcctgcacctgaacatgtccaggacatggtggcctctgtacatggcatcagcaagtgccttcagctgcatcagcatcccggagttggtgatgtatcgcccatctgcctcctcgacaaccatggaaactcgtaggagaagctgctgcagtcttttcagctgcttctcctctgagatttcatgtcttcttgagtacttgctcatgaggtaggagatgaaccgggtgaccagttcaccggttactgctgatacgacatgctccatatccaaacctcgaaatttaacagagagatgagagatcaaatttagctgttgtgtgtgactgaaatttcagggaagattgtttgcttaaattggtagtcatctttgtcaggtccgtcaaaattgttggcttctatttgtgatattttggccctcggagcaactatttagaagaatcttaaaaaaaaacatctggatgtcctgacaaactagcctggcagagcaagtgattttcctaggcagacataggatatctcatgattggcatactgtttaacttaaatatttagtagtacattactattttctatttttttgtcacaatgccacacatagttgatattttatagaacttcatctatcaactg

SEQ ID NO: 62244 - DNA, 1974 bp, Oryza sativa
agttaaatttaaaacggtttgactttgaccaaagtcaaaacgtcttataacctaaaacgaagggagtagcaacaattcagacaacttgccaaatgttgaccatggccaaatattttcatagccagaataattggtaaggctaatactggcatagaaccaaacaggctcttactctagtattcacttctttcatctaccactgttcctccgggtacaaaagcaaaatcaagaatggtagggtagcatcttatcttggcgactataattttagtcatatagcattgaaagttattggtttcagtatttttcttctcatctttgtcacattgaagccagattctattagccataatgcccttattttgctcgcattggaggcgtcagcaatgatagtgagggtgatggataaggcaaggagccacacacatgtttgaactctttctccattgcctttgacaggctgcctgccagccctagcaatccatcaagattgagctaaaatggacagagagggcaatgttagtaatgtgcatattgatttttggacaaaaaaatcggaggaaatctaacggttgtttggacggaatgttataagagggagcaaagacaactttagctgctaataatgtaaatccatgtccttcagtgtctcaatagaagttcaagtataattctttgaaagtatagaccataagtatcctgcttacattggtaacaacagaatgtacataaaactgttaccagtttagccatatgcccatatacgactaaaggcaataaccagaatttgtattcagacccaactcagctaacagctctattgatacaaagagatagaaactcgaaaaacactcttaaaggagactagtagactactgtttttacacaagatctattgatgcatatttttcacatccatgacccatgggcaccagatatgtctagaagcaaaaacaagaagaaaacaccttttttcacagctcttcaacaatgcaatccagcttattgagctcactcgtctggtccaatggcttccattgctgcataaaagattggatcttgttgtataaaatcgcaatgcagaggaggtaacattgtactgaacacacaattttcctgagttacaatatttgcagtaaaaacgataggattcctatccagttctacgagcgaaatgattcaactacaggaaagcgcattcgaaaacacccaaagtttgacaaaacataataggttaggtgacttgatctgtcttcaaagcatgcttccaacccattttctcttatagccaatttggttttccgaatgactctagttacagaataatatcaaaatgaatatctgaaattttcatctgcattttttttgtgacccatagatctttcatttaaacttctaccatccctccaaaagttagacttggtaacatgctactgtactaaaagcatatttttagtttttctgtagacaatctccactttctacgcaacgaaatgctgaaaagacttctaacatagctacatgcttgtagaaactttaacaaattatactgtaagaaaacagaaattgacataaagcaacaaactttcatgtatcttctttaaatgtggacatccataaaactacatttagttataacataaaagaataacacgctataattatgaatgcatcagtctaacaaaaaagtgaacagaaagcaagttaaattggtcagccaacagattaaaatcacagtaaggacattccaacaactaagtacatggaaataattagatctttttatgctaatgttacataaaaacaaggaactacctgcagtgtagaaacttgtgaagggatgacagcgggtgacgacattgcaatcaaaaagtttcttggactgcattgagtcaactcggaacatgtagaaatccgtatccaccactaaaataaacgcattaggatcctcggaatatcccacgatatctgttt

SEQ ID NO: 62245 - DNA, 19947 bp, Oryza sativa
cctgaaacatgtcgctaatgttgcaggaaactaatacttttatcaataaaattgcagttttcttaaatttactctatatctaaattacttttagattttattaaattacttcttagtcataaaagtaatttaataaagcttgaaagtaatttacctatattatagaaggaacttaaaacaaaaggtaacttgttacggcattaaaagaaatctatacattcatgttgtgagttgtttattttataatcatttttagtcaatgacgtaatttgtgctgattaaatttaatttctatatagactcatgtttttacctctataacgaatttacttttaatgtcgtgataaagttactttctttttttttctaagttacttctataatatatgaaattacttttaggctttattgaatttacttttatgagtctaaaaagtaatttagtgaaatctaaaagtaatttagatatattataaaagtaatttataatttttcatcaaaatataatcatgtgagattttgttataaagattcaattcttacgaacacaatagtgtaatcggatcgtagatcggatgattagtttaagacaaaattatttttgacgccggcgtagcatagagcatcacatggcttccaatttggattcctcttgatgatgccatgtccgtaaatcaccaggccatgtacggaggcaccagcgcttgtgggatcggacggccgatgaacatgtcgcatgatagggcaaaacagagagcgcgcgcgaattagattttgccttaaaaattggtgaaatttaggatttgctgcagtctcttggaatttgtaaccttcatagaactgttggtttcagttggttgtgaactaatattaccacatattttttattaaggtagctaagcttagttttaccatacttttgtggcaaacaaaataacaaactaagtttaggcaaagttagacaagaaaatagagtgtatgacatgtggcctaggtggctaagagttaggcaaagtagacttgtgtcatgaaccaatcactacatgttaaagtatggtttacctaaggttagatgtgacaaatttagttgccgaccaaacatgccgtctcttggagttttgctttcccctgcttgtcacctaaattattagggtgtggtcattttcactgtaatgtgtgagcttcatttgtaaagttgtaaccctagcaaacatggctttctataaattggtcctcgtggctcgtgaccttttatctaaaaaattaccgtattcgagaaatggtattactaaagttgacatagaatatgtgctattaatacttctctaaattttagccataccaataccattaatatttatgtcaacttccatctctcctctgttatttcttctctagcttcaacgtggatgccatcactcattcaatctagcttcgacgttgatggaatacgacgccaggggtggggaagacaatggatgtggaggagaagagtagcggtgtgtcaatcaccagtaattgagggggcaccttgcaaggcaacgattcctgagctcaagcagccaagggtgatggtggtgcggcttagggagatgacgcagcttggcagtggcgaggaaaagcgatggtggttgctagggcgttggagatgggcagaaaaggggcctgctagtggatcccgtcacgctttgcctccttcggccaccattgtatcctctccaaccacatttcctcatgctgccgctgaatcttctccagtcactgtccccgaaggaaatgtgactgaaatattttggccagagcaattttgtaatggtatggataaaattaacactaaaatttattaatttccttgtttttcatccttcttggccaaaataggtagctgggttatctgacaccatagaaccaaattatctatgatgtgtattagcataggggatcatagttggttatctaaaaatagccattctttagtcaggtttattatgtggatataggttcaccttttattctatttccatctctatatagcctgtgctcctcactcgtaacatatgtcgttgtaaatgtaaatgttgcgagtgtgtggatttctgtctctggttttttaatatatggtgccgttaacttttgaatatgtattttgaccattcatttgattcaaaatttttatgcaaacatagaaaaatataagtcacgcttaacgaaactttagtgataaatcaaataaaaaacaaataatgattatatgattttttaataaaataaacagtgaagcgcgtataagaaaaaaatcaacaacgtgagatgttaaaaattaaagggagtagtgcagtagagaaaacgtccttgctaaatattttccttcttttatacagaccacatgcttgatcggaccatattatactcctttaatatattggtgaccggagtgatctagctttaaaaaatgatcacgcatagtcacatataaaatcaaattaaggggaatattccctatacaaaaataataggtaacacattgcatgaaatatatagatattattataatatattttcgtttatctgcatcaatgcacatgtattcagctagtataataaaacattaattatatgtatttttttatgaaatttaactccatttgattgagaggaatggttcattacacagtagaacatgcagctcatcttaacaaaatgaaatcaaaagttatcttgcacttggatcagtaattaatggtcacatcattgatagtactacatgttcctacagtggatgattcatcattttttgtcacccttacatggaaatatgctggatgcttaggctcatcaaggaccatactctcactacttagcattgcaacaacatttgacatggtcggtcgatcaactgcattctcttgtacacacaacaacgcaatgttaatgcacctcaacatacacgatgactgccaatttgtaaccaatgatgcatcaagaagttcaagccatctttcctctgaccacaacttccatgcctatttcaatatttcaacagacagtataggtaagataccaaataaacaaaacaatctacacactttacatgtgtccaagaactcacatatccaaggagattgatgaagtcttcacattgatctaaactggcatttctttttccgctaatgatctcgagaattataacgccaaagctgaatacatcagattttggagagaagaggccctcggaagaatactctggagccatgtaaccactaaaaatgatatacaatatttgtcaaattttgttcgtgcttgaattataatgaaaaatatgttcaaatttctatgatacttactaggtcccaaccactcttcttgtagttccttcattgctatttgagccaaatatttttgctagcccgaaatctgaaattttggggttcatttcgctgtccaagagaatgttacttggcttaaggtctcgatgaatcacacgcaatcgggagtgcttatgtagataaagcagtccttgtgctattccttcgattatcactagacgtttgttccaatctagtaaatcttttttcctttcatctgcacaaaaattatatattagtacaacaggaaaaggagatagacacctcaacaaaatactgatgggaaaattttccaaattttcctcaataaataaacctaagttcaggaatctagatatataccgaaaatatagaagtccaaacttttgtttggcaagtattcatagaccaatattttctcctctccttgagagcagcatcccaagagcctaactaaattcctgtgctggagtttggcaattagttggacttcatttttgaactctaggaaaccttgtcctgaatgtgaagcaagtctcttaactgctatctccaatccctcagaaaacaggccctgaaacaaatattcagaaatttttcattgtgattatcatgggatctatggtagtatgcagttttttttatacgaatctatataatgagaatttgcatatcattcttttgtattattaatcagacaatgaaagattatactccacatgtgtcttatttaccttatatacagggccaaatccaccttctccaagtttgttttcttcagaaaagttatctgtagccttgataacctcacgaaactcgaaaaccgaaaactctgaaatctctccctccatttcgcaaattagttcatctcctcggaacctgcgactacgcttttctcgcaatctcactctatctggataattgagaattagtgcagattcattactcttagttaacaatataacgaacataacaatttgagatgaacatttcagcggcaataaacacaccttttctgaaccttcttgaccaacgacagtagtaacagacgatcaagcagagaactactgccgctacaggagctgcaatagcagcaattacccatgatttgctcttctttcctaaattaaagaacccacgatcaaatttaacatgtcaattaacggcatatttgcaaataaaaaataatttgtgaataaaaaatgtatatacgtgttcttagcaatctaaaaacaaaggctgaaaaataaacttcgataaaaaaaactctaaaatcaattctaaatttacggttgaaaatttaaattttggctggtaagcatagcataagtattcagagtgaaaatcatatatttacagaggaaaaaaaagcagaattttcagatactgaaaaagagggggagtttttacgcactgtttttggtcggagcgatggaatccggcgccggagttgagcccggcgggctgacacgccgcgtgggctcgccggcgtagaagacaaaggcctcgaacctgagattgcaccggagcaagaggacgcgtcctcccaagcgcacggaggtggtggagttcaccatggcgatgaggcgctggaggcaagccaggcagtcgccggcggccaagtccggcgtgcactgcgccagcgagtagagcgtctgcttcgactcgctgcttccgtccatgaagcctgtggcgaaccgcctcgccgccgccgccgccgtccgggccgtcaccgtcagcagctcgcggacgttggcggcggcgacggcggcgtcgccggtgatgttctgctggttccatgcctggaagagcgtggcgttctccgtgatgttgggcgcggcgaggaagtcgtcgccggcgaagcggaggaggcagtcgtcgtagtagatggtcgccgacttgtcgctcgggcacgtccgccgcgcgtcctggaacgaggccgcgacgcagtcgccgcaggcggtggcgttggcgacgtcgccgcggcagagcgcgagcgcgtacgccgcgtcgggggcctggccggcggtggccgtggcgaagtggtccggggaggaggaggcgttgctcgggagggcggcggcgaggcgcgcgaggttggactggtaggtgccgttggccgtgtagttgccgccgttgccgcagagctgcgccagtagttcgccggcggcgagcggcatgatgctaaggaggagcaggacgccgaccatggcgaacgacggtttacctgtagttgcatgcttggtgttttatccggaatcaacctgtagagattttttttttcaaaaaagaaataaataaaatggtaatgaaacaatactcccagtctaagatccgcgggtgaaaatgattaagtccctcaattcaaaagtctaagatccactggtaaaaatgattaaggtgaaccaaacaatactttaaaaatttatagaaaattcatttcaagtccgattaaggtgaaccaaagtttctccacgatccttacaatattctctttaatatgactggttcatatttacttaaaacaaccattttcagtatgattgtttacttatatatatcttacgtagtctccatgtaagttgatattagtaagtgaccatactaaaaattactgaaattgccatattataggaaatactataagaaatctcatagaactttggtttacctcaatcatgtttaatatgttttttttctatttttcttaagtttggactttctagaggtaaaaatatagaccaacaaatttaacgcatatttaaacccccccctaatgatctcaaatgaacgacctttcaactattaagttgtagatcttattcgaaggttacaaattttttttagaacataccttcgtctgaagacttttgcaaatacatataaaaagaacaaattcaaaaatagatcttagattggaaaaaaatatttgaacccctaaaagatatcaaataatgaataaacattcaactacaaagttgtatatctcgttgagggcaacatattttatgcacataagcttcccgtgcacaccaactagcaaatgccacagaaaattctagaaaaaaaattagatacatacttccaatagtattacaccaacgtgtgaaatattttcttcaaattcattatattttagccacaacaaaaaagacaaaattctaacagatttttacccaaaaactgttagatttttcatttttttttgttacggctaaaatatattgaatttgaatatgagactttacaaatatgtgtaatgctattaggagtatgtgtcttatttttccatcaaagatgataaataaactttttttccatcaagacgatgcagagtaagccagagcagtcgtgttgagacgctccccaaaaaccttattgcccgcctacctgtgcaggcactcaagcggataggattccggaggctccgctcgtcccgtacacctgtgcgtgtaggtgaacggaaccgggaaaggatcttgcagcgcaagaacagagggaggtacaggaggaagaacgaagtgcaagagtcgggtagaactgaagaaccttccgtacttctgttcgttcctatggcggtgtatatgcgagcgcgggagtaatgttaatcaatcaccgtgtttaataccgtccgttacaaaaagagagagagagagagagagaagcagccgccgtctgcctcgccacgcccacggcctggcctggcgcacgcacgcgtgtggctgttcgcccaccatctcaaccggtcaacaaagactctccactagctctatcgaagattacaattttttatagaacatatctccatgtgaagtcttttgcaaatataagaaaaacaaattcaaaaatagatctgagattggaaaaaatatttgaacccctaaatgatatcaaatgaacaaacattcaactacaattcggttaactgagacccatgaccgaccgaattaatttaggtctttcgctgtttgagactgaactactgatcgaatatcttttctgttcagtcttactctacccactcctatttagtggtgctcttatttttaacggtgattttcttacgtataaccacatgtgaaattcagtttttacatgctaatgtcgtagggaataattattttcgcagtggatttgttagagatccaaaaaaaaaaggttttcttagttagtctatgacctgagacaaccttaactatttttgcaagtgctatttgttttagccgcccgtgacgttgagacatttttacccatttgtgcgagaattatatagcagtgccaccgttcttttctattgttcaagtacttctactacctgatcagccaagggggagaaatatcttgatcctgcagtttttccttattgttgtggacgtactccctccgtactcgtaaaggaagtcgtttaggataatatttaagtcaaaccttgcgaatatgaatcatgaataactctcaagttattgagtttgaaaatataaaaattatataaatagatttgtcttgaaaagtcataaaagtatacatatatcacttttcaataaatatttttataaaaacaagaagtcaaagttgtgttttgaagaccgtatcgttgtccaaaatgacttcctttacgagtacggagggagtacactcgtacaggacgaaggtatggatctatgttagtctgacctatataaccaacacgtctaacaaagtattaaaattttaatatttataatatagtaataatagtctatgcaacattcgagttaacgactagttaatataatggcccattaatacataattagctagatgctactccctccattctatattataaattgttttattttttcttaatttaactaagtttataaaataatttagtaatatttactttcattaaaactaaattttaataaatttaaaaaatatatttattttgtgttgagaatattttaatatttttttataaacttagtcaatttttgaaaaaagttaaagcactaataatataaaaacagaaagactaattaagacttttgggtgtgccggtctccagccggcaccctgtccatgtctgcctctccttatcaatcaccatttgttcatttcacctgtcattttgagagataaaaaaatttctcgattcatttatatttatcgtacgttagttgctttcaacattacttcctaaattaattttaggccttcacacacgctttctagtatgaaatgttaacaattaacttgactaaatactctctctgtgtccacaaatataaatattttcttaaagacattaaggataaaacaaaaaaggctataaaatagagtttaggattagttgaaaattaaatgagatatggttaagtgagggaagtagtaccaagtaatcgcgtgtatttatatatggaaaaaattcaaatgctataatttcttatatttgtgatgaaatgagtattagacaataatgcacttcctttcttttccctgaaatcctatggactgacgtgaagggcacgagaccagcaaaaaactcaccgttaataaaatgaaatacttgtaaaccatcactctcgatggtctttgaattattcaatggacgcgccttcttgaatttaaagacaatgtgtactatatgggatagctcgataggtcctgaagtttgacaaattcttcatttagcttgttgctatcaatcaataaacggtccctctttaatttagatatatatatagagacaggataacaggaagaaaggaagtgtcttattgtccacaaatactccctccgtccttaaatatttaacgctgttgacttttttttaaacatgtttgaccgttcatcttattcaaatttttttgtgaaatatgtaaaactatatgtaaacataaaaatatatttaacaatgaatcaaatgatagaaaaaaaattaagaattacttaaatttttttgaataatatgaacggtcaaacatatttaaaaaaatcaacgatgtcaaaatgtttagagacggagggagtataaaagagtgaagtgtataaaaagttctagcacaagggactaaaaaataattttcatatatacttgaggtatcaaaagttgtgatagctctcgtcgtacctatcgaaggacgtaaaatcgctcaagatttttagaccttggtttgagatgtgtgtagtcaagtatgagatcaatttcctgggtctgccaacctgagtagaaacaaaaataagcagaagatgaccggccagcccggcacatcaatcaaatttaattaaacttatatttatattttgtgtgcataaagatttttttttaccttctctcttgagatatttgtagccacatatatgaaaaaaaatcactcgatccgcaaccatagattgatactctcttcgttcatattataaatttattttaactttttttaattattatgttttaagttctgaacaaatttatagataaattagcaacatctgcaatattaacttagttccattaagactaccatttaatatattttgataatatatttattatgtgttagaaatattgctatattttttataaaaaatcaaatctacttataatatgaaaccggaaatgccagcgatcgggcgctcgatcagctgcagaaaaatcatgcgcccaccgcttcccgcgcctatgcacgcgcgctcccgcgcctccgtgccgtccccaccacgcgtcctaccatacgcgccgttgcaacaaatcacccacatattacggaaacgctctgttaagggaatccgtttcattttttgttccaccaacaatgtttcaccaattgtacttgtaatgttttactatatatgaatcaaatgttgcagtgaattgaaacatcctttcgctatttgctgaaacattgtttttatgtagggtgaaacaacactcgatttttttggaaaatgttgtttcgtacgttgtagcaaaatgtttcacgaggtgatttaatttggttgtgtttcagctttttaaaatattgaaacaatttcgatctgcttggtgaaacaatttcgatatacttggtgaaacaatgtctgatttttttttaaaaaaattggacgtccgatttataggtggccccatatgaaacggtaacggaggggtagtataacaaaggggtgtagctatatttatggcgccatatttttcatcaaaaaatagtcggcatgtatttacattgtaagtccctaaattacatatgtaattttagtgtatttacaatgtaagtctcaaaattacatatgtaagtactaaaattacatatgtaaattcgaaaattacatactaattacatatgtaagtgaggtgtaaatgatatgtaactactgtgtaagtggctgaaaaaaatcaactagcatatagcgccatatttctagcaactccgtaacaaagagggtactgatcgggaataaaaaggggaagcagctgactggccggccggctgcgaggcagttagctagcttagacgccatggacatcgtcgtcggcgtcctgctcatactgggcctcatgccgatgccgttcgaggtcatcatggccgccgccgacgatggtggcggcgtgttctgcgacaacctcaagttcgtgtccgcaaccctccccaacaaaacctcctcctccccgcaccactacgccaccgccgccgccggccaagcccccgacgtggtctacgtcctcgcgctctgccgcggcgacctcaacgacacagcttgcggcgaatccgtcgcctacacgttcgcgagactgatcaacgagtcgtgcgtcgccaactacacggccggggcttactacggcgactgcaccggcgtctactccttccagaactttctcgatccttccgacgccacagaagacgaggagcccttcgagaggtggaacgtcaacaacatcaccggcgacggcgagaacgtgcggttcatcgccggcctcatccaacagcttctgtcggaaacggtggagagggcggccggcgccgcggggcggtttgcgacgggcgtcgtggacaccggcaggacgttcccgctggtgtactcgctggcgcaatgcacgccggacctgtccgccggcgactgcctggcgtgcctccgccgcctcaccggcatgatcaactccaccatggccgtgcgcatgggtgcgcagatacatgtcacacggtgctacttcaggtatgaggcgtacgtgttctacgacagcaagcctatgctgcatctcaccggcgcgccggctccggccatccccaaaagtaagactattcttggattctcaattagacctcgttcggttattccctacaactgtggaattaatcctctgggtgggcttgttcggttattctccacgactatagatggccaaaataggcgccacggccgggcccgggccgagatcacttgcccatgtccacttgctgcaccatcggtctaggcacggctcaataaaacttgggccttaccaagccagcccaaaggcatgaaagccatcatgctaaaagtttatttgaagtccctaatctctttcggcagtctcttaatggctgggataagtctatttgcatccctcgtttctttgggccatatcctatatatagatggccatatggcttgaggcccatggcccggcctaagacacgccattttggcccgcccaagcacggcacagcccgactcggggtcatgccggtgccggcctggcccgatagccgggccgtgcctcggccgcaccctcggcacggtgggccggcccggcacccaaccaaataaaaaaagtcgtgggatgcaaaatatacttgatgaaccatatcagacaggacccaaagagaagaggaatacataatagacttattttccagccatatagacctagcccacagagttgagggaccaaaaacagatttattatgtgaaaatcacaataagtcgtgccttcaagccggcccggcacaacccgagtcgtgttgggccatgcctgggccatgtgtgcggcccgtgggctggcacggcatggcccggagtgtaggtcgggccgtgccggcccaattaacctcggtccaggcatggccaggcctgggccgtgccgcccgtttggccatctatagtcctatatggctagaataagtctatttaactccctgatcatttgaccgggccatgctgggtcggcccatcgtgccgagggtgaggcccaagcacggcccaaaaatcgggcaatgccatactttaatttggtcaggccaaaaccccgtgccatgggccaagccgtcgggcctctggccttttggccaactatatccacgacggaggcaatggaggggattgagagggaatatataatccctatgtaaatctctctcaactctcttgtgggtgggattaaccactaaataagtccttaatcacgtccaatttctttctcataaagatcaaccgaacaagctttagagattacaaattccgtaaaattaatttaatcatatatatactcttcagatcccacatgtcagtcaccttagatgacgtcacatgacactagtatagcagagtaaatctttattgttcgattaaaaggaaggacatatggtcaaacctcacaccaaatgttttgaatttgtttgagtttagttaaaataaattaacttcagcaaaatcagattcaacctttttctttctgaaatttggaattcaccaaaattattatgtattcagattttcaacctcctgacccacatgtcagttactttagatgaccccacatgtcattgggaacatgagagtaaattcttaaattttgatctaaaggaacagtatatgatcaaatcgcctgctatgatttaaattcctttcttgttagttttgaagtgaaaaatgttcattgccttgaacaatttcgaatttgtttgactttaggtaaagttatttcaaattcagcaaaatctgttcaaattattttttttgaatttcctgaaatttgtaattcaccaaattatttcatattcacgttgtgaacctgtcccaatgcactatagttatgaatgatttgcaaaataatatccaatgtgtactattaatatattttccatgtatacaaattagcttctatctacttttgtttagacaaaagattgttatgtcatgttttagggcataagagcaagctctgggtaattcccattgtcataattcctgtggtggcatttttctgcttcattgtttactgcggctggcggagggggcacagaaaaggtaggttactaatttataaaatatttcatattgtttaaattacttaccgatgtcatggtcagttttttactgaggtacagatactaggagattctacattactaattaattaaaatcagagaaaatgacactagctagttaacattaggtggtctcagaccataaaaggtacctagtatagtgttgtgttcattagatataactgaacattgaagattgatattcttgattattcaggtataatgggattacaagcaaggagaactgataacttgcagggagaggaagaattagtttgggacctagaaggaaaaaatccagagttttcagtatttgagtttgatcaggtactggaggctacaagtaatttttctgaagtaaacaagcttggagaaggtggctttggcgccgtgtacaaggtaaaaatccaaaacacatagttccttcgttaacttttaaacatatatttgatcgtttgtctaattaaaagaactagtacaaatatgtaaaaatataggccatgtttaaggtactagtaatgataaaacaaattacaagaaataaataataattacataatatattttgtataagatgaatggacgaacatgttcataaaagtcaacagcgtcaaaggagtatgtgattataagtaatgggaaacctttctagtttaacctcagtagacaatatacaataaacatgcaactattatttaaaacgggttcaattttggcttgatgataattatcaggaattgaactttcggtctaaagttttatgagacctaaaccacaccaccctcatctccaaatatgcatccaaattagctactggtttcctggggacttttcatggatcaactagattttgcaccacaaaaaccactgaaggacttctatttttttgcagggccattttcctgatggaatagagatagcagtcaagagacttgcttcacattcaggacaaggtttcatagagttcaaaaatgaagtccagctcatagccaaactacagcacaggaatttggttaggctcttggggtgttgctctcatgaagaggagaaaattttggtctatgaattcttgccaaacaaaagcttggacttatttatctttggtatataatttgtattatatttctcagtataggttacatattttgataaaaaaaataattgttatgttctttttcctatcatactgatactttactgatgtgcagatgaaaataaaagagctttgctggattggtacaaacgtctagaaataattgaaggaatagcacatggacttctttacctacataagcactcccgattgagtgtcatacatcgagatcttaaaccgagtaacattctcttggatagcgaaatgaaccctaaaatttcagactttgggttagcaagaatatttagctcaaataacacagaaggaaacacaacaagaagagtggttggtacatagtaagtttcatgtaaattagtccacttatgaaatttatgttataactcaactgcacatacaatatataatttttacttgcatgtatcattttagcggctacatggctccggagtatgcttctgtgggcctcttctctatcaaatccgacgtattcagctttggtgttctatttcttgagattatcagtggaaaaaagaattctggttcccatcatagtggagactttatcaatctccttggatttgtgagtttacaaacacatatacaatattttaaaattgtcttttctgtctaagtggtgtttttcctacattaacctacctatattgttctcgaaatttcatacaggcatggtcactatggggagagggaagatggcttgaactcatcgatgaatcattagtttccaaatatcctcctgcagaaaatgaaatcatgaggtgcattaacatagcattgctgtgtgtacaagagaatgcagctgatcgaccaaccatgtcagatgttgttgcaatgctaagcagcaagacgatggtcctggctgaacctaagcacccgggatatttcaatgtgagagtggcaaatgaagagcaatctgttcttactgagccatgtagtgttaatgatatgaccatatctgccataagtgctagatagtttattcttcatgtgtcatgtggctttcgttgatccaatgtacgtagtatttgaagatatcataacagaattataatgctgtggtatttcaggtgtcggagtatgtactccccaaagagtgatcctagatttttgtatacaaacaaatggcttttgtatttatttggtgggtagcaaatcaataccataactatcgttggtgccaattttgaaaacaaagtgaaaatattgggtatggcctagtaaaaaatgaagaacattggttacaagactctgttcgtgatgggttttaggctgagcttatggtttgcacgacaaaacgagacaattgattagggatatgattaattaagtattaatctctactattataaatattgaagatgtttgtgccggtattttggtatgttatccgtgtttgagtcagtttttaaagtttattcgcttttgaaaatacagatccgtgtttaagtcagattttaaatttgtttgcttttagaaataaaaaatagtcgtataagaaatctctttaaaaaactcgcatgcagacttctaattgtagctcctgattttctaaaaaaaatatccaagcaaattcccacaatcaattttaccttagctaaaccgtataacaataataagattaaaatagttttcactcgttgtaatgcatggatatttttttaagctatattataaacttgaaaaatgggtttaaccaaagaaatgaaacgcagctgacattggcatttgccccagttgctgcctgtctctgatgagtaaacgcaggcgcatatgtgtatccctatccagccactatggctgccacctcacgggactagagtggcaagccacactgttcgccgtcgtgggtactagtcattgtacaaaccggcagcaatcgatgtactccctccagcccataaaaactaacataatactggatgtgacatatcttaatactataaatctggatggagggagtataaaataatgcacttcagaatttcaacctcccgactcacatattagtgactttagatgaccccacatgtcattgggtacatgagaggtgtagaatcgaatcacagtaactaaaccaaccagaggaggggtgaatggttggtatacccaaaaatcaaaaacttttagcggaaataaaagttaccctcgaattcaatgagatcggtctgaccggagtagattagccggtctgaccgaagcgtagccgttagtctgaccggtgtagatcgatcggtccgaccgccaaaacttgttgccgcctcctatcgccgaagccggtctgaccgcaggtcacccgccggtctgaccgccgcgatgccgccggttagaccgccgaaacccggtgaaacacaaatcgaagaactcttaaagtagatgacgactttattgattctctctgtgtttacaaagtgcaccaacagcactccttataaaaatttcgactaaactcgaaaccttaactcaaaacttaactcaattgctctcaaaagcgataccgggaagcctcacgctccccctctatttatacgcgaggtaggcagcctaaagccatgaaccaaactcatactaggagtcctaaacaccttaggaaaccctctagtacaagaaacaaactttacataaccaatcataccaaatttggactccttccaaattcaactccgcatcccatacgcacacaataactccatcgtatgccatatggaatctccatcaaccacgtgcatcaactgtagcctaagtatcccgcatgatctttgaccaccacggacgttgtcttatccccaagccgactcccagtccattaccgcaaatactctcccgaggcatcgagtcacctacacatgaaataaacaaagaaactatcttccgagaccaagctatctccaacttgactcatcagtagcaaacaacagtattacatatatatagtatccatctagaagccataatcatgaaataatcacggatatccaaacaaacaacccgaaacagaaaccgacacagcgtcggccggtcagaccgtgagctgcgccggtctgaccgcgcaatacacgccggtctaaccggcatccacggcccggtttgaccggtcacatgaaataacagcagtatcctatagattcacctatgaaatccaatcatctccaaaaccacttcgtgaataaattccaaatatcaaaaccaataatttccgatgccaattgttcatcacaaaataataataaaaaacctttgattttacaatctcccccttgatgaacacattggcaaacccatcagaaatgttttggtatttggaaaaataaaaacataagtggtaaaaaaagtatacttcgtacaaacgtacacatcgtgctcgaaaatctaaaagaaaacttctctcacttttgaaaagaaagatattccctcatgaaccaaaaacaacatgctcttctcttcaactcatttgtttctccaaaaattttcatcttgcttctcccaaaaaaatccaaaaattttacttgcttctcccccttttgacaatgatttcatcaagcataggaattacgtttattaatgtataagagcttagcatacatattgcatatcaagtcatgtgttgcaataaaaagaagatgaacccatctataacataacaagcatgcattaagtataaccatgaaccaaagattttacaattaagcttgaatcaacaatcaaaattcataattttatacgatttataatgcaacaacttaacaagcacataggttgaagaataaacactaaacacatatacctattgtatttatcactctttctcaaataacctttagcacaaaataacaaagagatttttttgactttttcttttcttgagcctttttgctcatatttttctcttttattctgggtacgtccctgtcgtcaagactgttttcagggattcggcacccattattttgctcacatcgaatacgtccttgtcgtcaagactgtttccaaggattcggtattcattttttttcatattttttattctcttttcacaatgagcaattaaagctatttgaggaataacaattcaataaagcatatatatagagcatttataaatcaaaccatatgctagcatcaacattgcatatttgcttaattcaagtagaatttaaatgtcatgcatcatcgcccttaaaagcaaaatctaaatctcatgaaaagactataatacatacaagctatgctagagacaaataaaccttcaaagtattgctaacatgcacaagaaaataccatatgtataaacaaagctctcttttctcaatttttctcattgtcatatttttgcttgataaaaccataaggtacaaactccccctcaaaccatgccaaaaggatgaattatgcccaattcactacgaagaaaagcaaaacgattataatctaaaggtttagtgaaaatgtcagcaagttgcaactttgtgtccaaaaactgcaattcgacatctcccttctcaacatgatccctcaaaaagtaaaaacaaattatcacaaaagattcttagcaatgttaatagcactaatattatcacaaaagagaggtactttctcaaaagtaagaccataatctttcaaagtagataaaagccaaaaaatatgtgaacaacaactagcagcagcaacatattcagattcagcagttgattgagcaacactagattgtttcctagaagaccatacaatcaatgatgtaccaagaaaatgacatgttccactagtatttttcctatcaattctacaaccaccaaaatcagcatcgaaatatccacttaagcatatagaagatgaagtagaataccaaattccaaactcaagtgtatgattcaaatacctcattatttgcttgaccggttgacgatgtgaagcacgaggagaagcttgaaagcgcgcacacaaacatacaacaaattgtatgtctggcctagaagcagttagatacaacaaagttccaatcatacttctatactccttttgatcaacagcttcaccatcttcatcaggatccaacacagctgtagaaccaattggtgttgaaattggcttgcatttctccatcttgaaccgtctcaagagatccttcgtatacttcgtttgatgcacaaaagtaccttgaggtgtttgcttaatgtgcaatccccaaaaa

SEQ ID NO: 62246 - DNA, 782 bp, Oryza sativa
ccaaaaatacgaccatcctccccctgaacctgtaacagtgtacctgcaatatcgtgtctagttcctggactagcctcatcaaaagaaacttcgcaagtttcaacgattttgttagtctccaaaataagtacacgatagccacgagtatgtgcggggtaaccaaggaacaatccaacagtagaacgtgcctcaaacttgtccaaatttccagatttcaagacaaagcatttgcaaccaaaaacacacaaatgtgaaactttgggttgatgaccaaatcgaaattcataagaagtttttccaagttttgatctcaagaaaactcgatttgaaatatagcatgcagtgttaatagcctcagcccaaaattttctaggagttttatactcgtccaacatcgttttagccatctcaaccaaaacacggtttttcctttcaacaacaccgttttgttgaggaacacgaggagaagaaaattcatgttcaagacctctttcgttgcaaaattgttcaaaagtatttttaaactcaccaccattatcacttcgaattcttttcaaagaaccagaaaattcaaaatctaatcgaagaaacaaaccatgaaagtgttgaaaagcttcgtccttagttgccataaagaaaacccaagaatatctaaaaaaaatcgtcaacaataacaaacacataccactttctttaacggattgcactctagctggaccaacagtgtccatgtgtaatagctgtcccggtgcattcgtcatcacagaaacaataggagcatg

SEQ ID NO: 62247 - DNA, 1313 bp, Oryza sativa
attcgcccatccatcttgctggcgccgatcaagaccaccttgaagtggcaggaccggaagccgccgccgtgcacgtggccgtcgtcgccggcggcacaaagcaccgcgccgttcatgacggatctctccccaccgtcgagctcctgcggaacggccacgcggcggcgatcgccggaaacgggatcccacacgaggaactcgcaggtgttgtagttgaagatgaggacgaggccgtggcggcagccgaggaggctcgcggcgcggtagtcgtcgagccgcagcgcgaagcggtcgggcgggatgagatccggcgggtcgaggacggatctgaagacggggtggtggagctcgtccttgaagacgccgaggagggggggatcccggtggcgggcgcggaagcggcggaggaaggcggggtcggagacgaggcggcgccactgcttgcagacgagggaggcgcgggggagggaggagggatgcgaggggaggcggaggaggatctcctggatgaggtcgtcgttgtccggcggaagcaccggcggcggcgccggcgccgccggggatgtccgccgccgccgccgctgccggcggcaggtcatttcgtcgccatggtcactcatgggaatctctgtctcgtttgttcactctggtttagtttttctcccacaaattcgggtaaaatttaaaaactcggatgaaatatgtctctcaacttaaaaaatggacgtgtcaacagagaccgttctctgtatggtcataaccaactacctcaatctcatatctagttgctactagtatacttccttcgtcccaaaaaaagataaacactgggtttccgtgtccaacatttgaccgtccgtcttatttgaaaaaattatgaaaaattaaaaagacaagtcacgcataaagtattaatcatgttttatcatctaacaacaacgaaaatactaattataaaaaaatttcatataagacggacagtcaaacgttggacatagaaacctagggtttgtcttttttttgacggagggagtactcaaaagtgcatgtatttttttttcttcttatggaattttatcttagattacttatccgatttacgatccgattacaccattatgttcataacaattaaatatttataacaagatctcatatgactatatttttatgaaaaaaatataaattacttttataatatatctaagagtaaatttcagaaaactgcaactttagtgacaaaactatcagtttgatgcaacattagcgatatgtttcagtttgctacaacaatagcgtgaaaaattatcaca

SEQ ID NO: 62248 - DNA, 1816 bp, Oryza sativa
aaaatcttaccacttctagcacaacacctaacacaacaggggggtgtctagaattatgagcataaggattaaaacctaaaccacggttatgtgtgctaactttagattgatccaaaatcatgttgaggttctttttaccatcagaaaatctttgcaaagaatttttcaaataagaaacctctttttctaaattagcacaattttcacaatctaccatgacacctttgcttttacgacacttggggcaagaaagcacttcattgtttttcacaacatcttccatttattcaacacgacctaaagcatctttcaatttcatcttattcaaattgcatgttgagcaatccaaaacatcatgaggttattttaactttttagcacaaatcatgttaaacatcaaactagcatgaaaagcaatttgatatttttgcaacaactttttagttaaaaacaactcatccaaagtgcgtgtgtgcaaagcaaaactacaagcaagagaagatctatttttcaaatcatgtgcaacattaatctctctaatttttgaaatatcattcattaaaacctcacaacttttgcaatcatcatcattaggaataagagattttaatctagcaatttcagaattaagagattcaatgataaattcctgttttctatacatcttctcacacttcatattttttgcactcaaaatattaatagcttcttcaaaagcacttacctcatgatcttcatactctgtatccgattcaccacgcgccatgaagcaaacactggagatgttctttcctttatcttcatctccacactcaccatctacatcgcttagtggctcaaatgcggcgtatacttgatcaaaaaccttcctgagattctccttgaacttcctcccttgggatgtaccctttggcttgttgttgttggttttctcaccatctttgtcttctcttttgcctctccgaagcttacgacaatgcgaacgaagatgatcaactgaaccacattcaaagcaacgatttggaccacctcttttcctgttcctggcattattcatagctcgagcaattctgttagcaaccaaagccaaatcctcctcctcgatctgttcgagttgatcatcggaagtggcattaaaaatagcaagaaaagatgacttagatgaagaagcatcaacatccaaaaagaagaaaaagaaaccaaagcactcgacttagaatcaactttacgagaaagaacgttcatctcatgtgttttcaattttgtgtaaagtgaatccaaagtcaaagtagatatgttaacagactcctgaatagatgtaactttcatctccaaatagacatgtcaagaccattcaaaaagtgacgagaaatctcagattgtgaataattagcatcactagctgccaacccgtgcgttgcacgggttatttatcaccatcacaaaatattaaaaatttaattatacattggcaattttataaaattacggcaagataagaagagggtcattgtcaaatgctactcctaatttcgaaataaaatttacaaaatacttaactaagaactaagagcttaagataggaacaaccatagtcacaaagttcctgggtcgatgggatcggggaacggggtcgaggaacgtgatacgctacttacaagaggtttttactaggtggggacgaaaatgaccccgtgttttcgggacggggacggcgttcccgggtcgaggatcgctgccaccgaccccgtttcctatgactatgggaacaacttcatgtttattaattctggatttagaggaagacaataagctt

SEQ ID NO: 62249 - DNA, 13946 bp, Oryza sativa
atatgtaatttgaattatagtacatttccatgatttaatattcgcgatgctcagaaataaaattaataaagtatcgagttctacctggcgttgattccagattgatttttttaaaaaataactttgaatttgtaaatctttaatgattttaaaaaatttaatagttgagtcgtaaaaattctagtctgaattatatatagtatttccacgattcaataatggtgacgctcaaacttgatttggagactcgattatagttttttttcactatttaataaatttgaaattcctaattaattaatgtcaaattgtgcttttatatatgatctaaaaacgaaagacagttatgcatacagctaatatatatgcaacaccactcccatctacctgtgaatgcatcccttaatacatgggaaattaaagacccttaatacacgggaaattaaagagataattagcatccgtgtgccatctctttcgtatgcttaatacatgggaaattaaagagataattatcgtaagtgtgccatctttttttatacgatactgattaggttaatcactgagtactgaaaaaaaaatagtgcaagagcaaacatggtctcaagcacgaacgttccatggttgacatacattgcgccatctcgttttctcatagaatgctgacgacacactcgggcggtggcggcggcggcagcggcttgagttcatcgagtgcagtcgacatcggcggcatatggtagcgacttcatcatccggagatcgatatatcgataggattgtatctgatacggtggactcccaacgaaacaatacctctagatttaatggcttttaaagtggcccataagtgtgatctgttaattgatggtcaggattagattgaatcacctaattaatggtttgatctttccggttaacgtgagagctcgtagaaagtgcccaattagtataggtatagatagataagaagaatcaacagatctaagatcacttaaaattttattaaacctagaaagatagtcatccaaaacttctccaggtttcatctcaaatttaatgtactctttttcaaaaatatcacgacgaagttctttaatgttatttgtaccttgatgaaaattattcaaagcaacccaaatctcatgagcagtttgaagatgagcaacacgatcataatccgaacgagaaatcccactcaaaagaatattgcgagctttgcaatttagttcaaaagcagttttttcagcagcagtattaatagcttcaggaatcacataaggaagagaaacttttctccaaatatcataattctcagccataatgtaagattgcatcctactacaccaatgagaaaaatccgttccatcgaaaacataaggcttagttgtaaacttattagaaatagccatggcaaaaattcaagatcggtaaagatcgaaaagagcaaacgaacgtggctctaataccacttgtaggatcgaatcacaagaactaagccaaccagagaaggggtgaatggttgagatacccaaaaactaaaaacttttagcggaaataaagttaccctcgaaatcgatgaaccgcggtcttaccgaagtatggttgagatacccaaaaactaaaaacttttagcggaaataaagttaccctcgaaatcgatgaaccgcggtcttaccgaagtagtagcaccggtctgaccgcctggatatcgtcagtcttgtaagatcataaagggcctttcccatcccaaaagctagccattgaggtgaggggcttctccacttatatcttaggtcctttgcccttccacaaccaatgtgggactattcaacaatctcctccttcacacattggtgtccctcagcccttcaccgtgtatagaccccacagaataggcccacggtccatcaggtatacgggccccgcaggcacccacggtccacggtccatcaggtatacgggccccgcaggcacccacggtccattagacctccccacagaacaggcccacggtccatcaggtatacgggccccgcaggcacccacggtccattagaccttcacacactgtgtccatcgggccagagatgttaacctagccaggctctgataccaattgtaggatcataaagggcctttcccacccaaaagctagccattgaggtgatgggctcccccacttatatcttaggtcctttgcccttccacaatcaacgtgtgactattcaacacatgtgtccatgaataatcattttctataaactgtagccaaagatattcaactgatgtcttctcttgtgcatattgactaggcacatgcaaagggacatctcagcacgtgagataaaaacacaacttattacgaatggtcataatttaaagcaatgaactcaaaaagatattaacggcacagtccatacatctaatagtatcaagtgaaaagactacctagctcgagggcttctaagtgggccaattgtaaaaatttttaattgcatgtttgtgaagtgatatattacatgttaatacatttcaaattttttaaaattttttcataacaatttgagtgacatgcaacaacgaggggatatccctctcgagcgatatcaaaattcacttcccaaagtgaagtgattgttcagttttcctcgacgagatagagagcatattgtcacaggttcacagcagcaaggacaaaggctaccatactaatgcattagtcagtgagtccaaagactggaaggactcacaatcccgaagtgtcaccacaccaaactacagacgaaggtgtccatatagcacctgaacatgctaacattgttagtaaataacgagccaagatatattaggcacaggcacatacatattactccctccattttaaattgatctatatatttttataggtataccaaaactaagaaaagctaataactctctcatactatatttactctagcaacaaactcaatgcatgcaccattctcagtatttcctagccaatagcaaatcaagatattgcatgtgggttataaatacttgtgtgcatggatgcatgcatcaatgttctttactccaatgcacaaataacgaatagccttaatgaatgaacacatatatgtaaattatttaggaataatctcaaaaatactatatgtagatcaatttagaatagagggagtatctgactcgctaatacttgggaaagatagataggcatctttaacacaccagttcaccagaaatgatgcatgatcatccatcgttggggcagggcaaccattctgtcgtcaacaagaaaacaaaagtcaatcagtaaacgaatatgcgaacggaaagttaagagaaaatcaattctataccactgagtttgtttggattcaataatttgccttcgatattgtctctttctataatataccggtgactttattaattgttctacaatatgctattggactgggcattcttttcaaaaatacgcaaaaaaaccttagatacatacaagattaacatttgatttatctaattagaagtttcaaaaaaatatgaaaatttttatgtggcctcgttacacaagtatacatgctttaattttttctagtatatttagattttagaaaaaaattttgtatgtggtatataatgggaaaaaaatatgcttatacgagggataataacacaaaaaaatatcttatgtagtatatgaaagatgatttatattaaaaacatcaataaaaaatattttataaagcatataacagataaattatatttttttaaaaaatataaatgtaaaaaatgtttcaggccatataaaagttttcatttttttaaaaacttttaataggataaatcaattattaaccttgtatgtccataagggtattttgggtatttttgaaaagaatgtctagcccaatggcatattgtagaacaattgatgaagtcgtcggtatattatagaaagagacaatgtcgatggcaaatcgttgaactcgaacaaactcagtgatatagaatagattctctcgaaagttaaatactacatacgaattatgcatgactagatgagtgatgaatcaccggaataaatccatgccttgtgcccaaaaaactacattttccttcattattagagaaaggtcatatgctacatcaaagtcaggccaaatcccccccaactatacgtcataaaccatcaaactcaaatgaagggcatccatagtcacattactgtactcttcccttacaagaagtgacatagtcactctatggcatctctgtatccacaaaacaaaactgaccatttaaataatactagtcaaatgtgcatacagagagtcagcaattaaatggacaaatatacactttcatgaagaaatatcaagaaagtacataatacaaatttaccacccagcatcctataccaaattaggactacgagtctaagatttatccagtccacagaaccgcatgcatgagaataaattaagcaaactgttataatttagatatttttggatcattcgagttcataattttcaatttcactctctaaagtaagtgttataagaaaaaagaaaggcgagacctctatgacttgtttaatcttcaccatcagtacaggcagtacacatcaataaatcataataagcacaatttttttaacatagcatttgcttcatcataaaacatagctttttgttatgggcattgggccaagaggccatgcccacgaccaacccaaggtgagaagtactcatgaacagtttcatatcaactgttatgcacaaggtttcattggggaaatatagctaggaaaatagccggacggcgtcggcttagatgggatgaggagagattataggatggggaggagaacttgagcgatattagactaatcttgatgcattgcttaaccaaacagagatacaatccatccttgtagatgggcgacttgtatcttactccatccgtcccagaaaaaatcaaacttctagagatgcatctagacaagtgtttgtccagatacatctctagaagttaattctatttggtacggtaccgctgctacagtaccgcgcttcatcttgggttggtcgtggacatgacctcctggcccaatgcccgtaacacttttggtaaaagagaatgatttgttcctctagcataacctccgtcacaaaatgtagtcattttgggcagcaaaaacaacttaaatataaccttaacaattaatttgtacacttgtaaatagtaaagaataataatattgagaatgaacctttcaagacaaaactacagttacatatgttcgatcgaaatatccaaatttattcaacagcaaatatttagacagtcaaattcaatcttccaagaaggacactagatgattctggaactctaatgacaatttcagcataagagattattgacaattcaaacagctaagcgagcacaaaggtgtgacatttagatcaacccaaatataacctataatttggagagaaaaaaattaacacagtttgcttatctacgtaaaatgaagagcatatacgcaccgtgcacaatagagttggtcagaaaagaaaatgcatcaacatataatctttcatgggctcattccatggttcttaagtagacaaaactaaaagtacacaaaaaaaaaaacaaactgtagcaacatgtgtcaatgaataatcattttctataaactgaagccaaagatattcaacttatgtcttctcttgtgcatattgactaggcacttgcaaagggacatctcagaacgtgagataaaacacaacttattacgaaaggtcataattcaaagcaatgaactcaaaaaatatattaacggcacagtccatatatctaatagtatcaaatgaaaagactgtatctagctcgagggcttctaagtgggcccattgtgttcctaatttgatatttcaattctttaaggtgagtttttcatgtggttgtcgccaatttccaaagtgatatataactcaagctacaaaattgtatactatagccatgtagtatgcacaaattgatactactttcaaacaagctgagtagaaatcaaagcacccaacatttagttctggtatttctaagctatggacattcatagcatagactagtcaaacacattaaaacagatagatagcacttatgagaaccgcataattcaagactaatatcggaagcggcatgtcatatgtaggacagttcatcaagcaggtaaagtaacaacaactgtcaccgagaaaataaaaggcattcacaagcaaccaattattgagaataatatgaccttgctatatgtagagagtaaatacgcatgggaagaaattacctttagtatcgaaactacagaacggatagtaataacccattccaatggtttggggtagtttcttaaattgcatttactccagatggaccaggaaggcaccaatacgagtgctcacaaacaacatattatgttcctcaacaaagccaagacatggtgatgtgatacgaggccctggttcgacagaaaggagcttgtccagttgaatggttctctcaagcacccatccagtagcatcatcacagttggtcttgttcttccatagatcgagactaaaatctgtgagaacaaggaagaccagcccaccatcctcagccggcacaatcctgcagcgctcatcccaatcggtatgcataaccagtaaaaggaattaccaaccaggatatcagaatggtatgccaaattcccaaaagaaaacgcagttgagatgacattgccccaatttccgttctcagatgagtaaacgcagacgaacgcgttggcctcgtctgcgaagagcattgtcacctcaaatggactcgaatggcagtcgccgtgcacgtgaccctggtcgccgtcgacgcaacgcaccgtcccgtggtagatggttatcctactctcgtcaagggatgccggaggaatatccacggcgccggtcgccggtgacggggtcccacagcacgaatcagcggcggtggatgaggttgaagagaacggcgcggccgtggcgggtccagcgccggggtgaagatggattccaggttttcgtcttgcctgaagaagccgaggaggggaggcttacggtggcgggcgcggaagcggcggaggaagccgtggtcggagacgaggcggcgccagcgcttgcagacgagggaggcgcgagggagggaggacggctgcggcgggaggcggaggaggatctcggagaggaggtcgtcgttgtccagcggcggcgccggcgaggtggggcgctggcggcggcggttcatcatcgccgagttggggttttcctttttgtctgtcttttttccttttttttcgaattacagaacactggggctgtttactcactttaccaacttctctatgccacaagtgtggtgtatgggctaaaacggtacggaaatggacggaaatcatctttatccttttcgttttcatatttttttcggaatcgtaatcggaattggaaacccggatacgaaaacggaatcgaatattatcgaaaccgaaaacggagcgaaaacgaacctgcgcgaatacggtaacaaaaatttatcggaataaaaaaccccttaaactggtaaatccaattaaataaattatatatatttaaaagagtaatgttgttgataaatcccaatgtaggacaaaaaatattcttatgtaattttagatttgcataacaaatattttttaaaaaaataacagccaaacaccaggtattcactatttagtgcttaaaaaaagaatctagtgtatttcagtcacaaaatttctagtaattccgagaaaatttccggaaattctgagaaaatttctgaccgattccgagttccgacggaaactgcccttatcatttccgattccatttccgagaaaatatttccgaattcgtttccgtttccgaaaaatttcgaccgacaaattccgttttcgaaaataggtccagaatccggaaagtttccataccgttttcaccgctagtgtggtgtgccatagtttttttggcaaaaaaaaaatggattcttttgaataccatcacttaaatgagtttcgctagaatctcattctcaactaagactacttcgccaaaatgccatctcggaggaaaatggccgtcattcttattcttcctcaccacaatgtcgaaggagcttacgggcaactaccgctagctccaccatcgcgccagcggtgccacctcgctggccttccatcctacccgccacattggggcttgaggagaccgcaaccgacgtcgtcaatgttgacgacaatcgagtcggagagtgggccgacagagacgaactcacttacgacgggggcggcgcatcgaggcgtgcggatgaactagccagcggtaagggcggcgtatcgaggcgggcacagaagacgcagacttcggtgagggctggagcgcatgagtggcggcgggggagcgcatgagtggcggcggcgcaaccgtggcggcgatagttgacgcgtgcgcggccagcaggagcgcgtgggcgggcacgcatggcaacgacggccgttgcacagcaagcaagatcttgtgggccacggcgcaaccgtggtggcagtgttcatcgcacgcgtagccggcgagagcgcatgcacaggcacgcaccccggcaagcaaccatggtagcggtggtcgtcgcgtgcgtcacgcttgtggtaattttttttaacaagtgagtgtataacatatgggccattttagtagaaaagtgtggcatgccatacctttggcttcaaccaaacacttgcactaaaaagtcaagcatgtctaattgtagtgtggcaatatttggcaagcaacgaaaccgtccctagattgtgggcacatcttttgcggtaagatgataatatgacgtactgcatattataacaaagtaattttatagataacatttttaaattaaaaaaatcgatagaaaactttaaaattagtttgtgaaattcaaattttgatagtgtttgattttatagtggtccaacaaatgaggcctggattttcttttcttttgtcgtcagtttcagtgttgccggtgatagatcggagtcgacttgggagaagtagatatctagggatcaagagatcatgcgggatactaaaaagctagagaacaataatgcacatgatgatgaagaattcatatggtatacaaagaggaattgtgtatgtatggaaagaggagtcaaatttggaagggagtccaaatttgggaagattgatagagataatgaaagagataagttgaatacttgcaagagagggtttcccacgtggttgggagtcctaaattgtgttagattcatgggatttgcacagcctacctcgtgtatcgattttaaagagacttgagttgagagaaagttagggtttcgagttcaattcgagattttggtgaggagtgctgttggtgcactttgtaaacactagttgatgcaataaagtcgagattcaatctacatcttcgagtttgtcatctaccggtgttttctgggtcccaacggtctgactgacagcacggcggcggtctaacctgtgggatagcggtggtctaaccgcaggtgtgcaggctgtctgaccggtaaggctacggtggtctgaccggcggcgacagtgcttcgtcatctactctggttgatgtaaatcttttactccgcaaaagattttaggttttttggttttccctaccattcaccccctctgttaggtttgtttggtcttgttcgatactacaatgtgctatttgtcatgtgttctataggtggcatatatattagttggttcgaccaacccagcgatcagaagcaatcactggtggagaagtgctttttagtcccggttcgtaaccccctgtagtcccggttttcaaaccggaactaccaatccgggactaaagatcgctatctttagccctgggtgaaaaaaccggaactaaaaatcgatctttagtcccggttgataacaccaatcgggactaaagatagggatctttagtcccggttggtgctatcaggcgcgactacagcggcggtagcggcagtccgccgggtggtccgttcctccctttcttattgcctcccaaatggcgcgttgtccatatgcgccagtcagaccgcacatgcccatcccaactccatagcgggaggcacagattcatcacaaattcattcacaatatccattcacgtattcattcataacatcacaaatatattcacaatattgattcacaggttcattgacaacattgagtcacatactcattcacaatattgattcatagattcattcacagatcaaaacatccaaaccacaaattaaaaaaaataaaaaaaaatcgactcaccggccggcctcccatcccgccgccggccagccacccatcccgccgcttcccctccagccggatctgggggaggggagggcgaggccgccggtgatcggcctccatcccgccggcccgcaccgggcctccgccggccgtcctccatcccgcgcctagccgccgccagcccgcgcccggccgccatcgcgccgccgccggctgcctctgcaaggggaggagggggaggggaggaggagagggggtgagagaagagcaaggggagagaatggaaggagaaggatggagaggatggagataaggaaggagaagaaaaagagataaggatgggagatggggagagagaggctacgcatgctcttgtgcgtgggctggtgcgtaacatcaaccgggactaaagatcccggggggcctgacaaggtctgacaggtttagaaccgggactaaagatcaaatatgcccgctgtagtcaccaaccgggactaaagatcggtttttagtggaaccgagactattatggatttcggccgaccgaccaaagatggtttctccaccagtgaatccacggtccatgtctatttggatttttttggatcactagctatgcatagatttataggagctgagattttctagatttaattgtgaacattagcttgaattactctagctcgaattgcacctacaaataggatggactaaacaaaattcggaagagtaatctcttgattaaagccttcatagttattatatcctgagatgtgttgcgaattggatgttttcttgtcattcatgagtttgtcaaagataggccataatttgatttgccttcatgccaaaccgcaacaattaggacggatcaggatcctctgtggtcgattgcaccgtacctttatcactgtaatatgggcccgatggtcttcgggcccacatattacaaaggatctcaatctctcccacagtgcgtggagctttagatatggtccaccactaatttttttcccgtctggtcccactaaaaatccgtcatctcctccttcagaggagaaaccgcccgcacctccccaactttccgccgctccttccccatctctctcttttatcctctccgttacgactcccatggtggtgaccatccgccccctcctcctctccgtcctctcccacggccgcgcacggcggcgactcccccgccccctcctctccacccaccggtggcacacggcggcggccattccccctccccctcctctctcactggcggcacagatttgagcccctataccaccggcgccgcttgggagaagacgtggtggtggcggcatctcgacggcagcgggtgcctctcccctccctcggctaccccgagtccacgaagcggcggcgaccttcccgagcgccccaactctggcaagcttctctctttagtcggataccgacattcccctttctctctcctgctctcgctttcttgtgcacggatgggcaacgaaattgctgcgaggttctcgtgaccaaagttggtcatgcgaacccagggaaggaacggtccccattccactctcttctccatgcaagcaatttgcctaggtgaaccaacattgccatatatcacgtgtgtgcactgtgaatagtcttatagaacattgctctagccatacatacaacttacaaaagcagaaatcatcaactcatggccgtcagcatgtagccaatcttcgcatatgcctgtaaatacatctgaactctggaaatgatggctgtagcttcgacgaaacaaaacaactgcatttctggactgataaccggcatgtatccagcaaatctgtcgcttgttcgcgccaattctggttgcagttgtgttttcgacagtcacggatggattcgattgaagtcacaagtttacagcagacaaaatagcaggattgagaaaacgtaaaaatagaaaaaacgtaggattttgataggaatgtaagtgtaaaatagaggattgcaaaacgttggaaaaacacagaaatatccgtttgatcgaaccgcaggaaaaacgtgggaattggatgagagagatagactcaaaaggaaagttacaagaggttgaagctcttgctaaatttactccaaaatctttataggattgtctattccatagaaatttcaaaggattgaatatgattcaatcatttgtttcaaagtgcttcatagaaaattttcctacaggattgaaatcctccaaaattattatgtttttcctcgaaatcaaaggggaccaaatcagtaaatatgcccaaactaaaaagagtttacagcaaacagaaaagaataatacggagtactgtatatacggagtagtaaatagctaaatatgcccaaactgaaaagaacccaaaagttcttttgcatctacaatatctttgtatatttgcgattacacagtggacgcatgcccacatccaaaaatttgtttgtaataacaataattttttatttataattatacggcagacgcgcccacacacaccacttacaccacttcagatgcaacatcattataataaatcatgttgaaagcccacttacgtatgcgtagaatttatggacactgggattatttgaaatctaattggtgaaatcattcacccacgacttcatcacacctgtagtgctttcccatttgcaattacaatatgagtaaatttcataaaactacatatactttgcatgatctatcataaaactacagattttagaactagtttcacaaaactacagatttaatgttctcgtttatcacaaaactacaggtactttgaacactatatcataaaactatagatttaagaacttagtttcacaaaactacgggtttaatatcttcatttttcacaaaactacaggtttaatatcttcatttatcacaaaaactacagatttagtgtctccattctcacaaaactacatgttttaacaatgctaaaacctgtagttttgtgagaatagagacactaaatctatagttttgtgataaatgaagacactaaatgtgtagcattgtgataaacgaatacactaaatctatatttttatgaaacaagttcataaatctgtagtttttttatagattgtatatataaagtacctgtaattttatgataaacaaagacactaaatctgtagttttgtgaaacaaactcttaaatctgtagttttgtgataaattatgtaaaatacatgtagttttgtgaaatttactctaaatgagtaaatttcataaaactacagatactttgcatgatctatcacaaaactacagattttagaactagtttcattagtcttgcacagccatctaatgcaacgaaaactaggtgtactctagaaacagtacgacttgcctatgcatccccattgatgtacccatcccattccaagcttcggttatagtgctgcaaatatattactccttcgtttctggttacaagatttttgattttggtcaaagttaacctgctttaagtt

SEQ ID NO: 62250 - DNA, 23626 bp, Oryza sativa
caaaactacgggtttaagatcttcctttttcaccagagcacaggtttaagatcctcatttatcacaaaaactacagatttagtgtctccattctcacaaaactacacgttttaacaatgctaaaacctgtagttttgtgagaatggagacactaaatctatagttttgtgataaatgaagacactaaatgtgtagcactgtgataaacgaatacactaaatctatatttttatgaaacaagttcataaatctgtagttttttgatagattgtatatataaagtacctgtaattttgtgataaacaaagacactaaatctgtagttttgtgataaattatgtaaaatacatgtagtgtaaaataaatgagtaaatttcataaaactacagatactttgcatgatctattacaaaactacagattttagaactagtttcattagtcttgcacagccatctaatgcaacgaaaactaggtgtactctagaaacagtacgacttgcctatgcatccccattgatgtacccatcccattccaagcctccttatattgctgcaaatatattactcccttcgtttctggttacaagatttttgattttggtcaaagttaaactgctttaagtttgatcaaattatagaaaaaaatagtaatatttttaacccaaaataaatttattataaaaatatatttaattattaatttaataaaactaatttggtaatgtaaatattactatatttatctataaacttagtcagacttgaagcagtttaactttgaccaaagtcaaaacatcttataacctaaaacgaacggagggagtaccaactaccaattagatgactccccacactttgctacgggaaacactgagcaattctcaatattttatttgacgatcaagctatgagtaaaaagaaaaaaaagaaacatcaaggtttattagtcaaatgatacccgtgctttagtgtgaaacatattgataagtatatgctaaatattgtaaaagtgataaatagatttgttaaaatatagtgcaaatgacatgagggggtgatgattggatatgtttgcattttgatttgtagaattaaataaatgagtaaattttataaaactacagatactttgcatgatctatcacaaaactacagattttagaactagtttcacaaaactacagatttaatattctcatttatcacaaaactacagatactttgaacactatctaaaactacagatttaagaacttgtttcacaaaactacgggtttaatatcttcatttttcacaaaactacaggtttaatatcttcatctatcacaaaaactacagatttagtgtctccattctcacaaaactacacgttttaacaatgctaaaacctgtagttttgtgagaatggagacactaaatatgtagttttgtgataaatgaagacactaaatgtgtagcactgtgataaacgaatacactaaatctttatttttatgaaacaagttcataaatctgtagttttgtgatagattgtataaagtacctgtagttttgtgataaacaaagacactaaatttgtagttttgtgaaacaagctcttaaatctatagttttgtgataaattatgcaaaatacctgtagttttgtaaaatttactctaaataaattgtaaatcatgttgtatgcttgcatgagattaaatatataattattgctagtgggtgatgatgtggcatggttgcagttgagatttagatttagtgggctttaactttatagaaagtatagattaatagaaagaattagtaacaatatcccctgaggccctgactgcggttgatcaaccaaccattgcagatgctgttgcaatgaaaagcaataaaaagatggtgcttgctgaacctaagcacccagcatatttcactgtaaaggttgcaaatcaagaggcatctgccgttacttagaaatatagcgttaatgatatgattgtatctgtcgtaactgatagatagtttctttgatccacatgtaatatcgaagatatcataattttagtatataatgctgtggtatttcagatagacggttgctagttataaaaataattaaatgactgcacctagatttaataaatggttgcacctagatttgtagataaatgaattgtaattgtgttgtgcgcatagcaaaacaaaccataattttgttggtaccaaactgccaattttgaaaacataatttgctactgaaatgaaaaatattgggcatggacaggtccagaataaaacattcgttataatgcttatcataatgctcatttcactttgatagaaagcaagtcagggcatcagttgttacgtcttataacaggacatctcgagtagataattcctacgagtccacttcacaattgacaaagtgcactaaataaatagagggtcagtttccagtttatacattgggtcattggcacatatcttcataggccacacagccaccgccacatacaaaatggaagatcatgcaccagtaatccatctctgcaccttaccaataacagtcaaaagtctagatacctgcaagagaacaattccatcagtcattctggtataaatttacagtcacaaaattatatcgcattttttttggtgcaatgcaaaatgtaactattattttcagcgttgtgaaccatacatcaaatttccaaagttgaataattccagtattattactaggcaaaaacaaaaagaagaaacactgaacagacaatatagaggaacaattgaattattggaactgttctcgaattttggctacatcaaactagaaaaaaacgcatattaggaaaggacctaatattaaataaatagaaggggtgaggcttcgaaccaggtctgctagcccaccaccttgtggagctagttggaaaacgcgtgggcgtttctctctacatctaactagcaactaaaggggtacaagtacaacgacacttggcaggtagaaagtagaaacacctgtttctagttcatactccagtctacttttagaaattttaggacaaaccaattattactatattcaaattaaaagtcattggagaagcatagggacatcaaccattcatgatttactaccgtttatgattgtacactcaactctttctgatgtgtacctcaatatctcataagtggaacctcttttggtccacaaatatcatttatcttagcatggtaccaacacaaaccttaccaaattttcttaaaccataatttgctgccaatgaaaattttattactaaaaagtacaaaagtatgcacaatgaggatgcaagtgagggatctagttaatttcaccttgaaccagagctcccaatgagttctttactgtagttagttatctattttatagaagagtgaatttcactatggacccctttttattaccctagctgcacagtggaccatgtttagcaacctttccactttatgccacctaaacataccaaaatacagcaatttgattcgattccctagcctatttgtggagcctggaatctacttcgctcctcgtcggatcagcggaggatcgagttgcctgggcatgcaaatcagaggtgcagtttgctgctgacctctccgctcacagaagccactactgctctgacaaagcacactcattatccccttgtgctcacaagctagtgccatctaccatctcttactccttccatggatgggtcatgggccaaatagccatcgtagaatctcaagcaatacccctggttcaagactgctatgttttgtcaagtatgttaaaacttggatataccctggtccattgtgcagctttatgtcccatggaacgtggaacttgggtgtgttccttgttccgggaactttgttctagatcgagaaacgggaactatgtggaccttcgtcccgaaaatggatggaacttcgtcttgagagtcgtcctagtacaaggtatggagtaacaagtagagtggtctgatagagaaattaatgtggcacgatggaaaatgatggaaaggcaatccaaaattttcaagcaaaatctataatttgattaactttcactaaatttgaactcatctggatgggacgaacgctgttgttgctcactcgctgctcgccaacgttctgctgtgcatgtacgagcgtcagcaccatcatgcagtggagaatggacaagcattgccctcatcacgctgtggtacgaccatggagagatagagggacgttccaaacaacgtaggaacacgttccaactaacgttccatgcttttagaaaatgacgtcccacgttcctcgatccatcgatccgggaacttttgtgagttagtaatactgcagctagggtaataaaaatgtgtctaaagtgaaattcacttattttggaaatttagtggacatctgacaaatcataatcagacaaatacttctgtaatcacaaatcgccatccaaaacctgtgtaacacactagcacctaaaataataaaggctccagatatccaaaaaacacacatacaagataaatatatgtaaactgaataaaattctaaaaggaagcaatattcctccaaacagtatattcataaaccttgtaactagggggtgcataagttatctaaaattattctgtgcaagtaatcactagtatgtaaatggactagagtaatacatcctgaagctaacataatctagtaaaaaatagaacttcattgaccaatacaaaatatataaatagtgatttcttcttgtgcaaattaatacattgcttgcagcaggactaagaagaaaaaaaagtattccctttgttcttttgtagtgatactccagacattctacagtctctagacaagatagaacattagtttccttatattagagtcgacaactaaatactatattagtattttccaagacaaatctaactgtggttctcttctcagtggccaatctaaatagtaaatacttctacatctttcaatgttcaaaattaagaaaaaaagaatggaccacaacacaaggcttctaaaaggtcatctcgcagaaacaggtattgaatgaaaaaaaatagtgtcactctctgaaacgagccagtaaattacttatttgatatgtcggatgaattaatctgttctgcagtcaaatgctgaaaacacacctaattttactgcattgtaaaaacataagtacctgcaacataagtacttgcgtagggatgaagcgaggacataatattggtttcccaaagcttcctggactgcagtgaatcaatttgtagcatgaagacactggaatcagcacatagaagcatcaccttaacatcctcagcataacccaatctcactaaatgacttgtcttgaccccagagcccagttcaagaaccttgtttagctcagctgtcctctgcagcacccatctggtaacaccttcagaacagaccttcctctcccatatttgaaggctgtcgtacgacagagtgacaaggccaagataaccaccttctgccagaaagatctgagacatgtagtggctataacaatttggattggaaggccactcaatcacagcaagggtttgcctatccaaatcaaactgaagaatggcactgccaagaccagtggggaaccaatacagggaatggccaacgagtatgccaggatcaacaaaagcaaagaccaagaatggagcaggagtgaagatgagattgctccatctgccggtctccgatgtgtagaagcaagcgaacatttgtgtgttgttgctggccacgcccaccaaggcaacattgaaggggcaacagctgaatccgccgtgaacgtggccgtcgtcgtcggcggcggcacagagcgccgcctcgttccagacgatcttctccttgccgtctatctccggcggaatgcccacccggcggtggtcgccggtgtcggggtcccagaggacgatctcgttctgcttccggtccaggaggaggacgcggccatggcggcatccgcagaacatccgctctttgcggacctcgtcctcgccgagccgcatcgagaagcgctcccttgggatgagatcccgcggatccatcacggaccggaagaaggggaagccgaagtcgtcggcaaagacgccgatgatggggggattccggtggtggcgggggcggaagcggcggtggaaggcggggtcggtgacgaggcggcgccagcggttgcagacgagggaggcgcgggggagcgaggagggcagcggcgggaggcggaggaggatctcggcgaggaggtcgtcgtcgtccggcagggtcaccggcgccgccggtgaggtggcgcggccgcggcggtggcttatctcgccgctgaggccgcgtgcattgagattggagagtagtactactgtagagtgtggacagtggataggtggagaagaaaaccatgaaaattttgcaaaaccgaaattattttgttaaaactgttaaaccgattattttgaaaaccatactccctcgatcccaaaaagtttcaaatcctaattacaaaatcgtagccatgaccatgatggttagctacaggtaaactaacacgtgattactagaccagcacccagcatgcagaggtagcacatgtaggaccttctgtttctcctggtttctggtcttcttagctcgatcttgtcctttaatttatgatttctgaatcgtctaactttttggatttgataatttgtgaagatggatattaacgggaaaggaaaaaggcctcgttatctcaaagaggtagatttgggaatttttattagtctatttagaaccagatttgaaagatattggaaataattgattgattttttttctgtcttcaccttctctttgtcacctttagcttgaagccttaaaagcttgcctatgttgtctcgtaggtttggttccaacaaatattatttatgtgttagtaaccgattagtacatgatgattattagttatgtattagtaacaagtaaaacttttaatgaataatattttttaaagcaacttttcaatagaaaaaatatattattttgcagttaaaaacatgcaacaatatatcctccccggtcacaaaatggaaaccatgcccatacgtgttggccgttggacacttgaatcacgaccttgctattgtgtgaatgtctattgcgaaggcgtggaccgtggaaacacatccctacgagatctatttgcgtgcttatggcattcaagtagattagtgtgtacaattgctattatagttagatgagcacttacaccaaaaaattgttttttaaaaataatcttgttgtgcaaaaataaattttctttaaataaaaccttctactcaacggatttttcttaaatatttttcttaaattatgatagggaggtaggatggctgggggggaggcggaggaggatctcggagaggagatcgtcgtccggcagctgctccagcgaggtacggcggcgatggatcatctccgactcactcgtttggggggttttctcgtccagagaagcatatttgaggtttttcttgtgccagacaaagatcgttagcttacgtgcttttgcataattttcaaacgatagcttgtttagttgcacattaatttaaaaaaatcaggttatttttattattttgtttaaatgtgggatagtttcggaataaattcaataatattaacactaacacattaaatacacaaatgttgcaagattaataagatgggtcaagtagtcttgttgatgcaaactgctcactttgtatatgaggatgaatcaagactccccctgtctcctctttccgatggattaaaaagacttcctaggaaagctcaagttattctcaagcaacaagttgccattcagacattgtcgagaacacatttttcatgggctttaagaaactgtactcgctatttgtccagggagagcttatgttttattagggattgtttatatgcctaacttttttgcatttttaagtcaaattatttttctccagtgatgacccaaagacaacggtgatgaaaaggaccgattaggtgtgagggttgaggttggggtgggatagggggttgggatagtcgaaggcggggtctttgcgggcttagagtaatggcctaggagtcagcgatagggttagagcagtatagtaggtgaagttgatggtgggggcaagggaaatcaatttgtaaggaggtgtaagccgtcaaagatgaggaaggtggggggatttcatcaatgaggaagaagggcgagagtagttggctaggagatgggcatagcgcacgaaagccgacaggcctttctaacattatagaggcaccatgaagcacatcactagtggtggcgggatgctaagtagggaaaagggattgcatcggtagtggaattggggtgaggaagaagagggaggtagggttgggggagggggagtggtttggagacagcctgttcattcaaaaattgactgatatttttttctattttcagacctcggaactatagataatccctttcttattattaatatggatcctataaacttacatcttggtgctaactctttcttaaaaatagtcgcacctgataattccgcatctggttacttaataccatgagttggagtaaatttgttttcattctcccttgaaacaacagagcaatttaattcaatgtaagtaactttcctaaaaaaaacctatttctctcctaaaacaattttctatagaactaaacccctcaagtgtcctaaagtattgagaatgattgtttaggctgtgttcgccagtccatgttcccaatcggaatagtacgcgtggaaaacagagcggtctattagcccatgattaattaagtaatagctattttttaaaaatggattaatttattttttaagcaactttcatataaaaactttttgcaaaaaatctcaccgtttattggtttaaaaagcatgcgcgcagaaaacgagggagaggcattgggaaaagggtgtgccgaacacagccttacttattaatacttcagtcctaaatttttttctaacatttcaattctgtcataaattataaggaacaattttctcttagtctgtctttaatgcaaggcagcgcttttgctataggaaaaagagagcgtcacgttcttttatgtgctgttaggcttttgtactagaggtagcatatttgttggttcgcccaacacaacaattagaagcaatcatcggtcgatgtctatttggactttttggatgactagctatgcaaagatgtagtaccttcatccctaaatataaaattcaatccctaaatataaagaattttggtgggacatggcacatcctaacacaacgaatctagataaaagtacatccaaattcattgcattaaaatgtatcaaatctcactaaaatcccttatatttagggacggagggggtatgagaactgagattatggagatgtaataagctcgaattgctcatagtcatataaataggatggagtaaaccaattttgtagagtaatctcttaattaaggcattctaagtttatgctatcctgagatatgatggatttttttttttgtaattgagtttgtcaaagatacatcataatttgatatgctttcatgcaaatcgacaacatttatagaacatagatcatcgaaattctagtaagccaaagcaagctaaaagaggacatgtgcatgctccaaattccaccacccaaccaaccagttcttaaaaccatctgaagtgcaatttttcgacaaagagagttttattaatcttagacaattacatcaagaggatacaattattctaagaccaccctcgccctctgcatagctaggatgcacacagcctatcatctgaagtgcaatgccaaaatgtaaataaatcatactaaaaaaaggtggaactagcaacaacacaatctccatcatgttataaaacaatgggcaaaattacacgcagtactagtaaagtagaaacaccattgatatatagtatcatttaccaacaacaaagcatgaagttcctcaaacacgaggaaatgtgcaaaagatacatcaccagctccatcatagattaatattcatgggcaagcatgtgtcaaaattcaaaaggattcagttcagttcatgaggcaattactagctatacatacaacttacaaaagcataaatcgtcaactcatggccatcagcggtttgcccatatatacggcaagtaaccaaaccttcccatatgcccataaatacaactgaaatctggaaatgaagtggcaagccagcaaattcatttgtcactatcagtcacacaatttaacaaatttcacaaacatcagagttcaaagcctggatcaagctgtgatgataatgacgacttcaacgaaacaaataactgcatgtctgttctgggtttaaaacccataagaaacatgtgttcagctgcgcacatcagcctaattagtgctatgactgataactggcatgcatccagcaaatctatcccttgttcacgccaattctggttgaagttgtgctgccaagttttcaacagtgacgtatggggaaaaaaaactcaatgaagtcacaagtttacagcagaaaaaaaagcataataatgtatatagtaaatcactaaatatgcccaaactgaaaatgacccaaaaatttgttgcacaccaagcggcattgcaactacaatattgttagtcttgcacagcgatctaatgcaatgaaaactgggagtgtactctagaaacagtacgacttgccaatgcaccccctttggtgtacccatcccaatattatgatatactgcttcaaatataacatcgattaatacaaacaatatcccctgactgcagttgatcaaccaaccatgtccgatgctgttgcatccagcatatttcaatgcaagggttgcaaatcaagaggcatctgccgttactgagaaatctagtgttaatgatataatccactttatctgtcataatgctaagatagttttttcgatccaatgtagtatcaatgattcataactttagtatataatactgtggtatttcagatagacggttgctagttataaaaataaatgattgcacctagatttgcaaataaatgaattgtaattatgttgtgggcatatcaaatcaaaccataattttgttggtgccaattttgaaagcataatttgctactgaaatgaaaaatattggtcatggcctggtccagaatgaagcatttgtataatgcttatcctaatgttcagttcacttcaatagaaagcaagtcagggcatcagttgttatgtcttataccaggaaaccttgagtacataattcctacgagtccacttcacaattgacaagtggactaaataaatagagggtcagcttccagtttctacattgggtcattgacacatatcttcataggccacacagccaccaccaccacatacaaaatggaagatcatgcaccagcaatccatctctgcgccttaccaataaaagtcaaagtctagaactctagatacctgcaggagaacaattccatcagtcattctggtatttacagtcacaaaattatatcactttttttttgttgcaatgcaaactgcaactattattttcagcattgtgaaccacacatcaaatttccaaagttgaataatgtaagtattattaccaggaaaaaacaaaaagaagaaacagtgaacaacgatagaggaacaattgaattattggaactattctcgaagtttggctacatctatctagcaacaaaaggtttactacttcactgcctcattttggcagatgagaggcacaaccacacatagcaggtagaaagtagaaacacctgtttctagttcatatgtatacttttaaatatttaagaaccaatcagtaattactatgttcaaattaaaagttgtcagagaagcataaggacaccagccatgcatgattactattgtttgtgattgtatacgcaactcattctaatgcatatctcaatatctcataagtgaaacctcttttgctcgacaaatagcatttatcttagcatggcaccaaaacaaaccttaccagtttttcttaaacacacatacaggagatatcacaaatgtaaactgaataaaattctaaagagaagcaatattcctctaaaacatatgttataactatgggtgcacaagttatctaaaattattctgcagaactgaccgtgtgtatataaatggactagagtaatgcatcctcaaatctagtaaaaaataattagaacttcgttgacaaacagaatgttatattagaaaaaagataatacaaaaaatatatgtatatatttcttcctggtgcaaattaatacattgcttgcaggtgcaaattaatttcttcctggtgatgcttctgactttttaccctcttttgacaggactgaacattaatttatcaagtaaataaaaacaaaatactatgcagttattttccatgacaaatctaaatacttctacatcttccaatgttcaaaattcaaaaaaagttggaccgcaaagcttctaaaatgccatctcgcgcaaacaggtattgaatgaaaaaagaaacagtgttaccctctgaaatgagcgagcaaattacttatttgacatgccatatgattcaaattctgtgctttttatttcgtgtttatacaactacacctattaatctgttatgcagttaaatgctgaaaacataagtacctgcaacataagtacttgcgtagggatgaattggcgcgatgacacaactttcccaaactttcttggcctgcaacgtatcaagttggagcatgaagacactgtgatcagcccatagaaacatcaccttgatatcctgagcataccccagttttgttaaataccctatcttcaacctaaactccgggttaagaacattcttcagctcatacgtcttctgcagcacccacttggcaacacctccagaacagactttcctctcccacatttgaaggctgctgcgagacaaagtggcggcgccaagacaatcaccttctgtcagccaggtctgactgtatggctcggaatcgtagggccattcaatcacgctgagggtttgcttatccaaatcaaactgaagaacggtaagccaacgttcaccataagccatccaatacagggcattgccagcaagtatgccaggatcacgaaagaaaaacaccaagaatggagcagctaccgatatgagatcactccatttgccagactccgagcagtaaacgcaggcgaacatctgtgtgttgttgccggcgacgcctaccaacaccaccctgaaggggccgtcgtcggcggtggcagcagacagcactgccccattccaaatgatcttctccttgccgtcaatctccggcggaacggccacctggcggtggtcgccggtgtcggggacccacacaacgatctcattcttcgcccggttgaagaggaggaggcggccatggcggcagccgtagaagtgccactggccgccctcgtcctcggcgagccgcagcctgaagcactcccttgggatgagatccggcgggtccagaacggaccggaagaaggggtacccgaggtagtcctcgaagacgccgatgaggggtggtggattccggtggcgggcgcggaagcggcggtggaaggcggggtcggtgacgaggcggcgccagcgcttgcagacgagggaggcgcgggggagcgaggaggggcgcggcgggaggtggaggaggatctcggagaggaggtcgtcgtcgtccggcagggtcaccggcggcgccagtgagatggcgcggcgatggcggaggcggttcatctcgcacgcagcgttggggtttggctggggggcggcgggtcggggtaggcggacggctgtggggggaggtggagcggtggtggggaagagctggcatgccgggctggcggcggccagagccggcgccgacgaacggtggatggtgtggcaagagattattgatccgatggttttagatacatcaactagtgttccgatgtcattaaatccaaacgattaaatccaaacgattagataattaataaaacttttattgcaactagctaaaaccaacttgttgtaatccttataagccgatgcaacgttcagataactcattggctgaaattccgataaaacccttattgtcaatcaaaacgcaggctagagattatggttttaagcacaacttaggaggtcaaacccaattgatacagcactaagtatgaaaaaaaaatataatattagacaatcaagcctttgattgattttcagggtggtggatatcttagctaatctagattgacaaaaacaatttagccgatactggcaaaaccctagaaaagatctaaccgatataagtaaattgaataattgacttaaattaactaagatatatgataaataggtacgcaaatatatcaaccgaaccagagcgatccaaaagatcaaaatgaaccgccggcggaatgtaggacttaccccttcgccgaagatcgaactgaaccgatgcagcccgcgtcaggtgccaaactccgccagttgataagtaaaaacctcatgaaagaagatggtgatgcaccgagagtagttgttttgatcgagagatagattatagggaccctaggtcttatagataaaaggaaatatacaagtcctgatcggacactaaataaacacttcctaaagatagaacgaaattactaaatcttgccaaattaatagatagaattaagccgtcatgcgagagtcttcacgattccttcttgaactcggtctcttctggataagtttcagtcggttaattgttctcattccttaaccgaattagtaaagaatcttatcaaattttggggttaacaccccggccccgagaggggcggattcagccttgggcgcggcggagtctcgacaatgacagtgtctatactagagtggatttgagctagggttttgaagttttggcattttttttgtgatttttgttttggaccttcacactgtagtgcatgtacaccaatcatgcatcaaccctttctagatgctcgcatgtactaatcatgtatcaacctcatctaccagggttgattttccatgacaagccatggtaagaacggcttgccatattcgtacttttttggcatgtcctcggatgtccaatgttgcatccctttcatgcgaaaaaacatgaaggcctaggatatctgtttagctccagtgcatgacctaaactttgatgaggtatagacatgccagtcagtctgaacctgcaactgacaatatgtcgatgtagcagcgattagacgataagttgaacaatcagctgttagagaattggagacccggacgttgatgatgattgtaggctctagtctcaagtgtgccaaaagcgtgtaccgacccataaacgatagccgatggcttggtgtagaatcggctgaaggatccgatgtagtcgttgaggctagccgatgttgatgggactctgaatgatcaactgcaagcttgttgtagaattggatcggccggaagtccgatagaaatagactcaaatagttagataaacaatgaagccgttgctaccaatcttgtatataatccttataagtcgatgcaaccatatctagataactcatcggttgaaactccgatgaaacaatgattgatgcctactgacttaactaaaatttacttacaaccacaaccccataggtcaaacataaccgatgcagcataaggttgataattgcctgatatatttaagcaaaccgatatgacaccgatcaaagtggtcatgtattaaatttaactaagacagtaaaaccatcaacggagaaatttaagacacctgataagatcagctaacactctgataaaacattagcatgaacctactggcttaacaagacttagattatcaacaacagtctatgggttggatataactgatgcagcacgatatataataatctaatactcaatgaaccgataaatttatctaatgtgatggatataacgaatctatctaaaacaacattgtgattgtagagatatattgactaagtcagaagatcagacctaaccgagacagtcccaactaaactgatgcttctctaaatataatgcaattaaagatagaattaagatatcatgtagacaaagataccgactaaagcagagaaatccaagaggtcaaagggatgcagccttgaacaacaccaatgtagccagtacaattgacaaggccgacataacatagtacttaccccttcgtcgaagatcaaaaaccgatgcagccccgcgttaggtgccaagttccaccggtaataaataaaaaccttgaaaatgagggtggcgatgcgccaagagtagttatattgatctgtgagatatattacataaaccctgggtatatatatttatactcataggctgataagagtccaagtaagacacgatataaaatttcctgaagataaaaagaaaaacatatgtcctgatcggagatgacacaaactttcctaaatacaaaacttgcctaattaataaataaactcaaactgtcatgccctggtcttcatgactcctcgaacccggtcttttctggataagcttttcatcggctaattgtgatctttccttaattgaatccactaaagaatcttatcaaaatttgacgttaacgggaatcaggcacgcgtcacgaatgactcgcaaggcgcaagggcgctccggattcagaatcacatgcggttggacaggtgacgctatgaagtgggtaggcgcccgcaaggtagtaattgaatcggacgataacgtaatcatggcgcccgatataccactcatgtacttggacaccgatattgtatcggaatagggtgacataccaaaattttgggcagaaacatctttaatttttacaataactaaaaaaaagcccatacattgcaacaggtaaaaacgttttttcagtggtacaaccgctattaggaactaacgttaggatcactgcatatatacattataattgaaaacgttaataaaaattgttccatggtttgggccgaaagcctattctttctttccttttccatcccaacccaatccgctacctctgtctgcttgatctgactctcttcgatccagcccacaagtggagctacaagtccagctcacacagccgactgccctgacttaggtggagctataggcccagctagcatattcaactgccgtctccaacctccagatagtcatgtgcttgtatgccggagccgatcctctccatcaaatccagccgaatcttttttatatctcaaaattagttgagggcttttgttccactcgatctcctctttccatttttcctgaaatcgaaacgaatccgtaaaattcggaataaaaaggtcggtcggctatcatcggcaactaagactaaatctactgaattaaagccaaattgaaaggaaaattatgagaaaaaataatgagggaggagtggggaatcgatttttgcaatgtagagactgtcgacgtttgatgtcgcgattccggtatttgcatagtatggggatcgtcggtgctaggatatatgcgagactgaggtaaaagagacagagacagggatttttacatatgttcgggcccctgaattgtcaagtaataaccctacatcctattggccggagccggtgttgctcttattcactataaatcacaccagtacaatatttgggcagcctatctaactgttgtcaatatggcggtttaaaggtctgactcgtagtcgacaatagggtagtcttcctcctcgaatccgtgcccggcgagatcagagatagcgctttcgtctctcctgacagtatccggagacaccgtaggggactagccgtgcttatccctgaagtcgatatccggcgtcttgtcttggcgtatgttggcttgtatgttgttccgtagattgtggtgggtgttgattgtggtgatcttgtcccctctcctcctagggggccttgtatttatacccataggtgtccccttgtccaagtagaactagggaaacctatatggatacaatccgagtagtccttgtcgtttccatgtagaactctggttgtctttccttattcggaacttcatccatatctgaggtcggtttccgtataagacatgatacgtggtgtgtcctgccgagatgtagtcgactgctattaggtatgtggtatccataaccctgacagtagcccccgacttcaatgcaaatgaacaaattcatattctcaaccgctgaccatggagtaactgttatcgagctcaagtgaccgttcttggtgagttcggagataacgttagacttcctttatcagcctcgtgcgggcacctaaagggtttgtctgagtcaatctctgacgtcaaccaagaaagtacagagcatacgactaggtctcccgtcttgctgtaatcgagaatttggattgaagtcaagaaattttatctcggcggatacaccatctcttcattccgtattccttgtcgagatccaccaactgttctcgagcgatcgagaaggcgtagaatctgcgacgaagccttgtcaacattggtcgtactcgccttagtcgatcttggtgtagaaccatagagacatagagtcttcgtcaatgtcgaatagaattttcctgaaatcaatactcagaaaagaatattagatagaaatagcccccgagcgagcgctcaaagggtgacatgttataatatgtatgaaaaactgaaaatgagttaaatttatagaccaatgttttgtatatgagcgtcttctctcttaccgacttcgatcagtcagtttgttgagtcatacactctcccttgaccctaagaggagaaggctcttggacccttgacctgccttggttgaacaagcactgatcctagcccccagccgtgaagttggaaaactcaatttccgattacacggcttggttaatacgcgcggcgagaactcttacacgaccagatcttacatggtcttttgtctctacaggatccgacaaggccttatcggctctgggcgtcactagccgaagttcctcgaaggccttgtcaagacggcgtaaagggacagtaggataggtttcaacgctaggtgtcgtcgtggtaagggatctctgggtaaaacacttggcgatattgtgtacctgatatcaactttgttgaggtagaggtagtgggagaatcgctacacttttggtcgaggaccaggtagtagtcccaactcgaccacttgaagtaaaggtagtgggagaatccctacaccactggtcgaggaccaggtagtagtcgtaattcgaccacttgaagtggaaatagtgggagaatcgctacaccgctggtcgaggaccaggtagtagtcgtaactcgaccactagaagtaaatgtacgagagatcactacaattaactggttaagaaccagtgagtaggtgtctctcgatcattttgagtcgtggtacgaggaccgctacgctgccggtcgaagaccagtcgtagctgttcctcaaccatctgaagtcatggtgcaaggaccgctacgctgccggtcgaagaccagtcgtagctattcctcaaccatccgaagtcatggtgcgaggaccgctacgctattgctgtagttgtacctcaaccatatgaagttaaggtgcgagagattgctacgttttactagttcgagaaccagcgagcaagtagaattatctctcgaacaccaatggaagtttgcggtgcgagagattgctacgtactggttcgagaaccagcgagcggggcagaattatctctcgaacaccaatggaagtttgcggtgcaagagattgctacatactggtttgagaaccagggagcgagtagaattatctctcgaacaccaatggaagttgcggtgcgagagattgctacgtactggttcgagaacaagcgagcgagcagaattatctctcgaacaccaatcgaagtttacggtgcgagagattgctacgtactggttcgagaaccagcgagcgagcagaattatctctcgaacaccaatcgaagtttgcggtgcgagagattgctacgtactagttcgagaaccagcgagtgagcagaattatctgtcgaacaccaatggaagttgcggtgcgagagattgctacgtactggtttgagaaccagcgagcgagtagaattatctctcgaacaccaatggaagtttgtggtgcgagagattgctacgtactggtttgagaatgtcacgcccagaaattcactagtaatttccgaactaatttgtgtattaaaatcctcgtccaggaatcagccgaggtacacaaactgacaatttaatatacagattcatcataatgcgataaatacttacatgagaggcactttagtcctcagcacgaagaaaactgcagcgaaaaataaaatctagcgaagctctggcttcactcccacaggcagctcaactggggtataagccaaacgtcttctccttcgcaacttgtcttcaactgaggtttgattgattattgcaaggtgagtatatggaatactccgcaagccacatagcaaatatgcaagtgcacaaggataccaaagaatggcataatatagggcttatttgcaaaagaagcatttagcaaacaattgagaattgtaaaatagtggagtaattaatcatcaatattaatcaacactgaacagcacacccatgctgcacaagcccaaccatcctgaacaaccatacccggctgtacagatctatctccaaaccaggaatgtaccattccaaaccaggagctaatcaaattaccatcaattatcacgttattattaataagtagtgtgggactaatcacgaaagacattgttagacccgcccataaccgcaggcacggctattcgaatagttttactctggccagaggtgtaccactgtacccataagatacaacccaccgtcatgtcaccgtgtccgcgcagacacgtcaccatggcgagtgattgtgacaagacccctcgcataactcaactcaaagcagtgcaccattcccggatcatagtcaccccctcaaaaaccagaggcatggactccctagcgacccccatgggcttatctccaccacttctcagtctggtgctccgcagtgagccttgttatacaaagtgtccagccgttgcccattctggcttatggttggcacggtaaatgtttcacaatcgaaaatcgtgaacaggtccttaattgtcatgagcactaccatcaaaaccatgtgctcacaacccaccattatcaaattttagttggcacattaattaatcaaccaatcacgattgaccatcgtgagctatcattaagccatcattaaataacagtgaagcattagttatcccaattgtgtgctaatgtttctaagcatggctaagcaattatgtctaacatctagctgaaccaatatataaagctcaactagtcaaattataataacctaaggtatcaaggaatagagtaatcaatgcaaacaggccattacaaaggaataagttcacaccacccggtggcattcgaaaataaatgcacagttgaaataaatagagaatttaaatataggatcaacatgcttaaaggaattgtgtttgggatctgtgtgacttgccttgcaataacgggtcttcaattaatcttcttgaacacttccggcgcactcgcgaaccttcgaaacgacggaaacgacaagctaacacgcaaaacaaggaaaaagactaataaaaaccaaataaacaatacatataaagtaaacaaacatgtagatcataattttagatgaattatgagacttgaacggcctcattctgacttcatatgaatttattacgaattttactagattaaatctaattaaagcctatttaaaaaggattaaataaatttaattcaatttatggataattttaatatgtggatctttattttatacaacttttgcaacttgaaccacattaaactgagttacagagaattagttatgaattttcaaagattaaattggattaaatcctttatatagattttaattgaattatgacgcaataatgaattatttttgaaaaggaaaagggatttattgcgtcagcggactcggctcatggtggaccgggtgcacggcggcggtctacggaaacaaacggccgagatctatcctatctaaaacggacggccaagacctaaacgatccaccgcggtccacggggaacggcatcgatgacgtcatcaccagcggcgactcggcctcgcacgctcgccggcgaacgacggcgcggcggcacaaatgaagagcatctacgcgatgcgggcgacgcggcgatccttaccgaggcacgaacggctgcggacggtgaccggacgacgacggcgacgaggatgagcggcgacgaagatcgggtcgacgacgacggcgatgttccggcagtcctcggcgttgacggaggggtggacgaggtcggcggcaactcggcgaacacggcggtggtcttcccaagcgacgacgatgaccggagcgacggcggcgcaaggctggacttgcggcggcgatggcccacggcgaccggcgatgggaaggaaagattagggttcggggagagagacgaatccgattcgagatcgaatccacggatttccaaacgattttagtcgacgattccaaaagagaaaaggtagaggagatctcggggatcattttccctctatcaattcggccagaggaggaaggaagcggccgaatttggaaggggatcggcggctgcacggcaaggctagggcacggctgcggcgactggaggaggaagacgacctgacaggtgggccccacctgtcagcggcgagggctcgcgcgtgggcggctcggctggcgggctgactgggccggggagagagagagagagctttttgggccgactttcggcccaaagccaaaagaagaattttaaaaactttttcaatttaaattattcgtgaaatgcaattccatttattaaaaatacttccttggctcaaataaatcccagaaaaatctaggaactatagaaacaagagaagtatttaacaaaattttatctagcccacttttatgttgagatttaacaaattaaaattagatcttctcttttaggattttaagatcatttctaataattccttttacacaacaatttataatttaaggatttttaaatgagaaaagcacttaacataattataattagatcattaattgattaactaattactgaattgttctttgtatcaattaggaattgagctctgaaaaatccgagaaaatttcagagagtatacttaatcatagagaatttaataaaaattaaattcatccatgctttatatttaggaaattttatttcccacatttaacttcacctgtaaattaatgaacatttaatataaattctattaataatttatt

SEQ ID NO: 62251 - DNA, 3429 bp, Oryza sativa
gggcggaattatctcttgaacaccaatggaagtttgcggtgcgagagattgctacgtactggttcgggaaccagtgagcgagtagaattatctctcgaacaccaatggaagtctgcggtgcgagagattgctacgtactggttcgagaaccagcgagcgagtagaattatctctcgaacatcaatgaaagcgctagagttggtttattacatgtgcatctcatgtggccagcatgactcacatacccaacttatagcatatccggaagtccgttcgcaatcatgtcgggtgatcaagccgacgccgttcgcgaggaattatccgttaacaaccttttctcgagtagtccagccatggccggtgctatgagataagtcgtcaatcttcgttggtaggttggacgcgacgactctgtatttgtcgagatcgttctcgataatgcggtgtagtcgaccacaacctactcgagtgctcaattattcctgaaaaatattttctagaaggcaagacatatagcagagaatatcgagtatgtactaaaaaactgcatggatcttctagcattatcaggatataacgagcagatgtaattatcaggcattatgtaaaccgtaaacaagcatgatttatacagaagaaaacagagcgagtccccaatgttagaccgtagtcagtttaacatcgggaacacttgcacaacagatattgtataaaaaacatgctctaggtaaacataataaattactgatctgacaatattgtatgaatctagaaaacaggtacgataaaaaatattgcgtacctttgtagatacatgccggatgtatatacggaattagtagattaatttaaaataattaatctgctaattacctttgttcatgtgttaattggtctgacacatgcgacatgtgtgtagacgtgtcaaggagctgtccagtagttttgctcctggttcatggttgcgtaacctagtcggtttcctttaggcttcggtacagcatatcccgtcgtgtccgacaactcgttggactcggtcggcgcctcggccgcggtatgtgtttatatgtaaaccaaaaggaaccaacaaaaagcacataagcagtactaaaagacaaaaccgatataattatgattagaatcagatttagaacggttaacctgttaacgatggatttcaagatttcggcggtggacgtcggctcggatgtggttggaacggagcaagatctcgtggctgacgacgctgaaccgatgtcctccgcggtatctcccaaagctgaagtcgagagtttcttgtcgggaaatccatctcttaaacccatctcatcaaaatcttgaagcaccaaaatcctcctacctggcgtgccattgttgacgtttgatgtcgcgattctggtatttgcatagtatggggatcgtcggtactaggatatatgcgagattgaggtaaaagagacagagatagggatttttatacaggttcgggcccctgaattgtcagttaataaccctacatcctgttggccggagccggtgttgctcttattcactataatcacaccagtacaatatttggacagcctatctaactgttgtcaacatggcggtctgaaggtctgactcgtagtcgacaacagggtagtcttcctcctcgaatccgtgcccggcgagatcaaagatagcgctttcgtctctcctgacagtatctagagataccgtaggggactagtcgtgcttatccctgaagtcgatatccggcgtcttgtcttggcgtatgttggcttgtatgttgttccgtagattgtggtgggtgttgattgtggtgatcttgtcccctctcctcctaggggtcttgtatttatacccatatgtaggaatgaaaacggatcaaatacggtcggaaactagctttatcatattcgttttcatattttttctcggaatcaaaatcggaatcggaaacccggatacgaaaacagaatcaaaaattatcgaatacagatacggagcgaatacaaatcgaaacgaatacggtaacgaatattaatcggaacataaaagtccctcaaactgaccttcacaaatcaatgaagaaatataactcgttactttttctaatagaacatatcaacattttcaaattttagtgttaataattttgttatatccgattttgtggttgaggaagatgattcaatctaagagtaagacattatgaggcaaaatcatgtcaataaattggatgattgtttttttctaaatatttctaaaatcatgttctatcgagttattgtgttcttactgcaactagtttttgataaccttttcacatgagttcatttagtatcataaaatttaattcaaagttgagggacatcatatagacttaatagctaattcttaggcccgttggcccagggatatataaacctatccctagtttctcccgcctcccaatctcccacacctcccaatctcctctcagccgccgcccttcctcccgggctcccggctcccgcgagacgccaccacgggggcggggcccgcgtgtggcggacggcgacggcgacggcgacgacgggggctgggccgcgtgcggcgaatggcgacggcgacatcgggggcggtgccgcgtagggcggatggcgacggcggttgctcggcggcgcgaggcgacgacttgcggcttgcggcgacgagcgtaaccggccgcgccgccgtcggggcggccgggtcacggcgacggccagcgcgaggcgacgtcgtgtgggtgcggcggacggcaacgccggcctcggggcggccggatccggggttggcggccctggagccgcgggatccgacgtcgtgaggcgacgacgacggagggggctcggcggcgcgaggggacggcgtgcggcggacggcgacgagcggatccggcgtgcgacgtgcgacggcaacggcgggaactcggcggcgcgaagcgacggcgtgcggcggacggcgacgagcttttttcaatgttttaatttggatttttctgtttattatgattcggatatccggcaaaaacggtcggatagtttccgaccgaatccgagttctgacggataccatcgctactgtatttgaattcgtatccgagaaaaactatccgaattcgtatccgaatccgaaaatatctgaaaaaatccgaccgcaacaatccgcatccgaaaaacaggatcggaactcggaaattatccgtaccacttttatccctacccataggtgtccccttgtccaagtagaactagggaaacctatatggatataatctgagtagtccttgtcgtttccatgtagaactctagttgtctttccttattcggaactccatccatatctgaggtcggtttccgtataagacatggtatgtggtgtgttctgccgagatgtagtcaa

SEQ ID NO: 62252 - DNA, 6183 bp, Oryza sativa
ccggatggaaaaaaacagcgaaaaaagcggcaacaacaaaaaaaaaaacggagcaaaagaaatctgatgaaaaaaagcggaaaaaaccgaatcgaaaaaaaaaacagcgaaaagaaggagacgatagaaaagataaatataaaattagaaattaactcaaacacggatggcgtaccaaaatcccgacggaaatatctttaatttttataatagtaaagaagagatagagatagagatagagataaagataaagataaatataaagatttttgatttccaggatcgtaagattagatttatctgatttcctatttttaaggtcgttagattatatttgtgatttttatttttagagtcggtatgtcaggtgggacttaaaaaacactataaaaatattttttaagtaggtaaagttacggagaaatatatgagcctaactcaaattagcccccacaggagatatgccaacaaatgcatgcggaagtcagggcaaggctcgtgcgttctcattaggatgacctacttccaccaagtttctttgcatgaaggcagctgcagaagcgacccagcaaccacccaaatctccatacggtatggtcgatctcgatcatgcatgttgaagaagaccaacgatgaccggagtagtagctgactgccctgactctgcttgatttgctatgccacctacggtttggaagattcagagaaatatcccttttacttgtacatgtactaataattgtcgacatgcaaatgcaagtggttgctgttcgtttgtggcacaaacaaagttgttgaggtattattgaaatcaatatttgctataggatatactccctccgttcctaaaatactattattttaactagtcgaaggcaaaataaataaaattgtaaaagattactatgcccttcattagattttattagataatggaaatggattacatctccgacttctatcataagacacataaccataagtttgtttaatataaaataaatcaaaatgagaaataagatgatgggacaaatccccaactcccctttattattgatagattttttagctagcaattctaatgaaactagaccacacatagtgatagtgaagtaagagacccttgactaccgattacaagagtgtaataccgatgtatattatcatgttcttcctcgtgtgatagcatcgtaaactaaaagtaaagtcaataagaatatatgaagataacccgcgtagggttagataattgtttatcattatggcaacatcaaattgaccaagatacaacactagcttcaattagaataatatttttaatggatctagatacctctctaagccaattaccaaaaatatttttgatgttacggggtggagggatattaaaagaaaaaaacacacatctcaaaacaaactgagcaacgtaacattaaaaaaaagatgttggattgtctcttgtccataacagacagaatagtgtttgcctccttctattttcttttatccagtttatatctttcgttagaattactttctttagtggaacgtacatatcgataatgagccgtctttgatgattttgtaagtctcaagatatgccggctgagcttttagagatgctcgtaagggtatgacgtgtgttagtaaggattagtgtgcatacggttagacgagcatttgtgtctgtgtttgtactgtgtttcatcgaaaaaaaaaagagaaagggataaaacaaagagggagtatggcgtgtgttcgtacaggttagcgtgctgtttatatgagcgttgtattgttttggggaaaaatataagcagagggggataaaacaataaggagtactactgattaagtggttaattaaaggaaagagtatgaattaccccctaacaatcgcaacaatacgaattaccctcgtaaatcacaaaaccagacatttgacaccccaaactattgaaaccggataaattactcccttggctaaatctgaagtggttttggtgctatgtggcatacacgtgatgttaatctggcaatccaataaaaaataataataataactatgggcccatttctcatatactcctacctcacccctttctcttctctctctgatgctgggggcgcggcatgcagggcgagcggtggccggagggcactgtggacgtggagcaccggtgttggtgcccgcgtctgtggtgggtgcagtggcggtgttgcggggagatatggaggtgcgccagaggcggacgatggtgaggaaggccgccaccgttgttcccccattcccctatccgtctcttatgactccctcccctttcttgcagtgcggcggtggcggtggtttgggcggaaaacgccacgggcaggaaggtcgccaccgttgccgccacctttgcacgggggcgagctctcggccactgggggcgtggtgatcgtggaaggaggaaggggaatgggcgaggaggcagacacgcgaacgggatcgtgctggcgtgctacaccgcggtcctcgacgagccaggcgcgcccccgcgcgacaccagttctgcttccgccgccgcctgcctggtccgcctccgccactacagtcggccgcccaagcgtgtgcgagagagagaaagagcgaccggggaaagattgggttgagggagaagaatggcaagtgggcttggagagttttatttgtttttttactgactggattgccacgttggcaccacgtgtgcaagctcaagttgaaaccactcaaaatagtgttaaggggggttatttgtccggtatgaatagttgaggatgtaaaatgtctggtattttagtttggggtgtaattgggtcaaccacaataatttgatggggggaaataattcgtatttttttccttcattaaaagagaagaaaagggtaagcagtagcaagaggttcggcagacctcactctaaaaatagtctttgtgaaacaaaacttgaagctgaaacgacagtctctagggtacagaggaagagtaactaattaacatctagtactaataatttagctgtccccactccccactagctagttccttcttgcacatttccattccaccaaaccaacttccagacaaagatggatcgattattggttgaagctcagaggaggctacgcttgctttatacaagtgctggagctgctattgcattttgagcatcgagcagccgcggtaccccaattctcgggcctcaccaaacgcagaaaacacacattatatactgcattcgtgtcagtaatacaatggcaaagaacctgtcaatctccgttcagctgcttctcgtcctcttcgttttactcgcttttgccagcggcatcctcgcacaaggtggaccaagcacctgcacggacaatcgtaagctaccactgctgctatttctttacttctttttttctaaatagacgaaagaaggtttaatttgctgcataaattacgatcttaatttcgcctttctagctaattaaagttctttgctcgtcatttctggcagctgtgcagcaagattgcccgccaatccctggtagagggaactaataattaattaatgttgccaccggatccatgcatggatggacgatgcggagaaatatataattgatcacgtgccatatagtagtatttctacgcagcaagtttactacggagtactttctcagtcaataaaacccatttctggatttgaatatagatatagtgttgatgtgtttttgccgtgcgttgcttgtaatgatttgctttaccaatataaataatataacggacagtataactgcccgaggagatattgtatccggtaataagtaaatgtatattcaccatctggtgtccaacaccgccaagttatatattcactgtggggaagagctctttagtcctggtttgtaacctcttttagtcatgggttacaaaccgggacacccaatccaggactaaagatgataacgctaccatccttagtcccggtgttaccaactgaaactaatttttttttcttttttctattgttttttttctacttgcatctatttatttcaagcaccaatgctgtcacccccaattcctgacaaatcatccacaacaaatcatccaccataggtccatccccaaaataatccgcgttccacaagtcattcaaaaaatcatccctaaatctaaaaatatctacaacaaaatttacaaatcattcacaaaatctaacaaaaatctagaaagccacagccgccggcgggcgcctggccatgcgccgcctcccatcccgccgccgcggctgcttccgccacctggcggcctcccctcccgccggatctggtggaggggagagccgccgcccgccgtcgctatcgtcgaaggaggggggagggggtggagaggggaaggggaggagggggaggatgaggatgagaaaatgagaggggaggaggagaggatgagcagataaggacgaggcgcgtggctcggtgcatagctcggggcaactgttcatggttttttttaattttggtcccggttggtataaataactgggactaaagataatagggtctgacatgtttttcaaccaggattaaaaatgataagtaccctaggttactactcgaatcaggactaatgtgatttttgcatgaccaagcaaatatcacttctccagtagtgatttcatcctactcaatgtcacgatgcactttctgaaatgaccatggatcataattggatcaacttactttgtaccgggctctttctagtgcccacgtactgtctctagatagcgtcttgccatcaagtgcttttgtcggtgcacggtttaggaggaagactgtcgtaatcacaggctcaccctacaacttcataggcaagtcgtgttcggttcagcagctggctatgcaccatcgccacgatgctctggtctcacttctcaacgatgttgtttactccctgttggaggcatgccatgaagcctttcggccggacctgccgaaaccatagtaccagcagggattcaagccaaagacgtcaagaccattcgggcgaagccctatggcgaaagccataagcgaagctggcgaaggctggaaagccgcatcggtactccgcaagtaaaggcatctcgggcgaagggcatacggtgaactacaaatacttcgccatgacgagttcggcattaaggaggcccagcaggctgcccccgacctttaaggccccttcgccatagaccaggcccagcctatcggcccattaaaggcccatatatgcaaatgacaccgtgtacccatataaatatccctttcataagggcaaccatgtaaaatcccctgtaaacctaaaccctaggaggtgtaagcctgtgctaaggttataaatagacccctagggccatgtaatgggggatcccaataaattttataaatcaatacacttattgcttttccaacactgttgagcaaccacgtccttcgacgtgacgcagttgtccattcgacaacagctggcgccgtccgtggggaacccagactaaaaggctgaaatgggagccttttgccacacccacacccttcgccatgttaccaataaggtacgacgtcaagggctgtgggcgaacaggttttgccacacctaggcccttcgccgcaataccaataaggtaaggcgtcaagggctgggggcgaataggttccgccatacccagacccttcgccacagtaccagtaaggtatggcgtcaagggctgcgggcgaagagatttcgccacacgtcacacccttcaccacaataccaataaggtacggcgtcaagggctgggggcgaataggttccgccacacccagacccttcgccacaataccaataaggtgcggcgtcaagggctgcggatgaacaggtttcgcccgcccacgcccttcgccatagtgctaataaggtacgacgtcaagggctgggggtgaataggtttttccatacccaagcccttcgccacagtaccaatgaggtacggcgccaagggcttggggcgaaaatgagtcaggaccagagacgaaaataggggccgcgaagccaaactagcctgtggacacctttcgccacaataccaataaggtacggcgtcaagggctgcgggcgaagaggtttcgccacacgccacgcccttcgccata

SEQ ID NO: 62253 - DNA, 22010 bp, Oryza sativa
  unsure (1)..(22010): unsure at all n locations
acacgccacgcccttcgccatagtaccaataaggcacgtcatcaaaggctgcgggtgaacaggtttcgtccgtgacgcccttcgccatagtgccaataaggcacagcgtcaagggttgcgggcgataggtttcgcccgcccacgcctttcgccatagtgccaataaggcacgatgtcaagggctgcaggcgaataggtttcgcccacccacgcccttcgccatagtaccaataaggtacggcgtcaagggctacgggcgaagaggtttcgcgacacctaggcccttcgccacaataccaataaggcacggcgtcaagggctgcgggcgactaggtttcgccacacgccacgcccttcgccacaataccaataaggtacggcgacaagggctgggggcgaataggttccaccacacacagacccttcgccgcaataccattaaggtgcggcatcaagggctgcgggcgaacaggtttcgcccgcccaagcccttcgccatagtgccaataaggtacagcgtcaagggctgggggtgaatacgtttcgtcacacccaggcccttcgccacagtaccaatgaggtacggcgccaagggctgggggcgaaaatgagtaggaccagaggcgaaaataagggctgtgtaacaccctgaaaattcccgacaacaaaaaaaaatcactaaaattttgaacttttataacttgtgcatcatgctggttgttatggttgatattgcttgccaaaatgtaaataatcacaaagaaagcaaatccaaacaaagggacggttaattactaatttaatttgtagatcaaatattaaatattcgaaccatgctgatagcttgatgccatgattaactaaaagaaacagtaaattcaaatctaattcatttggatccattctcacatgaaatataagaacacatgaaatgatgatcaccactataatgatcgttttttataaataagtaattcaccagaatatatagattgatacttagaacacttcaccaagttcctgatgacatgaaaatcactcatataaaataatggtcatataaataaattaagctttatatataaacaagaatatgtgaatgtttaattaaacaattagattaatgttgtatcgagtctcaaattatatttatagaatgactagatccacgtaaaatacattgttatacaaataagttcattcaatgtgctattgtaataataatagccacattaggatattttaattaattttagaaccctcaaagcctccaaaattatctaggttaattttggaattagacctcatctaaataatgcaataggaatatatatatatatatatggataatattaaacattgagtaaactttcatctaaattaacagttgagtgacctggctcataacagttgaaacatacctgctgctcccttccactactgttatcttcttgaggctggttctgctgaactggcactgattgagtagcttgctcaatgttaacttcattgcttgcattagtctctgaattgatctcacaactgatgttcaactgttgcgactgtccttgacctgcagaagaagattcacccatttggagtggcttgatacgctgcctctgcctcctggaaaacagtcattcttctcttacggttgtccatcctgttcttcttgtcttcaagtcgaattgctttgtcaaccaactgctgaaaatcagaatagtcatgagagatcaacttaactgacagttcatcctttagaccttccaagaacttctcctgcctttccttgtcagtacgcacatcttctagagcataacgtgctagacggttgaactcatgaagatactctgtcacggtatgatccttttgcttcaatgtcctgaactcacgtttcttcaaagtaaccactcctgcaggtatgtgtgtcttcctgaatccttcgatgaactcttcccaagtgattggttgtccttttgctctgttcatccgaaagtgatcccaccattctgaagctggtccttgcaactgatgtgaagtgaaaacaactttctcctggtttgtgcactggagcaataccaacttcttctcaataatgtgtagccaatcaccagcttccactgggttggtagtgctagaaaaggtaggcggcctcacacgaagaaaattagctaacttgttttgaggcggcggaggattgacattattgttcccttgctggttctgcacttgttgcactaacatgttgatcaattgggtctgttgagccagcacttgagcaagggttgggttctcttcattgttattgttttcgcttctactggcgcgagtgttcaccatttgttgcatattagagaagatagaaggagaggggttacactagagttaagaccttaaccaggttaccactgatctggtgtgtgtagaccattatattgttcaagttgattaagcaagcaaccttgtatagttacacgctcatcattgaaccacaccaatgacgagaatgcaaccatacctacacacaagcaagcaacaaacattctaccctactaactattcttccacgacagtttggcggcgtaggttctaaggtaggatgcaaacttcattccatcttgacatctgggcactttagatcgaccattaccttcttattcgtcgatccacttgacttaacctccataagtagaccacattggcgtcttcaagtttcaacaactagtttcagaactactcaagttgaaagagagaggggagtagacaatgaaacaatttgcaaagaattctagataaggaagaaaggagaaattttcacaaatcatgtttttgggaaattagtccttaaggtttgaccatttggcttatcctacagtcgagatggctctgataccaacttgtcacgcccagaaattcactagtaatttctgaacttatttgtgcattaaatcctcgtctaggaatcagccgaggtacacaaactgacaatttaatatacagattcatcataataataacgttacatacttacaaaataaaagaaaaacagcagtggaattacggtctagcgaagctccggctccactcccacaggcagctcaactggggtataagacaaacgtcttctccttcgcaacttgtcttcaactgaggtttgattgattattgcaaggtgagcatatgacatactcagcaagccacacagcaaatatgcaagtgcacaaggataccaaagaatggcataatatatggctcatttgcaaaagcagcatttagcaaacatttgggaattataaaacagtagagtaattaatcatcaattttaatcaacactgaacagcacacccatgctgctcaggcccaaccatcctgaacaaccatacccggctgcacagatctatctccaaaccaggaatgtaccattccaaaccaggagctaatcaaattattaccagttatagcatcatttattatggtgagaagtgtgagactaatcacgaaagacattgttagacccgcccataaccgcgggcacggctattcgaatagttttactctggccagaggtgtaccactgtacccacaagacacgattccacacatgttaccatgccctgaagtaccaccacggcactgcagtggtggtggaaatcgcgacagtacccttcgcacaacacaactcaaagcagtgcaccattcctagatcataatcacccccttataaaacaaggcatggactccccagcgacccccgtgggcttatctccgccacttctcagtctggtgctccgcaatgaaccatgctatataaaagataaagccgttgcccatgctggcttgtggttggcacggttaatgtttcacaaccgaaactcgtgaaccggtccttaattgtcatgagcacgaccatcaaaaccatgtgctcacaacccaccattatcaagttttaattggcaagtaattaattaaccaatcacgattgaccatcgtgagcttccattaaatatccataagtgatagtgaaacatgatttatcccattagtgagctattgtttctaagcatggctaagcatctattataagcatctgtgtgacttgccttgcaataatcggtcttcaattaatcttcttgaatacttccggcgcacacgcgaacctttgcaacgacggaaacgacaagctaacacgcaaaatgaggaaaacacagagaaactccaaataaacagtacataaaagtaaacaaacatgtagatcatgattttagatgaatttagagacttgaacggtctcattccgatttcctatgaattaaatacgaattttacaagatttaatctaattaaagcccatttaaaaaaaattaaataaatttaattcaatttatggataattttaatatatggatctttattttatacaacttttgcaacttgaaccacattaaactgagttacagagaattagttatgaattttcaaagattaaatcggattaaatcctttatatagattttaattgaattatgacgcaataatgaattatttttgaaaaggaaaagaggattattgcgtcagcggctcgggttcacggtgaaccggttgcacagaggcggtctacggaacggacggccaagaacaaccctatccaaaatggacggccgagatcgacttgatctactgccggtctacgggaaacggcgacgatgacgtcagtggtgacgtcaccaccggcggcggctcgggcgcgcatgctcgccagcgaacgacggtgcggcggcgcaaacggagagcatctacgggtagcgggcgacacggcgaactcaccggtgacccaaacgacggcgaacgacaaccggatggcaacgattacgaggttgaaacggcggcgacgatcgggttgacgacgacagcggtgctccggcgatcttcggcggaaacggaggggtggacgaggacggcgacggcttggcgatcacgatggcggccttcccgagcgacgacgatgaccagagcggcggcgtcgcacggctggacttgcggcggcgacggcggcgcacgggtgaacgcggagacggcactacaagcggcggcgagctaaggcgagggtggcggtgggtagaggaggtcccaggggtccttttataggggctaggaggcggcgacggaggcccacggcggccggcagcgagaaggaaagattagggttcgggagagagagaggaatccgattcgagatcgaatccggcactttccaagcgattttagccgatgattccaaaagagaaaagatagaggggatcccggagattatttcccctcaatcaattcgggcggagaaggaaagaggcgacggaattggaagggcggcggcggcgcggctcggctagggttcgggcgagcgacggcgcgaggtagacgacgggcctgacaggtgggccccacctgtcagcggctgagagagaggagggagggcgcggcgaattgggctggcttgggccgggcgcaagcaggccgaggagagggagagagagagacttgggccgactttcggcccaaagccaaaaagagagatttaaaaatctttttctatttaaattattcatgaaatgatattccattgattaaaaaaatacttccttggctcaaataaatcctagaaaaatctaggaactatagaatcaagagaagtgtttaaaaaaattttatctagcccacttttatattgagatttaacaaattaaaaatagatcttctcttttaggtttttaagattatttctaataattccttttaaacaacaatttataacttaaggatttttaagcaagcaaaacatttaacataattataattagatcattaattgattaattcattgattaactaattactgaaatattctttgtatcatttaagaattgagctctgaaaaatccgagaaaatttcaaagagtatacttaatcatggagaatttaataaaaattaaatccagccatgctttatatttagaaaattttatttcccacatttaacttcacttgtaaattaatgaacatttaatataaattctattaataatttattaaataatttataaatccttaaatggaaaatcaggctgtgacaattgggtaaactctattcgtgtgaaatctagaatttatgggacaagttttaataggaaataggcccctaaaattggataaataggaaaaagtcactgttcattagcccctaggtgttcgatttggttccctagccctgccccctcctctgccacgccgtcctcgcaccccgcgcgccgcgcgccgtcaccgtcaccgcggccgctcgcccgccgctcgcccgtcgcgtcaccgcctcgcgccccgcgcggtcacgctatcacccgtcggccccgagccccgctccgccgtcgccatcaccgcgcgccgcgcgccgtcaccgtcgcgctgccgcaccctcaagccccacgccccgtcactgccgcgccgctcgtctgtcatcgtcggcctcgcgccccgagccgccgcgcgcccatcccatcgccgctgccacgccgcgcgccgtcgccgcacgccgcttgaccgtcgccgtcgccgcgcgcttctcgccgtcccgcccatcgcgtcgcgtcgagcctcgtgccgagctgcgcctagccccgcgccgcgctgcccacccgtcgcatcgccgctccgagccccgcaccgccgtgccgtcgcgtcgccgcgcgtcaccgtcgcctcgcgccccgcgcgctgcgccgtcccctcaccatcaagccggccgcccctcctcgagccctataaattccccccccccgtcgccattccaccccacaccacctcgcctcctcttcccccatttctccccttccttccaccgcgaccgccacgccgccacctctgtgccgccgcgccgcgccgcgccgcgccgtgtgacgctccgccttgcgccgccgccgccctcccctcgttcggtcgccgtcgccgccccgggtaggcagagagccgagagagagagaggagggagaagaagccgggagggagggatagaagggagagagaaagaaaagagaggaaaagagagaaaaagagaggaaaagagaagaaagaaaagaaagagggaaaaaggaagaaaagaaaatagaaaagaaggaaaggaaaaaaaataaaaataaaagagaaattagggagagattaaggaggtctagaaagttaaaataattagagtttagttattgattaatcatagttgaagaattgcaaattttatataattatagattattcttggtaatctctataagtaattaattcgcgatgaataatcgggtataactactaagagttgtattgtcgttgaaattttaaagaagatacttttaaatcgcaaaatacctttgagtaaattaaaatcgaaatagtcctatttcgcgaataatgtaatcgatatagaattcacctctcgtactcgctttttgatttggttttcattagatcttatctgaattctaattgagttcaaatcgtttctccgcacgtacttttagagctcgagggagttgcagatccgagagaggatcaagacccgcaggactatgagtaaggcaagtcatcactattccttgaacatgttgaacccaattgcgaaattattttgtttacaaataaaattgcatgcaatgataaacatcctacttgtgattatgccatgccttgattattgtttaccccttattccttcgtaaccatgtttacgtatggagtccctagtcaattatgacaaatgcttagaaatgctcttctagaatcatgcatactcatattatcaaaatgctttatgcttgggcaattaccttcgagaaggtaattgagatgtggcatgtggagacatgagcgccacattgccatgatattgatgacatgatttgtgaaaggaaaataaaatgaaacaactgttttcgactggggcggatggaggaattgggtggtatctggaaaaggctagtaccgtccccagtcagttaaaaaccgagccatgaagttaagcatgaaacgacccccgtacaaccatacttctcgaatgggtatagacctagcggattagatagccgagcggaggcagtatccctgcatagatggttcacccccatgagtgaggcaggtgcgctacggtggggcagctgttgaggtagggccgcgaggcgtgctcctacatcggtgtcgccattggtaggactgccatgagtgtgtgagagagagaacttaacttgaaccataatttaatatgtgtgtgatacttctctttcctgggagcgctagaactcctctcactgctagaaacatggacacctagagtgcatgaggatgaaagttcatggagcgggtactgccaatgcaaggttatcgaaatgctttgccgtgacgcgtctcatgtgttgggacgaggctcatgtgttgggtagtcgcggagtgcgggtaaagtgtacatccactgcagtgtgagtagaccaaatctattcgaatagccgtgctcgcggttattgagcaccgggacatgtattacacttggctagactctaaattcataacttgtgtgggatgggatattgcatgatgatttttatgctgatggagccacttcctgagaggagggaaggtggacgtcctcagaaaaccatgacgactcaatggcgggaagctatccttgggatcacaatggatggtggacagaaccgccgttgtttaatgtgaacactggtactaaaatttgatcagtctatgctaggtcttaggcttgtgaaaagaattacaaaacttgctttacgcaaatgaaccatagccacaccttgaatactctctatcatgtgcattgtggctatggtggcttgctgagtacggttggtactcacccttgcaatatacaaatttaatcagaggtcggagatgaagcttcagacgatccctacgcttattaccaggcgggcgatgaagacgatggcgctcagtaggtcttagttacggtcattacctgtggcaatggcgtgccgctaccttaactccgctgtcttatctacttctgcttttgggatgtattccggaccgttcggtcctatgttctaagactatgcctgcgggcctatgatgtaataattcgcactagactctcgtctatgtgcgcttggtatttcagctccaaattcatgtgtaccagactacttgatccagggaaatggtaccgtttacacgcttgattcctgttataaaaacgggggtccacagcctacgaagccaacctagcctctggacacctttcgccgtatccacacccttcgccacagaaccaataaggtacggcgtcaacgctacgggcgaagaggtttcgccacacgccacgcccttcgccatagtaccaataaggcacggcgtcaagggctgtgggcgaacaggtttcgtccgccgacgcccttcgccatagtgccaataagtcacagcgtcaagggctgcgggcgataggtttcgcccgcccacgcccttcgccatagtgccaataaggcacggcgtcaagggttgcgggcgaataggtttcgcccacccacgcccttcgccatagtactaaaaaggcacggcgtcaagggctgcgggcgaataggtttcgccacacgccacgcccttcgccatagtaccaataaggcatggcgtcaagggctgcgggcgaacaggtttcgcccgcccacgcccttcgccatagtgccaataaggcacggcgtcaagggctgcgggggaataggtttcgcccgcccacgcccttcgccatagagccaataaggcacggcgtcaagggctgcgagcgaacaggtttcgcccgcccacgcccttcgccatagtaccaataaggtacggcgtcaagggctgtgggcgaacaggtttcgcccacccacgcccttcgccatagtaccaataagctatggcgtcaagggctgtagccgaagagacctttcgccacacccacacccttcgccacaataccaataaggtacggcgtcaagggctgggggcgaataagtttcgccacacccaggccctttgccacaataccaataaggcacggcgtcaagggctacggacgactaggtttcgccacacactacgcccttcgccacaataccaataaggtacggcgtcaagggctgggggcgaataggttccgccacacccagacccttcgccacaataccattaaggtgcggcgtcaagggctgcgggcgaacaggtttcgcccacccacgcccttcgccatagtgccaataaggtacggcgtcaagggctgggggtgaataggtttcgccacacccacgccctttgccacagtaccaatgaggtacggcgccaagggctgggggcgaaaatgagttaggaccagacgcgaaaataggggccgcgaagccaacctagcctctggacaactttcgccacacccacacccttcgccacagtaccaatgaggtacggcgccaagggctatgggctaattcgccaagggtaatcttcgctgcaggcaaacgaagaaagccggcaacggttaaaaaggtcgaagtactaaaagggccgaaggccggtaacggttaaaaaggtcgaagtgcaaaaagaccgaaagccggcaacggtcaaaacgatcaaagtacctaaaaatacctttgccaaaggcaaaaagggaaaattacgagccgaacagccgtaacacgcaccacaccccatttatttgccaaaaaagcacaagttacagattaaccatgacgactcaatggcgggaagctatccttgggatcacaatggatggtggacagaaccgctgttgtttaatgtgaacactggtactaaaatttgatcagtttatgctaggtcttaggcttgtgaaaagaattacaaaacttgctttacgcaaatgaaccatagccacaccttgaatactctctatcatgtgcattgttgctatggtggcttgctgagtacggttggtactcacccttgcaatatacaaacttaatcagaggtcggagatgaagcttcggaggatccctacgcttactaccaggcaggcgatgaagacgatggcgctcagtaggtcttagttacggtcgttgcctgtggcaatggcgtgccgctgccttaactccgctgtcttatctacttttgcttttgggatgtattccggaccgttcggtcctatgttctaagactatgcctgcgggcctatgatgtaataattcgcactagactctcgtgtatgtgcacttggtatttcagctccgaactcgtgtgtaccagactaattgatccagggaaatagtaccgtttacatgcttgattcctgttataaaaacgggggtccataggccgcgaagccaacctagcctctggacacctttcgccacacccacacccttcgccacagtaccaataaggtacggcgtcaaggctgcgggcgaagaggtttcgccgcacgccacgcccttcgccatagtaccaataaggcacagcgtcaagggctgcgggcgaaccggtttcgcccgccgacgcccttcgccatagggccaataaggcaccgcgtcaagggctgcgggtgataggtttcgcccgcccacgcccttcgccatagtgccaataaggcacggtgtcaagggctgcgggcgaataggtttcgcccacccacgcccttcgccatagtaccaataaggtacggcgtcaagggctgcgggcgactaggtttcgccacacgcccacgcctttcgccatagtactaataaggtacggcgtcaagggctgcgagcgtacaggttttgcccacccacgcccttcgccatagtaccaataagctacggcgtcaagggctgtgggggaagagacctttcgccacacccacacccttcgccacaataccaataaggtacggcgtcaagggctgggggcgaataggtttcgccacacccaggcccttcgccacaataccaataaggtatggcgtcaagggatgggggcgaaaatgacttaagtctaagctgggggggctacaaagccaacctagcctctgggcacctttcgccacacccacacccttcgccatagtaccaatgaggtacggcgccaagggctaggggtgaaaatgagttaggaccagaggcgaaaataggggccgcgaagccaacctagcctctggacacctttcgccacacccacacccttcgccacagtaccaatgaggtacggcgccaagggctcagggctaattcgccaagggtaatcttcgctgcaggcaaatgaagaaagccagcaacggttaaaaaggtcgaagtacctaaaaggaccgaaggccggtaacggttaaaaaggtcgaagtgcaaaaagaccgaaagccggcaacggtcaaaacgatcaaagtacctaaaaatacctttgccaaaggaaaaaagggaaaagtacgagccgaacagccgtaacacgcaccacaccccatttatttgccaaaaaagcacaagttacagattaattccattgcccgccaaaaacattcggactttagatccgattcatcagcaaaagctgtccttaatggcgaaggactaccccttgagcatcttcttcatcgctagttgttagatcaacaaaaatttttaagcggtgaagaaggaaaaacggggactatgctgtatcgatgctgggcaatggcaaactggcgctcggacatataaaaattcataggtgtcttcgccttttttgtgtatgatatttcgtggaaaaaccccaaggcaatcgtttgatcaacgaaaacgccgggggggcgatacgaaccggccgaagcactgctcgccgaacgttgaaaccgcgacagctcgttttcggaaaacataccgatcgtcgttatactcgacttatgcaaatacttaagcgtttctggacgcgtatgccaaaagtcgagagcgaatgatgagggctgaaaagtcgacaaatcttttcgctaaattacgcaaaggggccgacatgtttcgacctaacgaaagcacgaaagtgactatgcgaacattagcaaaaagaaatttgaaacacacataagctccatcaggcgaaagcacatactttaaaaaaaaagaagaaaaggagctacagcttcgccataaaaaggcgaaaacgaatcggccaaggcatcgctcgccgaacgttgaaatcacgaacgttggaataaagataccgaacgccgttacatttgacttacgcaaaacacaagcgtttttcctagcgcaaaatgctacgagtcaaaaacggaagtcgaaagctgaaaagtcaacaaatcttttcgccaatcctcaaaagggggctgaacgcatgactttcggcgaaacccccgctaaagcaatagggaaaaggggaaggaaaaaatacaagtcaagaatcgcgcaaagcagacaaacttggcaaaatataatcacccagtgtcataataaagcttcaccattctcgaaaggcgaacgccagtattcatattttttctgcaggagtctaaaaagagttttcggcaggaacgtcggccgaaagggggcgcctcatgccatactgtatagtttgcacggtctcggccgaagctccttactcacccttgcccatgaggggcttgttggaggcattccatgaagcctttcggccggacctaccaaaaccatagtaccagcaaggattcaagtcaaagacgtcaagaccattcgggcgaagccctatggcgaaagccataagcgaaggtggcgaaggctggaaagccgcgtcggtactccgcaagtaaaggcatctcgggtgaaggcatctcgggcgaagggcatacggcgaactacaaagacttcgccatgacgagttcggcattaaggaggcccagcaggctgcccccgacctttaaggccccttcaccatagaccaggcccagcctatcggcccattaaaggcccatatatgcaaatgacactgtgtacccatgtaaatatcccttttataagggcaaccatgtaaaatcccctgtaaacctaaaccctaggaggtgtaagcctgtgctaaggctataaatagacccctagggccatgtaatgggggatcccaagaaattttatcaatcaatacacttattgcttttccaacactgttgagcaaccacgtccttcgacgtgacgcagttgtccatttgacagcactccctctgtcccaatatatagctaagacgagcccatcctacttgctatatgttgagacggagggaatagtttttatgatattatttttatagtatggtagcataaatatatataaaactatacttctacgaaagtacatattgtcacaatatattttcattggatatgcaacaacctatagttggcaagtttatttatctttctttatcttttttttttctggggtgtctaaaatggccatttctgttattaattcgatcaaatgggcatctcatgattaggctattgtgaaactggcccacctagatttaaagttacttagtacaggtgcatgctcacattttttttcgattaatatcagaaaataaaaattgctcttatgctacaaagtcgaagagtgtactcacaattgccacaaggctgattgatgttgcaaatttgcaccttagttcttttttttttgaatgaacatcacctgagagtatggtgttttgtattgatatagcagaaaaaaaatcacaagactatagccctacgatgttataatcgggcaaaagaaaaaaaaaataggaccaccacgcaccgacggcattacgcacacctaaatttaattagaaccgcccgcctgccactatgcataacaacgccaccaaacctataacgtacccacccctataccgttcaccacctccaaacagcaagaaacaaaatggcctcatggacaccacctgtgaagaagggcgagagagcgagagagacgatgatccgtgcatccctcgtataacccaccgccattcaaaagcgttggctaaactatttggaggtgggaaaggcaggaacgagacctcctagatgatgcctccagggaggatgtgatgccatagtgccgcaactgcccatctaatgaactggatatggtttttacctagagtgtcccaccagcggcagggggaggtgcctcaacaatgccctcatcaggtaacaagacactcaaaagtgtcggtgttactgacgcaacaaaccactaggataggtttacacatgcaggctacagcctaccaacccctgcaatcatgacccattgtccctctacaggccaccctccacccacctcatgcatcaccccaaatcaacatgtcatttttgtcaccacaagacaaaccaccgcaagggccgagcacaacgctctccccatagtgtagtttgtcctttgctatcgacctcgccggctagcaccgcccatgttgttgtcatcaccacatgacagattgccacgaggccaagcacagttgccttctcgcacatggatttggtccaacaccatcgatagcgcaagtcagcaccgcccaagccactatcgttactgtaaccaaatcaccgcagggtcatgcctccacatgctggctacaccagaccgaagatttcgtaggcctccatcctgaagtcatcgttgccggtcccccgaacctccaagaagacctctacctgcagctgcggatgccatgacgccactagatccgcggatcttgtaatggatgtgccagatctgcctaccttcgccgtgctcatgagcacaagcatcagtaagacgaaccgactagatctagcctaactagttgtggatctgaatgcttccaaacaccagctacactcgcaccacccaagttgccgccatcagcatcttctctactcgtaaggtctctgggtgggattgccccgctgccaccttcctcgttgcttgtcgtgctcccaacatgctggttagacggcgacaaaggcagggtgatgggtagggggaggagcggtgctaggtttggggtgtcgcccgagttacctctttaggcaacacggtggctaggcatgaaaaatctcctatgcgctccattttttgccccataattgaggtgctagcttgcgctctcttttggcacaacatacacaacacatgaacttccaaagttaccccccttttaattgaggcgctagcttgcgctctcttttggcacaacatacccaacacatggacttccaaagttacccctcttttccctccattctcatcttctttctctatacgtctaactaggccatgccgtcgtgttcatgacctttctcacctacgtggaagtctctaccaagccacccgttcccatcaacatcgcccatcgtgcccacgctgccaccagcctcgacggtatcgacggtgatggcgagaggatgcagcagagtttgggagcagggtggcgccggcgaagcttgaatgcgtcatcggtggagcttggcaacgtgcataggaagatggaggaagaagggagaaaatttgaaagggaacgtacatggtgttgtggcaaaagagagggcaatcgcctcaactatggggcgatttttcaataccaatcaactttgtggcacagggtcaatttttcagaaaaaacattggttttgttttttttttctagtggctactcaaccagtggcatgcatattacagaagcactacttggtgataaacttgacaacaaagtcaattcattcttttatttcaggaaaactttgcaccttgttgcgcctatgtccaattgacctaccatcagtcaagccaaacacaaataacacagtatctacgccaaagtgaggtgattattcagttttcctgaacgggatagagagcacattcacaggagcaagaataatgactgctattatgtgacatcacaattccagacacaggcgacaataccgaattgcagatgaaggtatctatgcagcacttgaacatgatttacattattgtcgctaaattatatcgatccaagtattaggaacatgtgaccgtacaaaacctgctaggactgacaacgaatatcatatccgacttggtaatacttgggaaatatagttagccatcttaaaactcacgaaaatcaccaggaatggcgctcttgtgatctccatggtcaaattacatgatcatccatcagtggggcgacagttctgccatcaataagcacacaaaagacaattagtcagcagaatatgcaaacggaaccctgctacaccaaaatcaggccaaatctcaattcttaaaacatctaactcaaatgaaggacacgcatgttggcaaaaattcgcttacaggaagtgatatagtcattctatagtatgtatccaggaaacaaaaccaacttcttaattaatactagtcagatgtggatacaaacagccagcaagtaaataactctgggacaaaaatacaactccatgaagaaacatcaggaaaatacacaaatacagattcaccacccagcatcctaagaaaaattaggactacaaattaagcaaactgttattaatttcttaagatattttggatctttccaagtccatcaatgagtttccattctcaattgcagactctaatgtaacaacattgcaataaaaaatgggttgacctccctgactacttgttcatttacgtaaaatgaagagctataccctgcacaatttagttggtcaggaaaaagtgcatcatatataatctttcacaagttcattccatgcttctcaaacagacaaaactaaaaatacggcaaagcaaataaactataactacagatgtagccagtaatgaattttatagaacttaggccaaacatattcaacttatgtcttctcttttacaaatggagcacgcacttgcaaaaggacttctcagcatatgattaaaaccatcaattagttgaaaggtaacaattcaaagccatacatttaacaacacagtcaataatttatataaaagtattgagcaaaaagactgcacctagcttggaaccttctaagtgggccaactgtgttggtaatttgatatttcaatttattggttcaggtatgttttccatatggttgttgctaatttcaaaagtgatatgtaactcaagctaaaaagtactataccatgtagtatgcacacattaatactaccatcagacaagttgaataaatgaataggagctcaaaatttagttctagtatttctgatatgagtaataatggtcctaacttctaagctatggatgttcaaagcataaattagtcaaacccgctaaaacagatagagactaatattagaaacaacattcaatatttaggacagtttatcaagcagttaaaggaacattaattgtcacggagcgaataaaaggcattcagaaaaagcaagctactggaaataacatgattttgctacatgtacaacggaaaaggcatgggaagcaattacctttagtataaaaactagtgaatggatgatagattagactcattctttgggaaacactcttaaattcctttgactccagatggatcatggagacaccaatatacgtgcacacaaaagccacattatgttcctcagagaagcccagaagcatcggtgccgttttctgaggccctggttccaaagaaaggagcctgtccagttcaatagttttctccagcacccatccagcgacaccatcagcattggtctcactcttccatacattgagagtataatgtgtgacaacaaggaaaagaagcccgccgttctctgcaggcgcaaatctgcagattgtatccccaaatctgtggtggccattcccatcaggatgcatatcgggtggaacatcgatctgagctgttatctgtttatccaaatcgaactgaaagaagctggtcctctgctcacctaggagcaaacagtaaagggaattcccaaccaaggtagtaaaattgcatatgcaatccccaaaattaactgcggctgagatgacattgccccagatgccggtctccgatgagtaaacacaagcgaacgcgtgtgtccgattcttattagtgcctagtatgacaacctcaaagggactcgaatggcagccgccgtgcacgtggcccgggtcgccgtcgccggcgacgcagcgcacctccccggcgcggacgaccacccccctgtcacggaacccgccgggaatagccacggcgcggcggtcgccggcgacggggtcccacacgatgagcctgcgctgagaatagcggcaggtgttgacgtggacaagggcgcggccgtggcggactcccagcaagtcgttgaggtcgtggcggttgtcgagccgccaggagaagcgcgcggcggggatccggtccggcgggtccagcgcgggggcgaagatggggtaggcgcagacctggatgacgccgaggaggggaggcttgcggtggcgggcgcggaagcggcggaggaagccgcggtcggagacgaggcggcgccagcgggtgcagacgagggaggcgcgggggagggaggatggcagcggcgggaggcggaggaggatctcggagaggaggtcgtcgttgtccagcggcggcgccggcgaggtggggcggtggcggcggcggatcatctccgcgctcgctgtgttgtaattttcgatgcaatctagtcgacgtggggttttttcctcttcatatatatttttttttcagttttcaagtaacgttcgctgcaactttggctgaattttcgggggcagtttttctttgatttaccacacttaatgcttgtaaaatcacgtttcacaaaccaaaaatttattaggagttattcaatccaccgtaaaatgtgattttaggtgtttttaattattctttcaattatttacaggggtttgaggatagaaaaaaggtgtgcaccatctgggttgcacagagaaaacattcattattagaaagaaacgaggatattttcggtgtgtctgattgctttactattaaatgtgcatgattagaaagagactagaacactttcggcgtgtctgattgcttcactgttaaatatgcatgattagaaagagacaaggacactttcggtacgtctgattgcttccctgttaaatgtgtatgattagaaagagacgaagacactttcggcgtgtctgatcgcttcatggttaaactagccatgtaagccacgcgttgcatggctcttttaagacccgttcgaaagatatgtaaaaatatgtatatatgggtgaggccaacagtgccccgttattgagttctcgttgatgggcaaaattttaaaggttcggtaaaaaaaacaaaagatatatatttatgacaaaagagagtgcattattatatgataaataaatactaacgtgtttctctatctattctaaaatatatatggcattcttattttgaggaaaatcaaaacttaaaaatttgactaatgaatggactaaaagtttaggagtatatgattagtgctatgtatgtcgatttttatttgatttttatatcactatatgataagggagtgccgtcaggtttctatttaaatctttttatgtaacgttgatttcgtagttatcgataataaacgaaagaaattagtagtagttaaagtataatgttaaaatttccctaaaaaaagtataatgttaaaagattgtgtaaaaaggtaacactgtatctaagtacattttagaataaagggagtaattagtacatatgcatataagtacttaactaaattatttatttaaaagaatacttgctacactatttacatatgcatattaaaacacacatcctgcctatagcctttttctctgcatttaacagggtcacatatgtacaggacatgctgatgatggatgcactacgggctgtttgaggttttatcaatttttgtcatgccaaattttggcaagctaaaattgtgtttgaatcgaaatcaaaataacctaagttaactattgaaatggcctttttttaaggcatgctaaaatttaatttcaaaccaaataaacactaaatattattgaaattataaaaattggtaagattaatttagatctcaaaccaatctagccctagacgttttcctacagtcaaaaaaaatttaaccgtccagtcctcatcattatcgtccctactcatttattcattgtttcccttttgcatctgactctgggttctgggatacacagaccaaccacgactccacgagtaggaccgcatcttgtccccttcgtctctgctataggtagcctgtagctcgacctttgctgccgtggatttgcactgaaaaggaggagaatgtctgaaggatgaggctggcttcactgaggagtgaggagtgatctcctcaacctagccccctttcgtcgatcttttctaaagatgagttttcggcggccagcagcatggtagcgcatcgagggcttctatcttgtgctgcctgcactgacttggtcccaatagggagatggtgagttggtgtggtgaagatcaaggaagcgttgcgttttttttcgtcagttttctcaattctcttctgctagttgcctagttctcctattgaagaactgtactacgtatctacgtaacttacgtgtggaatttgacaaaaactctagatccttccgttcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62254 - DNA, 794 bp, Oryza sativa
ccggtcggtgaagatgtagacgcccaacaccggcggcataataagtcagccgtgcaggcggaaacaccagtcggcggcggtcgaggcggccggtcggtgaagatgtagacgcccaacaacggcggcataataagtcagccgtgcaggtggaagcaccagtcggcggcggacgaggcggccggtcggtgaagacgtagacgcccaacaacggcggcataaaggccagccgtgcaggcggaaacaccagtaggcggcggcgaaggcaagccggtcggtgaagacgtagacgcccaacaacggcagcataaaggccagccgtgcaggcggaaacaccagtcggcggcggcgaaggcaagccggtcggtgaagacgtagacgcccaacgacggcggcataaaggccagccgtgcaggcggaaacaccagtcggcggcggtcgaggcggccggtcggtgaagatgtagacgcccaacaacggcggcataataagtcagccgtgcaggcggaagcaccagtcggcggcggacgaggcggccggtcggtgaagacgtagacgcccaacaacggcggcataataggccagccatgcaggcggaaacaccagtcggcggcggtcgaggcggccggtcggtgaagacgtagacgcccaacaacggcggcataataggccagccgtgcaggcggaaacaccagtcggcggcggcgaaggcaagccggtcggtgaagacgtagacgcccaacaacggcggcataataggccagccgtgcaggcggaaacaccagtcggcggcggcg

SEQ ID NO: 62255 - DNA, 711 bp, Oryza sativa
cgccggcctgcctccgtcgccgccgagtggtgcctccgcctacacggctggcctattatgccgccgctgttgggcgtctacgacttcaccgccggcctgcctccgtcgccgccgagtggtgcttccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgtctccgcctacacggctggcctattatgccgccgctgttgggcgtctacgacttcaccgccggcctgcctccgtcgccgccgagtggttcctccgcctacacggctggcctattatgccgccgctgttgggcgtctacgacttcaccgccggcttgcctccgtcgccgccgagtggtgcctccgcctacacggctggcctattatgccgccgctgttgggcgtctacgacttcaccgccggcctgcctccgtcgccgccgagtggagcctccgcctacacggctggcctattatgccgccgctgttgggcgtctacgacttca

SEQ ID NO: 62256 - DNA, 5255 bp, Oryza sativa
  unsure (1)..(5255): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggttcttcttttgcaggagcagctttcatcaggcccttaacatttaagccctggcgtttcagaagagcttcgagaaaattaatagaaaaaaggtcagaacattttatcaatggaaaagaaacagtgaattgacaagattgcatataataacctgcaacttttcctcttccatcctcagatgacaatttcaagtcaggtgtctgtggccactctttaaattttgacttgaacataactgtctcaaacccctcaattactttgattacatgtgtttttgttcggttatcatcagagagcaatttctgcatacacaaacaaacattaagtatgacggcaaaatagttcaagatccagaattaatttgagatatattagatgtataaaattatgtgatatatttctccagaaaaagtttatgttcttttctgggtgatctggactaagtaaccaaatttctaaaattcagcagaattattggctcatcatttcatcaatgccacaatgaaaatgcaagcatgttggaaaattctggtttcattcctccaagctttcaagcttatgtgattactggaaaaaatgcccgtgcattgcaacggaagaaaacatgagaaatttaagaaaaggttaagaaaaatttacattatgtaattaattaaaatataaaatcacaactatacatgtatacgatgttgaagaaaagaaaggctcgtaaaaatcaaggtaaatgtggaaaaataaaattttccaaataaactatggctggatttattttttattaaattctccatgattaattacactatgtgaaatttttccgatattttcagagcaccattgctaattttaataatacaaacatcattttagcatttatttaaatggaaatctaaatgaaaaccctcctttctccctgggccattttgagcccattctttctttagcccgtagctgagccggcccattaacctcacttctcctcccttccacctcggcctgcaagcgcgcatccagcccatcaagcaaccacaaagtctaatcagcatcccttctcctcctctcactgtcgcgtgggtcccagtgctacagggtcgtcccctacctccgtccgactccgcagcttcccaacaccgccggaaaccgccccctccatgaaatccgttcgcatccacggagataatccaaaattgattgaggggttttgatccttatctctttctctttccctttttccaagaattagagcaaaatcgcatcatatcgacctcggaatcaagccatatagcaaaccacctagagttgtccgtttcgcgtacggggagagaatcggactggcgcctccagggacgacgtaccaaaaaagttggcaaaaacatcttaaacttttataataggtaaagataaagatatttctgtttcacaagaatgtgatgacattacataagtatttcttgaaagaagaacatgttacctcagcagcttcactggcactcttcctctcctgcaaagatgtggttctgcccatccaaacaaataattcgacaccacaatctaacaagtaacacttatttgtcttgagcaactcgtgcaataaggattcataattgataggctccaactttccttggttaaaactgaaaagatgcatttcataaatattgactgacctcaagtgaaaattgttgtcttcaacaaatgaacacagggtttgtatataaatagcacatttccaattaattaccagagcaatttgaaaacagtttcttcatatttctcattatcttctacaggggctctccttggtagaggggcaaagccaccaaaaaaaccccaaaattcaccagcttcagcatcggccatcaacctgccatcctctatgaaaaaagtacaatcaaacatatgcggaaaatatcattgttccagtactatgaacacacaaggacctgaaatagaataacttaccaacagctgcaacttcacacttgccctcgtgaaatgtatctttgatgtactgcacgacttcaagagcctttgcacgctcttgaatagacgaattggagccattgaactggaaaattttggacttcgtgtccagaataaatatgtcatcatgattcagggacgatcgagcaaaaggaacctagtaattgaatagaaagtctgatcaagacatgaatagaaagcccctttctgaagaagaaaacagttatctagatagcttgcctctttgacatgaacaacacgattccctgtacagacatacagacgggtttcgtgctcctgctcattgacctcaacatgcttgaacccagatgccactcctcctggctgtggcatgatgcatggtctaaaatatgagaggaacttatctgtttcattgccttgtatctctcggtattgaacagcgcgtccaccaagtgcagcatcaagctcaactgttaaaattgctgcagttccagattcatcctaccatgcatagaattggtttcaacaaacttttgaagaactgaaagtctgcatcatctaattatgagaattttacctgactagtatctttgccaatccagtaatgaatgtcatgtcgaagagaaccatttttcaaggcagttgtctaggaagaaaaaaagagcacgatgaaacattattacattgattgagaattatgcagcaaagcatttccctttttccatgagaattagatgcaaaacagtaaatttcagaagatagtttatgtcataatatggtaataagagatttagagctgtggtgtcagagaaaatttaagaaactatttcagtttcctaaaaccatgagagaacagtacatatgaatgaaactgtcatattgcagtaacatgggggcaaacacttgggagctttttatgaggcttgctagatactccctccgtcccataatataagggattttgagtttttgcttgtaacgtttgaccactcgtcttattcaaaattttttgaaattattaattattttatttgtgacttactttattatctatagtactttaagcacaacttttcattttttatatttgcaaaaaaaatttgaataagacgagtggtcaaacgttacaagcaaaaactgaaaatcccttatattgtgggacggagggagtaccatgaaaatgctaaacaattttgccatgtaaaacaggcgaacatttatatggttgagcaagctatagaataagcataaatttatactctataactgaacatggatagactattttaggcaaaagactaatgatatgaataagaggacaaaagagaggatgatatatggattatgagttatgacaccatataatatgtacttggataccttcaagatgatgtaagaatcacccatgaaaaattttccatatgaagacgcaggaataggaactggcttgaagttctcgatgcgccatatttccaagcctctgtagtgtattaaggataatcgtggctttgtacattgattggactaggaccaataaaatagtgaactgaacagattgtcaattgtaaatactcaaaaaagatcaagagtttaatgaatatttaaagaaaaaaaggcttctgctaaatcactacagaccctgtgatcattgttatctcattaacttctactctgctaatgctaatgtctagcatattgtcaagaagcttgcacctgtcaggatacttcatatgtgtgcacagtagcattgcaaattcatgatcatctagcaaacaaatgcattttacttgttttagcagaagtgtacaattaaattatcttcttaggaccaattaattcaacatggtagatagtgttcactcaacttatggacaaaaaacaactaaaccacaaattcagagtttcaacatgcacaaagaagttttcctggttgacttaagtaatgttatcttgcaaattaagtgacttcaatcaaggtgaagataatgaaagcaatagaggaaagtacactaaggtgaaattaaaaaaaaggatactccttttgcccagcaccacgaaaagctggatccaaatccttcatagaaaccgacatccttgatgttaaagaaacctctcaattcttctctttcacaggagagctaatagtatgctgtaaacaggggtagaaaaggtgggcagtaattaattagcaaacgaaaatgcacttggttttccttttttacgaaaattaaactagatagttcagttgttaagaaacacgaccgaagacatgccaagtattaggtattctggttatataaagaaagtcagctttgatgatacaatgtctactaacattaaagtaaggatgaaccaaaacaggcatactatcatatcactaatggtgactacatgccccatatagaatgtgaaaaatatgcagtacgccatttccgcatcgaaatacacactccaatgtattgtagaagtctgactagcacatttgcatttcacaaccaacatgaccatgggacatgaccctaagttccccaaacaatgactagaactgtcaaagcaatgcagcaagctaagaagtttgcgcttcctaagggttatgtctacacaattgaacaatgatccaattccaaatggttaagcaggcaccgagaggcacgaatctggatcaatcaatcaaatgagcactcccagtctcccaaccactaggcgccgcccgccgcgcgaggctggacagaacacagctcactgaagcatcaccaccccccaaaccattcctcccctcatagcaaccaagcttaaaacctcacgcgattagcccccacccaacccggctccatacctcccaaataaccagcaaatgcgaagctccccgccgcaactccaccccaccccccaccccctcctgaaccccgtctcctcctaccctaaccacgggcgcctccccccctccgctcacctccggatacctccacgcgcatgccgccgcgataagcggcgagtccaccattagtccaccaaagctcaagcaaactatctccaaaaaaaaacaaaaaaaaaaagcaagcggcggaagatcgagagcaccgacctgggagggaggcggcggatatcggagcggggaattcgcgcgggcgaggtgggggggggaatc

SEQ ID NO: 62257 - DNA, 1433 bp, Oryza sativa
cagacagaacagaagcgagagagagcgcaccttttgttttgcgcgttttatgctttggtccctctgattgtccctatttttgttccggtgaatccacgagtttgaggatctggatgttagatgtagctgtacctcgtgacttgtgtggcaagaggtcggtgggttttttatgctttcggactttcggtcttaaaaaataataataaataaatctaaacctaattatgtgagatcacctaattatatgtataattttttacgaatagagtattccttcgtaaaaaaaataaattagaattggaggtgaagtatgctaatattcattgtattagaatacatcacatctaattttaggtttgcttttagagacaaagttattcattatggtactgagatacgtcacatataattccaggtttttatagagaaagtatttatgttagacttttagtctatttttttatgtttatcgaatttgtagtgttgtacctcatattctagctaagtctatagtttatgaagttgatgctatatggactgtaaataatatttagtagggcctctattatatcccctaagatagaaaggcatcaaaatcacccttgactacagcccctattcttgaggctctatgccacagtccctatacactattcattagcgcagaaagacatttttcctcacctatttgttccctctcctccctaccatgcaccgtacctccgccatgctgccgccccaccgtccaacatcctcactattgccccttcacccctctttcgtcgatgcatgctagaagaatagatcgatggttcattgtcatccccaatcttcgttgtccttatcttcaagctccctagatgttgtgttgcaaccaggttccacattagccttcgagctcctccgtcctagtccgccgcaactcttttatttgtcccctatgacatcctctaccgacgccatgttgttgcttggatagacttcaaataactatgaactatgtggtgtcttaaacatttgctactcgtattttgtcattccatatttaaaagttttaaatttaaatttgagttgtggtctttgaaattgtgaatttgtatatgatcagattatatgcattagaaatatttatgttcaattattctatgttaactaataatagtaacataaagtgtatgttgatatagaagagaagaaaattgggggcttgaaaatggagacatcctagaaatgaatgctccgttggagttggaggtattttttaagtagttacttcctaggaaatatggatatcccgtaattgatttttagggctctataatgggggcttcgatcattgccaaaattttcttaccaaattaaagcattttgatatttaattaagacaatttatttggtgctatcaatttttaaaagcaaacaaattgatcaaa

SEQ ID NO: 62258 - DNA, 29456 bp, Oryza sativa
catgcctatcaacttgtgtatagagaaagttctatctcctacctattcatccatcaatactatttttctattacgagtgataatttcatattttctcttcaccattgtatgctcccttcgatgttaggaatgttcttattttgggatataattaatattgtattaaagagcaataaccagttgccctactttggatccaagcatgagccttttgtccatttccgtcatggctagtatagcattatattggaaattattgtcaatcttttgttgaaaacacttgaactcttcgatagccgtagggcctcctcaccttatatagcaaattacagtctatttttacaagttatgattatacgtctatttatctcaaatattttcaccatttactgttcatctaatttgtatacacatcgtttttatttaagaaatcattgacttgatgattggagaaaaagaatcatgagatcaaaagcaaaattatctctaaagcgaaggcactgaaagcaattttggaacaataccaaatcggtggttattggctaacttgctcagagaagttggaggatctaggttcaattttgtgcagagataaagggggtatctgaaaagcaaagctggaacggtacacggcagcaagggtggcaaatgatggactggagcgtgcgtgccactaagcaacacctacaatacagaacacacttatcttttctatcagaatatttttcaaaactgctctaaattgcaaagttaatagtatattcatcacataagtattaaactagacattttcttctttttatatattgcacatatgtgcacacgccacaacttatagtcaacattatatttcacagcatctgctgagttaactaagacttattaattctatctttccaatctagatatttttcaaaactgttttaaatcagaaatccagtcatatattaaaatgttttaaatacaaaatcggttttctcatgtttgcacacgccatggttcaagaatcaagagtcaaaacttcacggaatctgatgagttgattattaagatgtattgattttttatctatgagactatgacaggtgactttggagaattggagtacatttttaattaatttgggaatttcatttgcatttgatattcggaggatatttggggcggtgtcctgtgtctcctcattaatagtctgacctcatagagatgtaatatatatactccatgagggaaatgatagtacttaggccagtgttaatttatcatgtgctactcatgcagctgagaaagtaccacacttattagtagcactatgtactccacaagtccattgattttggaggccctgtggtacttagtttcattggaaaggaagttgggcaaatgcaaagatgcattgatcatcatttgctaatcgatcacctgttttaccagtcatatgggaccagatgacagtagggacatatatagggggacataggaaattggtttctgggttggcactttggcagatccccattctttgttctgttttgggtcctacctccacatttggttattgctttggtatgatatgaagttgatagtttgctttttcttcattacttggaaaatgtaataagtcaaaagatcgatggtcatgaatggcgatattttatatttgatctgataatatagataaggatcttttgcttctctttattagcttacgggtgtgtttgatagtagcggttgtgaacctttcctcattgcacgaaaaacagagtgatagattagcatatactcactccgtttcacaatgtaagtcattctagcatttcccatattcatattaatgttaataaatctagatagatatatatgtctagattcattaacatcaatatgaatggggaaaatgctagaatgacttacattgtgaaatggagagagtaacaaattaaatattagctaaaaattgaaaaataaattaatataaattttaaagaaactttcctatatatctttttaataaaaaacatatcgtttagcagttcgggaagctatgaaaaaaacaaagacagtataagttcggaagaggtagtatagaacatgcaagtctattgataaattgatcggtgcatgcaacctagcaaattagggaaatatagtcacccttcttcttcacttgcttaaacttttaggtaaaccgactaatgtaatgtaagtgactttaatgttttggattacttaaagggcgatgaagttgcgcatgagtctaacaccccgcgggagcctggattgtcaagggctccttccttttgatattttgaggggttgttgagttctctacccaaatttgcccttcctaataagaaggtagtgctaatatgaccctcggcccttgatccatttaatcggtcaaaaaataaatttcacaaaacctagtatatttgtttcaagtagtacaaaactaaatgtttggaatattgcgtatcattaataaaaaacatttttttccagacgtaccaaaaatggtttttgcgtgtggaactctagcctgtctatccgaaaggatatgcaaaaatcgctcttttttcatgtgggtgctttatgtcgtccgcacgcaaaaataaaaatccaaataataataaaaaaactagctccaccgtcagatcctcccgccgccgcccgcggatctggtcgtcatgggcccggtggaggcggatccgcccgtcaccgccggccgcgcccaccgcctgccgccatccatcgtcggccgcgccgcccaccgccggccgtgagagaagagtgagagaggagcgccgctcgcgacagaggagtggagagaagaaaaagaggcgagagagtttagtggaaaggaggtaagagagatgaatggataagaatgaaaaattttgaaatgttaagagggaaatgaggaggtaactcggactttaggtgattacttaagaggtccgtctgcgaaaatatattttcgtgtgtggcccattaagaggtccgcctgcaaaaataagcttatttttgcgtgcggacccttaagagacccgcttgcgaaaattgatttttccgcaaggtcctcttaagaagccgtatacgaaaatagaggacgatttttgtagatgcgactagttatggtccgtctgcaatctaaagagggtctcgtccaaaaaattcatttctgtagcagtgtataaccacatatattagtattatggttatatagtttgtcaaacattttcttaacctattgtacatttgaattctatacttatattcaaaatttgagttcgttcaatccatcgccaaaatattggagtatagccatgtaagtaaaatattttttcttatgctacaatatcgagtaaaactagttaatggtgcggttttttgaaaccttaagaccataataactgcagttatatatgtgacatgtccaaactaacaaggttcttttacaactcaagccataataatataatacatacatgtgaatctataaaatttactcaaaagaatttattgccaaaaaattggctaacaaactgtcaatttgagtctaagcatacctcctatacatgagtttgtgcctttcggtatatggaaataccatatagccaatagtatacgtgaatgtatccttttattaagaaaatacgatgaatagagaaggaaattatcttcctaaaataggaggcgttagagttatagtcgggaagataatgcctccttagtccgtatcatattctatctctccggattcttcttggagaggaagatgatgttcgatataatacaagaccctagaaggagagggaacataccaacaaaatacaagccaatacagataagagctatgaaggctgacatgagggattagagctacctgcaatctcgatgagttcatattcaaagacgaatactacactagctgtcgactacgtgtgagagctacatgatgtcaaaccgacaaaaaaaactagattaggtgatcccaaatattatactcatgtgatactgaaggtagactagattaggtcatcctaaatactgtactcatgtgataccgaggctattacctgtcagttaaggggcccgaacctatataaaattctgtctcctatctctttttaccgtaatctcgcatataccttggttacaacgacagccatactataaatacagtaggcgagtataacccgtcaatacaaaccccactaattaaaacgcaaacatttctatttcttttgaactccgcacgtctcaatttttttggagaggaaaagaactttccattaacttaaggactcagcaaaatcgctggccaccaagtcctccatgcccggaggcatactgtcccatggttcaacggtattccgaggacatttacaacccaaagctgctaaagcatgcgctactctattacatttttgtggtgcaaaaacaaagaaacaggaaaggaaactacttccaatcagctatttcgttgaatatagtattttaccaaaatttttgggaacaacatattgtaccaatttcgttgaatatagtattttaccaaaattcgtcaaaatctgtatagacctgtacgggcaataaaccaaagaaatcctttttccaaaggaaaaagtacaccgaaggtccctcaacttgtcatcgagttacaaaatcgtcccctaatcacaaaaccggatacaacgcatcccctaacttacaaaaccagtgcaaactagatccctcggtggttttgactccggttttaaccgacatgatagctgacttagcgtgggacccacgtgagccccacatgtcagcgtggccacctcagcctcctctcttccccctattctctcccttcctcctctgtccctctctctcacttcgccgaacaacggaccgatgccggcggcggtccagagcagcagtcgtgcctccgcacccaccaccgcggtggcgcccgcttctaccttcgcgcccaccgccgtggcggtcgagcggtccacgtggtggtgcgacgttgagcggcccgggacagcggcgtggcgccggtggcggtcgagcggcctgggctgccaccatcgtcgtccgtatgcaaccaatcgcaaatctggggatgaatctattgatgggagagggagacgacgaggcacgttgctgcatcaagacagagacaaggagcaccggtcaccaaggacatcgggctagcagtaggcggtggtgcatcgtgtgtgtcttttcatcactgaagtcttgtggagatgaagagttgaatacacagaagataagcgtgcgctgtggggcagcaaggacggcgtgcagctggcaccgactttcgcccccacaacgcttgtcacgctgcctcggccggcctcgccgccgctgaccgtgcgctgtaccctataggtagcctctccatgccgtccgggtcgaggtgcaccgccgccgcgtgagagccctccccatctctccttttctcgagctcggctcgccggacccgtgttgtcatcgtcgctgtcgctgtccgcttccacccaccaaacgcgtccctctccttcgacggtgggcacgtcgtgcgcgcatgcggggtgggaggaacggcgtgacaagacggacggcaaagagtatatgggcacggcggacgcgggcggctgccgatgagggaggagatgccaccggcggcggcggcggcggcgactctccgctggctagcgtccagcccgcggtgacaacgacggccgcacgccgcactcccccacacaccccgcgcgcggcgcccgacgcctccgacatgccgccgcccacgaccgcgaaccacccgtagcaacccggccctcagcccctcgtccgcctccttcgccgacgacgacgccgcccgacgcacacgcggtcgagactgcctgctagcccctgcccggttttgcagttttcaccaactcgccgggagctcgcttcggaggatgaagacgacgccgacgccgcacgcgaacgaaagcgaggtcgcagcccgcctcgctcgcctgctccgcggttctcctgcgcatgcggcgaacagctccgcggtcggggcacccgccgagtccatcgccgccgcgtggccccttctcccgtgtcgccgcgccgccgtgtcgccccttctcccgcgtccccgcgtcacctatcgccggcgccgcccagctcctcccccgctggcgccgcccagtttttacgcaccagccatccgccgcgccagccgaaccgtacccagctggccagctgctttcgtgggaggagagagaggaagagaggtggagatgggaggggaagtagaggctgacacgtgggacccatgtgggtcccatgctgagtcagctgctacgtcagttaaaaccggagtcaaaaccgtcgagggatctagttttcactggttttataagttagaggaggtattatatccggttttacggttcggagacgattttgtaactcgatgacaagctgagggaccttcggtgtactttttccttttccaaattgtaacgggccgagtgggccggaaatggcatgaacgccaacttaacgcatttccattttcgaaagaaaaaaaaaaccacacgaattcccaatttcaaacgccgatctctccgtctcgccggccaccgcaaccacccacccacccactctaccacccatggaccacgccgccgaccacctcgacccggcggcgccgccgtccgggcccgcctcctcgtccgccgccgtcgccgaggtcaacgcgtggttggcctccctcgcggcggaggccggaggggccgggggaggcggggtcggggctccgggagggcgcggcggcgtcgtcggcgtcggcggtggtggggcggcaccggagctctcgctggggcccgagcccacgccgcgcggggtggcctacctccgcgcgctggcggccgcgtcgcaggcgaggtcccgcgcggcggggatcgcggccgcggggctgcgcgcgcaggccgcggagtaccgcgccgaggcggcgcgcctgcgggaggcgctggagcgggcagggctcgcgcgggacgcgctctcgccgcccgcggccgtgtccgcgcgcgccgtggccgccgtcgccaacctcctcgccatccgcgacacggagatgagcaggtggagggggctagggttctcagtttttcttcttcttcttctgcgtgcttaattctcgaatgaataagactatttgttctgccattcgcattgccagtgagagatatgaacatctaacaagtcgatctgtttagcatatgcggttttatcctcggcattgggtgaacttcgatgaagttgtaattccagtaggcagttctgttatgcgtaatgctgttagtttagtaggccaaatagcaggaacatgtaatatgtctggagcacatgctagtttagctttcatgtttggttctaatgcagacaaaaacttagtttgggatgcattattgcaacaagaaacaaacaatttgatggtggagaacagtaatgttaggcttcatactttcatagtgagtgttctggtgattctttccttttgttttcattgttctctgattactttgaaatggtggttgtgcagctttgttgtggccagtgcggacctgtcgctgaggagagcagaggtggaggagaagagggacaaggtgcataaggaatcaaaggcgcttcttgattacacaaggaaggccatcaccaagcttactgagctcaagaagtgagtggaaaactattcactttcagtatacttaaggagatttgtgcaaccacttatatctcttgaggaaaatataatgaacaatgtatcatttgaaggatgctggaaaaatttaaaaatgatgtggagaagcaacaagcagaacagatgacggattggcagacaaagttggttatgatggactcaaaggaacgccaatatatactccaagtctccaattataaggtgactagtttttcttcttttgcaagtggtgtaatcagtatatggttttagttcttcttttgacctgatagttttggccgactaccactaaacaaagcagtttctgttgctgaagcagcatatggtgtttgctagagattgtcaactgttagaacttagaagtatatagtcagttatcatttatcaatacttgtgcttgtgagtttagcaggatgctgcaggacatgacatactattatcaagctaaccgtacaactttgaaatcatttcaatccacatatttcctgaatcttgacctgaagaggctgttgatcagatgcttatctgcgcttttatgcactctctgctctatctttgattggttttgtaagatagggcaataactgtatatagcttgtgtgtgttttgggggtagctgtgaaattgttcaatgttgaaataatgatgtatctaactaataggtagaatttggtttgaacatgcatttccatcacttgtttctgctgatgttaccgtttgctagtgacgaagttagtcatatgatgagttgaatagtttcacatcatgatctgatgttgatagtacaaacatgtgttacttctaattttaagggcttatgtgatattatactattcttgttattcttaccttaacagcttggctatctagagctatccatcccccttttagtccgattgcatgtatgccgcaacacactgttctttgatttggtaatatacaatgacacattttagattcactctccttttctatctgttaggcaatgctcaaccgagtgggatatacaccggagatcaatcatggtgtgctgatggaaatggcagagcataagaaggatctagagagaaagactaaacccattgcagacacattgagaagctaccaggacttgccaccagtatgccttttgctttctgttttgttccttttcttcagacataaatctttacttattcttggtattttttgtgactgtcatcaggacaaagctctagcagctctagctatagaggacaaaaaaagacagtatgcggcggcagagaagtatctggaagatgtgttacagtctgcattaaccacacctggcctatgatgtgtgtgtgtgtgtgtgtgtgtgtgtgtgtgtgtgtgtgtgttattaagtttgtaatactatttggtctgacatgccattgattgatagtgctatgcagtaatggccattgatttcttgtaagttgtaacttgattctatgatcctgtaaaatgcatgttctactgtttacctaaccacagcatatttcaccacacaaacttatttctgttgcagctactgagctagcatgtcatcgacaaccaggatgcctctgaacatcttggcctgttgctgtatatcattttgcattgatgtctatgtgattatggatagtcatgatgattcatgggatcaattgatgctatatgctagtagattaggtaaatgtgatcatatgccatatgaacatgccatttgtctttcatctgtccttgcatctttcatagagttaaccagatttgttggctttattccaattgaattcttatgctcatattaaatgttagtactttctgcgatttctattagatgtttagcgcttcttttttccccaaataccataacaaaatgtgttctgctacaacttccagaatatttctttcaggtgaattcaggtattatttgttctctcatcttccattggctaatgatatagcttaatttgggctctttaccaagttattaaactagatattgagctgattgccgaatcaggttggttctcttgagctgcaaataaaatgagggagtaatgaagactacctatattcctgagcaaattttggactttggagacatcctgaatggtggttccatacttccaagaaataggtgggtgactttatcctgaaattgatgtgctttcacactatctgtaatactagaataattatatccatttttcttgatgcctgattattttatttctataggaattgtgtttgcactgtattttgtattcctttctagatctgccttgcctgtcgacaatacaacaatatcttattagcatgttttttattgttggagctagatgacaccatgacaaagtgagaacatctttaggaaatgttctacatgaagaaatcctatagtattaaatattcattgccaattgtgctttctagttatgttgataaatatgtaattatcttgtctatctcttcattaaaaagtgaatgctgtcttgctaacttgctatatatatattgaatcgaaagctctgttgtctgttgctatgttttctggtagacccaatagctaaaggcaattccatacagaatattcaaaattagaacactcaggtagaagctgacataaagaagctggagttgttatcaagtggacttgtgcttcccacttcccagtaggatctaaatattgcaataataatatttttcagaaattgttctttgtttgaatagatgttcttaagccctgactctgaaactcttttcagtcggcctgtaaattgggaacaatgatctgtccttcaaatgtgccttcgcctgattagcacaactggctcatgaacattaaacttggcactcggcagccatttagtgtaacatgctaacacattacaaaaaccatatttggctatagctgataggacactgcaaatctgcaatattgtgacaatttaccttgggtcactattcattataatcgcatcatttccagctgaggaagtgaatatctccctgagctctgattgaacaccatcaaaatatcatttggtttggactgaatggtggtgtggttgacctccccagttttataaatgtattgcctatattttgtattgcagtccctagcatattgtgctttgaaggcctggatgcatgattcccctggttttactctgcatagaaatgagaagtcctggttgcaaagctgtttccagtgctgcctcttagtgaaagaaggaatgctgattcccctcttgcatacaaccttacaattgaaggtcagtattacttttttttttttgctgatatgagcacaaaatagttggcttaaatttcttccattttagtgacttgcttcatatcttagcatggaagttacatggtaagcttatatttactactataaatgggccagctgacttagatttctttgatttaagtagtttgctgcataaatggattatttgacttttcgttggcactactaatagttaaatttgtcattctctattaatccagctcagctcattgtgtttttttagtgtaatgtttttgatattctgggatcaatatatgggtgcgaaggggtttgattcttttttgattattttcctcaaacaaatgtgcaaaagaaaaaaaaaactcagctaccctttctatcagctaactgaaatacttctactgtgacccgcactctgggggatacccatttgggtacctccttgagtcagtgcagtaatcataaatcttgtagttatcatctacgtccttaagtttctgcttcccttcctcatccaaatcctgggtaaaccagctgctgtcattagacccttggctgcaaatccaggcagttttgtacggaatgcaggcgttagcttggtagttccggaagaatgcggtaaatggtgcttgagaccagtcggttttgatacgcccaccctgcgttgcccagtcatcggcatcccagatgctggcgtacagcctcattggttgatatagcgggaagggtatatcattccttagctgattcttcatctgccgaattggtgtgccatcaacaagtattctgcaacaacagaccaaacaaattaatttatgcttagctctaataaagaatacaccttcctagctgtgataaaacctttccacaatcgcttacgtataggacggtattacccaaatgaggactattaatgctgcatatataagaactgatgactctaggaagagaggtaacttacaagatcatctgcgggttccagatgatggtgtaggtatggaagtcttctgttggatcaaaccaaagccggtactgcttttctcggccacctgttcctctggcatagatgttagtgtgcaaggtgtagggctcaccggtggtgttccccaagaactcgagatcaatctcatcatgtatgtcccacagcccctcagttatcatctattcccaagttccggtacaaaggaatggttagtctaaggattcaaggtatattgcagtagcatcacttgtttcttacttacatataatgtggtgacagtgccggctgagtccttggcaacaagcttgatgtccatgtcaatcctcgcaaagagatacttagtctttgagcggaatgcagaagtagtccagcggtcaagggacagtgatacaatttggtggccagtgctgtcatagagcacctgtgtattgccccacagcatgtcaaggctgtcggtcatgtcgctgattactggggaggtggctaggatgagatacaaagctgccatggacatggagggtaggagttgagccctaggttgccccatggcttttgctaatgcgaagtgcctaagtgagtaggcagactgtggagtgtgctgtgttgaaatgttgtagactttatatagactcatgtgaagaggaaaccaggtgttcaagtctaaacaagatctaggtctgacatactattaccttagattcttggaaggtgtatgaactggacatcattggctgacatgaagaagtgggcataaaaaaaatgataaaaattggcctgaaccatagcttgagcaggaatgatccagcctggattctgtagtctggagttgacttactggttctgtcatccaaccaatttgcaagccgccccatggtggcttctgacgaactcacctggccttaagcaagttgaaagcttatggtttagagggttttagccaccatgcagtgcagttcttgtaggtaaattactagatgaactcaattatgaaatatgtgctcagttatggtctagaggtttttggtcgccacacagtgcagttcttgtaggtgaaattactagttgaactcaattatgaaatatgtacatagttataaagcatctggagaattgctagctttatgcagtcctgccacattgatctgtttacttttcatcaaatgctgattttcctcttcatggatgttcgtgatgagggatcgaactgcaactattttttgtggtcgattacattggtccatcaatgacttccataaagaatgaaattatccagatgtaaacagacatttaataagtgatgcttatctttgttaaacaactcaaattatgtgcaagtcagacaagcaagtgacctgtaaacacaaggccatctagtcatgcacactgaagtcccactgggaatttcacacttcacacgtatttgtaaggtcattgtgtcagtgcactgctgcttataggctagtttgtacataactatcttgaattccactgtctaaaaattcctataatactatttgatacacaggccttagttgacattgtaacaacggaagtcgtacctagttatttaacgttgtttgtgttgatagccgtgatactggcacgaatgtgcaggcattgtgagctgtaattttcgatatatgcaacaatagagtactaattctttatccctaataaacggtgcctgtgtttttaatactttatgtttctaggcagtcacatagagattgctttgattcaggttctgtttggcattgcagtggactatgagttttggttcaactgcttttatacattttggtgcttgtaaactgtcttctgtttcaatctaatctcaaatgataatatatagtgctatgcaaatatgaataaaaaaaagagtcatgacagattgataaatattttgtttagctttcatttgattcataaacaaaactacaaccgttttagatttatttttctacagcaacttttagaaaagggaaaaatatgcacagtgcaatatagcacaacaaccacgaattgagcctcaatactttgtagtttggattaacacctttcttaggggccatgttcaacttttgaaatgtttattcagttgatatgtgatagagtgggcaatgcagtaggctgttgatactctgagactctgggcatgcagaaaaaaattgcgatgacatttttatttgagtaaatttcacaagactacatgtgctttgtacaatctatcacaaaactgcagacttagtgtctccattatcacaaaactacatggtttaaccttgcccgttagatgcaccagcacctttgtgcgggacccacctgcagtctccggaaactacagaagtacatatttactcaaagcatccacatgctgatcaggtcaaagcatccgtgcagaggtaacacaaaagcatgtaggcgcatatagctaacacttgattatagaagcatcaaaatgcagaaatctaatacctaattactgatcgcttcatgagacttcaggtgggtcccaaacatcaggtgtcaatgcgtgtaatgggtaaggctaaaactgtagttttgtgataacggagacactcaatctgtagttttataagacaagttcttaaatttgtagtactgtgatagactagcataatacctgtgagttgcaacagatatcttttaagaaaaatagctcatcgtatatattctaaagcccacaataattgttcttattgcctaatattatcatcatgttacttttgcagtcactttctaggtgtctattgagctagagttctcagggtctgtggccttgggggttgggaaataggcaaagtctccctgtttatgggtcccacatggttattgggtacttgggtggtgattcaccaccactaccactaccatcttttacattagcacagatatagattgtgcaaagtacctgttgtcttgtgaaatttaatcattttcttttatggcagcctccttatgcacattatcctactgacatgtgggcccagacccaccttgtgagttgtgagtgatgcaacaaatgatttgcaaatttaagtttgcatttatgtagttatatttgtgagtgatacacaaatgatttgcaaatttaagcatgcatttatgtaattatattttttagtttatatagaagtaacacttggggtaatatggaaagaacaagataagttatacattgggtctggaactctaaataacaataagcaactttttattgagcaggttgaggatggaattgtatttctcacattaatattaaatgttaactactaatctttttgtgataaataggtttattgccaagtactgacatggtgatggtagtttggcactgctgcaatggactccagtgtaaaggaattggtgggatgatatctgctcattccaccactcttctgttatcaaaagcatacccataagtccagagatgctgtgattcagaaggaaggcatgggaggatgcacagagccaattgatacttgatagttgatactacctccgtccctaaatatttgatgccgttgacttttctaaacatgtttgaccgttcgtcttattcaaaaaatttaagtaattattaattatttttctatcttttgattcattgttaaatatactactagtactcaagtttttaaataatattcacaaaagtttttgaataagacgaacggtcaaacatatttaaaaatatcaacgacgtcaaatatttagggacagagggagtactacgtaaaggtaattaccacaatgttcggtcacgtgggttctgtgtgatgtgttactgcaggttgacaagattagaaaaggctataggggatgcagaaattatttagtttttaaagtatttcttagaggatcttggtagtaccttattgcccagggttactagctatatatgtggattagagagttgcgaggataacatgtaaaattattcaataccctgggatatatttattggtgcaaagtttaccttttatgagggcacttagatattcatcctcaaccagctacaattttcactagctgaatttctagccacaccttaatttctggaattagagatggagctctatagctcagcaggatctaattgtaacacacatttgcttccagaaatgatatgaatattgtgaatctttttactgatgaattcatgcgctttaaacttgaatcctttactgccatgctcactctccacatcaagaaaatggtaaccttcatggtcagatattatttttctgtagtgttgatatcaaagcatattattagaggacaagaacaaggcttaaatatttgttctggatacaaagtcctctgaaacacgctacttcctctgataataaggaatgagatgtgttttgcattcaatatctttgtggcaatacattgaagcacagcaaacaaggggtctaactgaaaactgctgtatttccaggttgatcttaccagttacatgtgaggtatgtaagtaatcaagcataatatttagtgatgcaaacacaaatgattttataccatgttattcatataacatccttcatatcttgtttgcaaattgcataattgtgtttatattttacactgacatctatgagttgactggcttttaattgcaactatttgcaaatgtttcagttagccttcacataattaacactagcttgactagaaagcctttacatagttagctcactgcacatgagttgctgatcatatttcatttgctatatgtacagccaacaatttattttcattttaaagtagagtgcttccctgatgcttcttgtaataaggaagatttaggtttcttctgtaagaatgcaatggacaatacatttgttatactgttcatacttggaaagaatgaaccgaatcatccaatacacctctcaccctttctatctgctaattgaattacttctagtttatcgtacactctttggggagattatctttgaacctcttggtgtcagtgcagtaatcgtagatcttgtagttggcatccacctcctgtagttgctgtttccgtgtcacgtccagctcctggttgaaccaatttccggagctctggccgcagagtggggagctctgttgtggggggcaagcgatagccctgtagttccggaagtatgctgtgaatggcgcctgcgaccagtcagtcttcacccgccctcccattgttgcccagtcatcggcattccagatgctgccatataccctcattggctgataggttgggtacgggacactgtacatcaaattgttcttgatctgccggatcagcttgtcatcaacaaggattctgcaacccaacagcattcttattgttaaggtttgtgcctttcaaataaatgggctgcataagatgattttcttgatactattttttctttctttctactacctccttttcatatgtcgctttgatttttttttctatgttaaacttcttttaactttgactaaatttatagaaaaatataacaatatttttaacataaaacaagaaactatcaaaatatatttaaaatgttagatttaataaaactaatttggtgctctaaatattcctatatttttctataaacttggtaaaactttcaaaaagttttgacttaaaaaaatcaaagcgacttataatacgaaaccgagggagtaacatttatttgccatgtagtattgcttatcaaataattgtgaaactggtactaattctgcacaatataagtttaactggataggttgggggagcttacaggatatttctttggttccagatgatggtgtaggtatggaagtctgcagtgggatcaaaccagagcttgtaccgcttctctctgccacctttccctctggcatacaggttagtgtgcagggtgtacggctcgccagtggagttccccaagaactcaaggtcaatctcgtcgtggaattgccataggccctctgttatcatctgttccaagatcgcaacacaagagaatggttagtctaaaagatctgcaagtgacaccaatgctaatacagtaatctgttcattccctggccacttacataaagagtagtcacggttccagctgagtctccagcaacgagcttgatgtccatgtcgatcctactgaagaggtatgtgctcttcgaccggaatgcggaggtcgtccagcggtcaagagtcagtgagatagtctgtttgccggagttgtcatagaacacctttgagtttccccacagtatgtcgaggtcattggtgaggtcgccagtgaccatggagattgctaggatgaggtagaaagcccacagggaggctaggaggtgagccctagcctgccccatggcttttggtggtatgggagagtgagcagagtgagtgggtgtgctgtgtctcaaatggtgtgccctttatagactgaggtgaagggagacttggttgtgcgagcgcgtctaaacaactaaacaatatctagcttgccagtgactttgattcttggaagatgtaagaaactgaagagaatcgtctggctgctgaataagttgtgtaaaaaatggtgatgaaagtggcttccattaaagccagaatggtgatcaagttgactaactggttctagggttcgatcttggctccaaatctgcgagccgtcccacggggtcttctgacaagctaaggtggttctcaagcaagttgctgaaggcttatgttatgatgacaaaagagttttaggatccctttggccattgtggtgcaatctgtcactagatccacataaaaggtaattattagttcagctataaggcatctaatcttgcttgctggtttctcatgttatatgacatctactaggttgtgaaaggctggaagtacacaaaaatgatatgcagttacaagttgtttccagtcaatgccttcggaacagttaccaatgatttgctgttgttcaactcagtccctcattattgtcaggtttgtgcagctccaatagatatcagtcgttcctcagaggaatctttcaaaggagttactcctgactggtggattaatttgattgatctgatggtttttgtgtagaccgacactctggtctagaaacccaactaatgcaagtgacgcggtgaactgttcttccatagacaaattgatctgcaagtcagaaagggtaagtcagttgtggattacgaggtgatgcataccaaaattccaccagtaaattcagacctccaagtttcagactaagccctatgtgcggctgtgcactcatattcttttttcatggatgctcatgggaacaaaaccccagaacttgtgctataaacaatttgcaaatttataacggtacatcttagtacaagttcatcacatatccgtactttgagaagctcaaatgttgtcttgggacaaagtcaactggatttgctttaaatgatcgtaaaaatgtcaacatagcacttgtttgagttaaatctgatgtttgcttttgtatttttcccaaattgaaacaaatcttttgcgcttactgcatcctgccgtaccactcatgtttaagttgtctgatttttatctgtattttctgaataaatataattctcatatacatttttgttctccaggatggtaatgatactaatgaagtatggaattaatcactgaagttgttggggctttgattaattgctggacaaattatactactgaattcaagtaaaaagaaaactataccactgaaattacaccaagcatctggtgagtgatcgcatcaatttatcaattcttttcatgtgtttctacaatctctgacaaaagctacatacatctctgcatcttattcatggatcagcatttcttcattccatcttctggaatttggcgcaggatgccagtatttttcacttgccagtttgtcattcttacagatcttgcgttgactccacttacagtcagtgtgccattttattttaaccacatgtctgtgtagaagaccgtgaagcttgcagcttgcaggggcttgcagtattaaccaaattaacatggcacatgggccgtaatttctcgatgtacgtatttcctacctcctctagttaatggctactgtttttttatatgtgtgagatcgcatcgattcatgctgctgtgatttggattagtaaaaggcattttgatcaggttcgtttctggctttgcaaatgtctaggcacatgagagttgtcggcgtcatttctgtcaatggaagatggcaccggcggtgcttccggtgccaagcttggcatgtgtacgtaccgtatgctcagaggtaaaggaaactgcgtcttagcttccctttgtttaatacggctcttctcggaatttattccttgggttttatgatatgcttgataggggaaaaattactttcaaacaatattggatatgagcatgatttgccaagggatttaacgagtgaagggcgaggtcggttatgtctggtacccgagagttttcactccctctgttatttttttatttatcgtttaatttgcagatcgacaaatcgtttaattcacgtgtttgatcagtatatttttacgtgataaaaaagacattttaaacacagaattactaaactgctttttgaggtctgtcttccactcttcatacatgatgactacgtattgtgagtcagaaatatcttttggttttcggtcgaagcccagggcggtccatcgaaaaaagctgggccatggtcttgattcttttttgggctgttctgctcctgcacgatttgagtcttggccaacacaggctacggccattttaggtctctcaattaaggctacatccatagtccattttaggaggtttttacctgtatgccattaagaaagatggtgcttgtctctgtgccactaaaaagttcgagcctccctctatgccatcgttgaactttactgcgctctccacaccattccgtcactattttgttaaggttcacctatttggcagctctgacatgtgggggctcgcgtgtgggagggtaaccaaggacagcctaccaaaccctctctacctcatccaccaccacgtccaatccttcggtccttccaccctatccgtgaggacaagctcggccgccgcgtccccgccatcaacgcggtaccggcgacggaggagccagccgacaacgcagcgatgctccatccgttgtagcatcctctcaccaagctcacgccgccgtggcgcccagaagctgctaccagcgctaactttccccaccaccatggcggtcaccgcgcatgctccgctccgtgtggcgggctcgcccgtcgccgctggcgctctgctccgccgccactgctctgctcgccgaggccaccctctctctcgcaatggcggcagcatcatcaatgtcatggcttcctattcgactatgcgccaaccgccacagtgcctgcctctacttccatgcccaccgctgtggcgccatctgctcccggctcgccattgccacgtcaccccttctccagtttcgccgcgccaccgcaccgcccgtcgccgcccgctctttcccacctcaccccaccaaccctatgaggagaataatgagaaagatagagaggaggaagggagagaagaggggaaatagatgacgacgatgtggtgaccctgatgtgtggggcccatgttgagtcagctgccacgtcggataaaaccggagtcaaaaccgtcgagggacctagtttttactggttttgtaagttggaggatgtgttgtatccggtgttgcggttgggggacgattttgtaactcgatgataagttgagggagcttcggtgtacttatccacaaaaaaaaaaaaccaggcgtgaactgggcctgcagcagcttgggctcgatgcccaggctgcggacgatgggaaaaaaaccaggcgtgaagagagaagcccaacccgtggcttatgggacgatgggaaactggagccctcgatctctccccctcaccttgtcgcttcctcctcccccgacgccgccgcttccccaattccggctccggcggcgagcagcaggctgcggacgcgccgtcgaagctccaggaggatgtggatctccggtgtagtctccgtggcatgcctacatcggcggcgcgaatattcagcaccggcttagatcgatggcgcccctcgccgccgggcttccgtggagagcaggtatgcttccgcctctactcctaggtcggtctgcgccgctgttctttggctccgactgaatccatccaacaattagttttgtaccatatcgccgattctgagacaacacgacctgtttattagctcgatttgattccattccatcgccaccccagaggcacccaccccgactgcaatgggcagcggtagggcgtgtatccgcactaccgtttcagctgcaaaaaaaaaaaaaaagcagtgaaaagatcccctactggggcacggcaggcgaccccctgccaaaaagatgccctatagaggcacacagtcgggtctctcggtggaggcagcgctagacactagcgcttggctttttgaaatttgtaacattagatttttttcccctgttgaactcatagctactcatgggataattgaaccaattgcaaaaatagttcgattacttcgtaacactcctccatatacaacatactccatgcgcacaataatctgaaaaccgtttcataagcagagagagaagcttaatgtcttcaaacattattaagatagggtaggagaggagatgtgatagtatatagactgatcatccaataatttcagtagatgtttgactgaaacatccaatattttcagcgagttgtctgaagatgtgaataccaaggttccaaatgactagcggcaagatcaggtatgtgcagacgacctccgagactgaaccaaactcatccaggcatggaatgcggaaaaaaaatagaccatagctcatctcggcatgaatgaagaatctcacattttgaagagtctttttgatgctcagggattcatgtaagcaattatttcttatccctaacacaaataatttgtctcggcttttgtttctgaaaatgatattttttttccatttttctcagagtgcaattaatcacgatgccataatgcatgctaatgatgaccagaagcttgacgccaatcggaagtcatgatagttttttttggttgctagttcgactggtaagagctggtgctgccgagacaccatcctcagtgttcttgaagtttaagtcaacactcaataggcattggtttatttagttcttctcagccatcagaaacttcaaatagcagggccaaagtctgcaaacttttaggtaggatgcacttagaacatctcttgcatattcgctacaaagaaaaagatgatctagggactagcttctaatcacacaccaagtttatcatagaaaggtcatgcatcaagctcttctactaggaacattatcatgcaacctcaagtcctaatttaccaatatgcaccttcaggcttcagccagctcaacaagcattaaccaggcattttaagaactccattatgtccaaggatatgctgctatttaagaatctgctgaaggaaatagcaatgttgcaaagatgcaaaaatgatgcaacatggatgctcaaaccttactaccagtaattttagctgtacttgagtggaacaatatttggctaggtctggtgtgctgcataaattagtttcattcagataggacatgcaaattagagatagggggaatgtttccaacatctttttgaaaccttttggcattgctgactgattctttttgtaagaaaggaacaaatctgaaacaagagcatgttaggtgacatgtggcaaatagatgaatacaaacatttatcaccggaaggattggtggcgatttttttttttcaaaacaaacttgtgggaggactgcggcaattcgttcttcccccaacttgtagtgttatacacgaaacatgataggcatgttgaagcatgaaaatacgtccttcacactttgttttttcctcattttttagatttccagctgcaacaaatttggtgcaaaattgcttatggggacctggttggactggtgaaaggaagctcaaacaacaatctttatttaattttcgtttgctttgagacaggaagaagtaactgaaataactattccctccgtactcgtaaaggaaattgtgttggacagcgacacggtctccaaaacacaactttgacttcttgtttctataaaaatatttattgaaaagtgatatatgtatacttttatgaaagtattttttatgacaaatctattcatataatttttacattttcaaactcaacaacttgagagttattcatgatttatatttcgaaagtttgacttaaacattgtcctaaacgacttctaatacgaacgagtatggagggagtacttgactaataccaacatttctttatcatttaatttttttttgtcttgattgccaatgcagggccttgttattcagctttgatgtttcgtgtgttcgtttcacctatttcctattttacattttcctgatactatattatcatcgaccttgttgtctagcaccaattctatagccaaattttggtctgcatttcaatcacttgggttcaatcacttgaccagattacgccattgacttttatgaaataacgtttgattatttgtcttatttaaaaatttggtataaatatgctaaagaataagtcatactgatacggtatcatctatttaaaaatgagagtactatgatacgatgaggttttctgcttcgaacatcagatgctagatgacagtagatgctagatgacagtggaaacccttacggatgttaattttctatgcccttgtttagttccaaaatttggtataaatatgctaaaaaatacctgtgcgttgcaacgggtgaaggctattttaattttattattgttatatggtttagttaaaatggaattcactgtgagagttaggttggatatatatatttttagaaaatcatgagctgcagttaagagtagttagcatgcgagttcttttttaaatagatttcttatatgatttcttctgtattactaaaagcataacaataataaaccatataacaataataagattaaaatagatttcatccgttgccacgtacgggtattttttctagtaatatgtataataggtaaagaaatacaaatattacatatttaactggtgaatcaccaaagaaaataatgaatacagttaaaagtggcttagtgaaaagggtacacaacacaaacgttacatgaaaaacgcatgggttgataaaattatcaaattcatcataaatcatgtacaggatcttctcccgtttatttataccaaaaagcagagaatacaacagaaaaaaaaatcattaactatttagctgggaaggagcaggaccggccaggcaggaagaagcccaagaggcctagggcgatgggcagatggcccagctggtaaaaaaaaaaaaattcaggactcacgagcgcttcctcggtcagatgcagaacagcgcctgtacatctccgtctccgagcgacgtgcggcaaccaagccgacgcgacgatggataaaaaatgggacaacgtacgaaaatttgagggcaaaaacaccttgcataaattaagttgcaacaaaataaataatatttatataattttttaataagacaaatgatcagacaaaaatcaaccaacggtatcatctatttaaaaatgagagtactatgatatgacgaggttttctgcttcgaacatcagatgctagatgacagtgaaaacccctacagatgttaattttagttctaaaatttttcttcaaacttttaacatttccatcacatcaaaacttttctacacgcataaacttcttaacttttttgtcacatcgttttaattttaataaaacttctaattttagcatgaactctacacaccctatgtctacccgtgttgctagtcgtcctggttttcttgtacgtcaaagaagtgctgctagtcattaatgattgaccccctatgttgcagttactgtttggaaagtcgtacctcatcatgctcaaatgttctgcagtgtacaaagtagtgtatgaatgcagttctctactactatcacagctcatgtgaaatgggactccagctgagaaatgcaggacatggaacttcgattcattgcataagccctgcatagatatttttcaaaagatttattcatgatgggcctccctaataaagcagcggacggtcctagagacacatggcagaaatatcttactatatactagtatttagcaagtaaaaaaaatgcatttaactttgtgttcgttcaataattaaggagacgactacacgtcggacatccggagatttgtaaaactccggacggtgtttcactacgtgttaaagagatgtcgcaatgtttcattgtttcaaaaaaaatgtttcaccatattttgcaaaacgtcggacgttattgcacgaaatgtttcacatgttacaccactcgatgaaaaatgtttcaccaattaaaggaaaatgtttcatcgcttgaacgaaattgtttcaaccaaatacaacattcgaaacacaccaattgcaacacgaagaattgatatatgcaacatcaaatcaaaagaaaacgaaacaccttaataaaataaagtgcaatagagataaataataggctgcaacatcgttaaaaatccaaacaaaaatgaacccacctttgttttcttcatctactccatccgccgaaatcaagttaatgatgcagcatgggagaggtaatggctagggaagaacacatatgagcagcctcgtgagaggagtgaccttagccagggccaccacatctgatccacgccgatggcaagtccagtgtctccctccccgacatcctcacgttctgccctcctgctgccgctattgtgtgggcaccggcgaggtcagcatcttcttgctatcttgcatcaccttgccctgccgctgcagccatggatgcctccgctatggaagaggtgaataccgtaccgaggaggaggaggatgcgaggatgtggtggcaacaggagcacgcgacggggaggaggaggaggaggaggaagaagcaaggcatgaagagagccaagaacacaagcaagcgaagagccgtgtgctcgatggctggaagtttcgaggaaggagggagagcgagaggaaaaaagttaatagaaaagatgtggaggagaaggtagttggagttttggataaggatgaagccgtccgatatttcacatgcgctcggacgtacgtcggaaagcatttttgaataattaaccctaggaactgtaccatttcaacaaactaagacaataatttggggagggataagtcagacttttcccaaatccaaatgataaatgactgattggagggacatcaaagaaatgtaatcctatggcaagtaaaaaaaaagaaatgtaatcctagatattattttcccctgtggctgtgttgagaagagtttaagattataagaaaaaaactgattgaatagttaagtttctaataaactagaaaagttagatttcataccttcttgcttcttgtttattttctgaattttataacatagattctaattaggttacgttctttagtctactttccctaacttcactttcctcgttttctaaatggcgtgttttttttaaaaaaatttctgtagaagagttgcattaaaaacttcatattattactagccacattcgtcacccattgcgcgactatcatgacttttttcaatctctatatgtggactatggcatatgccactaagaaggactatggcatcctctatgtttgtcgtcaattttacattcatatgttgaataaattttacaacatttaatataacctaccagtgcatttgttatagtaaattcattttttactatattcaccttgttgcaaaccccgaagctaagagtttgtttatagataactttgtacttattgtatataaattttacaaaaagaattatattattgtatataaattttacaaaagaatcacatgtttaaggttattcataataattgcaagaaatataccacaaagccatgaatgcattatgaatgggttttcaatttttgtgtttgtaaatgattgagaaatgatattaatatgcatccgttgacatgtttaatatcttaaaaccattttttatttggtaaattattaaaagtggtattaagaaaagtaatctgtctagagtggtaattatctttcataaattagaaactcgcatataaattatctcttaccgtaggtaatttaccatgggcattaagattacaaatttaatcatgtttttccatttgaatcataatttacttgaatatatatatatttttcttcttttattcaatataattttgatcctcctatcttttacctttgttatatctcctattctatttttgataatcatgttattgcattgcaattatatttttcatattttcaaatattttactctcaattataaaataaccagtgtcaactcagtctctaatgcgttaataaaataaaaacccttaaattaactaacttcctttctgatcaaattacatcatgtgtaaacccaatagctacggtctatataatagtaacaggaagcttagtacgtggcctttttttttccatttgactataggtctgctactatgcttcctttctctagatcctttcccaagacctgaaccctgacctgggtcatcttttactgtccaatcctcactctagatccgacgttatctattgaatgcatgttgcatccaacggctctgattattctgatgacgtggcaaattgtgatgatgagaccacttatggagaaaccatctttactcccggttggaaacccccatttaatcccggttttccaaccggaagtaaggatccaggactaaagatgtctctgttaaaataaccgggactaaagatacatctttagtcccagttggtaccaacaactgggactaaagagaggggatctttagtcccggttgatgttaccaaccgggactaaagagacaatagcggcagtaccagatggtcgccttttctttttcttttttcctttttattttctctcgaatcaagtaggcaaatccccaaatcaatcccccaatcaaagcaacatcccaaattcatatcaccaaatacacatcacaaatcataaagttacttatacacacaaatcaaatacatcacaatatcctaaaaaattactcaaatacatcacagatccaaacaatgaatcacaaatttgtatatctcagcgaatcacaatttttttttaaaaaaacaatgccgatgctaccaccactc

SEQ ID NO: 62259 - DNA, 34741 bp, Oryza sativa
cgggactaatgatcaagagtaccaaccgtgactaaaatggtgatatttagtcccggttattgacaccaaccgggactaaagatcctcggccccctgacatacatctgacagggtatgaaccaggactaaagatcaagatcaaaatttttatctttagtcccggttctttttggaaccgggactattgtggattttgccagaccgaccaaagatggtttctccaccagtggaaagatgaatcctttcactactttagattttttaaatttttagctaatatttaactaaatatacgctaaactgttgtttcgttttgcgtgcaatgaggaaagtgttttcaactccaactgacgaacacaacctacagctggagctgtgccaaacggtatagattctctattttttggagcggagttagtagagctgctccacaaatttgtactacgggggtggagctaggtttttgctactccacagcttcactccaccgcaaaagacccactaccctttaattttttagtctatttataccaaaatgctactgaactaccccttcctaccccatctcccgttctcgctcatccccatcttcatcccttgacaccggcggcgccgttggtgtcggcagcggcaggcggtggtggcaggtgttggtggagtggcggcgagggccacgagcggcaacggtggcgggagacggcacgtgggcggtggagtgtggtcggcggcggcagggcgaggtgcgagagtagcgtcggctgcggcagcaggcagggccatgcgcgtgcggtggcggaggcagtggggcgacaccaaccaggtgttcaactaaatgccaacaagggacgtgttggtgtggagctaatcaatctagccaaatacttatatacccacttcagctcctataggagctagctatcactggagttagagtttaaagttgggagttggagcttggagtcctactaaacgggcctaagaatccggataagaatattgatcattcgagagctagaaatttttggagaaactgtggccgctaaaatctcgtccagatagtgcctatagtaacctgccaaataaagtattgtagagaatctcatccggctgtcaaggccatctggccatgcataccaaatcttttctcaacagcaaaccaatatacggagtatagtaagtactagggtcttataagagtcgatactcgctcttgctgccgccatggcgaacaagggaggagagccggcagcaagagcagctgtgcgccatggtggaggccccgtcgcgttcaaggacgctgtcgacgtcgacgccacgccggtgcgccctccgacggagctcgccgccgccgtctccgccctgccggcgggcgtctcctacggccagccgatgcgctgctacggggggacctgggtgttcgagagctgggcgcagggcgtggtcgccatgcaccgcggcggcctcgtgccccgcgccggcgacgtcctcctcgccagcctccccaagtcggggacgacgtggctcaaggcactcgcgttcgccaccatggcgcgccgcgcgtgcccgccgccggcgagccccgaccacccgctccgccgcctcaacccgcacgactgcgtgcccctcctcgacaggctcttcgccgccggccgcgacgcgcttctcgacgagctgccgtcgccgaggctcatgtgcacgcacatgccgctctcgctgctgccgccggcggtggctgacggcaactccaacaccaagatcatctacatttgcaggtacccataaccatagctatagctagccatcccttattcgttatattgttattggtactccctctatcccaaaataagtgcagttttgcactattcacgttcaacgtttgatcgttcgtcttatttgaaaactttttataattagtatttttattgctattagatgataaaatatgaataatattttatgtgtgactaaatattttcaaaattttcaaataagacatacggtcaaacgttggacacggatatccacggctgcacttattttgggacggaggtaatattattttactaaggggaatcttagttttgaatcatatccggtcgttttcgtttttgtacaccagccgaaatttatacatatcagattcaaatattagctgctctcatctcaaatctcatgtgtgaaaactttaaactaattttggaaatggtatgtatttctcccttaaaaatgagtattttgccatatggccgttaaatagagattttttatttcccaaagaaaagcgttaggaagaaagatggtacatgaccacgtgctgtgctatgtgtgatacaactgcgtagtattattatgacagaacgggaccctctaccaaatatggtgatgtagcatgtttcctatttggttattgcaggatctagattagctggtactttgttgtcattatttaacattgtatttttctataagtaaagtacataaaaccctactattatggtgtaagttacgtaaaactataaggattttgatacgtggcacatcacaccggatattatggttctaaaatttcataaaaccgtactattgaacattttgatttttgatcaaccacaccttttagttctacaattacaatttaaatttttgagaattttattcatcatataaatgttttgtccactttttaaaatcttgatataggagcacattaaaatggttacacataatacttgagattatgtgtcacatgccaaaatctctatggttttgtacaacttgaaccataataggtggggttttatagaatctactcttttctatacaagaagataaacgcacaattacaaccatgaccttggtaagagccccttcaaagcaaaaagaaatccccttccacacccactcccctccgtctgagagtcatccttgcagtattggtagatggtgtctttcactggtgccattatcctcctacaagagttcaaggtgatgaggtcaaataattggcttcccttttccttatatccatatcgatggagaggcagttcatgtttttctatagtgtcgcaagcttctagtccctctgttctgaaatataattatctttgccccctcttgtatgtcccaaaataagttcatctttgagtcatcattgcattggattttatgaaagtaggggacaaatgcattaattgtaattaggtaagtaggggactgataaagtagagggtattctagtctttttgctttgtattagtatgcaagagttcggtgaaaaacaaacttattttgtctcccttgcaatgagtcatgatgctctagaccatggtgccctttgagaagtaaagagccccgtgtctcgtgtgttagcttgttggacttgttcaacaacctcgatctctaccctaggaaaaaaatattgttcttacatacttgatccaaacattgtccaaaatttcatgaattcgcaaaagcaagtcctggatacaatatgtatatttagaaagagagaaattgcaaaccaaaatccaaaacatttattcacatagtattaactttagtgacaatgaaacattgctttactctagcttgttatattttgtagggaccagaaagatagattggtctccatctggcactttcggaaacgcaatgtgccagatctgttgctccaagaagtgtatgagtctatatgtgatggcactgggtttgctggtcctgtctgggatcacttgcttggttactggagggcaagcaaaatagatctaggccgagtgctcttcttgaaatatgaggaggtgcttcgagacccagtgaacaccgttagagagctcgcacaatttgtcgggcagccattctctgacacagaggaagaagctggcattgttgcggagatcgtcaagctatgtagcctagagagtctaaggagccagaaagccaacaaagaaggcatacaaggtgtgtacatcaagttctcgcacgactcgtattttaggaagggggtggaaggggactggaggaaccacatgactcctaagatgggcgaacatctggattcgattatgcgagaaaagtttgatggatcggggctcaccatatgatgcgccattatggccggggtttcatcttttaatttgtagtcacagttttcaagctatgtgtttcataataaaacaaagcctcctagcctgtttggaggcttaactttaactgtttatgcttataaacaggtacatctatgacctatgtaattttcggtgcaccaaataaaatccttccgatgctacccatcgtttttgtcaatcaccataggcaaccatcttttttgttaattattgtaattaacctctgtttaggtaaatgctgcagttacattcgatctgtcactactataggaactcacttttgtgtcagttgggaaccggtctttggtgtcaaattcacaaccggcacccttcatgtgacactgatgtggagaatggtctagaaattggtgcttttgagattccatgaataaaaaaaatgctcgatgcatcggctcgaatcgaacatatgctacgagccaagaacacatacaaaaactgaatggaagattctcacaaatccaatgacaatgtatcagaatcatcccagaaattacacacataacattcacgacctcccccctcaaagaaaaaaatatttacaaatcaacacaaggatgcctccattgcctcatcccagcggagaccaaggccaccaccacccatcggaggccaaagccacctttgccgctactgctcaccaccactactcagatccagaagaccacagtcagatataaggggtggtgggagagatcagggaggggaattttttgggaggaggggtattggttagtcatgtggatcgccaccaccgctgcttgtggggaggtggggccgaggggaggatgctgatgctgtcccaccgaggggaggtcactgttgctcgttgtcgctcgtcatggtcgacagtgataactaggggagggaggagggcagatctagaggttcctgaactcggacaatctagatatggcatcggtgccaccgccatcgccaatgacgatgaatccgtctgcgggaactgaggctgtggccatggtgagaggataacctaatggcttgttcgccgcaatcgtcgtgtcactgggagaggcaggctgccgcctttacgtgttggggtgtcatcgtagcgtcgcaggctaggatgctgagaggtggagaggagtaaagagtgagagacaatgagagaaaagatgaagattatcttaggtggaggcttagagggtttgagagagacggatataagaaaggaatggacgaggtcacgaggagatatggcgtatgtctatgtgattttttttccgctggtgctgctgctccaataatgtgccaaaaaacctagcacatatgacatctttatttgtactgcttttattaaagaaaatcaggcacttgtattatacgtgttggtttttagaaaaattggcacgttataggtgttgatttttaatttaagaatttacgaaggataggaaaggccttgtagatagaggatgtccccaatttgtggttttctagtagtgtgttctagggatcttgcagcgtatgctggagcttgtaactagcttaattaccaccgtacttcctccgttccacttcgatcatcatttttttctctctctcatttttgtatttgatgtatttattttggagcatgttaaaaaaggtttaccataatacatcttgatttgtcatctaaatcagcagttttagctatatccacgcacatgtgccaaattaattacatgtgccaaattactagaacaaatcctgtaacacacacatgccaatttgatacacaaatccacgaacagtatgcaaacagctgctttgcctccacacaattagtaagaataaaaacatagctcatgaaaatttagatctagctatcagtgaaaatgggaaaaatagaagccccaactcagcggaggcgcaatgacatgttcttcatgtaggctgcgagcagtatatactccctccatcccataaaaaaccaaatctaatactggatatacttcctccatcccataaaaaccaaatctaatacgggatatgacacattttagtacaacgaatctgaatgtatcacatccagtcttaggttcgttttattttggacgggaggagtattttttttaagaaggatattttttacccggattctgcatccaaccggatatatgcagcctttttaaattaggaacttagcctatcaaataaggaacttgccctctaataactcaatctaaaattcgctcatatggaaatttgaagttaggaccttgggtgctactcagatcactgcaaccactaggctatatgccctttcacggacgggaggagtatatatcatctccatattaattgcagatgtgtgaattaattaattacttccctccctcccttaagatgactcatcatatggggcttgggcaataacactagcatacttagtaatctatattaaatttataaatcctgtataaacttataggatttataggatttataggatttatgacttcataaacaagtacatggatatggcataaaggcttccattgtcgaagacctggtcctttattcttctcaaaagaaagaattagaggttgaatttttctagcttatatttcaatgaacagtatactggattgattgttgacattacacttagttagtttagtcatcttgaattgggaaatatatatgaagttagttgaattcttaagtaagctgaaacagtttgccttaatttactaaatttgtcttagggtgcagtaatcattgatgatagacttctagaaagcattttatatagtatgcgcatctctccaaagcaaatgatatccacagccatcttgcagcaatgtgtggggaatcattatgtatttatgccagatagctagtccattatcccattacatcagtaaccagagtaactctaacaattaccaaaatacaagctacattgtgattaaccgaattagggaaattacaattaaagggttttccttggtgccctggaaattacaaagttataaccgttttacaagcataaaaggttacagactatacttccaaacaacaccattatttcaatacatggagaaaaggttcaacaagaaaaaaaacaatccaacgttttttgcgtactactatatattgttaagcataaattaaaagacgaaacacacgtaaaactaaatgcatattcagatagtgagtcctgacccatcaaacttgtcccggagaatcgcatccagacgtcttcccatctcaggggtcatgtggctcgtccaaccccctgccacccccttccggaaatacgagtcgtgagagaacttgatgaacacaccttgggcgccttccttgttggccttctggctcatgagattctccatgctacagagctctacgatctccgtgacaacaccagcttcttcctcggagctagtgaatggctgcccgacgaactcggctagctccctgatgctgtctgttgggtcttgaagcagccgctcatatctaaggaagagcaccctgcttgggttcgctttgcttgccctccagtactcgagaatgtgattccaaacagggcccccgaagcatgtgccctcgcagaaggactcgtacagattttgtagcccattgcgcttcaggaagtgccacatggagaccaatgcatccttctgatccctgcacatgtacatttatatgttttgacagctccttcttttttattgcaaaaaaaaggaataagacttaacaatggtgttttaacaaatagcaaaatcgaaaaactacgtaactacagttcaaacctggttaccacctagctagttattgcattggacgaagattatgaggcatatctgtattttggggtacctagctcaattaaggctggacattatatgttaaactttaatttgtctttagatcgatcgatgtgctctttttttaattacacatggcatgctgcagtgattatattatagtgttcgatgtgtgtgctctaatactttattcacgatgcaattatcaaattgtggtttggatttttgatgaatgataggagtaaaacattgttgatcatgatgtgttccatgaaaacgatgaacatatatcatatgagaattatatttgtcacaagcaacttgttaatttttgcctttttatgtctttcagtgatctcggttcttcgcacatgcaccaagcaaaatttgaaaatggtggtattattccatcccacttgtttacattaacaatcttagttaattatcacttcatcatggtacaaatataatgggccgcaaattgaatattatatatatcgacatgtctatctatatataccacacacatatacagaaagagaaagagagagtatgtgtataagatcttatgtatttactcccggtctgttgatgagagagattaaagaggaatatatgtgcccaaattatggctatatatagaggttgtttaattatatacaccctccatttgatatataagtagtttgacttttttattagtcaaatttctttaggtcacatttataacattaaattagttttattaaatttaacattgaatatattttgataatatgtttgttttatattagaaatatatatatatatatatatatatatatatatatatatatatatatatatatatatatatatatatatatatatatgagggcatatcaggtgcaaacagggtaaatgttggaaatatgcaaaccaaccgttagatcctattccaagggatgagatcataatgtaccccttccaactgtacattttacgtttaccaccccacttaacatatgttttactgaaaatatcaggaccatgttatcccgctctcaattccaaaatccccacctcaattctcagctcctctccatctaaaagaaaaggtctcaccctcagctagtcccctaccccctccttccgattcgaactgatgagaaatccccacgattatgtgcttccctgactccctcgagcttcctcctcgcatccaatcttcctcctccattcctgctccagaggtatggacaaaagctcaacaagtgttcatctagggttagggtttggggtggcggtggcagatggggctggtcttcagtcataatcgaggtgtgctcccatttgttcttgacctgatttgttccttatgcatttgatttgttgtgttcctctgcacaagcttgcccacttgcattgggtgcagtagtgttcttttgttgcaacccatgattggggaagatggagaagatggagaaactcacccagggacactttggtgacgagggggaatccctggccaataaactcacctcaagccggtaggttgtttgtcatccatataaaaagactacttctcacaggataacaccagagtaatttgaaagcttttagacatgcattgatcatacaaaagaagaacacaatatctgcataagatggtatgccccaattatcccattcttgaaattatattatcactagtgctctagagctatcagtccccaaatctctcaactccttgaaaaaaaatcaaatgagtaatcttaaacagtctcatcttccatcttctttccatcttccatcttcttttcaagtcaacatcctcctccccacatttgaatcttcctatgcacaatttgcagatgttctctataggaaaaaaaacaactattccttgtgagacacaaaacaaaattcaactgctactgaatgtttctcattggcatgcccagatgtagaatgtttcttatttgtgatcagatgcacatacttattcatggtatgttgttagttgcacaaagagataataggagcaacatctcgcgtaatcaaattaaacttgtacatgaatctttttggatagatgcacatgcatttgtaaaaaaaattatataataaaaagcacaagcatccagagtgactttcccaaatagagatccatatacattttagaaactaaaaaacatttcagggactatgatgtgtgagttacatttatagaattccagcatgcaagcaatattctcatgctctccctccaatcagagaacaattccagggttattgcacatttctaactaagaaatcagagaaaaaaaaccaagagcacttatgtgctctccctccaatccttgctctacctcaccaggctccaatgcacagatccatcatcagggagaagagaataccttggcccagatctggttgggacttgattcccttcgtagccctgcaactcaatgtccaggtcaggggagcggtcgggggcgaggttgctaacggccttaggggattgggtagcgccgatgccgttcgccatcgccaccgcggaggatggattcgtccacctgctgagggaagaaccagcagaggaggaggaggaggaggatggagaagagacggctgcggcggcggcggcggggtgaaggtgaaggcggtcttgaagcgcgccgagatggagtggctcatggcgcagctcaagaccggcgaccgccgtctcgctggccataggagtcgaccagtgagctttgttggaacaaatcatggtagcagtacattacaagatgagagggatagaatctataaagaagatgagtatagggttttttttgtaacatatgcagccaggtgcgggcggttttctgcaaaagtgcatccaacaggtgagagagtggatgggagcttatcatggtcgttcagattggatgcaacggtggagattagtatttccaagtttgcaacatttggtgcattttcacaggatatggcctctatatatatatatatatatatatatatatacacacacacacacacacacacacttataaacttaataaagcttaagagagtttaactaataaaaaaatcaaacaacttactccctccgtttcaaaatatttgacaccgttgactttttagcacatgtttgaccgttcgtcttatttaaaaattttgtgaaatatgtaaaactatatgtgtatatgaaagtatacttaacaatgaaataaatgatatgaaaagaataaatacttatttaaattttttgaataagacgaatagttaaacacgtacttaaaaaaatcaacgatgtcaaacattttgaaacggggggagtataatataaaaagtgtggtgtgtatctgtccgattaattacctgaaggacacacagtagctagcaactttggtcgagctagcccatgcatatatcagtcccattccgtcgaccgtccttattgtagctaacaaatatccggtacacctaattgatatgacaacacccagtcacctacttccacgttaattgtccaattctatcacgtagctagcacaagtacgccttgcgctgtactaacactactacaataccctccagtcgctctctccctccccgttctctctctctctctccccctcatcatattttgtttgcacatatatataataacgacatgattctatatattcttctctgcccattgttattcatcacagaaatcacaattattaacactactacaataccccttattgatatcgattcataggtgtcggtcgacatttaaaaccgttacctacggatattttctcacatttgcacgatgaaaaaaatatagaacatacacctttgagtaatataaatgtcagttctaaagaaaaaatcagcataatattttcaaatgaactaggacctataatatattgtaatatattgtaggtactggttaataattaaaaaagaacctataatatattatatgaactgattttttaattaactattacccataaaattgacggagccaagccactttcttatccacatctttcacacatctatcctcacattttctccctacttttctccctaccccgtactccttgtccacatcttttgcacatccccaccacacgggcctctcctcctcatccatcttcgtccgccgccactcctccctcctctgcctcctcttcctctccctggtgacgcccctccaagtaattctgcccctcctcctcaccactacctctaagccatgctagatccggccgcctggaggtcggggtccgccgaatccggctaccacgcagcagtagcaccgctagaaggacctgtcaacgtggaactcgctggtggcaccggggccgagaatatcgacgaggacagcgccggcgtcagagccaatgccgaggatagacaagcggcgtacggagaagagtggcttctgccccgtcgcagcgccatccacgagtaacccgtcctagcggtggtgtaggctggggcagcggcggtggacggtgagcacgggcttgagcagcgcaaggtcccgtgccactgcacaccctgccgggcctgtacatctccaccctgaacgtcatcatctggatccatcctccttaaggggatcaagcgggagcagcaccggtttgtcgagaggcagcaactgcgatgatttattttattctcctctctgtgtattctctattgttctttgatattgattttgtatcttagtgttgatttcgtaattgtgttattggatgtgatgaggggatcttataggaatggttcttggatggggatcagtagctgctcgatgtcgagcaaccttgctttatttgttcctcacaccggtgttaggtggtaagaaccgacacctatgcgcaactgcataggtgccgactacggaaaccgatacctatgaccagtttctaaccggtacctatgacagttcaagcaatattgtaataagggcatcaggaaggcacggttctcattgttccctgtggtatatctatctgtttgcaaagttatccttatttcatagataagaggtgtaacaatgatatattataacctaaacttaaagtaattttacaaataccatgaaataatttaattaacaattggtaaaaaaaacaaagtgaaatgcaaaaataaagtaaatctatatactactacaatatatttttgtagttaaaatgaactaaaatcgaacacattaacatggcactacaaatttatgattagcaattaatgcataattttaggtgtttggaattttcaaattttcatgtgcctaatatctagcttttaatatccggcacatttgagtttagacttaatatttgaattcggtatgaattttttgcattgtggcctacataaggattttgcgaaagatgtagcatcattttttttgtcctattaattcaatcactttattttattaccatttactccacaattggttatcttcctcatgtcatgtgtaagttaataaactaagccagtatataggagtacttgctagccagtgtcctcaaactttatcacgcacaaagtcccggatacctgcaaatgtagatgatcttacagccggagctaccgtcggccaccgtcgccggcagcagcgacagcggcatgtgcgtgcacatcagcctcggcgacggcagctcgtcgagaaccgcgtcgcggccgggggcgaagagcctgtcgacgaggggcacgcagtcgtgcgggttgaggcggcggagcgggtggtcggggctcgccggcgggtgcgccgcccgcgccatgacggcgaacgcgagtgccttgagccacgtcgtccccgacttggggaggctggcgaggaggacgtcgccgtcggcgcggggcacgaggccgccgccgccgcgctgcatggcgaccgcgccgcgcgcccaggcgtcgagcacccagtacccctggtgctgtcgcagcttcaggttgtggaagacgcgcgccggcatggcggacacggcggcgtcgttgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagccccctctaggggcatgagacaacctgatcgtcagatctatactacacccggcggattcaaatccccaaacaggagtagggtattacctctcattgagagggcctgaacctgtctaaatcctttgtctccgcatccatccacttttaggtctcgtgcgctacccccttttattattgccgaattcatgtttcgacagttggcgcgccaggtaggggtaaacgccgagtttcctgacgacgagtgcgatggaatcaactttatgagtcgccggcttcgtcttcgctttgggagctccttgattcctcgccgccgacgacttcaacaagacgaatcgtcgctgctattctctgcctgatcttgttcgcatcagcacgacggcaacgacggggcaacgacagttcgacggatttgatggtcgtcctcgtccaccaccaagcctacaggtccaatctacccaacgaagatgccatggtgttgcaagatggatctacaaacacgaagcatgccaaaaccgatctaatcggatgcataggagacggctgcagccacgccgatgccttcctgccgtcctgcgtcgtgctgatggacaccaacgccgcccgcgactgcgacctccgcctcctccgctccgtctcggagtcagtcgaagagatcaatctcggcgagttttttccttttaatctccgacttcgccgggttttttccttttcaacttattgttgtttattagattgatctctaaatgtcagattaatctctcttggtattttctgctgtttgcatgtaacgccgcggcactactcttgccgactggtgtttccgtctgcatggctggcctattaagccgccgctgttgggcgtctacgacttcaccaccggcctgcctccgtcgccgccgactggtgtccccgcctatacggtcggttggtcacaccatcgttgatgggcatcgtcatcttcacctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcttccgcctacatggctggcctattatgccgccgctgttgggcgtctacgacttcaccgccggcctgcctccgtcgccgccgagtggttcctccgcctacacggctggcctattatgccgccgctgttgggcgtctacgacttcaccgccggcttgcctccgtcgccgccgagtggtgcctccgcctacacggctggcctattatgccgccgctgttgggcgtctacgacttcaccgccggcctgcctccgtcgccgccgagtggagcctccgcctacacggctggtctattatgccgccgctgttgggtgtctacgacttcaccgccggcctgcctccgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattactcggaagaaatcaaaagcatagagataatataatttattttctgctcttaataattgcaaaagtacctgagtagtaaattctgatccgtgaaactttgttccattaatgacgaactcatgtcactcatatgcatgtttgggaaatgcctaggccgactcccgatgcttgggggctatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccgaccggcttgccttcgccgctgccgactggtgtttccgcctgcacggctggcctttatgccgccgttgttgggcgtctacgtcttcaccgaccggcttgccttcgccgccgccgactggtgtttccgcctgcacggctggcctattatgccgccgttgttgggcgtctacgtcttcaccgaccggcttgccttcgccgccgccgactggtgtttccgcctgcacggctggcctattatgccgccgttgttgggcgtctacgtcttcaccgaccggccgcctcgtccgccgccgactggtgtttccgcctgcacggctggcctattatgccgccgttgttgggcgtctacgtcttcaccgaccggccgcctcgtccgccgccgactggtgtttccgcctgcacggctgacttattatgccgccgttgttgggcgtctacatcttcaccgaccggccgcctcgtccgccgctgactggtgcttccgcctgcacggctggcctattatgccgccgttgttgggcgtctacgtcttcaccgaccggccgcctcgaccgccgccgactggtgtttccgcctgcacggctggcctattatgctgccgttgttgggcgtttacgtcttcaccgaccggccgccgcatccgccgctgactggtgtgactgcctgcacggctggcttgttataacgccaactgatgctatcttcttcacggctggctacatcgctgtcactactaataggcatcagtatcttcaacacaagctgcctacgtttgccatggctgccgactggtttcttcacttccatggctgcatgattctgccaatgttgattggccttaccatcttcatcgcctttcgtctcgtctgctgctgactagtgccctcgcctctacatctggtttatacagctaccactactgatgaacatcatcgtcttccgtcgccgactggttatgctgtcgccgactagtgcttttatcttcacaactgcgcgtcttcactaccagtttgcttctgttgccgacgactcgtgttcacttcatcacggcaatgcaactttgtcatcatggtagagcgacttcatctttattatcttcggcactggcaaactctattgctgctacttcgcaagttttgctacttcaccaaccacgacgtctttgtgagcctcgacatctcggcatgcgatgccatgttattttactacaacaagaggctctccaatattcaggatttctacttggacatcttcaacacatatcttcaatcaagcaatgactactcgatgacaagaagctataattctcgactctatgttcagttgtttcccaactaaccaaagagtcgggggctacacaaatacaaggctcaaaatttgacaaattttatgtcaagctgaagaaatcaattcatcaaccaacgagtcaacttcaggagtcattatcttcatctttgattcagagcagacattctacttcaacaacttcaaatatttcggtttagacgagttgggcaacaatatcaactctcctccaattatttgtcttcacggttggcctactacgcaactgccgatagaggatctcatcgttatcatcagctgctacatcgctattgactggatcaccgacatcgtcatcttcatcaacatcttgtcaagcctcttcaacatagcctactctgctgtcgttgatgggaaacttcgtcatcatagtcggctatctctgttgccgctaatcatcattaccgtcggatgcgtttgtcgccaccgattattttcttcatcttcatgattggtggatttcgccatcactgttgatgcgcgtctacgtcttcatcgtcggtttgcttttgtcatcaccgactgttctttcgttgttgttgggcgcctacatcttcactgctagctgacctgactgttgccaactggtttcttcgcctccatggttatgcaacttcattacctttgattggtgtcactatttttactaccactgacatcttccgttacttttgatgagcaatttcgtcttcacgttggtcatttcatctccatgccgactgcgtcagctattgccaatagacaattttgactatgacagaaggacaagctatatgctcaggggctcatcaactcaagcgtgaggattatatctccaatttggacttgatccggatacattccacatggattcatagtcatgagtctattttctatgctcaaagactggaccaattattattccccgtaagggctatcaaccgaatacttgcgccagtcgggattcaattattatatttattttggagtatcccataagggataatcatttagatcagaagctattcatatgagctacacttggtctatattacccagaagatttgttactcaggagcatgttacatgcgtcatcctttaaagggtatcgaaggcatattttttggccttggcctaatatgtctgcagcccatattttcaggggtggcctgtcacgttcttttagggacttaggcactttttacttaggccaaagtgcgcgtgatcaagtgcccaataccttaaaatccttttataccgcagttacttaactttttaggagttggtacaatacatcttaaaaggtgtcaaacagtaaagctttatatagctgtcccgctgacttttttatatagttaaggtgctgtttgggtttatcaagcaattgattggatacaatatcattgctttttgccatgtaagtgtgcatttttattgaccaatattatggcttaggctgattatatattatggtcatttttcaggcggttggtaaatcctttatgagtttacttactcggatgttataccacatatgccatatatttccaggtgtggtgaaaccatgtgtcttttagggacttaagcacatctgttaaagcagtgtgcgcatgacgtatgcccaatactttggaaatttctttattcacaacatacaagcttctttatagctattttgctatgtgaattttcaatgatgtagccaaccttaggttacactcatcatattttacaaagcagtcggtatatcacttggatcatattattcggggattcacaccgcatatgctatatattgatatcaagtcacttggttgattacaatatcaaaaccactcagttggtacatctattaggtgcatctattcgatgcacctgactttatttttcagccctccacagtctttatatttggtaaaagtactcgggagatcatggcgaggatgattgaagcactcggctttggagtaatctagttcgagagaagattatctttccgactgtgaaggtctcaggggctactgtggagattatgggtaccccatacccacacggcatggttatccgactagttataggggataacttatatatatgaaatatgtaacagatcatgacttgggtattacgtttccctgcatattatggaacggcctaaagtattttaagcccaacttttcttttttatatttgcacaaattatttaaataagacgagtgacattagtattttaaaaatagtgaatatcctttatatgactttatatgagggacggaggtagtaattactagtgtttcctgggcatagcagtattatttgagtatttccactagctgttgataatgtgtagttgtgtactggaaggccactggccagataaccatcttcatattttcatttttatactaattacttaattaactagaggcctgttgatattacatatatgtactgtcaacttggatctgaacccgtagtgatcaaaatggatggacgagattagctgcagtttttattaacgtgcagagatatcagtccagctgatctctattctcatccggccgatatatacactataaaacatcattttttttttgacgctacactatttattttctcaagcagtccaaaagaaatagtgcatgtgaaaatagttacacctcagagtcattgaccacctataaaaaccttttttttggcaggtccacaaaaattcgtttttgcgggtggctttcctaaggaaaggcttacaaaaatcatgatttttacagttaaagatccagtgatttttatctgtggttctcataaaggaaatcatctaaaaatcgattttcatggatgatctcttaagaaaaatgcatttagggtctgtttagatctatttagaatagcaaatatatggcaaaagttttggtggcaaaagatttgacattgcaaaagtactagttagtgtttagatgcatcttaaagttttgccattttagcactaaagagagagagaaagagagagggtgtggtcccggagcactttttggcaaaatttgctaccatggactagctgttggcaacttttttgataaagttgacaagcacagtcacagcacctaacgctttgcggtaatcttagagtcgccaaccacctcaatctagcaaaagttaaactaagatggattttgataaactaaaccggctagcggagccgatctagatagaacgatagataactacccgtctcgtgggaaaaacagaaggttttcaggacaaacctacaaagaggtgtcgcactcacagcggcggcggaccggcgcaaatcgacaaagatggacaaactaaactagaactagaagcaaaagtaaaagaacgattcgattgattgatagttgattgatctcttacaattgaaccggccttgtcccttatataggggttggtcttgccctttacatgccctcctccacgttcaactcgggctagaaacagatggaaacacgaaacatgacttcccaagcaaggaaacccgagactcgatgaaaacagtctgactcggactctaccggtcagaccggcccactagcggcggtctgaccagccgacatacggcggtcagaccggccctctcagaggaaaaccggcagatcgtccaaactttggcaatttccctattttaatcctaggtgccaaatttgggtgtaaacactagcaaatgccaaatgccaaattgccaacttttgctactagtgtttatatctaaaatggcaaaaagtgctccaaaacggcatagcttttgccattttggaggatctaaacaggcccttaaaaataggaccaccactaaatatgaaaaaaaaaactaactctttaaaattgtcagggttatggataacacatacctaatagtagttgactaaatttcggcaggatccaccacataccatgtcttatacggaaactgacctcgagggagttccggataaggaaagacaaccagagttatacatggaaacgacaaggactactcggattgtatccatattggtttccttagttctacttggacaaggggatacctatgggtataaatacaagcccccctaggaggagagggtgaggagaccatggaagacacccatgacaatcaacacacgcccaccagaagccacaacacacaagcctacatacgccaagacacgctgccggatatcgacttcagggataggcatggctattcccctacggtgtctccggataccgtcaggagatacgaaagcgctatctctgatcttgccggacacggatttgaggaggaaggctaccctgttgtcgactacgagtcagaccttcagaccgccatgtcgacaacagttagatagactacctcacatattgtactggtgtgattatggtgaataaaaagcaactccggctccggccaacaggatgtagggttattacctgataattcatgggcccgaacctgtataaaaatccatgtctctatctcttttacctcagtctcgcgtataccctagcaccgacgatccctatactgtccaaataccgtagtcgagacatcaaacgtcgacagtggcgcgccaggtagggggattttggtgcttcaggatttcgacgagatgggtttaagagatggactctccgacaacaagctactcgacgacttcggctgtggggagatccaacctgtccaagtacatcttccgactagatcagaaccatcatcgccgaggagtgctactgtgtcggtggcatccaagagcaatccgacaccgattcctccatgtgtgcggcatcgactggtgtgagacatcggctggctaagttcaaaccgaactcggcttatctccaccaacaaaacgagcgccgtggagctgaaatctagagccagattgatatgtacatgggtgtaaattctaagtcggattggaggagttctcttatgctcgcactagaatccaatctctaggcagcatcctggttggccgttccaacgacgtggcaaacagatcaattaaaggaccaaaatacaaggttcatgcttacatggggaacagtaccatacacacaatcggatcaattaaggagttactattcctcaccaagcatacacagtaaggcaattagtaggttgaataatttaattgatctactaatttcgtagatatatttggcatatatctacacaggtacgcggtaatttatatacaatttatcgtacctatttttccaatctatacgatattgtcagatctataatttattatgtttacctagagcatgttttttaaacaatatctattgtgcgagtgcttccgatgtcaggccaactacggtctaatgctgggggctcgctccgttctcttctgtataaatcatgcttgtttacggtttacataatgcctgatatttaatctgctcgttatatcctgataatactagaagatctatgcagttttttgagtacatactcgatattatctgctatatgtcttgtcttctagaaaataattttcaggaacaactgagcactcgagtaggttgtggagttatcgcacccaacctaccaacaaagactgacgacctatctcatagcaccggccatggctggactactcgagaaaaggttgttaacggataattcctcgcgaacgtcgtcggcttgatcacccgacatgattgcgaacggacatccggatatgctataagttgggtacgtgagtcatactggccacatgagatacacttgcaataaaccaactctcgcaccgcaacttccattggtgttcgagagataattccgctcgctcactggttctcacaccagtacgcagcaatctctcgcaccacaacttccattggtgttcgagagataattccgctcgctcactggttctcgcatcattacgtagcaatctctcgcaccttaacttcagatggtcgaggtatgactacgccagcgtagcggtcctcgcaccacgactccaaatgatcgagggacacctactcaccggttttcaaccagttgatcgtagtgatctctcgtacatttgcttctagtggtcgagttacgactactgcctggtcctcgaccagtgatgtagcgtttttcccactatttccactgcaagtggtcgagttacgactactgcctggtcctcgaccagcgacgtagcgtttctcccaccaattccgctttaagtggtcgagttacgactactgcctggtcctcgaccaacgaagtagcgtttctcccactatttccactgcaagtggtcgagttacgactactgcctggtcctcgaccagcgacgtagcgtttctcccaccacttccactttaaatagtcgagttacgacgactgcctggtcctcgaccagcgatgtagcgtctctcccactatttccactgcaagtggtcgagttacgactactgtctggtcctcgactagcgacgtagcttttctcccaccacttctgctttcagtggtcgagttacggctactgcctggtcctcgaccagcgatgtagcgttcctccgactacttccactttcagtggtcgagttacggctactgcctggtcctcgaccagtgatgtagcgtctctcccacaacttccactttaagtggtcaagtcacgactactgccttgtccccgaccagctacataacgttcctcccaccacttccactctaagtggtcgagtcacgactactgcctggtcctcgaccagctacgtagcgttccttccactacttccactccaagtggtcgaattacaactactgcctggtcctcgaccagctacgtagcttctctcccactactttcactttaagtggtcgagttacgactactgcctggtcctcgaccagcggtgtagcgactctcctactacctctatttcaaccaagttgatagcaggtacacaatatcgcccaatgttttacccagagatcccttaccacgatgacacctagcgttgaaacctatcctactgtccctttacgccgtcttgacaaggcctccgaggaacctaagggatcctcgtctggggacgcccagagccgataaggccttgtcggatccttcagagacaaaggaccatgtaagatctggtcgtgttagagttctcgccgtgcgtattaaccaagccgtgtaatcggaaattgacttttccaacttcacggctgggggctaggatcagtgtttattcaaccaaggcaggtcaagggtccaagagccttatcctcctagaacggttctccgacgacaaggctgggggctagggagagtgtatgactctactgactgatcgaagtcggtaagagagaagacgctcatacacaaaacattgatcagtaaatttaatttattttcaatttaccatacatattataacatgtcaccctttgagcattcgcttgggggctatttctatttgatattcttttctgagtattggtttcaggaaaattctatttgatattgtggaagactccatgtctctatggttctacaccaagatcgactaaggcgagtacgaccaatgttgacaaggctccgtcgcagactctacgccttctcgatcgctcgagaacggttgctggatctcgacaaggaatagagaatgaagaaatggtgtacccgccgagataaaatttcttgacttcaatccaaattctcgattacagcaagacgtgagacttagtcgtacgctctatactttctcggtcgacatcagagattgacttagacaaaccctttcggtgcccgcacgaggctgacaaaggaagtccaacgttatctctaaactcaccgagaacggtcacatgagctcgataacagttactccaatgtctacgcgcggttgagaatatgaattcgttcatttgcatcgaagtcgggggctactatcagggttatggataccacatacctaatagtagttgactaaatctaggcaggatccaccacataccatgtcttatacggaaactgacctcgagggagttccggataaggaaatacaaccagagttctacatggaaacgacaaggactactcggattgtatccatattggtttccctagttctacttggacaaggggacacctatgggtataaatacaagcccccctaggaggagagggtgaggagaccatggaagacacccatgacaatcaacacacgtccaccagaagccacaacacacaagcctacatacgccaagacacgccgccggatatcgacttcagggataggcatggctattcccctacggtgtctccggataccgtcaggagatacgaaagcgctatctctgatctcgccggacacggatttgaggaggaaggctaccctgttgtcgactacgagtcagaccttcagaccgccatgtcgacaacaattagataggctaccccacatattgtactggtgtgattatggtgaataaaaagcaactccggctccggccaacaggatgtagggttattacctgacaattcaggggcccgaacctgtataaaaatccctgtctccatctcttttacctcggtctcgcgtatgccctagcaccgacgatccccatactgtccaaataccgtagtcgagacatcaaacgtcgacaaaaaagaagtttgatatggtaccaaactttaaaaaaagatagaattttcatattaagcctttttgacgtaaacaaattttttataggattcttactatattttggtaataagacatacagttactactttaattgaatatttcctttagtatggttattcataaagaggctacatgacataagttaacaatcatactaaaataagtattttaattaaatgtgaaaacacacacacacacacacacatatatataacagaatattagttttcctcagttggacttaaaattaattatccacatttatttagagattagcggtttttcggacggactagttaatgaatcgcccttaaaggcggacttctgtaagagccaccctgacctcatgggagagttgtgctatggctagattattaaggatccctagtggaaggaccccacaacagcacccgactcggcatgaggctactcatgatgagtaggtaaggacccccgcccagtgttctgcttgaagagccctaggatctagaatcctagtcggcctgagcccatgaaacacgtggtaccctgacccatcccatggcaggcgagccatgaccggtcgccattccaccgtacatgttgcctaacctccctacggcgtcatatgtcttgaaatctagaataggtccgatgcactagggatgcctcgatggacctagattcgatcaccaaagctactagagcaatggctcgtgtgcctcatcattgaacgaaagacttcaatcgaagttctagttgaaggttgtgctggaggacgtggccacctcgccacacactaaaccatatgtaccttggtaaccgtaggtgcaaacaggcagcaatgctaaagcagtgcaggccccgacggccggagggatgaccaccccctggaggggtgaggatggtgaagcctacgatgtgttaaagggtactgggtcaagacacaagttaaggtcgtggcataagcaaagccactaatgtacatacaacgtgctagccagaggggcagaactgtctttttctcatggtttccccctccattaagcccaggaatgatgaaataatgactgtggtgtccactagtaaatcacgtgtcttttaggagtcctagagccatgtcacgccttttaggagttcgttaggaaataccagaaaatttgaccgtcctctagcaaatttttcctatatattatgtcgaattgcagaaggtaagaaaaaggatagtctggaggccaaacagtaggcaaggctaagccagagagaaggctacatgaagagaaataaaagaaacagggaacacaggaaaaaaaagagagcaaatttctctaaactacatgtactttgacaaaactatcacaaaactatatatttaaggtgtatcacaaaactatagatttaggaccaactttatcaaagaactacagatttaaggtggaagatcaccaaactacacatttagtaataatattatcacaaaagtacatgttttgcaacatgttaagtacaaaactacaacatttatcactctaacatagcagtagtggtagggatttaagttgtaaaatatatagttttgtgataactctagtattaaatctttagttttgtgatagttggcctcaaatcttgtgttaaatctgtagttttgtgatacagtgccttaaatttgtagttttatgataatttgatcgaagtaactgtagttttatgaaatttactaaaaaaaattaactaatccctacaccttgggcacactcttcgttttcccctcggtgtaagcggcgagctcagccactacaacgttgtgacccaacgagggcccaatcctccgggtgaggtcgttcatgtcacgacgcggggatggtgtgctggagcgccctacattaggatggtgaacaccacggggtccaagcaaacggaggggtcgatgtgcctacactcctgttgaagcaacgacaatatatgggtggtggcctatgagcaccaagcctcgtaggtggctatgaccttcttggtgaagcccctacctcatcgaccaggtcatcttgtcggtgatgggggcattgtcctttgggactgtaggtcctttgatccacaatccacgaagtcggagcccaaagcccacgtaaccgctagggcacatgcacggcattctcatctagtgtgcgggcatcaagcgaatgagtctccgactctcccttggccatgctaatctcctaagacaacgcctcttctccggggacaggcgggccacctcggtatgaacatcccacaaccatttctccacctatgaccgagacacctccacctgcaagagggccagttgcaccgtcaccattttgcctccacctatgaggctgcaccactggcctccgctgtacctaaggctataatctcgtctagacgaagcctctccgcgtgttgtgttgctgcatcacttcccccacgcttgatggatgctttgacgaccaccatggcctgagcgaaggaggaaggcactctgattactcaaaacaaacccaacaagaaacaaggacagacggacgcacctactaggccaacacacattgcagctccattagctccattgatctcatcatagtagccaatacacgagcgtcatccccaagcagggaggaccagatcggtgcctccacatccaaccggagcgccaccaagtctctgggacgcacgagccgtcccatgatggtaggcaatggatcccatgagtggatgatggcctctgcatggatgccctctggagctgcctccatgatatgcccccacagagggcaatcacttgctccggagtcaaatcaagacgccatccgcctccgatatcaccatatcagttgatatctccacttgaggtggcaacgacgccacctcctcttctccagtccaccacggcatcgagggcattgtctcaactttcgaagaagacgactacgacctgtaccctggaaaacctacaatgaagaaggggaaaatgaagagagaggcatgtaagagataacaatatagcctcacgataacaggaaggaaacgagacccttacctgtgagggccacttgccaggccgtctcgttggcctctatggcaaccgctaccgttaccaccttcggtgcatggatagtggagaccgacgaaccgacctcgatgatgtcatgatcgaaggctttcaccgacgtctctgacaacaacagtgttggtcgcttggcctgtagaggcacgcccacaaaaggaggagccaaagatttgctccctgcttggacctcttgggagcatggaccacgtccgccccgcgatgccccttgcgctttccatccttgttggtctcctctagctcatggagagaaggcatggcaaggagtgtaagcccaaacctcttggccacactattccgtcaaactgatgcattctttcgagccaggcgagcgaccttcttcctgggtagcgaactccctagtatcttcttggcatccgcgatcaccattgtgactaggataatggtcttagaacgctgcagtgtgtaccgaaggtcggaatggggagacaacaagtggagcactactgcaaggtagaaatatttaaggggttatcaaccacgcgatgtgaaggggcctaggtcctcccatagagactattgggtgcccaatgtaagggagtgatcccattggtctttagccatgtgacccccagcaagcaggactccttgactagatccctcatcctctagagagaggagatgcggcggaggatggtgttcagcggagcccccactaggtgtaatgcgtccacatccagcttccactagtaccgtatgtcttgactggtaaagcagagccccgagtctgtcccccaccattaggtagaattagcgcgaaggtcacctagtggcctatcggtcattggtagcccgtgagggaaagtactccgccatgcctaggtggacctagaaatagattctaaaacaattcaatgatttcgtcaccctgccttacatcaccttattagggtgacaactagctaattggagggtggcaaagtgcttcacggagccttgcctgttgtccacccacatgtttcactcatagatggcgatgtgagccatggcgttggctgtcagtattaggagctcgacaacaaggaagaagtcgagcacacccaccaccaacgaagccatggtggactcgaagctcgctgcacataaggcctcaagcaccactatctcatcatcccgggggggggggggggaggggggcaactcgccgcgagacaaacttgtatccccgtccgtgcaatattcttctccgctacgtctagcttgtctacgtgccgctgcttggcctatgagcggcccggcatgccagattgcaaggggtaggtttggcttccctagtaaaagttttatgcattcttggcattcgtctcgccatcgtccccatcacccggtgccatggctaggcacactgccggcggttgtctgaggcgtcgataccatctcgttggcccactcgatagcatatgtataaactttatatacacatatatacaaagtttatacatacgtatataaagtttatacatacgtatgcaggaatagtagtggacttggttgacacgtgtcccgcgggccacgggttgaggagagtgcgcccaaccgttgattacaccaccacaaaaggcaaaaacattattgggaaccgctcagccatcgtctctcactagattgatctatctttctgtttttggctagatttttattttcggcatatgatctttctattttgagctacacacatgagagagaacggccgcatgcctggggccgatctcgactggaaacgcatgcagagcgacgagagtgctgattcgcaattaaagttcatattaggaaaatgcaaatcaaagtctattttttcatttgcattttaaatttgtttcgaacttatacgtacaagtttgtaagcatacgtacagacttctaattggtattattatttttttagaaagttaattggtattattattgccatgcattgctgtatgttttgctactgttattgttattactcatgaatggcccaaggcccaacgaaataaatggggtaatatatagttagcttttcaaccctttcaattattcatggcctaattgttagaaatatactgattacaagttgatataaattaaagtgagtaaattttgtaaaattatatatatttcaataaagctattttaaattgcacatgtaaatccacagtatctttattattattattttttaaaagaaaattttaagatacaatatatcacaaaactacataaactttttttttttcatatcacaaagctagagattctgaaagtttcatcaggataacaatgctaggattgaaactttgtgacatggaaatttgttataaattgtgatttaaatatataggttgctgatgctgtggcataattgtacagttttgtaataaatttgatggttttgctaaagtatatatatagtacccttgtgaaaattgagttgtacatccacatgtaatttatagccagcaatgaacatcaatggcacaagtacatccgtataattatttatagataaataacgaacatcaactcgacaacatactattaattcactccatataatttaaagaaaatagtgtacatcaaatgcatggctgcttgatatgcaaacttttatatcgagaacgagagttttatttcgatgaaataattgcactggtcttcctagcatgattaattagcaatcttcatttcaagtgtttgtgaaaccagtcaagcattaacgcaagtgcttgctcagcttttttgacctcgaaagggttgctggcgttatacctgcaagcgaagccatggttcactccttgaaagaccttggcaaaataatcaatctgcaacaataactcatatataagaggttatttagttataaaacataatatattattcccgcaatcataaaatataaaaatataaggtacaaaccaccactaacacgaaaaccaagaaaaaaaatattatcaccttctcatttggattacctcaatataatacgatgcatgcatctaatgtgattaaagatcttggggtggaggattgaaaaaaacaaatttagggaagatggagatgattgttaactacaacataaaaaggtatgattttgcctttttattttggaacgaaggaagtaatatgcaatgttatagcacttattcttccaaattggagctagcattctttctcaaaaaaaaatgcaaatagagctagcaaggtcttttaacatctcatcatcagtaaaaattaattctcttttatgtttacagttgcaatttttttagcatattaaacactggttcagtttcagttagtgagagctagcttgtgtgttttgtacatgcaacttgtatttagaaactattattttgcttgtcgctattgactatcattttttcagattaataactttttaaagattaatgaagttaacttatgtagttgtattatggcagaacacacatcgttaatatgtaatataattatttttgcaaataggatgaatggtcaacgtcaaaaactacttcttccatcctaaaataaacaaatattaaataggacgagcttttacctattcaacaaatctgaacaattgcctgtttaaattcgttgtaataggtaaagacttattttatctaaggtttgtttattttagaacaaagagagtaaatagaatccagtaacaagtatttgaagagcgagatggagtttagaagtaaaaaacatggatgtatttgggaccaaccgtcaataaaatcaacaggaactcacctgatcagttctttgacgcaaggcatgaacaaactggtaaactaatcttggtggtgtaactgtgtcattctgagctccaaggatctcaatgggccatttgacctctgttaattaatcaaggagagcttggaataagaaaacaattattagctattttctattgtaacaacgaacagcgcaacaaaagaaagaaagttcacctttcatgtcatcagcagtcaccgctgcaggatgggagatgacaattgcttcaacctcgttagtttttgctacctccactgcgaacttccctgtcagtaaaacaaatttgttttcagagacttcaatatgaattaaataactgcttgttgaatatatggggttaggaattatatattctggaattccatatcaaagattttgaccattaagttcaggatattacaactacattttcttatattgattgatagatgtgactcaccgccccaacagtaacctccaactccaacaatagatttcccttccttgcttagagcagcaaagattggtttagcatcttcagctgcttttacctgcaagatcaattgaaaatgcttgtcaatattaattatatattctttctttagaactttaatttattatcttgaatcgtttataactgtttatatattatcttttcttagaactttaacatattatctttataagcatcccgcataagttacatttttgggataaagttttgttttgtggctttgtgtatatccttggtgcagctgtcgagttttcttttactctatcgtctcaatcatatatcacgatttcaaggtaaagttacaggggaatattagatcaaattaattaatatggtgaaatgaattaccggagaatgagcactgagccattctgtacggttctggtcaaatgtgtagggttgtccatggaacaaatcaggcacaacgacgtaatatccggctagaccaactttatcagctattttcctgaaattgtcagcaaccttataatcaaacatctgcttttacattgttttcaaatgtaaaattaaaataaagtactggcagataaacagagtttctgcaagccatggagaaatagcttgacgtacaacctggcaatggaagatcacataataagttctgaattaacattgggttcacaatcttacatatattaattgtccctaagcagatgtgcacactatacaatgatgtacaatagtatatgtgtcatgaaaaacatattttagtttaagtaagcacaatatggaattcttatcatggcgcatatactcgcccattttaaattgctgtccaattatatgtgctatctaagtactagttaaagatattaaaccatgattaccacactattaaatggtatatttgaacctcttggtatatttatattactagcaaatatgcccg

SEQ ID NO: 62260 - DNA, 1265 bp, Oryza sativa
gcggtaagatttgatgtcttaggtcctcccggggtggtcctttttataccgcaggtcagttggtctcaagtagaactcggagacatcggaccccacacgatacagtaacgacccagttctgtctgagtaggactccttctatctgtggattccgcatctatctcgtgacgaatttccttaacgtacataggaaatatccgtataggcgcgggtataccgtatcagtatagaacgtgtatccaagggtagagggtatatcttatccataaccctgacacttttcatgataatcactactaaacgatagattttcatggacgttacccccttttatttccatgcagttcttaagtggaactgcacggaaaaataggggaaccggggctgggctgttgcccgtatgggaaaatcgattttctcgtgcggtcctcctaaacggaccgcacgggaaaatgagccgattttcccgtgcgtatctattaagagagccgcacgcgaaaatagtattccctattttccctcccacccatttcaaaatttttcctcatttatctcttttaatttctcctcacatccctcccctcttatctctcttctctctcctcctctctctttcacgcctctcctctcgtctccttttggcgcgcgggcgatggcaacgacaacggcggtcggcgtcggcctcagctccacacgacggcggtgcaggcgcgggatccggcgggcggcggtcatccccgcacagatccggtgagcggccggccttccccacgcgggatccgctcccctcccctccccttccttccctccctagatctggcggaggggaggggcttctgtggcggtgcagccggacgggagggtggatccggcgggcagcggcatggaggggagcgcggatccgacgggcggcggcgcggaggcctccgccgatgaggaggaggaggaggaagcggcgccgctgccatgcgccgacgtggaggcgcccgtcgcggctgctggtggaggcggcgcggcggccgccgctggcgttgaagaggaggaggcggcagccgggagcggcgccgctctccccacctcatgcggccgccgacgacgacgaggagaaggcggccaggagcggcaccgccctccccacgccaggatccgtcatccggctgtggcggctgcactccgcacggatctcgcggcgacacagtcccccgcctggagccggccagcggtgacggcggggagtggcggatctagggttagggttcggtaat

SEQ ID NO: 62261 - DNA, 5150 bp, Oryza sativa
tttttacggaagatggaaaccttttctttgcacgttttttcctttttccagtatggacgacggaactttttttcccactaacattgttttttttttttggacaacggtttatacagatgattttttttaatcgggcagaaacttttttcacactttttttttttgcttcttttacatgcggaaacctttttttcgcgtggtttttatcggtacggacaacggaaatgtcttctactttttaagtagtagagattagctgtaggaggatagaatatgaaacaattccaatatatatatgtcgctatgctgctgattatctccatgtggggataacatattgaaaaccctaagaaattactctcaaaactagcacagtggcctgcacagattgcgcggctagtatcattatattttctctcatataatagcatacatgtttcctcattatattattcaaatatattaaaatgacaacataattttaaattttgcaataactttacaaaactactaatgggtaatatttatattatattttatatacgtgttagttattaattatttttaatatcaaactttagttatttgtaaattatatatattcctatatggactctagacttatcttttaatattttctttttttttaattccgaattttctgtaaattgtatttctatatagactctatgctcttcttccaatattatttatttttatttttaaatttttattatttctaattgtatttatatgtggactctaaactcatcttttagtattctttaatttttaatttcgaattttagttacttctaaattgtactcctatattgattttaaactcttcttcccatgtttttcttaatttggaattttagttatttgtaaattgtatctttatacgaactctaaactctacttttaattttattatgtttattccaaattttagttagttttaaattcctatatggactctatactctacttctaatattccttattttttaattccaaatttctatttttttcttaattgtatttctatatggactctatactctacttctaatattccttatttttaattctgaatttcagttatttcctaattgtatttctatatggactctatactctacttctaatattccttatttttaattctgaatttcagttatttcctaattgtatttctatatggactctatactctacttctaatattccttattttaattccgaatttcagttatttcctaattgtatttctatatggactatatactctacttctaatattccttatttttaattcagaatttcagttatttcctaattgtatttctatatggactctagtctactcttctaatattccttattttttaattccgaaattcaactatttctaaattgtatttctatatggactctagtctcctcttctatattccttattttttaattccgaatttcagctatttctaaattgtatttttatatggattctactttttctttttctccgattaatgtgagaatttctaggccatgagagccaacgtagaggctcctttttctattcatttaataatataatagatagatgtgtattatataggaataataggacgttagagtatcttggcatatatatcgatatttactactctctttgtttcatatttttagttgttttactcttttcttactcaaagttctttagttttgaccaaatttatagaaaaagttagcaacacctacaatactaaattagtttcattaaatttaacattaaatatattttggtaatatgttaatttgttttgtattaaaaatattagtatattcttctataaatttgattaaacttaaaatagtttcactgagaaaaatatcaaatgacttataatatggaacagagggagtagtacataatgattctcgatacaggagtggcctgtcgccatccaagtcttatactgataaatcatgcagatatataatcagtaatattgaatattatgtgtgacttaatttctcgcaagtcacaaataactggagatcactataaaaaagacagagagagttgaccaaaaaccatatccgatcccttcaaaataaccatagtcacctttctattgttgtaacttgcatgacaattgaatgctaatgttcatgcaagtgtacgatgcatgactggatcgtaccaaaatcataacaagtttatcgtacatacagcaatttccctattatacaaacgaagaagaagattgtacctcagcaatggcgcttcgaatcctgaagtagagacccacaattaacaaccacgcaaccactcacatgcaacagcaagaattcaagattaattaatggttagtaataaatgaatccacaatatatcatcaaagaatatttcaaagacagataagctggcagctcaggcaggcatgcactaaccgaagatgtcggtggccaagaggatggtccgcctggaatggacggcgccggtgacgtaggcctcgaatcctccaagatcgtggacgaccacgccggcctcgccgccgccaccggccgtcgtcaggtccggcgggttgtcgagacactgcgagtgcggcggagcggcggcgccgacggcggccgctgcgaggaagaggatggtcgggtagagcaacgctggtgccatggttttccaactatcgagttttgacgatacatatgaggcatcgaatcgatagttgctggggcatttgtagtttgtttatggcctttagccttaggttaggtagcacattgccctcagtttcttgtttaatgtcacacccagttcccgctgcctgttgacattttgaattgaatttaaggtgagaaaaatttttttgtgtgcctttcgttatattgatcagtttttaattaatcaatcccatgttcaatgttttttttcactgttaattaaattaaatattcctaaattttcattttgtttcctttaaaaaattttagcaacattaactttgtatcatagaaattagattaaatttcacaaaactgtatgtattttgatcaaactatcacaaaactacagattgattgtattatatcagaaactacagatttaacatagatttatcacaaaactacaacttttgtaacctcaattgttctacgctataaactctaaaatttgtagttctttgataatttcatcactaaatatgtagttttttaatgaagttttaaatctgtagttttgtaatatccttggtgttaaatctgtagttttgtgatacctatatttaaatatgtagttttgtgatagtttgatcaaattatttgtagttttgtaaaacttactctaaaatttataccatgaaagaataagtattggtcaaagtttgtcccaacaaaataaagtgtacccttatttttttcaaacagaggtagcatttctctctctcaaaatgattattatctctacgtttgtaatttgtttcttataaaaaagatcatctctgcctcctaacacaaagttaaaaatctcactagggatatttttttcttcttgattttaattgtcaaagggtgtgaaaatgttcaagtgattgaaatttttaaacatgataataattgaaattaaattttaatgtttagtaggaataatttcaaccatattttaagttcattagaaaaattgaaattttagtttaaaaaatcttgtaaaaatataaaaagaaatggtgaatgggcaaattcacctccctcataaatttgttctaatttaatcaagtactttcagaaaaaatatatttcagtttcaattctgaaggcaaaatcacacgaagattagataatttgggtacttttgacctttttattctattttgaaagaagctcatcaaaaagaatatatatgatcttctcaaaatgaatagtgcaattatgaaaaaataaaacttgttcatcaagtagttcgacctcccgcattcgttcatactcttttcataaccgaataatttgaggcaatgtgagcaaaacgtggaggcctgagaaagattaagtgaaaacttagggacaatcaaacaaggaccatctctttgaaatttggagattttaaatttcaacttgagaatacgtgcccttttctatgaggctgaattccttccacgcatataggtttacatcagtctatgacagtccacaagcccagcggttatgagttcaacatcatgtttaatttatagtagttgaccttgttgattctataaatcggtagtaagaaggggtatcacgagatctaaaatgagtaagtaaagggacacaaatttagaaaggttgaggcattctcgatgagaagtattaccctattcatatttagatattgtatccgtctggtgttgtattgatatgacgatcgagttttggccatgttatttaagggctccatgtccatcttatataggtacggaggcaggattacaaagagaaatggttattgggtcatttcttccctcataaaatttgtgaattttactacctacgcaatcatcaattattgtgcaaagtcaaagcgaagaacttggaagctgcaggcctatggccaaattgctggactttttggtagtgcatccggttcgccaaaagttaatgcttggtttatcgtcgatgtatccatcaatataacagtgcacgcatgcgcacatgggagttcgatcagtaagcatatgtgcccggattgttgacacttaaccaaacacgccctaattattctcaagaaacattgcactggtgtttcatgggagacagagagaggaggcattgatgatctatagccaatttgatggccaggagcatggatgcaaatattttaaataattgtcacttgtggtgcatgataaaacccactagtaatttagtttttatcatgataaaaaccaattggtggtgatgttcttttatgccagttttatacaaactgacactgataataaggggttaagatatcttgttctgaaatagtggaggacacacctgtgttgcttcatttatttgtgggaaccatggattgctcctgttgctagctccagggttcaaaatttcgtaacaaaatttccgaaatttcggtcctattggaacccccatacgat

SEQ ID NO: 62262 - DNA, 6293 bp, Oryza sativa
catcggaaacttattttgacgaaattatagtcgtggccttgcatgcatgattagctgatccttgtcttcattatttcaagtgtttgtgaaaccaatcgaccattaaatcaagagcttgctcagcttttttgacctcgaatgggttgctggcgttatatctgcaagcaaatccatggttcactccttggaagaccttggcaaagtaatcaatctgcaacaattaatgaacaaaaggttatttctaatgttcatttttgctaatgaataatatatttctttgcaaagatttattattgaaatatttgatgaatgtttcaaagaaaaatatattcttcttgcaaaaaaggagagaaaggaataggtataggatcaaagccacagtgccccaaatgatggcctagcttttgtggattagattttgggtgagttattttcctcgtttctcttatgcaactcacttgtttactgcgactatattttttaaaaccacaaaacagtgtcttttaaagaaaactttatatatataagtttctttaaaatttaaataaatatgttttaattttttaatagttaatatttaattaatcatgtaataatggtatttctcggttctcgtttacaatgtgctagtaatctttcagtttttatgctattgtataatctgcttctgctctaacttttgccagatgttgaccagccattagagccagcattccctcaaaaatatagccagcatgcatgatcctttatcatctcatcatccgtggaaaattctcttgtgtgtctacagtttcatttcctttcagaaaatagacctagtgtttcagtttaagtgttctgtctcttccggtctattgaattcctgtgcttcatgtatatgtgcaaattatcttatctgaaaaaaaacaaaaagaataacaattgcaaggcaaatggacctatatatgctgatgcatttgctatatatatcaactgtaaacgaaactggtaataggggaactcacccgatcagttctatgtcgcaaggcctgaacatactggtacactagttttggtggtgtcagtgtgtcgttctgagctccaatgatctcgatggggcatttgacctctgcgtgaaatgtcacggcgaactttggaataagaaaacaatggctagctatatattcctgtgcaacctagctagatcagatgatacatgcatatttcagcaaaagcaacaaagaaaatatatatatatatatatatatatatatatatatatatatatatatatatcacctttaatgtcatcgacagtcaccaatccaggatgggtggtgacaatcgcttcaacctcgttggtttttgctacctccacggcaaacttccctgccagttaaaacttgcctttgagagactttaatatgaatcagatctctgcttgttcaatgtggagaggagatcacgaaggttcagagtgtatccttacaatgcgaatctggacagactcatgtccagattcgttgaactagaaaacatctcatcaatattagattgggatttttttgggatggagggagtatgttgttactcgtgactgcaaacattttttggtcgagccctaggcactagatagtaatagcagatcaactgcctagcaacctcaggcggctgcccaggctcattgctgaatccattgaaattctatattagacagattgaaacagagtttttatagcaaataagtttacttgggctctttttatttttaagatacaccactgatagatgtagtagtataattataaatgcacaaattaatgtgcttcttctttatgttgattaatatcactcaccaccccaacagtaacctccaactccaataacagatatccctttctttcttagatcagaaaagattgctttagcatcttcagctgcttttacctgcaggatcaattcatatatactggtcaaaaatcaacttattgagtccttgattagcatctagctagtataggttaagtactttggatatagttttgcttaatttgcggcttaatttgtgcatcctgataggtgcaggagagaattttcatctgaacgatcacgattactaggtaattaatgttctagggaatataaaatcaaattgcataagacggtgaaacgaattaccggagaatgtttgctgaaccattccgtaaggttcaggtctagtgtgtaaggatctccgtggaagaaatcaggtacagcgacataatatcctgcttgaccaactttgtcagcaattttcctgtaattttcagcatcattatcacacatatgcttttaaggtgttttcggatctactactggatcacaattcacgatatattcagtttaactcaatacaacaaaacaacacaattatatcgtcctatgggtactaatcgaacaaaacacatcactgataagggttttcccaccatacacacccacgccctccacacaacaagaagcggcactgataacaacacattagtgccggctacgacaataaccgacgatgattagtgggcagacaattagtaccagcctgtacaattagccagcactaataacaccctaatcagtgccggttggtgtactaaaacggcactaacatcacaatcagtgctgatatgtgctaaaccggcactgataaagatggcctcaaaacagttcaccaaacccccttagagcacccgcaatggtaaagtaaggtgctatctataaaacatgtacacctcaacaatagactagattaatagtaaaccacttcaatggtatgtctacatgggtatctatagctctctaatccattgcctcgtttttctctatagactatctccatgttagtagatagctttgctctctctcttcatttaatctcttccaagtaggaaaatatgctgacatggatctcttatagagagcttatagataaccattgtgggtgcccttataattatgtacaagcttgagtagaagtgtagagcatgcagggaaccctgttgctagacgggttgagattgcagttttttttagaagaaatgggaattttcaaagctcttcttcgctctatatttattttgtatgtctcgcacacaattaattattcacatagagctttattatgtgaaaagcattgcattttttgtcctctctctgcaagatagataaaattacgatgttttgcacataatttctccttcaggaacaagtacttatatctcatgggttgaagaggtatatatctccttgcgacgcatatatattacaaatgggttgaaggaaatgcttatagtgaaatatattagtttgattttttttatgacatgctaaatggttcgaacaaaaaaaattgggcacgcgtaaattaatacaagagcgtacaataatctggaacttcaagacaactttgccggcttcgtcgttagggacatttctcaaaagacatgttcattgatcgagggatcgcctcgtactatactacaaagtaaacagaagggcaatcatttctacaagacatagatttgtcaagttgttcaacaaaaaaaatagctgttggtttcttgtaacgacaaaaaaacacgacttgtaatgacgtatatgtgatgtaatgtttaatgatttataattaatgattatacatgacgtattattgttgtaattaattgaatgttattaaaatttatgctggcaaaagtaaaatatggataggcacaatattctttttttttaaaaaaaattcagaatgaggtgctcctggaaccatctgtgtcggttcgggaatccaatccgatattttttagataatggaatagaatcccgacctttcctcaacgagagaaacccaaactggtatatgtttggatatatatgaggctgatcaatcggcacggataacaatttaaaatggacggagggtacacaatattgttgatattatgttgattttatcccaagtaacaaactcactatagaaaaacgaagagagttgacagttgacgaaagatcatatccttttttaaaaagtaagaacatagaagatcaccagttctccacgctattgatttgtaaaattcagtctctttccaaggtagttgttcgtttgtcgatttcctttcgatattgttgtcgggaaaaaaattatggaggaaacgagaacaactatgaaagatgatcgtgacaacgatgtcgaccggcaatggaagaacaagacaaagagataaagaaaataaggacgaagtgtaccttagcaaaggcgcttcaaatcctgaagaaaccaactcgatcaacaacgatgcgtgcaggagcaaatattataaacggttaatcaaatagagataaatggcagtgactgatcagtaggctactcatgaattacggctagggatgaaaatggtacggaaaccacctttaacgttttcgttccattttttttcaaaattagaaacggaatcagaaactccggatacgaaaacggaatcaaatacgaaaatgaagcaaatacaaatcggagcaaatatggtatagatatttattggaatttaaaaagctcttaaactgaacttctcaaatcgacgaagagatgtagctaaatatttttttttctaaaacaacaaatcgatatttctatttttttatcaatagtaataatacaactagttgtacactttacttttttaagaaaagaaactatattcatctataactataagtagtatgacatggactaataaaaactaaaaaaaatcattaggcaaaagaaatctaaactactagacaacaaaaaatatttctatttaattaagcacctataaatctaaatatcaagagaagatagctaaagctaattagttgtacataagaaatactctgttcccgattccgagagaaaatttgaattcaatttcagaaagtttccgatgatagcagccttatcatattcgtttctgtttaaaaaaaaagaatctgaattcgttcccgtttctgaaagttccaaaaaaaattccgaacggcactttctgtttccaaaaacatatacagaatcctgcaactttccgaatcattttcatccctaatcatgatagggtttgaatggaacaaaattatttgaaatttaaacattttcttgaccgaatttgaataaactttactaaattcatacaaacaaaaaatatttgaaatttttgggcgaaataatttagtctttttactttcttggggggttccgaaattttgaaaatttaaaacctaggctgtgtttagttcgtgtgccaaaactttttaagtatacgaacatacatttgaagtattaaacatagactaataacaaaacaaattacagattccgcctgtaaattgcgagacgaatctattaagcataattaatccgccattagcaaatgtttactgtagcatcacattgtcaaatcatagcgtaattaggctcaaaagattcgtctcacgatttacatgcaaactgtgtaattggttttttttgtccacatttaatgctccatgtatgtatccaaacatttgatgtgacggaaaagttgaaagttcgaagaaaaaagtttgaatctaaacacggccctaaattttaaaccctgaatcgtaatcctagacatgcactcaccgaaaacgtcggaggcaaggaggacaaccttggtggaatggacggcaccagtgacataggcctcgaagcctgccaggtcatggacgaccacgccggcctcacctccgccggctgtcaagtccggcaggttgtcgaggcactgggagtgcggtggagcagcagccaccgctgcggcggcggcggcgaggcagagcaacaacgcccatgccatggttttcatgctctaccgagagaccttgggcttttttttttccttacgtggctttaatcgatcggtagtaatactaagagagtagctcgttgcctaactatatataggcaaacgggatggacttgtggtcttgtggaatcgtgagcttaactcgatcgcttggtcataagagctatacggctccatcgtttcacttattcgggaaataagcgaaatggcgtatttgcaaacgaaaaataatttgtaaataaaacttttatatatatgtgttcttagcgatctagaagtaaaggctgaaaaataaacttcaatgaaaaaaccctaaaaccaactccaaatttaaagttgaaaatttaaatttttgctaatatataagcataagcatagtttatatttttttcaatttgacaatgtagacgtgcttttctattaagctga

SEQ ID NO: 62263 - DNA, 2771 bp, Oryza sativa
tcgatccacagctccgttgatcccagccaaggattaatggacaccgtacgttttgtacttgcgagaaattaagcaataagcatttcgcaggcggatgtatggttcaagaaaaaaaaaatccgtctggaaaaatggaaggacctcatctgcgaaaatagttttgctagtagctagtgttcttgcatctccaccaactatagatactccatacagctatactttctaacgtttgcattttctatcggcctctacctgcttcctccttgtcatatgctatttcttaaaccagaatcatataatatgtagtcatttgacagtaatgaaatgatgattaggtcgatcatttcctcctgcaaaacttatgtcaaaatataatcacttgtagcacgaatactactgccaacaactctctcacccttaccctcccttatttaacaagaggcaccaaattcttttcttataaaccttaatctcttctaagcaaccaacaaatgattatatctcataatagatggatgtgaagataacatatacacataagattcatgtgcatactccgtgtacaccaactaacaaatatcacaataaattctagaaaaaaattgtgcatatactgaaattcagtatgtattattacacttatatgtaaaattttaaccccggagacattatagtttagacgtaacaaacatatttaatagttttaaagctataattctatctgaattttgtattttttctctttatatatggtgaatttaaatatgcgactttacgtgtagatgtgtaatattactaaaagtatttgtttctaatgtttttagtgatatttgttagttagtgtgtacgatgtgtacacgtgaagccctgtgtagatatggtacattttcaagacaaagtgtatatatattccctcagtaagaaaactatatatgagagcaggtacaatagcagactataagccagctataaatatattttaaagagataaaggaagagagtaaagagtagcaggctacagatatgtagccagctgtaggacggacttcaagacgcagtgtgcatatgataggtgagaccatatattaatagtatagtaagcaactattatatgaattagctattagattgactataggtgaattggagttagtagtggactatactattgaacttgctctgaaccttgacttataaatcttggggagaacattgaacgttcctcgatgatggtatatatgtcatctgttgacatttagcactgaattaagtttttttacacggttagagcgaggatgccgtcttgttttctctactaccaacaataatcagaagtcatgtatgcttctgtaagttatcgacagccaccattcgaaacatcgtaattaattaagcgatacaaattattttgtgatgctgattgcatacctgataaatcattaaattatatctctactattataaaaattgaagatgtttccgcggtcattcatccgtgtttgagtcggttataaaaaattatagatgtttccgctattcgtcatccatgtttgagtcgattttaattttatgttttggtttaatctatatctcttctctactattataaaaattaaagatgtttttgccggtgttttggtacgtcatccgtgtatgagtcggtttttaagttcgtttgcttttgaaaatacatatccgtatttgagtcggtttttaagatcgttcactttgggtaatacagaaggaatcatgtaagaaatctgtttaaaaaaacttgcatgctaacttgagacaatcggactcctaactataactcatgattttcaaatatatatattcaagcggactcccacagtgaattttctcttaactaaaccatataacaataataagattaaaatagacttcaccccttgcaacgcatggatattttttctagttacggtaaatgttaggatgccatctcagcgagattgctaatccgcgcagacgcaccagattagcaactcgcgcgcactccgagtgcgtagcgcctcgcgcttcttttttttatcgttttctgtattttcggtaccgcttcttgcatgggaggttaagcgcgtggacccattagtcattagcactaataatagtgctaagcgtataaattaatttaattatagattttattatcaaaataatatacaaatagttaagttgaaaagtttcagaaatatgatgaacattttcaaaatttgagttgaagtttttaaaaaatgttttgaaagttaaaatttcgaggtgacggttttgaaatttgagttagaaatctttcaaattcaagtttggaagttttcatatttaagttaaaagttttcaaggtttgagctaaagttttcaaatttctagttgaaagttttcaaattcgggtcaaaagttttcaaattcaggtagaaagttttcaaattagagttgaaacttttcaaattttgaattgaaagtttcaaaatctttcaacccaaaatttgaaaactttcaagtcaaaattaaaaactttcaattctattttatagaggtgtgtgaaagattgaaaaaaaaatcgaaaacaaacggcaaaaaaaagaaaaacacgcctaaaataaaaaaatgtgcaaacagtaaaagaaaaaaaagacacggggagagggctagctaccacgcgcgccagctaaatcgctggcgcgtatgcgcgcgctagcacccccatctcagacacatgagacatgtttgttacaagctagtttcgcgcatct

SEQ ID NO: 62264 - DNA, 3585 bp, Oryza sativa
  unsure (1)..(3585): unsure at all n locations
acaaatcacccacatattttggaaatcctctattaagggaattcgtttcactttttattccaccaaaaatgtttcacctagtatacttataatattttactatgtatgaatcaaatgttgcagtgaaccgaaatattctttcgctatttgctaaaacattgtttttatataaagtgaaacaatgtttcacgcccaatttaaacgattgaaacattttcgatctacttagtgaaacaattccgatatatctagtggaacatcatgcaacatttaaaaaaattcaataataagctatcggaatatatccatgtgtggtcttgttttgaagatttaattgcaatgaatttaatgctgcaaattttctaggatttaatggctttgtgctttctgtgataggcgacgtacccgtcgacagcgagacgcctatagtgactttgtcgatctccaggatttgtcggtccagtcttcgaagatacttatagggatagggtttgcgtgcgtgcgtgcgttcataggggtaagtgtgcatgcgttgtgagtgtctgtgttgtactgtgtaatttaaaaaaaatatgttctcaatttaatttacacattatagtggttgacacacatcagagcgccattaattgtaatcgatccacagctccgttgatctcagccaaggattaattaacaccgtacgttttgtacttgcgagaaagcaataagcatttcataggaggatgtatatacggttcaaactaaatatccgtctgaaaaaatagaagagtctcgtctgcagaaatggttttcttagtagtgttctagcatctccaccaactatagatatacagctatacttttttttaatgtttgcattttctatcggcctctacctgctttcctccttgtcatatgctatttcttaaaccagaatcatataatatgtagtcatttgacagtaatgaaatgatgattaggtcgatcatttcctcctgcaaaacttatgtcaaaatataatcacttttagcacgaatactactgccaacaactctctcacccttatcctctcttactcttatttaataagaggcaccaaagtcttttcttataaaccttaatctcttctaaacaaccaacgaatgcttatatctcataatagatggatgggaacataacatatacatataagattcatgtgcatactccatgtataccaactactccctccgtttcacaatgtaagtcattctagcatttcccatatttatattgatgttaatgaatctagataaatatatatgtttgagttcattaacatcaatataaatatggaaaatgttagaatgaagtaacaaatatcacaacaaattctagaaaaacaaattgtgcatatactttcagtattacacctatattgaaaattttaaccccagagtcattatagtttagacataacaaaaatatttaacagttttaaggctataagtctatctgaattttgtatttttctctttatatatgatgaatttaaagatgtgactttacgtgtagatgtgtaatattactaaaagtatttgtttctaatgtttttagtgatatttgttggttagggtgtacgatatgtacacgtgaagccctgtgtgtatatgatacattttcaagacgaagtgtatatatttcctcagtaagaaaactatatatgcacccgacttataaatcttggggagcgcattgaacgttcctcattgatggcatatatgtcatctgttgacatttagcactgaattaaatttttcacacggttagaatgagggatgccgtcttgttttctctactaccaacaataatcagaagtcagccaccattcgaaacatcgtaattaattaagcgatacaaattattttgtgatgctgattgcatacctgatgaatcattaaattatattacggtaaatgttaggacgccatttcagacacatgagacgtgtttgttacgagctagtttcgtgcgtctagtagattagtgaagaatgatgtactcaatctgcaatgcatgaaagaatatttacgagaaccactttacaggcttgttttagaatagaagtttttgatgaataaatttaatcttaaatagaattcaaaataaaattatctgtactgtggaccacaaatatgaaaatatgtggaaaaaaaaaactaaacagatggataacattacttattcagcctgcaaggttgttaatgcaaattttacatggaccaggaatttgttctgaagaaacctgtcgagcatgaaagcaagaccttgtgtttagcgatttagccaacgggtcgctggtgttttatctacaggcaaatctatgaggaactcctgtaaaaatcttggcaccgaactctctgtagctgtattataaagaagaaattggatcaaacccacagctttcaagtcggtccacaagttcctcgttgtacacagattgaccttcatttttttgttaacctgataacttaggctgagttcggatgggggagatgggaacccaacttctgcgcacggaaaacggagcagtccattaacgcgtgattaattaagtattagctattttttttcaaaaagggattaatttgatttttttaagcaacttttgtatagaaactttttacaaaaaatacagcgtgcacgcggaaaacgaggggaaggggatgggaaaaggtgcatgcgaacacagccttaaatgtttcagtttcagctactactctgagctctgaacgtttccttataatggaagcttgtggttcatacatgcaaattatctgtacaaatttaatttctgaaaaaaaaagttaaggagacaaatacatataattgttatgaaactattatctcctgccagagataaatatgggctcataccaaatatatagaaacgtatcctaatagaactcttcctattatatatatatatatatactgagagagagggcttgagaggttggttgatgtatccgcatatggttaaaacaataaagctgtgatgcccctctctatatccgtgttcatctactatatgattgtgtgcatgggatcgccgtcttctactccggatcagcgaataggccactagttattcaacacgttatcagcacgagtttgctcgttccgttgatccgggtaagtatttttgctagatcaatttttttttactaatcagattgatctactgtgtttatgcattggtctatcatcggccgagacgatcgcctccaagcgcagccgcgcaccgaggcagcccaccaggtgacacgcgtgcacgtcgcactccacgcgcgcgatagccggaggagcagccccgccacagtcgtccgcttcggagctcctaagccgacaacacatgcgcgtgcacatgtgtagatcgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62265 - DNA, 4245 bp, Oryza sativa
tctattaaaaaacggagggagtatattatagttataatgtaattacattgtatacaatcgtattgtagttacgttcaaaagtttaaagagagttttttttaactgtatagctagtctccaattagggaaccacgttagacgatttgccaggatcagacagtattgtaccttacaattgagatcaaacaagttgcacatatattatgcacatccctgattatattaattacttgctgataccaaacaaatagacacacacacacaaattaaacttgtgagtaaaagctaatgcatcaaagaaaaccattattctgcagacaaactgacatgacaggaaatcatatgcaacaacaccaaacgtactaaccaaacgaaccatgcatgcatgcaaacttccattgcttaattcgccggagggctagggttgtggtactctggcgcaggctgcggcttgggctcgggcttaggctcaggcttgggtggcacgggcttcttgtggaagtggtcgaagaagtgcttctccttcttgtggatgtggtcgaggaatgggtgctccggctcaggcttgggcttgggtggctccggctttggctccggcttgggtggcaccggcttcttgtggaagtggtctatgatcttcttcttgattgggccgcagatggtcacggacgcgcacaacgccgatcggtagtgggtcttgccggcgacggcagcaaaggtgccctccgacattggcacgatcttggatggctcctggccggggcatggctcgttggtggcgctgtggagctgagcgatgcagtcggagctgtggaggtcggcgtcaagggggacgctgaaggcaccggtgccgtcgagctttccagtggccttgctctcgtactcgccgttgccgttcttgcacttaatcgccacctggaggtctgcacaaaagaattccaaataatattgtcaatcacttgtaatcaactgtatcttcctctcgatcgacgatgtaaatcagctcaatgatcaattccaaataaattgttacgtactcttgaaagcatcctcagctttcatgttcttccgggtgcagtcggcgcacttggccgtgccgacgaccaccgacgccgcctctccgccgacggcgaccgccatcaagacggcacaaacgccgaggagaactagtcctcgaggagcacctgccattgctgatcagctaatcctagatagctctgtgtagctaaatattgctgatgtgtagagatggatgaagtgaaaggtgaggcaacgcgtggtttatataggcatcgatgaatacaaacacagcttgcttgcattattgatacatcaatcgatggatcgaccagctagctatgagcaatgcaaaaagggccaatttggcgccgaatttgcagatgggcgaattaaggccgtccaaactgaatgatttgatcacgtacgtccaatatagtcgcctctgcagctttacctacgacatcataataatctatcgatcggttggtacgtatacgtaggatctacgcaccgctttatgcatgaatgaatcataacaataattaagtacaataatcgaactgggtcttaactccttgtaaactgcggttgacctctgtttcagcagtgagttacagtgatcggctacttattgcaacactttccaaatgtactgcattcatatcgtgctacattcgtccaaaagacaatatatatataagcaaattgtccctatatataatcatagcattcaaattttgttctgaaaagaatgtaattctaaattactactaccactactacaaagatagattctcctggacaccgcccccttttgttttcatgcggtctgtaagtggaaccgcacggaaaaatagggggaccggcgccgggttctcgcccgcatggaaaaatgcattttcccgtgcgggcgtcttaatccgaacgcacgggataattgtcattatcccgtgtggtcgacttaagatgaccgtatagaaaaatcgattttcgcatgcgggctttttaagtggaccacacaggaaaatacctcccacctttccctcccacccacttcaaatttttcacatcctctcccttcctttttcccttttattctccatcaaccacccccctctctctctaccttatctcctttctcagccttcccggcttcccacctcctccccaccttcccggcttcccctcctcctccccctcccctcctccgtcaacagcgggcgtcggtggcggccccttccactcgtcctccccctcccctactccccttcccctctgtcaggccgacgatggcggtggccgggtgaggcggcgaccgagcgaggtcctgagcagcgaggcggaggcgtcgtcgtccgttcgtctattcctccgtccaaagataaccatggtgggaccctcctcctggtcgtcatcctcgtcgtgcacgttgtcgctcgggtccctcgacgacgatgccgtcgtcacgtgcgtcatcaaggcagcggcggagagcaggtggcggcgagcgggtggcccctttccacggtcgtcgtcctcgtcgtgcctccctttccacggtacaccagcgaagcagcggtgagcgggcggcccctgcccggatttggcgcgactgtggcggcggcgggtgggctcgacggcgatgacggtggcgggctcggcgacggccgggtgcgtgcggtccggcgggcggcggcgattttcgctttttttaaaaaaaattttggttttttcggttctgtgcaggcggtataatttgaccacacgggataatcgattatctcgtgcggtccacttaacacgaccgcacgggaaattgattatcccgtgcggtagagctgcccgcacgcgaaaatattgatttttcaagacacttgggtgcagacgggcaaatcctctgcacgggaaaatcatttcgaccgcatggaaaaatgttttttgtagtagtgtacatccgtcccaaaatataaaggtggaattaaagtgagaagatttgaatggtgaaaaatcatgattgaagcagggtaaagtggaattaaagatgaaggatgcaatacatttagcaaagtacaacatgccaatattgcaatacatttagaaagcacaaccacactattattacaaccacatgcaatattttttttaatgatcaaagggcacctaacaaagctagaataactcagaacactaaacatcctattattggacggccaacaattatttaagataaaaaaagtgcacctttatgatggttgtattaccactatcagtattatcactagtagatcgaagtgagatctcaaaccttgatttatcattactacaattaataaaaaaattctagtaccaatagtggcagtagtataaatagatacgagaaccattaaattaaaaaagatgaaaggcctatattgatctgtactaagagtaagactattgtaaaacatctcgctgtctagcttcaaggctcacaccaattatcatatgctgcaactttctcaagctgaagaataacgttttcctcacaccaattatcatatgctgcaactttctcaagccgaagaacaacgttttcctttgggagggcataaaatcgttttctttttgttgggaggacgaacatgcggataattcaatttagggccaagagcctacatatatgtactgagatgggccaaggaagaaaaagagcctactattcgttaattgaaattttctttgctcggtacgtccacttgtatttcgctgatggtttttggctgtcaaggctagttgagttcatggtagtgcaagtcacgcgcactttacaaggacgaaaaaaagatgctatcacattactcctaattaatcacaatgcattcatgtggacaccgcatagaaaggtgtatgcatcctgcgtataggtaccaaccggctgaagaaccgcgtcgtacctaggcaacgtcgtgatcgaatgtgacaaggatccagattggacgtacgtgatcaaaatcattcagtttggacggccttaattcgtagcatctgcaaattcggcgccaacttacagccgctttgctgatcatcgaccgatcgatcggtcgagctgtattcaactattgatcgatcatcgatgatgatcgatgagcacgagaggctaagcctatataaatcgcgcgttacctgtctttctcttcatccattcagagttagcaagctcttctaattcatatatagaactcagaa

SEQ ID NO: 62266 - DNA, 1867 bp, Oryza sativa
acagctctgactgcattgcccagctccacagcgcaaccaacgagccatgccccgggcaagagccatccaagatcgtgccattgtcggagggcacctttgtcaccgtcgctggcaagaccagctatccgtcggctttgtgtgcgtcggcgaccatctgcggccccatcaagaagaagatcatcgaccacttccataagaagccggtgccaccgaagccggatcccaagccagagccgcccaagccgaagccagagccagagcaccccatcctcgaccacttccacaagaaggagaaggacttctttgaccacttccacaagaagcccgtaccacccaagcctgagccaaagtcggaacccaagccacagcccaagccacagccagcgcctgagtaccacaaccctagcccaccagcgaagcactaaacattatctacgtttggtcttgtatgatttcgtgccatatcagtgtgtccgcagaataacgctttctacccccgtgtgagattatacattgaaatataatgtacttgctagctttcatccgcaggagttttttttttaaagtgtgaccgggttcatttattggatatcgcatgcatattagcagggcacgatgtgtactgtaatatctgcctgttgtttttatttctctacctaaatgaagttaaccacaaaggacaaacataaattcacatgaaatattgactctggattcgctgtgcacgtttatgaatttattggccatctagcgagaataagcagtgcgagtgtgctgtccttgatctccagccttaaatggggaaagcattgattcaaacgtactagcctacctgtaaattaaagtggcgtgcatggaatttaaatatattttaaattaattatatgctcatgcattaattatagctagaaaaatgggccaaaatcaattgttaataagtgaaaattattgcagttcgatcgggaaaaaatttaaaaactgggtgatttgatgatttttcactcttttgattgggaatttgaagatcgatttaccataacacatcattgactcaaagggtcatatgtgccatcaaatttgccgaaacagttctctcatatgatgggggatcactatcatacatactagacgacattctatgttttactacacgatatatagatgaataccaaatgaatatatgttaaatattataaaaatgataaatagatttggtttgagttgaaataatgggagaaatgataatttagcgagcttgtatatatgctgaggtttagaatgtaatgaattttagcatacttgcaagttgagttttatgtgtttaatgggacactatggtatgcttagtatgcttccttgttaagctttagttgctttcttgcttagtgggttgtaactatatacagaaggtatatatgtctgtgaagttgaaggcacacttcgatttcaattggaagatgacacattgacaaacaggcaacattacagtgcagaaaaaaaaatcaaattaacttcaatatgtgaattttgcaatttatgaatgtcttatcttccaaacgaaaaataaagtacatatgtattgaatttacttctttagttgtatgataggatctcgtctacacctgggaatttttgtgaatcgtttcaaaaggctgcccagagtctatgaagtagctaattaatttccacgatttcacacaaccagtggtttaattcacctgatattgcccaaattaataacatcaataggatccttcaaattaaaataaatatatatacctgctgtcaaggaaagcctattcattaattcttttggtttaaatatttagtatatgttggaaatttctatcttttaagcaactaagac

SEQ ID NO: 62267 - DNA, 1563 bp, Oryza sativa
tggttacaagtgattcacaatactatttggaattttactatgcagacctccaagtggcgatcaagtgcaagaacaccaacggtgagtacgagagcaaggctgccggaaagctcgatggcaccggcgctttcagcgtccccctcgacgccgaccttgacagctccgactgcatcgctcagctccacagcgccaacaacgagccatgccctggtcaggagccatccaagatcgtgccaatgtcggagggcacctttgtcgccattgccggcaagacacactacccatcagcgttgtgcgcgtcagcgaccatctgcggtcccatcaagaagaagatcatagaccacttccacaagaagccggtgccacccaagccggagccgaagccggagccacccaagccgaagcctgagccggaacaccccttcctcgaccatatccacaagaaggagaagcacttcttcgaccacttccacaagaagccagtgccacctaagccagagccgaagccagagcccaagccagagcccaagccgcagcctgcgccggagtaccacaacccgagccctccggcaaagaactgatgaatatgatccgcactggacgtttgatcatgccgtcctgccccctgtcagattgtctgcataataacagtttgagatcgaagtcatgcattagctttcatcgacaggagttttaatttgtacttgtatctatttcttctctatcaaatgcagttatatatggtaagataatttatttatatttaatcagtactgttgtggcggactattcactgtatcagccaaagccattggatcgtaagaggttagcattggttaaagaaaaagttatttttatctgacaaactagtcccaatgacggaattttcctgatgttgatacgtcacgaataattttcgagacgtttttttgctttatcctagtgatttttggccatcataagtaatctagttgctggtagtatcttttaattcttagaatgtgcttggttgcggcttacaaaacgtgctacgtgcccaaaagcaaccaaaataatttggtgcttaattaacttttatttataagctatggctgaaacatagagaatgataaaaaaacatgtatactaatataaattgaatttttttaaattgagagttaaactgatgagttgccaagtacatacttcaatcatattattacccttataactatttgactaacaagtcttgcctgtctgtcgtaccccccattggtttccccctcagttcagttttaagagcgaaccaacctaagatgaataattcatgaaatatatgtacagtacgcgcacctatggattttcctagactagtatctcttatataagttctttttaataattttttagttttagttaaaatgaatgaaaaacaaaatcatctaatccagaaaatgtaaccaaaaaattgaacagcaaaaaaatcccccatgctagttattgtcctataatttggaatttgtcaagagttttatgtcttacacattgatctccagtcagttatacatgcatcctgatttcatg

SEQ ID NO: 62268 - DNA, 4914 bp, Oryza sativa
ttccacaggcgttgttcatcgtgttctatcggcacaaaagactcggggataaaataagttcttgactagaagtgctaggtacatatttctaggaaatccattctaaaaaattgtagcatctctaggctcaagaattgtaccaacaatcatatcaggtattccagaatttacaattaagaatctttatcccacgctgtggatagcataactaaggaatacacaatttatggtttttggtccaagtttgtgccttttgactataggcgcattgaccttagccaaacattcccatgtgcgcaagtatgagagattcgacattttcctttccagttcctcgaacggtgttacttctttattcttagtaggaatttattcagcacatgacacacggtcaatatagcctcaccccaccattccttggaaagccctgcaatgtctaacatgtcattcaccaaactcagttagagtgtgattctttctttcggcaaacccgtttgactaggaaaaaaagggagtcgttctctcatgaataattttagactcttcatagaaagaagtaaatttatttgaaaaatactctccacctcgatcagacctcaaccgtttaacttttctttcaagttggttttctacctcagccttatacattttcacgtaatgcaatgcatcatcttttgcaaaatctaatgcaattatctataagtgtcatgaagtatttctttttcccctttagtcaacacaccatacatttcgcacaaatcagaatgaccaatttctagcagtgccaaatttcttgtctctgatgccttgtaaggctaagtatggcatttggaaccttttaccaaagtgaatttcggaattaattaactcattgtagctaagcacaacatgcaactaaaattcacatgacagacgtgaatgccaaacattggactcatcatcattactcacatagttcacaacattattacatgcgtcatccaacattattacatgtgtcatccacagaaaagcggtacaaacctccgttgtcataacctttagcaacaaatgtttcatatttagacacgacacatttattggactcaaacacaagtttaaaattttaaacattgatcgtgccaacacatgcgaaccgttctgcatcagcaaggaggaatctctcctgacctgataaaaataaaacagggaaatatcaacacacaaccaccagtatcaacccaccacttaggtgaatgaaatacataacgaactgtaggtaaaaaattaccataccaagatgttactcctccatcgctaataaccatgtttgcagattttttgaccttgcgatcagggcaatacttggcccaatgacgacttaacacacacacacaaagcagttatcctttgcctttctcttgccttttttttttaaaattggttatagccttgggtttgatatcatatatgactttttttcataaaattagttgtagccttgttgtgggatgcttgagcattccttttctgcaccaaatgctaaaacctccctcaaactttttgtcgcggttgttctttgctatcaccttctcctcaacacccaaagaggcaatgagatcaataacactgaacacttgcctcatgtgttttagacaagtagcaaagtccaaccaatatgtcatctatcacaaacttgtctagcaactcgtagatgttgttctcaagttcctttggtagtgcctgaaactcatgagcttgttttactatagaacggtcatcgacgatcttatactcatagcaatgtttcatgacatacaactcactgccagtatcgaagactccgaacatggcctcaagtgcatcccacatatcctttcgtgaaggcatgtgcatgtacacttctactcttttgttggctaatacacttatctatgctccacggaacaagcaattcgcgaactcgaacttagcctcctccacaggggagagaccgtacgatcgtcttgccctatgaaacaaagaaatattgcatagccgtcaaccacaatagtgcacgtgccttctatctcttataatttgaaccatcaattgcatgaggtttaagtgatgcagcaaaggcaactaccaaaaagacctgtcaagtttttggattgttgaaaatataatcataatctctactatcataaaattgaagatatttttctggtattttggtaagtcatccgtgcttgagtcggttttaatttcttgtttcggttttaatctctactcctcaaaatccgtaatttaaaaaagggcgaaaaaaatcacacggaaaaagaaaacgcccataaaataacatgaaagataaacagggaaaaaaacgtccgattcgtaccggaacgaaaaaaaggcaaaaaatgctgggtaaaacaaaaaaaaccgaccataaaaaaatgcaggacattggcaaagtacttcagatataacatgtactactcactgtagttatgtggtacttctattcaattaatcatctctcagtacacattgcacaaagttataagttctcacccgtagtttacattaggaccagttcgattattgtacttgtaacgatgattcatgctgtcatgcatgcataaagcggtgcgtggatcctacgtatgccagccattaatggataggttattatcatttatattctcttcgtctcaggacaaaccaacttaagatataagatgctactcaactaaggtcctgtttgtttcagcttaaaattattgtaatctagactattaaatcagattactctaagcaggattataataagctgacataaaataagctacgagttgtttgtttctctagattattagagtcatctaagggtagtgggtcattagccacttaataatctggaaaaagctcctctagaggagattattggattatagtaatctggcttatagattataataatctagcataataatctacttgtttgttttagcttactcctaataatctagattataataatcctaagctgaatcaaacagggcctaagccaaccaaagggggtgaatggttggtataccaaaaaaccgaaacttttagcggaaataaaaatgacccccaaattcgacggagatcggtctgaccgcagttgtccagccggtctgaccgcgcctgtgccgtcggtccaaccggtgtagaacgatcggtctgaccgccctgagatcgcctttacgccgccggtctgaccgcctttacgccgctggtctgaccgccgtgatgccgccggtctgaccgccggtgtgtcgctagttagaccgccgaaatccggtgaaatacaaatcgaagaactcttaaagtgggtgactactttattgattctctctgtgtttacaaactcatactagaagtcctatacaacttaggaaaccctctagtacaagaaacaaactttacataaccactcataccaaatttggactcctttcaaattcgactccgcattccatacacacacaatacctccatcgtataccatatggaatcttcaccaaccatgtgtattgaactctagccgtagtatcccgtatgatctctgaccaccacggacgtcgtcttatccccaagccgactcttagtccatcaccgcaaatactctcctgccatccgagtcacctacacatagaacaaacaaagaaatcatattccgagaccaagctatctccaaccttgactcattagtagcaaacaacagtattacatacgtatagtatccatctagaagccataatcatgaaacaatcacggatatccaaacaaacaacccgaaaccgaaaccgacacagagtccgccggtcagaccgcgggctgcaccggtctgactgcgcgatacacgccggtctgaccggtagcacatgcctggtctgaccggacctattccagcagtacctgtagatttacctgtgaaatccaatcatctcctaaaccacttcgtgaataaattctaaatatcaaaaccaataatctccgatgccaattgttcatcacagaataacaatcaaaaacacctttaattttacagttacatagtctagtataacgaatctgaatatcatcatgtccagatttattgtattaagttataccatatcctttcacagatttactactgagtgatcagatcattcagtttggacggcatcaattcgcccatctacaaatacggcgccaacttggtctttttaatttgctcatagctggtagatcatagttggatcgatcaacaatgcaagctgtgtatattgatcgcctatataaaccacgcgttgcctcacctttcacttcatccatctctacacatcagcaatagctacacagagctaagctagggttagctcagcaatggcaggtgctcctcgaggactagttctcctcggcgtttgtgccgtcttgatggcggtcgccgtcggcggagaggcggcgtcggtcgtcgtcggcacggccaagtgcgccgactgcaccaggaagaacatgaaagctgaggatgctttcaagagtacgtaacattgtatctggaattcactgagctgatcagctatacaccatcaggatcagaaagatatagctaattacaagtgattgacaatatcatttggaattcttttattcagacctccaggtggcgatcaagtgcaagaacggcaatggtgagtacgagagcaaggccaccggaaagctcgacggtaccggcgtcttcagcatccccctcgacgccgacctccacagctccgactgcgtcgcacagctccatggcgcgaccaacgagccatgccccggacaagagccatccaagatcgtgccaatgtcagagggcacctttatcgccgtcgccggccagacccactacccatcagcgttgtgcgcatcggcgaccat

SEQ ID NO: 62269 - DNA, 1795 bp, Oryza sativa
aaaataatttatttacatttagccagatttggtgggacgactgattattcaccatttagcattcaccttagcttgattcaagctactgggctcggccgagagaaacgtacggtacttgatcttacgataagtcatggcagcggtggctagacggttgtgaccagaatttagggcctgcatggaaatctgagcttttttttttggtcaattaagtgtaaaataatatgtttaccatattggaacccagaaaagctgcttcgatacatggactaaaacacactaaatttaccgttgtactatttgggaaaactttttaagctacgggtgaacgccgaattgtttaatttatatcgactaaatgattataaaatctttttaaacaaatgacatgaatatattactctataaattaacatgctagtataaatttggcttctgcaaattgtaacaaaaataaaaataataaatttgactgcaaataaacgtatactaattaaagtttaatacgttatttttttataacttgcgcataagtcaaatttaaacttgcatatttgtgaagtgatgcattacatattaatctacctttttatcaattttttcagaactatttagttgacatgtgatgaacaggtggacgttcactcgggtgattaaaatccttctccttgtatttgggccactccaacagaaattaggagtgtggtctcaaagaagccacactttttcgaattagggcggggggtggaggggggcggcgccagccaccctggcgccgcggcgccaggggcgggcccaggtttttcaacttgggtattcgaaattgtaagagaaaaaattttctaacccaaggtctaatagttgtataatatgtaacggtataagcatgattttataaagtcataaatagatagaattgaccataaattgaatgcgttgagcatattagagtaacatcactaaactattattgacaaaacaaatcaaatttatagagcacataaaatggcaaaatgataaaaaaaatcttacaatttagagagaacttttcgtttcttgatattttgaacatgattgatcatgtcttcattcttaacttgcaagaagagatctctttcaatgaatgtaaccaagcaatcattcaaatattctggccccatcttgcttcttgcaatcattcaaataatcaatacacttcagttcagtctgaagaagcattcaaacaataatatcctcattagtcattcaagcattgaagcaatatcctcattcaagcattcaagcaatatcctcaatcctcataattcattaatcgatatcctagtatttcctcaccggctcaccgactcaccgttgctcggttgctgtcttgctgactgctgtcgaggatgggaggagacaagttgggcagctccgcagctgggcaagagccaggaggcgtcgaggcggcgtcggcgggcgggcggtgggccgcgccgccgcgggcgacggccgaagccgggctggcgccgtggcgcggcgacggtgcgtgcgtcggcctagcgagctggcggcggctggcgtggcggctgggaatgggaaggggatgggaagggaggtgaggagaagagatagggttagaaaggaagtgggcttttctttgctattgggccaatgggcctgaaatgctgggtggtgggagggttcagtttgggcttcttttgatttttgaatgggtataagtattttttttcttttttcctatatatacatatggactatatacttcatatatgtattttttgggcaaaaattt

SEQ ID NO: 62270 - DNA, 4362 bp, Oryza sativa
tggcatgggcgcgacaccatggtggctggcgccgccatgtttggggacggcgccagccactctggtgcctaaaaaggaccattttcgatttaagtttttccaagggtccatttgtaaaataagtttacaaaaaggaccaaaatgtaaaaatttcaagtgagcaagtactcggtctttctattcttcccaaccacagaaccagtgtacttttggaagacgattactcgaaggagtaggttcataactgctgtcaaggatgtccgtggagtggagtcgccacgctgcgagcatcaagttatatagtttagctcactttaattttccgctacatatataagacttttaataatacttgtaagacgtgaatctgtgtatcaactttgtcatttgtgtaccttggccggtcatggacagggtttttatgcacattccgctttgggaattctggttcgtgaatttctaggcgtgacagtaggaaggctgctatttctgaaattttgatgaacaatgtgattcgacttgaattctatattgtttcatcaaattctgtggctccaagttgacgctttgttttgatgcatgttcatactcatctgttggatcagcaatgaaccttacttattcttctcccaaacagttcgactgtaggggaatatatatttcactggtacttttggataactcaaatttactggtgcattacagtcaagtttgtcaagcagactgaaataagggaggaaaaggttatactccatctgtttcaaaatatagtaacgggatacttgattagacaccagctagtactaggctactatattttgatgcctaatcgtatgaatgtgtatatacaaatgcgaactaaaattcgaaatgattttttattttgtttgcacctaaaaatcaaaaactggagattcatttttattggcaactctaaaaaaaccagccgtgaaaatatttattcacgggtgactgactttgctcctgtttaaatgattgattttcacgggttattggttataggcaggtggaaaaacatccatatatataaattatggaccacctaaacaaacggttttttatgtaccgatgagtgtcaaagtctaagtttagaatttaaactatttagatgggtcaaaaaaaaattcctaggagcgtttgcagcagaagttccaccaaatagggccccagcgtagactcgtagttgggacggatggccaaaacctccaatattgctgcaagacaaacttggctcatccccttaacatagaactgtaccattatattatattggcaaatcctttacatgtccagggtataaacattggggtaactcgtatgaatagtccctcaagggttatcattcatgaaaacaaaattttattaatcagagaaaatgattatcttttgattcttagaatctactagcttggtagtggttattataagccgtgatatgtgcctgaagcaaccaggctgcgttcggatgaggggttcccagcccctctctcccgtattccacgtgcatgcttttgaaactgctaaacgatgcgttttttaaaaaaagtttctgtacgaaagttgcttaacaaaatcatattgatccatttttgaaaaaaaaattagctaatacttaattaatcacgtgctaatggaccgctccgtttttcgtgcggaggatttggtttcccaactcatggtatcgaacacagcctaattttagggaggacatatatacctatatattcatagtggtttaaaaaggcaaggctaaaaaaaatctatactagtctaaaaattactaagttttagaaataaaagttggttgtaacctaaaacaattcgtgcaggtggtgcttgcctgtcatagcagagtaggcaccattggtttctctgcttgagcgcttggtatacattcacacacacaacccaagcccccaggaaaaaacattcatgtacggtttgccattttaagtgaaattatttttttcacagaaaactgcacatgagaaaaaccttaaaaatttaccaaataaagttcatgacaacattcacttccaataattttggcacaagtttttgagcactgccaaaggtgtgcatcccatctggtgggaggcacatcgcgcggcaagacaggcttgtagagggggagaggtggagagagaatatgagatgatgggaggcacatcgcgcggcagacaggcttgtagagggggagatgtggagagagaatatgagatggggtatagaggagtgaagggagagtagaggaagaagatgaaaatgacacgtgggtctcatgtgaggattgggaggcttaaatggtgggcagtttgtaccgagggcaatttgggtatttcaaaaaaagaaatttgtgtaacacgaacggcgatggcatttttaggacaagttggttcgtacgatgatatttttagaaagttatgttcatcaatggcattttttttgaagtaagacatttgtcaacggttttattggataaatttcataaaaccctatattatatattttgcgttcaatgtagaaagccaccgaattatggattgtagcacataaaacccgttatttaaattctaaattaatttcagcatatcttaaaaacaatatttttcatagcagtgaatagtaaaaccaacaaacctcaaacaagaattcaacaattaaaattttatatagactccatattttaaaaagttagtaaatgcatgttcatgagaattctggaattggctgggttgttcagtttaagaggggaagcaacttaacatggaaattcatgaaatatctacggcaggctcctaacacagcgtagaatcttatgtattttcctagacttctctctcttgtcctatagtttggagtttgtcaagttctactccatttatacagtacgcatcctaatttcatgaacattctaattcaacagagtgacatggattctaccagcaaacactaaacatatgcatacttatgaaatagtagaacaattttcacatttatttacattttttaaagacttctaatattttttcactaaggtggccaagatctcattcttctggcaattctgatatcaatttcaatgctctgtctgcacttactgttcatctacgagtaatggttcacctcccttagcgccatctaactaaacgagtactggttcacctcccttagctagccatcgaactaaactccacaacgaaccaagcatcaagttgatcctctacatgacttccctatctactcccatgccaatcatgcatcaagaattcaagcagacaataaaatttagattcttctgtaacaggtgaatgaaaatttagattttcgtggcacgcttttcaaactgttaaacttattcaaatccattttagttccgaatctatttccgaatccatttatatatcagttcgtacgtaaactatatatatgaaagttgttctaaagtatcatattaatccattttttaagtttgtaataattaaaacctaattagtcgcacgttattatcacctcgttttgcgtaaaacacttaatctttatcttcatattcatcttcatctttagaagattcaaacactgccaaaatataattcctattgcaatgacagacagattaactcagatgatccatatactgctcggcctatacattattcagaaaggtccagctacaggagtgaccacacttaaacagtgaaactatatatgagaatctgaactacagttgattaattgagactcttcagtcaattcaattctcacctgtcagatttttaactggataaataaaaatgactagtaattgggatgctataaaaaatgggcccaactggtagagctagtggcatgtacagcaacaatttattcaattttcacgcagtgacagattgcatttctgctgacataatggcatatacttcctccgtccctaaatatttgacgccgttgacatttttaaacatgtttgaccgttcgtcttatgaaaaaacttttgtgaaatatgtaaaactatatgtatacataaaagtatatttaaaaataaatcatatgataggaaaagaatcaataattacttaaattttttgaataagacgcactggtggagaaatgctttttagtcccggttcgtaaccccccttagttccggttttccaaccgggactacgaatccgggactaaagatcgctatctttagtcctggttcaaataaccgggactaaaaatcaatcccggttggtgttaccaaccgggactaaagtttttttctttttttttttctgcttttaatattgaatattgatttcacaccatcccctcccatatcgaaatcatcacata

SEQ ID NO: 62271 - DNA, 1772 bp, Oryza sativa
gtattaactagttaatctcaaatttattagtatctcgatgatgatatttcacatggaccgatggactacatcaccggaatacaagagcaaagaacctgcatttgatgtttatgcaactttgttgaaagatactccctccgtttcacaatataagtcattttaacatttcccacattcatagtgatattaatgaatctagacatatatatctatctagattcattaataccaatatgaatgtgaaaaatgctaaaatgacttacattgtgaaacgaaggaagtaataaactgccaattcctgcacaggaactgtcagtaccaaacaaaaatggcatactaattaatttgccagggcagaagttttgaaacataaactggaaaaaaaaaacttaatcatttcatcatcgttcgataaggcacctaagaaggataagttatagaccatcaccaggaaagactaacaacacaagcgtataatgaggcacaaaaaaatggtagacaaccaaaaagaacataaggaataggtgctctgcaaattacagaccactacgatgaaatgatagacactagcaagtaaaatatcgaagaactgaaaagggcaatttgtttcttcgactacttaaggctaacagtacttccatctatggtcatgtattagcatatgccaaaaaaaaaaaaagcaccagagaatcctaagacaaagttacaaaagaattattcaaaattggggaggttggacaagttaaggatgctgacagtgagccacaagcaagcccacaagggagcacaaataagagtgacagtggtggccaaatgggccgcactgcacggacacggcccactcagacgtcaacccgagtaaaaatacttccctctcaaagaaacaaaagagtaaaatactcgttcatcttggcgcgcgaccaagaaagcagaattcgccgtcttcgtgcctctgtttggttaggttagaattggaggactgaacaaggtagtcagtctgtgtgtaactttgcactgatgattagtcagagtcttgttgttggctttagtcccacatcggtatttgatgacgggggagcacgacttaaaaggtgggggtggtcttcacccatcaaactagtcttttgggttgtgtaggctaaaaacctaaagttgtggagcaggtccaatgtaacctgggtggcccacggttggtgggtcaggcctacgcactctaacacttgtgttaggactgatgtactctgtgatcttatattcttctgattattcattacaatcgtatttatatttatgtaatgctattcaatttgtacataacaattcaaggcctacaaattatcagctttatcagcttgttgaatcttgtttcatgactgcttgttttttcatcttcagaaaagggactagttttgtagtttgtggattctgtccttgatctttcagtacataggagtgttaaaatgaaaaacatagtgacctccaaaagaagggaaaatgacgagtagaagacatgtatttgggtagttccataatgcacacagtagaaatcatttgtcagaatcagtgttttggcagaaaaggtagaagaacgcagagtactctgcattttgtaatataggcattggactagcatagaatattagaatcgatagtctcaggattggtgattgcattagtacattggaattgcaatcaggggaatcttattcttctgtttattcattgcaagcataggcagctgcgcagtgggcacaaagcgaactattctttcg

SEQ ID NO: 62272 - DNA, 1910 bp, Oryza sativa
tcaaaataactgtgctgacaacaatcttcacttgatgacttcagtcatgtttttttactaattttattgaaggagaacaaccttttctttggggatccaatggtgtttttccacggtagtttctcacatgtgcttggttttagtcacccgcataacatctaaatcagtgtaacttttaggtgtgtcttctgtcatatagacttgcaaaaaacttcttaagaaaaaggcctgcttttattcatagcagtactaagagagtgctcttcatcctggctatgtaattgggaaccttttgaaattgtagcaaccctttgtccctctgtctaactgaaatagaggtccatgtccctgcaaatatgcattactgtacagcaatctggaaattagcacaggctgaaactggacagttcccaattgaagcccgtgctttatttgatatatttgcctacctatttatcatatatcttagttaatctaagtcgattatttaaatttacttatatcggtcagatcttttctagggttttgccagtatcggctaaattgttttgtcgatctagattagctattgtatctaccacccagaaaatcagtcaaagaattgatattatgtttcttttcatacttagtgctgcatcaattgggtttgacctactaagtcatgcttataactataatctctagcttgctttttgattgccaataagggtttcatcagggtttcaactgatgagttatctaggcgttgcttcggctcataaggattatatacaagttggatttagccgatgacaacaaaattttcattgattatcaaatcgtttggatttaatgacatcggagctccagtcgatgtatgttttaacctttggatcagagcttattccattatatcattattagccgattggtttctaccggtttacatcgttgtcttattatattatcattagccgactgtttttatataattatttactcaagtatcagaatatgcattggatatgtagccgacagttcaaaaccctatcaacatcggctggtatcgccccatcggcttgtcagccaagcgactctttagtgatcaacatatttatctatcttgtcagttgcaggatcaaactggctggcatgcccgcatatcatcaatatttaggacctgcactagagctaagcagatctcctaggccattgtgttcgtcgacttagttcgcgctaacacagatcagataccatcggccaagcgcggatttttttgtcaacaagacggaggacaaggtattgaccaagattgtaatggagatggatgtggcggtggagaccgtagttgcggaggagacagtggagatggtggagtccgaggattctcaagctacagcggtgggaatggatgccgctgctcacctgggaaacacgatgtagcgcttgcaccataatatgatggcgtgggatatctctcctagatttgtctacccatctcctatagggatgtccagctcaagatcgtcaaatccttagcagacccactccacctcgatctttgagtatcgaggtggatcgcgtcttgctggacttgtatggctatgccctccgccatcttcacgagaaacgaggttagttagtaacatatgcaccaattttcgcaagctacaaagcaggatgtgcaaactatgagcataccttgattgataggtccttgaagggaatatgcagctaacatggtgtctgttgcgtgatttcatccacggggcatggatttttcaatgatccctcagtttagggatttttcaaaatttggtgttagatccttcaggatatatctgttgtacaaatctttcttgaagcagttgagttgttgggccatcttttttagagtccaatcctttactttgttctgttctacttgaggg

SEQ ID NO: 62273 - DNA, 6619 bp, Oryza sativa
catacacccatgggtttataatagataaaatcccttgtatgctctaaaaatttcatcattcccttttgtacccttgaatcatactcaatctcttctatacctccgaattttcaccttgaactcttctatacccctaccgttagttgttctttagttgactggttagtttgcttgaaaatgtccgttatgcccttggcttggttataggttagatgaaaaaaatgttaataggcttctggatggttggtctaacctagaaatgtccatgatgaagataaaaatctctcggcacaagtgcaccattggatccgtcctccaaccagaatcgatgtaaccagctatcccataaaacaaatcatttgcatttacctgcatcaacaagagagaaaaaacagaaaacacaaggggaaaaaaatcccaaatttctttcagcggcttgctgctccagatttcttctagctgcttgctaattgtttcagtcaacgaagcgggcgtgctgccctttccacgccggcaggatctggcatcattacagcaacaacttcatgcggatggtgggaaccaacaaggtgaagcagcagagatgacaatatccagcgagtcgtcatcctcgacggcaacttcgcaagatgctggaagaccacggcttgaagcagcagcaacatcaacggtgaaatcccgttgttgatgcggggctgacggcgacgtgcagtggtgcaggtgcgtcgtgcacctggagagcaacaagtcgatgcggggcccgacggcgatgctcgaccaccgcacgcacgacgaggcccgatggcgatgtgtaggcatgctgcaggatgacccagagatgtggccttgacagcgccaggcaggcacgacgcacgtaggggggaagaagagacggccgtgactttatgggcctggaagtagtggcgcagtttccgcaatgtcatgattacaacgtagagcagtctatgtatttgaggatatcagaccttggcgtcatggagggcctcgttgacatagtacaccgggtgttgtgctttatccctctcgacaacgatgacagtgctaacagaatagggtgtggcggcaatataaggaaataactcttccattggctgaggggcaacgactacaaggggttggacaagtaccacttgagcgcgatgaacgtgttctcggcatcctgtgtccactcgaatttgtccgggtttttaagtaaagcgaagaaaggttgtactcgttctcccatcctagccacgaatcgacttagtgccaccattcatcccgctagcttctgtacctccttgagtcttgtgggcgaattcatgttctcgattgccttgatcttctctaggtttgccttaatacctcgcttagagacaaggaaactaagcagcttccctgatggtactaaaaacgtccacttctccggatttaatttcagtcgatgtcgtcggagattgttgaatgtttccctcatgtcgtcaatcagcttgtcgcttgtctttgttttgaccacgacgtcgtcgacgtaggccaccacatttcggccgatcaggtcaccaagagccccttgaatctcgcgctggtacatgttgcctacactgattagctcgaagggcatcttggtataacaaaaaacatcgaaaggcatgatgaatgttgtcttctccttgtcctctttagccatactgatctggtgatagccggagtaagcgtcgagaaaactaaatagctcacaaccagctattgagtccactagttgatcaatgcggggtagagggaagtgatccttgtggcacgccttattgaggtcaatgaaatccacacacattctctacttgtcattggccttgcgaaacattactggatttgtgagccactctggatggagaacttctcggatgaaactgttgacgaaaaatccgtgcttggccaacggtgccggatctgtgttggcgcgaacttaaatcgacgaacacaacgacctaggagatctgctttactccagtgcaggtcagtttgatcctacaactgacaagatagataaatatattgatcaagaaagagccgatcggctgacaagccgatatagcaatgtgagctgatgtcgatacggttttgaacaatcggctatatatctaatgcatattttgatacttgaaaaaataatgatataaagacaatcggctgatgataatgtaataaaacaataatataatctagtagaaattaatcggctaataatgacatgataggataagcactgatccaaagattaaagcatacatcggctggaggtccgatgtcattaaatcgaaacgattagataaatagtgaaacatttgttgcgatcggctaaatctaacttgtatgtaatccttataagctgatgcaatgtctagataacttatcggctgaaaccccgatgaaacccttattggcaaccaaaaagcaggctagaaatcatggttctaagcatgacttagtaggtcaaacccaattgatgcagcactaagtatgaaaataaacatctagacaatcaagcctttgactgattttcaaggtggtagataccttagctaatctacatcctcctccaggtacgagaggtggttggtgtcctcgtggccttcgagagccacctatcgatgatgatgaagacaacgaaggataactataatcgggagtacgacctctggatctatgccaatgtccttgatttctccgagaaccgggggaacgtgaatctcgtcgtcgtctgttgttatcgtggtgttttcgacctcggccattgtcaccctgacttctccagccttgattgttctcgtccttgcagctttgccaatccagtcggtctcggtcctcatttagatagcttcatgattgccatcgctgttctgttatcgttgtggagaacaacgttggtgatggccgacgtccgtcttgttctcgtcattcccgtctccgcctgttcaagtggtcgcaaagatcacgattacctcggcaagtggggttttccaacttggtcttcttggcaatgcattatggggattacggcctgggtctaaactcaggtgttcgctagggacatcttcaacattgacattcccaactccatgttgctcttctccttgagatggggaacaagaaggacgctaggttgttggtccaattgtctccaagaaggaattgtttagattggctattgtagatcgtatctgtccaacctagtaatctgcttcagggaacatgactgggtccatgttggtatttcttaaccttatagagatataccgatgtaacacttcacccaggagtattctcaggtatcgatttccacagggaacgtctgtgtcggctcttcaccaggtacgtccaagtacataaagctaaggataagcaaaggatagagtggattcaccggtgagaaacagtgtctatggaaagcttaactttaatcctaatacgatacttcgggcactggccagcttactactcccagatatcgctctactacgtacctagttagggaggacttcagtgatcttgagggctgtcaccacctctacacccaccccacacctactgtgggatacggagcgattaataactacctagacacagcgtctaagcaattaataacttactttaatgttaggtacacactaaagcaatcactatattttgctggattatagtgaacgatgatctcgtacgctgattaggaactaaccaagagataattctcaccaagcaaaactaaattactcgaaagatatttctattataatcagagtagttaaacaaagcaaaagaaataagaagaggattaccgacaattccggaactcctctgacttcttctactctactctctctctaatctagtatacaataaagtacaatagagcctcttataattcagctcaagcttggagtgtgtgagtgaagtgaagatgtgaaatgtccattctaccctccaaccgccattagggagtcatctggactgtccctgccaagccgcatatcagacagctgtgggagtggttcggccgaacccatgtatggcccaataggcccacttttcggcctgttgctcctcctcagcctcccatatctatttcttcgagtggaaggaccatttgttgatgttttgtgtagttattggcccactcgttgtatggataggatttcacctccacttaagtctgattttcatcccaacttcggcggtttattacctgcaggcacatatgcaccaacactcgtggaatatgttagaaataaacctaatcactatgttggatactttattctttctgtttatgcaggtattgacggcataaatttggcatttaatagccgccaacaaactccccacacttagctctttgctcgtccttgagtaaaggttagagataaatttcagaataaaattatccaatatataatagaagcacataaattattcaaaactattcttgtacctgtgaacttcagcggtggctatcttactatcctgggtgattgataaatggaacagtcttgaatctggtcctcctcgtattctacttcagacttttgggggtttataaattttcccaaaccagcttttctcatcataatgacttaccctcgatcactcggatattttgtaatgtctgtggatccttaccaaggcatattttgctgaaattattccttattctaaaggctgtatgtgtggagtttggtaggcataattcggaacataccttcatcatatatattacaaaatcaaatacatggactcaagaagataatcgatcatactctcgaaacaaagatcgctaatttttgggtggaaagtgtatgatatgtgtggaaaaatggaaaataaagaaaatgcttctcctttatttatacctgcttctccaattttctccttcataattgtagagggggcatggccattttctttctttcttttttttccatgttgctctatatttttgaagagaaatatttttttaatagccatgcctttccctccttttctttttcttttccaaggatttttcttaggagaagaagggataaattgaatggagaatttattcatcaaagttggtttttctttttcagtggtagtcgaaatggatggaatggtgccaacttccagtgtagaagcttagcatcttatatggataacatagtggttgtgcaaccttgatcgagagagcatgagagacatctaacacgagtcacaaaaatttggtaaagctcaatataattacaggtagtcatacacatgcataaggttcatcattaatggcttggtgtatggccttgttgggtaggaataaagtcatatgaggagtaaggttccaaataaatttttgattttaaaaacaaatccccaattgtcatgagatagaacacaagaatttccttcatctcaactatatctcaattatcatctacttagatgcataaggttccctaacatagatagttgttcacaagtaacaagtctagtcaagaataaaatgtgtacaagatcaatcataggaaaattctattagttggaatttttatcttctcattaagcttgaacatattgtcattgaattttctgctcatgtactaggcatttgggggagaaaatgaggaagtagatgtgcaaacttgtcttccaggagaaaatgacaggaattggggctagtgtgggtttggtcgaaccaggtgttcggccgaaccactcggacgcccaatttacctgcatttttatgcagtgcttggaaatgttcagtggttcagagatgtggctgcagtttctgaatttgcatgtcaggagtccgaaaggtctccccccacacctattttcaacctacaactttatttggacacaaaaaatggaaatagaaaggcaaacattggggtaaacaccaatgtgccaaacttttattgaattaaaactgagataggtgccttattacattgagtaaggcaaaattgaaatgaaaataaactaatgcacctatcatgataaaatgagagggggaaggcctctagttagcacaataaagttcctccttccccatctccctaaaggcatgcttgaccttggaacataatgcacggctaagcaattgaaattcattcctaaggtcggctatttctctcctacgctccgtgtcacgttccctaagctcctcattctccctacggagtcgctagatcctcttggcttagtgaccgaaggttgaggggagttactaccctcaaacttcccggcctcccccttgatagccggcaaatatacttctactattatcatataaaacatctgcagcaatgcgtgagatcccgtgtagttaattactccatccattctttaatagatgacgacgttgatttttagacacatgtttatccatttgtcttattgaaaagttttgtggaaatgtgtaagatataaatcatgcttacactactaaaaggacacatgcaagtcagcattataggtgctggaatagctaaaaccagcgaaaaccggcacctatagtgttttccccaccttcgcaggctgaaagtacaaaaaatggtacgagtataagtgccagttgtagagaaaaacc

SEQ ID NO: 62274 - DNA, 4929 bp, Oryza sativa
atctgacctatgtggctcaagtgcgacgaccagatctttcttgcatttttttttgatgtggataatgattttttttttaaagttgattgtgcgattgtgttccaagttgatcgattcaggggtgattgggagctgcatcgagccaccttttttttattattcttgggacatagaaccaacacctttgatttctctcattagtaccacctactatgtgctggttttcccgatcggcacctgtgtggggggtttccaaccggcacctattcgcgtttctgtagtagtgttaaaagtatttttaatcataaaacaattcacaataaaacaaataagaattagcaactttttgagtaaaacaaatttaacgtccaaatttaacaactttttgaggtggtgtttgaatctcctgaagatgaagatgaagatgaagattaagtgtttcacgcaaaatgaggtggtaataacgtgtgattaattgagttttaattattataaacttgaaaaatagattaatctgatattttaaaacaactttcatatagaaagttttcgcacgaaatacaccgtttaacggtttgaaaagtgtgccacgagtatccaaaagttaatccaacttttgttggagaaaagaacagggatgtatttgaaaattttattaaaaaaaattatgggtttctatccaacatttgatcatccgtcttatttgaaaaatttataaaaaaagaataagttatacataaaatattattcatgttttacgatcaaataataataataatattaataaaaaaatttcaaataaaatgaacggtcaaatgttggtcacgaaaacatataaaatacttaagataggacggagggagtagtatactgcgacgacctgggttgtgccgtttttttatagtatagtttttcccaaagacattgatatggcaattcaaaaccgtaacagtcgcagtttgcatatagtacaattaataatgcagccatgcgggcaccaccaacgacgatttccgtcggcgaaatttgtcctaacgagctccgacgacgacttccacattgcagccgtaatttgccgaggtcttccacattgcagccgtacgtgccgacggcccgacgccacgtatgtagctttccgtttccaaactctgatcgcaacatatggccccgttcggtagtacttctagagtactgtttgattcacagtactgtttaattcagcttagggttattataatctgaattattagaaataagctaaaacaaaccgataacatattatgatagattattataatctataaagcaaattactataatctaatccactcaaaagatgctttttttattattgggtggctaacaactaacaaacagcttataatccaggaaaacaaacagctcacagcttattatatgtcggcctattataattcagcttatagtaatctggttcaataatctaaattacaacaatcttaagcttagacacgtgaaacgaggaaaccattgatgtttgattaattattttaaactcatgaaatgaatctatttgatattttaactctatttcaatgaaaataatttcacggatagtactgattattagtttgaaaagtgtgttaatgaaaactgtgacaaaatttgtatcttaataggaaaagaacatggcctatgtactctactttcacttcttgcatgtgtggtagctagctgcagtaaataattgactatactcgctcctctgttgcatattataagttgcatattataagttatttttattttttcatatcaaacatttttaaatttgattaagcttgtaaaaaaatatggcaatattttaaaacatttataaaaacaaaatataaaaatatattcaatgttatatattatttaatgaaattaatttgttgttgtagatttcgctaagtttttctataagcttagtcaaattaaaaaaaattaacttaaaaatataaaacggcttatgatataaaactaagagagtaatatattttgcagacccctcgttgagtatgatctgataatggattaccttacgtgtggcgattaacaagtcacttgacaatattatcttttgaatgaggaaagcacagggaatgttctttttacttgtcctttggctcattttgcttggaatgtaattgccatggtgttgaatttatttttggaatgtaactgtccctatctatctttgctggaatggtatgagagctatcaaaacaaaaatgaaatctcaagtggggatggtagtgtttgatgggatgttgtggggtctatggataacaaggaatgagtgggtgtttgaaaacaaactaatcaggactcctttgcatgttgtctgtcatgtctttgtaaaaaactgcaaagatggaggctgactactaaaagaaaaaactgcgctgatttaccatgagaaagcatgctcattctggatggtttgccggcgcgcggttgacaatctgccagaagactttgggtagcttaggagagtttgggatggtttagttcccaaacaaaatttttcacatagtcacatcgaatatttgaacacatacataaagtattaaatgtaaaaaaaaatacaattacacagttcaccaggaaattgcgatatgaatcttttaagcctaattgcgtcattatttgataatgtggtgctaaagtaaacatttactaaagacggattaattaggcttaataaattcggctcgcagtttcctgacggaatctataatttattttattattagactgcatttaatacttcaaataccgtatatccaatgtgacgtgcaagggtaaaatatttttccaaataaacaggccctttgtgtcgttttctgtcccagttgtgtatatacatgatgtggttagtgagggggcttttagtactttttgatggtctgcacctttcatagaaagctggatgtccccagtgtgtcgcaaagccttttgttaccctgttttagctgtttacttttgtaagactctgtaagaacctgttttcttctgggctttttacaaagccgggtaatatatttgcctgatatacaaaaacaagtgacttgatatattttgcaaatctctcgtttatttatatccatatacatatgcttcttcccttcaaagttaaattcctaatatttctcaatgtatatatgtacgtcattcctacctccagtctagtgaacgggtgcagactgcaatttgcatagtaagtacttattgatgggaaaaggaattaattttgaaattataattttaaaaaataagaacgaattgcagttttaagatataggacacatttatttaccaaggcttcccattggacctctttattctatcctatactttcaattagaccccttactaccttaggcacttttttatacttctcaacctccaacatatgttgcgttcttaagggtgtctttagttcgcaaaaagaaaatttttgggtgtcacatcggacgtttgaccggatgtcggaaggggttttttttgacacgaatgaaaaaactaattttataactcgcctggtaaccacgagacgaattattatgcctaatttatccgtcattagcacatgtgagttactgtagcacttatggctaatcatagactaattagcctcaaaagattcatctcactttccatgcaaactgtgcaattgattttttatctatatttaatactccatacatatgtccaaagatttgatgtgacgtttttagaaaaaaaaatggaactaaacaaggtataagtttactttcccaacttcacctcccttgttttctacgtgcacatattccaaattgctaaacgatgtgttgtttgaaaaaatatagaaaagttgtttttgaaaaacatattaatctatttttcaatttttatttagctaatactttactaatcataatgtataggtcgttttacgtgcctcccgaacacagtcttagcgtgcaacctgacctccactaccttcctcttgcttccactaccttctaacatccttcatttgcttgaaggtggtgccttgttcaaggcaaaggggtcaaaaattaatagaaaaaaggcaataaaagtaggtccgttgttaaattgtaggacaggagtttaacgtgaataccggtatgaaaaaaaaatctgaacaaaaatccacttgagaattaattttagaaataaagtgttgaccaggagagaaaagcgggtaaggatctgactttcgatcttactgatgtgttcaaacagtactcgattgtagtcgctcaagggactgtgttcggaggacccggcacgcaaaacgaaccacctattattacatgattaattaagtatttgctaatttttttaaaagtggattaatatgattttttaagcaactttcgtatagaaatttttcgcaaaaaatacaccatttagcagtttgaaaagcgtgcgcatgaaaaacgggtgagaagggttgggaactagcactcccgaatgcagcctaatctctcttcaaaaaaactagtattcctggtatcataggtggccaaaaggcccactactaccgaaatgcaaaaaaaaataacagcactatatatacagactatatatacagaaaatactaaaaccgacatcaataatgtttttctcacccaaggctggtccgcatagcgccatcggctagaacaaatacctttgtggagagatagatgtcgattttaaataaaaacatgcacctatattgttagtgccgattttttaaagaaccgacaactataatatattataggtctcaatttaaagtacaggcactaatataggtgttgttatttgtttaaatttacacctatagaaaaaccggccaccgaacgactttatctgctcccttgtctagtcatccttatcaccacacct

SEQ ID NO: 62275 - DNA, 1737 bp, Oryza sativa
ggatttggcccccgagctcaggacctccacagcagcgaggaggaaaggagggggttcggctaggagcggcagtggcctcccgctcgcccgtccctctcctctcatctcctgtgagatttattttgtaattttcgcctctcctctcatctcatgtgtgatttattttgtgatttctgattggattgtctcttgtcttgtgatttattttggaatgatcatgtgattttcgattggattaggatttagtttttgaattaaatttgtgatgatttcggattcagttatgagctcaaagcatcgagtcgaatcaatctaatgcatcaagctatttttcttttgcctcgcgtgcacatcaaagatgtcggttgtgaaacttacatcaatgacttggggtttcatcagtgccgcttagcaggtgccgtttgaaacaaccggcacctatagagagagctctcaatcgacaccaaaatccttttgtgtagtagtagccaggtctagctatgctggcccagtctcgacacaacatgggcacaaaggttgggggctgtatcgtggttaggctgacactttagcacggccttgtgtcacctagcacaacctactatgtccatattttcccccattttctgctatatttcctatactttcatatctttccttattttcccatgttatttttccattttcccctctcacttctttaccttttcctttctttcaactattttctcttttctccacacacaccaactcgtgcggccattggcccctcttccattcctgctattctcgctccctcagccgtggcacgtgttcacaagccgtgaccagcctataggccactatcacacccattccgggccagcaaggcctaccatctgattgggctgtgtttgggctcaggcattggcacgtgggtcggcatgtcacaaaatattttagcagccatgtcttaagggtattaacttgatgagccgtgccagatgatctatttggctctaccactatcttatattatgagatagaagtagaagtagattagtatattccttccattttaaaatatagcaacctttggaattttatgttgagattaagaagtgtgtactagaatcgaatagggatgagtgttgagatgagaaagttggttgacaaattaaacgaaagatgattgatgcgtttagaggagtgggtaggtgaagaattagttatattttaaaataaatttgaataccaaatatagctataatagtattttaagagggagggagtagatcgtagcaggtggacaaacacagctctgctccatgctatctataaatatacgtacgcgccacagacaattggagctagcttattgaaggaaactaaaggaagaggcagctactcctactcatctaggaaaataaattcctagctagttaatgttgtacaacttacatgcgtccatggcattctggctacttgcagacctgctgattcttctagcttccgccgccgagagcgtcgccggccagcctgctgccagttgccaggctaggtgcggcgacatcgacattccctacccgttcggcatcggccccaattgctctcgcggaaagggatttgagatcgcatgcaatccccgaaacgacagcggcgagatggtgccgacccttgccgccgccaatggcaccatccatgtgcagagcctgttggtagcgccgatcccggaggtcaaggtgatgctgccggtgg

SEQ ID NO: 62276 - DNA, 22487 bp, Oryza sativa
  unsure (1)..(22487): unsure at all n locations
acgacaagaacgagtacgagttccgtagcgccgacctcaagatggacctcaaccgaaccatgccggtgtggctggactgggccatccgcgactccgttacctgccctccactggaggtgcaggagaagaaaccggctgggtacgcgtgtatgagcgacaacagcgagtgcgtcaactccaccaacggtcccggatactactgcaagtgcaagcaaggctacgatggtaacccctacgtcgacaaggaccaaggttgcaagggtaagattaatgtttttattttattactcctagttaacagttttgctaaatatatagtgccaccattttatttttacctttcgttgtgtgcaccaaccctgttggtgtttaaattcattaactaatttttttttaccaggtttcatttgatcttttcactatttgatgtaggcgcaaaaaaagtgaaaaaacgtattgtgtattttagtaagcatctatatatacacggccgtgtgttgcaagtttcacaagttgcgtaattttgcgtgtgtgtgatatataggatttgaacgggaacctgttcttcaagtagcgtccttaccatctcacctataaagaactttgtgcatgcgggagagatgcttattcttttgacttcgcccctctaaaacttgtaatatataaattgcactataaatgatatcaaaaggaaaatttatcaaccacaaacttgtagatcacattgagctctacaatttcgatatagagcacagctccatctgagttcatttaaaaacataaaagtttgtttattcaacaatagatttgagattttgtaacgaatatcaggacccgtaaaaagtctcgaatgaaaaaacattcaactatatagttgtagagctctccaattttcataaaaagattttcatcatacgacttcatatatatcaagatactactcctttcctattgtagtagtgctattatttttaagggtggtattttcaagagaaccgcctcaaaagttaatttttgcgtgcctttccatataagaattgccaaaaaatgacatttatgtaggaagcccatctgaaaaaacttgtaattctatgaaaatgtctaaactttaaagatttatggaaagttcattttaagttcaaatgaggtgaaccaaagttatatatgacccttacaatatttttttatttatatttctgttagtataattgtttacttatcatttacctctatatgagttggtatgttatctaacgtgacattagtgaatgaccatactaaaagaaatgttctaagaaaaatattaactaagttttactataagaagtactagaacgatctcggagaactttagtttacctcaataggacttaaaatgaattatctataaatttctaaaattttgatttcttaaagaactgcttatacaaaaatagatactagagcttataaagatatttactacaaagttgtagatctagttaagctctacaattttaatatagaatgtctttatccaagatcgtttgaaatactcaaaagttcgttttcaaaaatagatctgagagtttgtaaaagaaatagatctaaacgtattatccaaaatgttgaaaaaaagtttcaatgtagatttcgtgaagagcgacaatttttataggcggtttcctaagaatttgccagttaaaaaatattttatacgtggtttataatcctggacagccgaagccatcttcacacaggtgattttcattttgagttgcctgtcaagagaaaataaaaagaagcctaagcctacgatttttttttactagtgacagttgatctaacgactaatatatatgatcctttttatatgcacagacatcaacgagtgtgatgtgtccaacaagaagaaatatccctgctacggcgtctgcaacaacatcccaggggattatgagtgccactgccgtgtaggataccagtggagtggtgaaggccccaagaaacaagagtgcagcgcaaaattccctcttgcagcaaggcttgcccttggtacatatgcacctcagcatttttttaaaaaaatataaaataatatactatatatatgtcacattgagtttacaccaattcaatgatttcccattgactatgtttttaattgtttctacaatataccattcaaccaaacaaagaatttcttataatgcctaaaaatataagggttgacagttaattgaaaaaactaaagaaaaacaacaattttaaaaaattagcctcctagcacatgatataagaatataagtgtgtataagtttcatgctttttgcattttattattttttgtaaaatataatatgtctgttatttacatagactacttttctgcatcgtttgtatatttttatacaaatcatctttcatgtgctacacaaaatatttttgttattttgtttgtaagtgatttctctctaatgccacatagaatgacttttcaaaaaaaatacatgcaagaaattttgaaacataaacagaaaattgtatattgtgtaaggaaactgcactaaagattagttacagcaatatattgtgcacgccaatattaatataacattagttgttcacaataatatttatcaaataaaatgagccttcattcatactccctctacccaaaatataaggcacaaccactttttttccatgtctcacaatataaggcttgcatacattagccatcacctcttggttctttaaatttggtttattttaaatcatctaccgttaaatcctccaatcaaattgcttgcatgtatggatgtgatccaatcaagaaggtgattaaattatttcttggtctttgtgttatgagtggttgagccttatattttgggatagagggagtatttctattaaaaaataatactgcaactcatatatggatttgttatgtttgctaataagttttttttaactttcgtaggaatcactttgggattttccttcctaattgttgctgttcttttcacgctaatgatgcacaaaaagcgaaaaatgaatgaatatttcaaaaagaatggtggttcagtgctacagaaagtggacaatatcaagattttcaccaaagatgagctaaagaaaatcacaaagaataattcagaagttcttggtcaaggaagctttggtaaggtgtacaaagggactcttgaagacaatactccggttgcagtgaagacgtcaatcgaagtaaatgaagctcgaaaggatgatttcacaaatgaagtgatcatccaatcgcaaatgatgcataataacattatcaagcttttgggttgttgcttggaagtggatgttccaatgttggtgtatgagtttgccgctaaggggaatctgcaagacattctccatggtgatgccaacatccctctcccgttgggcttacgcctagacatcgcaattgaatcagctgaaggtctaaggtacatgcactcatcaacaagtcgtaccatacgacatggtgatgtcaagccggccaacatacttttaacagataagtttatccccaagatctcagattttggaacatctaagcttcttaatgtagacaaagatttcaccatgtttgttgtaggaagtatgggctacatagatccagtattccataagaccggccatttaacacaaaagagtgatgtatacagttttggagttgtactgctagagctcatatgtagaaagccaacaatatatggtgaaaattgtagcctcatcattgagttccaaaatgcctatgatcaagagaacagtgggaggataatgttcgacaaggagattgcaaatgaagaagatatcctaatcctagaagaaattggcaggttggcaatggagtgtttgaaagaaaaggttgaagagcgacctgatatgaaggaggtagcagaacgatttgttatgctgagaagatcaaggaagtgtggatagggaaattatagtgtaagtcctcaacactgtgagtagattactatcgagggaactcctaagcactttggtgccagcatcagtgcaagaagcagtgcgatgctttctgcaccagccactccacttaactagaaggtggacaataggaagataggagctacaaacaaaaatatgtattttgtggtaggcatgatataatcaatgttatcaatcggtgtcatttcatttaaagtaaattgtgtttttcaagtatgtatctcctatttatgttttctgtaatttgaatcgatttttgtgtattgtagtacaaaactgtgtaatctattgttgttgtgtggaactcaggtcatgttatatattgtctatggttgttttgattgtagcacgtggcttggaaatatttcattgatgtgcatgtactgtaacattgcttagctatatctaaagtaaaaaaagtcattatccttgcaaagattttagtgtaatcttgcatagtttacagagatagattggcttgccacctatgcattattgggttccaatatgtgccaagaaggaaatgtctaacatttgttctcaaaatattttatatttctatacataggcccatttggttgggcttaaactcctaaatttaacttcaggagttggatatagagtggagttgtggagtagcctaaacctagctcaacttttctagtttattttataagagcactctagttagctccgatcctttttttttgtcaagcagaaaccttttggttgggctccagctccaagacaagttggagcaagagctagagcaagaggtggtgccatgccaaacaggcccatacaccagcaaaaatgcccatgcattacaatgtatcaagtcaacctttcgcttattcatcttctcatacattgcaacaagaaaaactaatataataattaaaaaaatcacatgattaggttacgtttcaatgtcaatatagttttgaagatgatgcggtgaattttttggataatggaataaattcaagcctttacttcaaataagctataaccacttattacaaaattctctcaaagagagcaaacattcagaccatgtcatagcgacgggcgcatccggcaataacagatccaatatacatcgtcaccactcagaccaacaccatgtagacttctcgcagcatgactgctagcaggcaccacatgtaggcgtcagcgttaatgaaggaacgttaacatagagatcgaacgaagaaggcaggtagatcgccacaacccaccttgcagcacgggatgacttaatgttgacatccccaaccatgagtggcgttggacggttggagtctgatgatcattattggtggcactagcattatactccctctaacgttttcaatttttttctaagttaaacttatgtatatttgatcaaatctatagaaaaatatagtaacattttcaacataaaataaaccaatttaataaaaccaattatattcaatgctagatttaataaaagcaatttggtgttgtaggtgttgctatatttcgttataaatttaattaaaattaaataagcttaacatagggaaaaaaatcaaagtgtataatatggtacaacagcagcagccacagccatcagagggttcagggtatcaccgcctccgtgcatcttcatatgtgatttcctttgccttccgcggagggcggttcaaggggtgcagactcggcggcagctgttaacctttgactgcttgcctttgacaagatgatgacgggaagaggctgacggcgaaggacgtcgtggagcaccggtggttgacggggaggcgcctccctgattttagattcacaattttttcacattgttttgattagcattgtaatctgtcaaacgagactatttaaatgttgttggtcgacttaagtttatttaatcagattgattgccttcaaaattttataccaaatttgtttgtaacagaagaaattcgtccatcctattgccttacatcttggcaagcacgctacaatactcttcctggacagaggagcaatgatggggtaaaaaggagcgtcatcattcgtccaattaatggcttatcaaaacttgaattttaaaatttgattttaaagttggttttttgatttttttttcaatgtagttttatttttcagctttggcttttaaatcactaaggacacatgtagtaatttttacttgcaaatcattttttatccctaaaaataagctgttacggcttatataagcagcaaccaatgacccaaaatcacaagaagaaaaactggcaggtaggtccaactgtatgtctgcagataattctttcatcccatcggtttaccactacagacgctgccgcgaccgcgagatacaaaacttgaacacgactgttttcaattcacaagcaccacatgcatggcacataagtataactgaaagaaaacgacggtacatgtcttaggctattgcaggtgttatgctggaccagcgtctaagcttctatcttgtttcataattagttaaaaaaaatccatcgcattgcgtgatggctggatttgcggcatcaagggaatggaaatgaagagattactccctccgtctctaaatatttgacaccgttgacatttttaaacatgtttaaccatttgtcttattaaaaactcactacaccatgtaccagaattcgcgacagatatctgttgggaaatattgctattcaacgtcatatgttctgtcgagaaagcattgtgacagctggtctgtcggtagttctcagaaaaataaggacataaagtctgtcggtaatgttactgataaattaggactaactatctgtcggtaactccgtttatgcgagcgcgaggaggccaggccaaaaatcagatgtgttcgcgggctggggccaaattttcgtttccctgcgcgcgcttagtaatctccggtctttatctctcatccccttccggacaaaccctagacttctctcacctcctccgctctcgcatctcgccctcgcaaaatcaggcgtgcgccgccgctcgctctcccccggctccccctcgcccgcgtacgcccgctctcccatcgccgtgtctccactctccattcgggctccctcgtccatctagctattggcgctgccctccctcttgtgtcatcaggcgccagcgccggcgccgccgcactccattcccatagccagccgccggagctggtgtctcctccatcctcctggtcggtctaaccgccacgacattggaggggaatgggggttgtcagatccggctgttccctaccttggggcgactggatccgtccagcgccgcatggtcctcctgcagatccccattttcagtgataaacgggtattttcttttaattagtcattcttactttgtgcgcagtagctagcatgattagtttgatgcgtttatgctcaggtgcgagggccacacgtccaggggtgggcaggcttgttgtacttcccctttgcggcggtactcattctcgctgaccctcgcatctcctcaatatacaagctttacaggtttcgtatattaattatcattgctttggatcttaaataactctgacaaatctttttaacttaattattttgctgatcaaaatgcatttgttatcagttttcaagaaagatatataacttgattcaagaatttgttaatcctgtacaaagtttagattttgactatatatagtgcatcacggtcatctttgcttgcctgatcaggaaacgtagacagggatgttactccactagaagtcttgaacataccttataggtgttgagctcagcagaaaatttatatgttgaactatagaatttggataattacttactcagactactaaattaagtatataaaatttgtggattaatgttcattccaatccttttaggggcatttacaaatgcagagaatgcaagtacttcatatgttctgaatatatgcaaactaaagtattttacagaaattcggtatgagtatattaattcaagttggcatttttatacttactgatttgcacttttaccattttgtgtccttatcttcttagcctgaaataaattggactttaattaatgcaatccatctatgtacctctgaagagcatgcatccagttgagatcactgatcattaggtgcggaaaatcttagcacttcttttctctgaaataaactcctatttccgttgtcaaaattatatatatagaaaaatgctttgcaggttagttcctgtagatcttgtttcatcatgtactcagtggttttgcttcttgaacatataataattctcggtttctatactttcctttgatcactaaaaattccagaagtgatggtggcaaacgcatttggataagataaatcttaatttgggctatgatggagtgagtggtctctgttgtttagctatgttttagctgcttaatgttctgtgacaaaatactttatgttaagttcctgtattgcaatttagacggtcttgtcttaagggggcataataatctttagttcctgtatgatgaggtgatctaatcatctaaggcttcctgctgcaatattgaatagtagtgtaaaggacattgaatgtgggcaggttagtatttttgaatcttctagtatgtattcacatttttattgcactactaggccacctcagtttatagattttagtaaattagcaatatacacaatgaaaagaaaactgttgtgttaaggaaattctttatttgccatccagaatgaaaagaacatgaggttcagtgcatccagttaatgtgttgcccctttgttttttaagatcaaactagtatttcacagctgagtttaaagagggaataaattctgatttactcggtatacatacgctattttgtttggccaacctgtgctgctttttacccatgcatgctgttctagttgcggcatctgctatgctctgattaactggcacagctactctggtatgattagctattttggactttggttaggattggaggctgtgctgtttggctattggttttgcaaaccatgactattagagggcagcaaacatctgattatacactaattgcttttgtatttccttttctttaatcttatcttaacatgcactgttcaagaactaatgcatgtacctcacttgttttcagattcctcatactggatagtgtccttaaccttggtggatatggggctgtagcatatgattaggtctgaactgctaagggtggtgctactgcctctggtttttccttagttcaattttatcacctcttaatcaagtgatttatgtgaagccaaaaaggacttgccacccttaggatcgtcaatgtacaaattctttcttagcttttttttttttaattcacaatcctctgttaaaatgctgaggagaatggtcaattggtcatgtacatgatgaatgaatgaatgaaatgaatcagacatttgagggtggttgtcattgtgaatgtcattagctattgaaattggtatgctcatgtaaacaggtgtaatggacaataatgtgaaatagttttctttttaatggtagcagagcttgctgtcagacagtgtgtcggcaaatctacttttttcatcaactcgtctgtcggtaaagatgtttctgtcgctagacatgtctgtcgttgaaggtaatataggggtcagttcatctgtcggtaaagatttatctgtcggaaaagccctttgccgacaggctttcgcctgatacacgtaatctgtcggaaaactctctaccgacagacaggatgatgctaaaggtggtatttaccgatagatgagctgttgcagctttcaggtcatggtgtagtgacttttgtgaagtatgtaaaactatatgtatacataaaagtatacttaacaatgaattaaatgataggaaaagaattaataattacttaaattttttgaaaaagacgaacggtcaaacatgtcttaaaaaaatcaacggcgtcaaatatttagggacggagggagtatatggtaagacttgtttgcgactctagggcagcagagattatcttacagaacatatcccagacgaccgtcagggagcaccattggtaccatcattcgagctggtgctggtcctctaccatatatcatgggctgtaacgaaaatgtccatagagacaaatacaatgtaacagcagtggcggatgcagacaaagcatttgaaaacgaagaaatatttgtgaataaaatttttacatgtgtgttcttagaaatctaaaagcaaaggttgaaaaataaacttcaatgagaaaatttcaaaatcaactctaaatttaagattgaaaatttaaattttggctgataagcataagcgaaaaaatgaggcttcaggattcctagcattggtattcggagttacttaaatcatgtttcatagaatttatataaagatgtgttaacaaccaaatttggaatcatcggtgtcaggaaagaagattagatcgaagcgaagcggaggcggagatcgagttcggaaacagagcaagaatcggctggagtccagatcggctacgattaggatcggctgggtctgagtcagactaggtaagccggtacagccgattccgacaatgcaacttgatgtatgatattgggttgaattgaggcgcttcaaggtgattgccgcacatggatagagtcctgagaaggcaattgtatctattaattaggatgttttatgtaatctccttagagatacgcttgggcaaaagtctgccgcaaagacatatggtatcttagagtttgttagagatagtagtcatgtccgttatggacatatcttgtaattctcgggtataaatagacccgagccctatgtaacttttaacacacatgttcaatacaatttcggcgcatcgccacccttttgctttagttttgtttcgacgagttcttactttcaggttgagctgcatcggtttcgatcttcaacaagaggtaaaacttgttatgacggcttgtattctcgggattagtgctttcatctttatgacactctaatcttgtttatgtaattcgtcgagttatcatatatcttacataatctctggcaatatcgctatctaacctacaatcggctaagatctatcgaagagggcagccgattaggttagattttgacgttgattcagattatataagatatctaccactctatgaaacttccagcggcttgattttctagatattgttcttcttttcatatttaatgctgcatcagttgagtttgatctattaagtcgtgcttagaatatcaatctctagcctgccttctggttgccgattagggtagcatcagagtttcagccgatcttatctgatttaactatatttgctctatatgcttcattgacatgttaaatatgccctttatgtcaagatattgttgtatctaagtacattaggcctttgtttgatatattatacctgttttaatatcctgatatagagtagtatcggagtattagccgatacatgctagatctatctaatcggctatgctataaacatacatagtcctattattaatatatatttcgatctaagtgatttatactgtctcggcatagtgaccgatctatcccaatcacttgatttaagtatatatcgatataagaactatatattggaaatatctacagccgatcgaatagatttagttctttattgtctatttacaactgccgatcgattcacatatgacatcggctcaaagataaatggtatgtcatcggcacctagtcgatcaactatcatttatagatttaaccgcggtttgtttgcttctatttcttgttgattacaggatcaaatcaactggcacgctcatacattcgaaggcgagctttggacctgcactggagttaagcagatctcccacgcttcgtgttttctgtcaacacgcttttggcacgcctggtgggacatttaagaagtcagccaacaattcttcttcatggccgagaaacaaccaccaccaccatctagcccaggctttgttaaggacaagatgctaaagctaggattgactgacgtcaatgaaggaaacgtcgtgccgatcgatccagaaaaattcacacctgagcagaagaaagagtttgaagcaatgttgcagcaagtacgggattagttcttgaactcattcatgtagacccgcaaggggacacttgtttagaagtacaaaataaaagtggttgctgatgatcctgggaccagttcttttaaggatggagatgggaaacaagctccagacggctcggctcagccgagtatcaaaggtgctactgacggctttctaggaaatcaaggcgacaattctcaaggagtccatggagtacaaggtgacggggtgcatggagttcaaggtgatggtgctcaggggctgcagggaggaaatcttaatcagaatagtgatgtggcacaggattttttcaataacttccaagatcgggttgattacgctgtgcatcatgctttgatcaatcagtctggggtgttagtcaatagcttatcaaacatgatgaagtcaatagccgatggttcaatagctgagcatcaggctgcaggcccggtttatttgcaaggaggtgtcttcccaaattatcggtctttgattaccgatgttcagccatctactcaggcggttacctccgttgcaccaacaacttagccaacggcgccggcaacaactcccctacctgcttcatcagcgatggcgccaggccagccggtgaaccctcggttgttaatgagagagcagccacagcatggcgggcaggttgtgaatcggctgacccaagatcaggttgctgccatgtttctgccacctcaatctgttgttgatccaatacatcagcagccgattcaacagacacccccaattcagcaggttgtacaaccaatccggcaacaggtcatgcaaccattcagcaaacaccaccaaggcagcagcccctacagccgattcagcagacgctgttaagacagcaaatcgttcagccgatccagcaccaaggttcaataagcgcatcggccgggtttgcaacgcctggtggtcagcctgtacaacaatttttaaaccaagttgtcccagaacatttggttcaccacgtacagccgggtggcacagtaatgcctcaagttattcctgagcacttggtacgcaatatccagccgaaccttcataattaccaagggggtaacttgaattatcaatatcagcctccttccccgcaagcccaatatcagctaggggcattggctcaacctcagtttgcgtctcaatacggtcagttcgagcccatgcaacagcagtcacaaggggcagctcagcaacaaccgtgggccaatgtgattgctgacgtaatgagggaacagtttgggcttaaaccaaaagagactggaagtttgtatcggcagccttaccctgagtggtttgagagagttcctcttcccaattggttcaaagttctagacttctccaaattttcgggacaagatggtgtgtcaacttatgagcacattagccgattcttggctcagtgtggtgaagcatcggctgtagacgctctgaaggttaggttattccggttatctttatatggatcggcttttacttggttttcctctttgttgtatgggtcgatcaatagttgggccgatttggagaagcaattccacagctatttctacggtggggttcatgagatgaaattatctgacttgatagcgattaagcagcggcatgatgaacctgtgcaggagtatattcagagattcagggagatgaggaacaaatgcttcagcttgagtttaactgatgcccagttagccgatctggcctttcagggtatgattgctccgattagggagaaattctcgtctgaagactttgatagcttgtcacaactgatacagaagctaaccttgcatgagcataggtctgcggaagttaggaaaagctctaagaaggttaatcatgtttgtctgtacatgtatgggtcggatgatgatgaggatgattctgaaatagctgcagccgaatgggtgaggagtaaaaaggtcataccatgccaatgggtaaaaagttctggaaaagaggagaagtatgactttgatattactaaagctaacaagatctttgatctgctactccgagagaagcaaattcaacttcctgctggtcatacaatcccatcggctgaagaattaggcaaaaagaggtattgcaaatggcataattctaggtctcattctactaacgattgcaaggtttttagacagcagattcaagtggccattgaggggggcaagattaggtttgattattccaaaaagccgatgaaggtcgatgataacccttttcctgttaatatggtgcatacagctggccaaatagccgatagggtccgtgcaaggggttttcaggcgaattcggctaagattatcgacaaatatcatgaagaatacgatgatggttttgatccccattggggttgtgagttctttagattctgctggaatgaaggtatgagattgccatctattgaaaactgccctgggtgcagtgatatcgttgagagctcaagccgatcatataataggggtaatcgactaaggcagacaagagtttctgttcatcaaagattgggtccagtgaatcaagatcatggccaagaggacaatgtaatcaggaagaatcaatggtgtccttctggtattttcacgaagaatcagaagaacatttaataaatctagatttggaaataaatgtggatggagaaacataagaatttctatatgaacagaattggttgtagaatggtaagctctaaaggagaagtgttgactctagggagatggtatttcatgtactctagagatgtttgggaaaggatccaaaggaaatatatcccagagcaacggttagaggctagagaaataaatggaggggttttgtaaaagtcaaaagaaataaaaaggagggttttataaagtttgaaataaagaaggattttataaaatttaaaagagagcatttaactttacaaataaaatttaggtccaaagtaaaagagattaaaagaaagtaaggttgcttcaaaggaaaagtcgagaagagcacaactaaaacttttcgcgaaaatttttccctgaaaatttgagtatattgcatcaacccttcgctcattcatcttctcatacattgcaacaagaaaaactaatattatagaaaaaatcacatgattaggttacgatttcgatgtcaatatagttttgaagatgatgcggtgatttttttggataatggattaaattcctgcctttatctcaaataagctacaatcacttattacaaaattctctcagagagagcaaacattcagaccacttcatagcgacgggcacgtccagcaagaatagatccaatatacatcgtcaccatggagaccaataccatgtaggcttctcacagcatgactgtcggcaggcaccacatgtaggcatgagcgttaacaaaggaacgttaacatagagatcgaactaagaaggcaggtagatcgccattactcaccttgcagcacgggatgacttaatgttgacttccccaaccatgagtggtgttcgaaggttggagtccgatgatcattattggtggcactagcattatactccctctaacgttttgacttttttctaagttaaacttctatatatttgatcaaatctatagaaaaatatagtagcattttcaacacaaaataaaccaagttaataaaaccaattatattcaatgctagatttaataaaagcaatttggtgttgtaggtgttgctatatttcgttataaatttgattaaaattaaagaagtttaacataggaaaaaaaatcaaagtgtataatatggtacagcagcagcagccacagcagccatcagagggttcagggtatcgccgtgtcacaccataaagttcttctcccaagcctaaatcgtattaataaatgaccccaataaattgtttgagtaatggcaagagagaaaccctaatttaataaattcaattaataatcggaattagcatgtggaatttttcttgggttctacatgtcaaaatatgctaacaggatttttagtgaaattttcagagctctagaaataattttaaccaattaaaattgagcacaagcaattattaaacccctggaaaatccttttttctttttctttttcccctcctttttccctaaatgggccgtcggcccatttcccctcccctttctgcccagcaagtggcccagccgccgccccgcgccccctcctctctccgggacaccgacaggtggggcccacctgtcgggcccgcccccaaccttcggccggcgccgcccgcgcacgtcacccactccccgcactcgccctgcactcccctgcaaccgccgccccactttcccgcccgcgcccacgttcgagatggctaggattcaaaaacaaatcccaccactctccctctctctccacctcccccacttcgccggccactccctgcctctctcggccacgtccgacctccccagacctatataaagcaccaccgcttcctcctccacttttttccctctttcgtcatccactcccgagctctccttcgccctagcaccgtgcaccacccgccgccgccgctttagccaccttcggccgccgatcgtcgccgctagagccgtcgccgagcctcaccgtcgccgtcgtcgggttcgcaagcccgcgggccacgccgtccaccccttccccatccaattccgccgtaggagtccgctttccaccgcgcgccggtgagctcgccatggccgcggccttcggccggcgattttgcccgcctcgctctccctcactaatctctctcggttgtttccctaggttgccccggagcccgtccaactgtcgctgtcgttttccatcactcgccgtcgtcgatcgtcatcagtgagacccctccccttttcccctctctcctgcgccgcctagccacgtcgccaccgtcggccgctcgccgccggtcgcggcctcgcgccgccgccgctagcgccgcgccgccgctcgccaggaccgctgggctggcttaagccgctcgcgcatgctctcggccatgcgccgccttcgccgtcagatctactcgtgttctttttatagtaaaaacatagtgaatcttctaaatatcatagaaaattcatccgtgctccgtttaagcccattcaagtctcagtaaatcaagaaaatgcaaagaatccattaaaaatggttttgttctctgtttcagtagtgttatagcctatttgcattgtttgctttgtatgtcgcatagattccggctctcccgacgctctggtgtacttcgaaatagtcgtcgaggttcctccagccgcagagcaaggcaagtcatgcttgtcacttgaacatattgatcccatattgcaaatgctctattattttcctttaaatattgcatcgttttataatgttacaatgggatgattacctactgtctcagccatatcatttgttatcctgttgctttgctagtttgggttgtaacatgactagatgttggattagggaatgcttagccattcttagttcaactagtacacaatgggggaattacgttaatgcatagactccagatgttggattagtgccactgctgtggtgttggttaattaaaatatattaaatggtgggctgtgggtgcatggttttgatggtagcgcccatagcaattaaggaccggttcgcgggaaaccctggaagaattcctcgtacttaccacaagccagcataggcaacggctgggcttgtagtgtagcttccttctagctgacgcatccaggcaagggtgggcgtgatggagttcggatgggccctgcgacggcctatgccgctttcggattcacttaggcacgagaagggactgcccgctgccttgcgaggactgggggtgaaacctgaggtgtggtgtgcttgattagatggggttatgcgaagggtcctatcacggcctccttccggtatgtcgtggtggcatgtcgacgcacgggaacgtgtcgtggggctgtgtcttgtgggtacagttgcaaaactctgatcagagtaaaactattcgaatagccgtgcccgcggttatgggcggtcaaccagattcaccgtgattagtctcaccctagattagtttaatggaactgattagttcaggtggtggtttgggcttgtctcaacgtggtgtagcgttgagcagtgattggtttaatattggctaattattacaaatgttttactgctttcaactactgtttataaatgctagctttatacaaatgaactcttttagccctcctttggttataccttgcatcataccctctgttccggtatgacttgctgagtacagtgggtagttcttgctctatctcccaacccttagagttcgattatgcgtccgatggtggtttctccgaggagtaggcttcgtccgtgccgtcgaggatgcctgtggagtggtgttcccgctgctatccaagtcaaggcttaggtcagccgatggtattatgtggctagcaggaagttgtatatgtttctcccgaattagcaagtcaaaaattttatcagcttttgtatatgtttctctgaacctctggatgtaatcttgcgcggtttcatcatgcctctgcctaactgctgccagatcggagagcttcatctcatgggtcccactgtagaagtagctatgtaattgcttctccaaatcgacccaaccttgaacaaaattgtaaggcaatgaagaaaaccatgtgaatgctgatccggacaaagacaaaggaaacaactgaacccttaaagcgtcaaccgccgatgcctctccacactgagccaagaatcgactgacatgttcatatgtcgaaacattgttctgtcttgagaactttgagaaatcgggaactttgtatcggtttggcagtggaaccctctcaaaccgctcagggtatgggtgccgatacaaatttccggtattctttggcttaagtctaaactgttccctcatgacatctgcaatcaagtcggcccatggcctctgttgaggtactccttgcacctgttgttgtatcggctcgaactgattgagttgaggaacatattggggctgaggtaatcctccttgttggtactggatgcgaggcgaaggaggttggtattggtaattcaagttaccctcttgataattctagaaattcggctgtatattatgcatcaaatgcttaggaacaacttgggctgcaaccgattgatctggttgtacattatgtaccaagtgctcaggaataacttgagccacattctgctgtctttgccgattatcaggtgttctcaacccagttggtatcagctgcaccatctgctgctgaatcggctgaaccgtttgttgttgaatcggcgaaaccgtctactgttgaatcggctgaactgtctgctgttgagtcggcgtcgacaacactggtccggcagttggctgagttggtaggaacattgaggcaatctagtcttgggacagccgactaatattctgaccagcatgttgcggttgctctctagaaaagagacgaggattaattgtctgcctttgcaccgatgatggcgcagctgagatagccggagtcgaagctgctgccgtcgactgaactggtggtgcattggaagtactctgttggttacctatcaccaagttcctgtaatttgggaagacaccacttggcaagtagactggccctgtgttctgatgttcagctatcgtgccaaccatcacagatttgaacatatttgttagtgtattgacgatctctccagattggttgatcaaggcatgttgcaccgcataatcaacttggtcatggaaattggtgcacctaggaggttcttcttgcacttcagcaccatcttcgccaagatcttcaaccacaccatcctgaagcccgtcacctttgtcacccaaggcatctacaacacatttaccaccttgagatgagcttgagccaacttcatcagcagcaaccactttcagcttgtatttctgaacaattatcccttggcgggtttccttgaatgagttcatgaacttgtcctttacgctactcatcatctgttcaagctcatgcctctgttcggacgtcagtttgtctagtgtgattggaataatgtttgtctcattgacctcagactcaaccccagttgatggtagattagttcctggaggtttcggaagcttggttttcggaggaattggcggcttgcttgccgacgacggaagattgcttttctgttgacagtcagttggtcagattatgcgagtccccacgtcgagcgatgccagaaaagcagtgtgtgaggtcggaaaagaacacagcagctggcctgggaaagatgctgctgtaacgttcacgtgcagagtccagaaatcttgctatgttaggttgcgtgagcgtgccagcttcgatttgatcctagtaatancaacaagaaacgaaaggacaaaatgaaacccgtggtttaaatcccatgaagcgatagccgtatcggcccagtcgccgatgacatatcatttatcttcgagccgatgtcatatgtgaatcaatcggcagttataaataagcaagataagactaaatctactcaatcggctgtagatattaacactatataaaatccttctgtcgatgtatatttaaaccaagtgattgggatagatcggttgccatgccaagacagtataaatcacttagatcgaagtatacattaacataaatattataaatgcttatagcatagccgatcagatagatctagcatgtaccggctaatactctgataccactctatattaagatattaaaacagatagaatatatcagacagaagcctaatatactttattgcgataagatcttaatataaagggcagatttagcatatcaattaagcatataggataaaaagctaaatcaggtaagatcggctgataacccgatactatctctttcgatgatcataaaacaagccaaatatcataattatagatattacttaatagatcgaacctaaccgatgcagcattaagcataaagacaagtatgaaatctaggcaagatgatgaaaacctacaagagatggtagatacacgatacaatctaaattaataacaaaacataactctaccgattgcttcctaacaataaaaaccagccgataacaagttatatagcgcaactaacatagattgcaacatgcatatgataactcgatgaattacataaacatgattaaagtgtcataaagatggaagcattaaccccgagaacgcaagccgccatgacaagttttacctctagttgaagatcgaaaccgatgcagctcaacctgaaagcaagaactcgtcgaaataaacgaaagtaaaaagggtggcgatgcgcggagattgtattgaacgattgttgtttgattacatgggttcaggttctatttatacccgagattacaaaatatgtccttgctggacatgacacttatctctaacaaactctaagataccataagtctttgcggcagacttttgcccaaatatatctctaaggaaattacatgaaatatcctaattaatagatacaattgccttatccgagagctttatctccatcgtggcaatcctcatgaagcactttgaacgattctagaaacaaccttgaaaccatcttcatcggaatcggctgcatcacctctatcggttgtatcggctatcctctgtccgatccatctcagctgatgcagactccagccgatgccttcgcagccgatgcatactatgttcttcgaatcgatctctttttcgaatccgcctcgatcccaatgtcaaacctggttcacaatttaccaaatttggtcgtcaacaaatggtgtgggtttaatgttcatgcaaatgattgctctatatcgatcgcaagggtgtagagtagtatttaataatgtaagtgcggtgcttagattatcagatttcactatttgggcttatatgccacgggtcagtagaggtgggccactgatggtgacaactcaatacgggtattcctccacattcgtatataatcctaagaaattttcgtggtatgggtactcctccgtattcatttccgatcagatatccatgacttattgtcgtaaggaactcgataatcagaggtggtctctcgaaacaccaggagggcatagttagggggtattggctacatgattatatactagtaagtgtctggtggcatagttagggggtattggctacatgattgtatactagtaagtgtaaattactgatatctatatactagaagtatatgaatgattatt

SEQ ID NO: 62277 - DNA, 5490 bp, Oryza sativa
caccatccaaaataggggcaaaacaaacattcagttaaaaaaagcgagggtaaaaacgaaaaccctaaaaagtaggggtaaaattaatattagacatcaaagtaggggtagaaacgaaattgccccaaacatataagtgctgttaaattggaacggagggatgcgactgatggagtagtatactgtgacgacctgggttgtgctatttttttttagtatagtttttccctttgacattgagatggcataaccgtaacagtcgcagttttcctattgtacaatattaataatgcagccatgcatgcgggcaccaccaacgacgatttccgtcggcgaaatttgcccttacgacctccgacgacgactttgccgaggccttccacattgcagccgtacgtgccgacggcccgacgccatgtatgtagctttccgtttcctaactctgatcgcaacatatggccccgttcggcagtcctactaagcttaggcacgcgaaacgaggaaaccattgatgtttgattaattattttaaactcatgaaatggatatatttaatattttaactcaaattctatataaaatatttttcacagaacgtaccgattattagtttgaaaagtgtgttaataaaaactaggacacaatttgtatcttaatgaaaactggaacatactaattattttcacttcgtgcatgtgtggtagctagctgcagtaaataattgactatactcgctcctctgttgcatattataagttattttttattttttttcatatcaaacattcttaaaattgattaagcctgtgaagaaaatatggcaatatttttaacataaaaacaaaatatcagaatatattcaatgctattttatttaatgaaactaatttgttgttgtagatttcgctaagtttttctataagcttagtcaaatctaaagaattttaacttaaaaaatatcaaaacggcttatgatataaaactgagggagtaatatattttgcaaacccctcattgagtatgatctgataatggattattacatgtggcgattaacaagtcacttgataagaagtgtaaattgtctttaaatgaggaaagcacagggcatgttctttttacttgtcctttggctcattttgcttggaatgtaattgccatggtgttgaatttacatactgtctctctatctttctgggatggtatgagagctatcaaaacaaaaatgaaatctcaagtgggtatggtactgtttgctgggatgttgtggggtttatggattacaaggaatgagtgggtgtttgaaaacaaactaatcaaaactcctttgcaagttgtctgtacatgtctctgtccctgatgcaaagatggaggctgctactaaaataaaaaactgcgctgacttggatgatttccatgagaaagtaatgctcattctggacggtttgcgggtggttgacaatctaccgaagacttggggtagcttgggagagtgtgtcgttttctgttccagttgcgtatatacatgattacgggtggaaaaaagcttgccgctcgtgagctcgcttggctcagtacaatagtgtcatatgcaaaagttttacaccttttctaactatttatttgttgaaaatgataattttgattgtcatattatctatttatgtgttgtgatgacatattaaagaaaaatatcactttattacacattctatgtggtaaaatgttgcttcatttctcttagacctgccaagctagctcgagcccataaacgagccgagccgagctgcacttttagctcgttgtttgtagcgagccaagccaagacgagctttccttgtaccaagctttcacgagccgagccgagccggctctgctcggctcgtttccacccctatacaggatgtggttagtgagggaggttacgttttaggacttttttatggtctgcacctttcatggaaagctggggaccccagtgtcgcgaagccttttgttaccctgtttattgctgtctacttttgtaagattctgtaagaacctattaattttcttctgggctttttacaaagccgggtagtaatatattagcttaattagatctgtgccattaaaattttgctggtttcaaaatataccattacaatttacgcatttgtaacgatgccactgctacttgtttgtaatctcagttgtgcctctaagatacgtattttgcatgtattggacgaaaataccctcatcttctacctctctcttctcttatcttctacctctctcttcacgttgcttcactactgaagaaaccatctttggtcggttgcccaaaatccaaaataatcccggtttaaataggaaccgggactaaaaaatatctttagtcccggttaaaagacctgacgtcactttttgatctttagtcccggttgggtaggaaaatagatacaggcagcaaaaaaacaataaataaataaaacagttgggacgtgaccctatatatctgtagtcccggttggtaatactaatagggactaaagatggatttttagttccggttatttcacccaggactaaagattcctatctttagtcctggattcctattctcggttacaaaaccaggagtatagggggttaggaactgggggtaaagaccatttctccactagtgcttcttgctctgccaccacgctgctcacgctccgccgctgctgctgcttgccgccgtgctgctaagcaggaagagaggaggaagaagaaaggggaagaaagaagaagagggaaaaggggtagtttggtccaattttttctggaaatgcatccgaggggtaagtagtggtatcttttaaatatgtgtaaaattataatgatatatttccaaatacatgaatacaagtggcatatttcgaaactgataaatttttattggcatgtatccaattaaccctaatgtatttgcctgatataaaaaaacaagtgacttgatatattttgcaaatctctcatttatatatatccatatacatatgcttcttcccttcaaagttaagttcctaatatttctcaatgtatatatgtactcattcctacctccagtctggtgaacgggtgcggactgcagtttgtatagtaagtacacgaagatcgagtcaagcgagcggcgtagaggtcatgtgtaccgtgtacttacttattgatgggaaaaggaattaattttgaaattataattttaaaaaaaataagaacgaactgcaattttaagattttggacacatttatttaccaatgcttcccattggagtatgggacctctgtattttggcctatactttcagtttgaccacttactaccttaggtacttttttgtactcctcaacctcgaacttatgttgcgttcttaagttcactttcccaacttcacctccctcgtttttcgagtgcacatatttgttttacttgttttgaaaaagcatgttacttgttttaaaaaaaattatattagatcaacgggtaggtgaagaattagttatattataaaacaaaatttgaataccaaatatatatagctataatatagtattttaagagggaaagagtagatcgtagcaggtggacaaacacagctctgctatctataaatacacgcgccacagacaattggagcttattgaagggaaactaattaaaggaagagctgcagctactcctactcatatatctaggaaataagttcccagttaatgttgtacaacttacatgcgttcatggcattctggctacttgcagacctgctgattcttctggcttctgccgcggagagcatctccggccggcctgccgccggttgccagacacggtgcggtgacgtcagcatcccctacccgttcggcatcggccccaactgctcccatgggaagggcttcgagatcgcctgcgatacccgaacccgaaacggcagcggcgagttggtgccgaccctcgccgccgccaatggcaccatccatgtgcagagcctgtttgtagcgccgatcccggaggtcaaggtgatgctgccggtggcgtaccagtgctacaactccagcgacagcgtcaccgagagtttcttcggcgcggtagacctcaacaacaacggcgtgtaccgcatctccgacaagcgcaacatgttcgtcgtcctcggctgcaacaccatggcctacacgaacaacggggacagtcatggcaaaggcccttacgccggcctctactacaccggctgcgtctcctattgcaacgactcgtcgagcgcgcaggacggcatgtgcgccggcatcggctgctgccatgtcgacatctcgccgggcctcagtgacaacgtcgtcaccttcggcgagtggtcacgctatttccaggtggacttcaacccctgcaactacgccttcctcgtcgccaaggacgaatacaacttccagaggtcagatctccaaaaggacctcaaccggaccaagccggtgtggctggactgggcgatccgcgacggcggcaactcctccgcatcatcgtcctgccctgcgccggaggtgagggagaagatgccgcctgagtacgcctgtgtgagcgacaacagcgaatgcgtcaactccaccaatggcccaggatactactgcaagtgcagcaaaggctacgagggcaacccctacctagtcggaggttgcaacggtaagaacacgtacacgagacaaacaatctactctttcctactcgctatctttcatattgttagacattttaattttttaggcctactaccgaatgctacacagttctaatgaaatagctcatatgtgctgacgatatcttaggtaccacaggtaccaaacacgatactcatagataccatactttgatatctgggtattataataacgtcagtatggtacctacaatactagatttgatatcgggtatcaaacatgatatctcataagtatcaaatcatgatacctacctaacatactgatttcaactatatcgtttgaacggtattgccattttatagtatttttgttaattttttcaaagtcaaacttttcttacgtttgacaaaattagtttaaaaaaaatagcaacatttataataccaaatcaaaatgtgttatattatgaaatagagggagtattgagtttgcactattgtgcatcccacgctagtcatgccatctatgtctgtttaccaatacaattttttttaaaaaaattcaaattaagttatttgtacacccgccattgaatcgaacagtatatatgcagatattgatgagtgcgctcgctcggatgaatatccctgccacggggactgcagaaacaccgtaggagattatcactgcaaatgtcgcacaggttaccagcctagaggaggcggtcccaagatagacgagtgcagccaaaagttccctctacctgcacaaattgctctcggtatgtgcctttccaacctatgtatttcttttata

SEQ ID NO: 62278 - DNA, 2268 bp, Oryza sativa
atatatccatttaattcatgcggcttaacgcttttgttcaatgtttattcaaaagtagaaaactaagagcataaaaggaataattaaagcaaaaccctaattaagaggatggaaaagattgagccaagatcaaactatgcggcaggctgtatatgtattcccaaaacaacatgaactagtgaacaaatggagtatataaaatcaattaatgaaaaacaaaattgtttaattcaatactctacagtgagcatctttttctatgagatgtacaaggaaggtgtaatatagtcattcctgaaaagaaactaacggtaaattcacgtagtcaactatttcaactcctagcttacatctggagatgactccgcattaaactatatcggacgcccacccagcctgcatatatatggtaagcacggctgggctcagatcctgcagagtggcagattggcctcaccaaatcgccttttgttcactctaatatgcgtagtcgcccctcgtatgattatactttgaattttgtagttatttgtcgatcgtttgcattaatatatacataaaatgattgttgatatgattttggatatattttaacatgttcttctagatttatatataaaattaaacttattttagtatggagagtgtatgtccgagtccgaatatactttaatgtagcataaaaagaatcatttttaaaccatgtcactaaatagcaccaacactactcagtacttgaatgacatgacatcatttctattcatcctttttagttttggagacttgcagccacatcccttagctatgtcaattaactcaggtggatagctagatatagacaactaattaatgagcgaattgtattgattagatggctaatcacccgaaggtttgcatgcagcgcatggggatagggggtgccaggcccaccctggcaccctcggtggcttcgccactgcttctcacggcccgatgttgtgcattgtgcatggagcccacccgacctatctatcatgcattcttttttcacttttcttatgcgtatacattgttttatatcaaattttaaataatattgtatcgaaaagtgcatatccaatctaccaatctaccatttgattacattattatatttgttataatcaaaacattttagaaagatctcacacaattatactttgataaagaattatccattgtttcacaatttatagaaaattatgctatcacgtgtgcaaatgtttcaactcacctcattatttaagaggaatgaaatatataaacatattacaacaaaacattacatatatatcaacgagtgaaacataaacaacaaaattcatatgataaatatatgtttgcaaatacttaattttataggaggtgtagattagagctgtcatacatacacacacgtacacatatatttggggcgtataaaaaaataggagttcatacacatataatatacgtataattttttttgtatgtatacgttcagaataagtaccccataccgccgtatgtagatctcgcattagcgttttaggatgtcacctgccccaaagtgagggattgcttgtagagaaacgtcaggagcagaactgacatttgttcagtcaaacattattaacacattcgatagaacagtgtcagccccttataacagcggattagtggaaaatatgccagctgcacttcaatgacatttaatatggggaatattttaactgtttgtcactttaaaaaaaatgtcacaactcatatactacggctgtgtttagatctaaagtttggatccaaatttcagtcctttttcatcatatcaacttgtcatacacacaacttttcagtcacatcatctccaatttcaaccaaaatccaaactttttacttttatgataagtaatttttcactctttgctgacatgcatggcatgccagcctgcactcccacggtggacaagacgtgtgaaatgtttatcttacccctcgtgaaccctacaagtcagctgtatctctttgttctctatcagtatagatggccaaagggcccgcccggcacggccccgcccaggcacggctgggcacggcccagcagccatcgggccggcacggcccgcccatgggctgcacctcctgcccaggcacgacctaccagctgtcgggccgtgccgtgctggcccgaaggcatgggtggcccatcgggcctttttaaaataagtctattttttttccctcctgggtaggctttttaatttgtatagc

SEQ ID NO: 62279 - DNA, 3111 bp, Oryza sativa
agatccctatgctttcgttcatggcatataatgtctatatttactcccctatttttttgtgtatcgggcctagctgccggcccatcgtgccgggccggcccggccgtgccgggccgggccggcacgggcccggcctccgtcgggccgtgccgtgcttgggccgggccaaaataccgtgccatgggctgggccatcgggcctcgggccttttggccatctatatctgtcagtggatccatccaggaaattaagcaccttcttgtcgtccgagttgacagcgatgggctggggttgctgccgctggaataggccaaaaaaggctgaaacatccatggtagcaaatagataaaattaacagagaaaacctagacaacggtatcccgttgtaacgggatactcttctatgagacagtacatatacctgatacatgttgtggtatcaactacatggtacccgatacctgcgatacctgttatctggtacctatgatacctaggacctgatacctgtgatactcgtgcaagagaatagttaatatgtctatcccgttgtaacgggatcccgttttgtagcagccctctaaaattaaaggactgcgtggagcacacaaatgctaaattaattaagccaagttcgatagataaatgcaattcaccgttgtttttttaattggttggttgaaatgaaaaggcagggagctgaaccattcgaatttttttttttcatacacaaaattttcagaaatggatatggaagctttttcacatatcgttagggtttttatcaaatatgcctggatagtttcaatggacaaatggatcaactggagcaaagtattcgcactagtaaccgggaacatatcctatgcacactccgtgcataccaactagcaaatgccacgaaaattctacaaaacattatacacatacttcgaataatattacacctatatgtgaaattttatcttcaaattcattatattttggtcgtaataaaaaagacaaaattctgacacatttttaattacctagaaaactgtcagattttttttgttacggctaaaatataatgaacttgaatatgagactttatatatatgtgtagtactaataggagtaaatgtttaattttatagaatttttcgtgatatttgttagttggtgcgcacgagaaacatgtgtacatagaatatgttcctggtaaccatatatgatctttagtgagttacaaatatcctaactattttcatatttttcattcgtaggaaaaaaaacaattctttagcttttgcatgtcagtcgtacatgcataatatatataaacattacactgttgatatatagtaatatatattcatctcaagtgagcattcgttattattttctattataagttgataacaacaaaatcacaagtcaaatgtatttgttatcgttgctaatgagaacttatgatctttgtaggcataagcctgggattttctttcctgatagttgctgcactttttactctaatgatgctccaaaagagaaaaattaatgagtatttcaaaaagaatggtggttcaattctacagaaagtggacaatatcatgattttctccaaagatgatctaaagaaaatcacaaagaacaattcacacgttattggccaaggaggttttggtaaagtgttcaaagggacgcttgaagataatacaatggtggcagtgaagacttcaattgaggtaaatgaagctcggaaggaggatttcacaaatgaagttataatacaatcgcgaatgatgcacaataacattatcaagctattgggttgttgcttggaggtggatgttccaatgttagtgtatgagtttgccgctaatgggagtctgcaagacattctccatggtgatgccaatcgctcactccttctcacactagacatacgcttggacattgcaattgaatctgcagaaggtctaaaatacatgcactcgtccacaaattgtaccatacgacatggtgatgtcaagcctgccaatatacttttaacagacaagttcgtccctaagatctcagactttgggacatccaagcttcttacagtagataaagacttcaccatgtttgttgttgggagcatgggatacatagacccaatattccataagactggtcgtttaacgcagaaaagtgatgtttatagttttggtgttgtattgctagagctcattagtagaaagccaactatatatggcgagaactttagcctcatcatcgagttccagaaggcctatgatgaagtacacagtgggagggcaatgtttgataaggagatcgcggtggaagaagatatctttatcttggaagaaattggtaagttggcaatggagtgtctaaaagaaaaggttgaagaacgacctgatatgaaggaagtagcagaacgacttgtgatgttgcgaagagccagaaagcatggacaaggaagctataatttgagtcctagacaccatgaggagattagtattgaaacaactcctacgagttttggtgctgattttagcacaaatagtagtgtgagtctttctgcaacatgcactccagaacgcaaagaactctacaagctatagatcaacaactggaagtgaagcaaataagctatatatataatctatcttctggtatgtgcagcgtacctatcctataaattagtatccattgattgaaataactttatgtcttcaagcatgcatctcctacctatgttttctagctatgacagagatgcagtttgttgtagcacaagattgtgtaatctattttctgtagtgtggaacttggaccatgttagatattgttgtatacatgtaatgcacgacttcgatcacattcaagaatttcatagagctaaagtagcttggaatgtgtatagaagctttttatttgtatagtaaacactatatatctaatgatctaaatcgtttgttgacaagctacaaagctaactaatatttgcttcatcatcaaatgaaatgtctgctgaaaattatattgtcctgatcaatactatttatccaatcctgcattgatgattttatagacaattttctgccatacgatcagaaaaat

SEQ ID NO: 62280 - DNA, 788 bp, Oryza sativa
agcaagcacccatgtaggcgtgagcgttaacgaaggaacgttaacatagagatcgaactaagaaggcaggtagatcgccattactcaccttgcagcacgggatgactaatgttgacttccccaaccatgagtggcgttcgacggttggagtccgatgatcattattggtggcactagcattatactacctctaatgttttgacttttttctaagttaaacttctatatatttgatcaaatctatagaaaaatatagtaacattttcaacacaaaataaaccaatttaataaaaccaattatattcaattctagatttaataaaagcaatttggtattgtaggtgttgctatatttcattataaatttgattaaaattaaagaagtttaacataggaaaaaaatcaaagtgtatatatggtaccaacagcagcagcagccgcaatagccatcagagggttcagggtatcgccgtgtcacaccctgaagttcttctcccaagcctaaatcattttaataaatgaccccaagaaattgtttgagtaatggcaagagagaaaccctaatttaataaatgcaattaataattggaaatagtatgtggattttttcttgggttctacatgtcaaaatatgctaacaggatttttagtgaaattttcagagctctagaaataattttaaccaattaaaattgagcacaagcaattattaaacccctggaaaatccttttccttttttctttttcgttttcccgcctttttccctaaatgggccgtcggcccattt

SEQ ID NO: 62281 - DNA, 13369 bp, Oryza sativa
  unsure (1)..(13369): unsure at all n locations
tcacctaggcacgagaggggactgcccgctgccttgcgaggagtgggggtgaaacctgaggtgtggtgtgcttggttagagggggttatgcgaagagtcctgtcacggcctccttctagtacgtcgtggtggcatgtcaacgcatgggaacgtgtcgtggggctgtgtcttatgggtacaattgtacatctctgattatagtaaaactattcgaatagccgtgtccacggttaagtttaatggaactgattagttcaggtggtggtttgggcatatctcaacgtggtgtagcgttgagcagtggttggtttaatattggctaattattacaactgttttactgctttcaattactgtttataaatgctagctttatacaaatgaactcttttagctgtcctttggttataccttgcatcataccctccattccggtaggacttgctgagtacagtgggtagttcttgctctatctcccaaccctcagagttcaagtatgcgtccgatggtggtttctccgaggagtagacttcgtccgtgccgtcgaggatgcctgtggagtggtgttcccgctgcaaaccaagtcaaggcttagctccagttatcttttattttccgctgcatttatgtaagacttttataatgtttgtaaaacgtggatctgtatatcaactttgtcgtttgtgtaccctggccggtcctgaacagggttttaatgtacattctgcttgaaattctattcgggaatttctgggcgtgacacgccgcctccatgcatcttcatgtgtgatttcctttgccttccacggagggagggcggcccgaggggtgcagactcggcggcggtgtgttaaccttcggctgcttgcctttgatgagatggcgacaggaagaggctgacggcaaaggccgccgtggagcaccggtggttggttcacggggaggcgcctcgccgacttcagattcacaattttttcacattcttttgaaaaaaatcaaaaccaactttaaatgtcaaacgagacgatgtaaatgtttgttggtcgacttaagtttatttattcagattgattgccttaaaaaaattataccaaatttgtttgtaccaaaaattatacctattgccttacatatcggcaagcacgctacaatactcttcatggacagaggagcaatgatgaaaaaaaatttactaatatacttattttttcaataatttacgtttatatatctgcattgtaaggatttgtaaaaatatacccatcctgcgacggtcccacagctctaaaacacgaaaacgacggtcccacagatccaaaacgcgggaccacgacggtcacgcgtgaccaaaacgcggcagcgccataacagccatttttatcaatgtgttgacactgttcacaaactagttggcactgtttgcatgccggttccgcacaataatgggtctgcgggactgcctaatgaacagtgctaaacagtgtttaaaacagtactaaacagtccgatcggataataaattcgctctagccgcggtgccgcgttttggtcgcgtgggaccgtcagcggtcccgcgttttggatctgcgggaccgtcccgcgggaccgcgcgttttggagctacggaaccgtggcaggagggtatatttttttcaattcctttctatgcatgtatataatggtaaattattgaaaaaataagtatatttgtaatttttttccgagcaatgatggggtaaaaaggagcctcatcattcgtcctatggcttatcaaaacttgattttaaagttggttttgaagttttgtttttcaatgtagttttattttttagctttggtttttaagtcacactaaggacacatgtagtaatttttacttgcaaatcattttttatccctaaaaataagccgttactggcttactgcttatataatcagcaaccaatgagcccaaaatcacaagaagaaaaactggcaggtaggtccaattgtatgcagataattcttccatcccatcggtttaccactacagacgctgccgcgaccgcgagatacaaaacttgaacacgactgttttcaattcacaagcaccacatgcgtaacacataagtataactgaaagaagacgacggtacatgtcttaggctattgcaggtgttatgctggaacagcgtctaagcttttatcttgtttcataattagttaaacaaatccatcacattgcgtgatggctggattggcggcaccaagggaacggaaatgaagatattgtatatggtaagacttgtttgcgactctagggcagcagagattatcttacagaacatatcccagacgaccgtcagggagcaccattggtaccatcctcattccagctggtgctggtcctctaccatatatcataggctgtaacaaaaatgtccatagaaacaactacaatgtcaacatgcagtagcagatgcagacgaagcaattgcaaacgaagaattatttgtgaatataatttttacatgtgtgttcttagcaaatctaaaaacaaaggctgaaaaataaacttcaatgagaaaatttcaaaatcaactccaaatttaaggttgaaaattcaaattttagctgataagcatcagcgaaaagatgaggcttcaggattcctagcatgggtattcggagttaattaaatcatgtttcatagaatttatataaagatgctagaaattaattaaataaaacaataatttagccccgcggatgaaaacagctcaaatgcatatatatctcacaaatttactagatatctgataactaaatgcaaagttcatgcaaaaaatcatgatccatgtttgaaaaaacattaacagagtatcaatttgactaatcttcaagagactcactcaaggcatttttctcttcagaatatgatgctttattatcattagacaaacactaagaacttcctcatctacatacaaatcaagggagtatgtgaagagaacggtgtatgggattgcttttgatacaccatcaaaggtcaatgttggtgttcttacaacacgccaatttcatatattttttttcgcttccttaaactgccttcaatgcacttgaccacaatctctcttattccctgccttagcaggcggtaaaacgacttttgtgacctctccatgaatttcaaagatctccttaatcttctctttagaagcattgtctggtaagttcttcacatatatagttttcacctgtaaaagaaaaggccattcagacaaatgttcctagggaacaacaaaacaaattaaaatgatatgaaatttcaaagctaattatctctatgaatataaaaaaaaatcaacaagcgaagggtgccttgtacgaataggacaatccatccataacagaaacaaccttgcacaggttgagccagtggacagtggtattgaatcagtagactaacttccacacaacaaagtgtagtctgttatacattccctaacgtgccatgtagaaactaaaatcatgatgcagctgcatcctggaaatacatcaataaaatgatggttattttggttcaacaatggtaatcagtagttctggataataaaaactttaatgtgaatgagacatgattaataaaaaatacaaaatatttcatgtttctttgatcatttgccagttccattagcaaattatggcacgaaagaaatactctctctgtcccataatataagagattttaggtggatgtgacacatcctaatataatgaatctgaactactaggatgtgtcacatcaatccaaaatctcttatattatgggatagagggagtaaattcaatgcctcttttacaagtgaatcatccccaacaataaattagtagtatcccccaataaataaattagcagtataaaggccactttaagagtttagattgataaatttgtcgcaatcttttgtttaccatcttgttgattaacgattgccttaaaatttctctactacgcagtcgttctctaaatggcccacaactaaacccttataatccctttaaatgggacataacgatagtgcttatcttatatcctcggctatgtttaaataatagaaaatgaggagcgtgattgagattaaatgaaggacaatgatgaaataagttggagaaaatggatgggtagtattcaaagtaaccccttcataggtaaaaaatcatttccctttcccattatccaaacggtccatcgaatctctgttacagacgaggagattggaagaaggattgcgacggaggaagtatttataggctgtaacaggacatggtcctggacctcgtcggcgcggaggagcggtgttcggcaccgcaccggcgaggcaggaactgatactagattaatctgaactttgattgattacttccaacgaaagcagcttacaatttataagggagctaagggatagaatcctaacaactcgagagataaagatgactaacaaactcctaaactgaacagagactaaaccgattactgttcctcattacggctgtgtcggcggaactctgcgacggcgccgtgcataatgcaatccccacatgacatctctcccccctggagaagcagctcgtccgcgagctgaaaatctggatactgagcatgaaaatcatccaatccgacccaggacgcctcagccgccggcctgtctttccactgaacaagaacctctcgaaccccacgtgccaaacgactttgcgacacagaagcaggttgaagacaaacatcaccatgatgcgtcggaggcaggggcggcgcatggtccggcggatcgccacggaaaggcatcaataatccaacatgaaaaacatcatgtaagcgagcacctggaggcagccgcaggcgataggccactgatccgatgcgctgcgtaatctgatatggcccataaaactttggtcccaacatgccgcgattcttgacagctagagatgcaattggtcagtgaagcaaacgaagcgcctactgccaactccagcgctcggtgcttgccatcatatgctgtcttgtaggtttgttgagcttgttccaaacgatcacggatggcgcgcagaaaatcatcccgttcttggagcgcctgttgtaccgccggcaaccttgtggagcccggctcgtaagctcgaagcgtcggcggctcgcgctcgtcgacaacacgaaacagagacgtccggagtgacgattggtacgacgtgttgtagcagtactctgcccatggcagccatcgaagccactgtcgaggacgatcgccagtgagacaatgtaggtacatggcaatgatcttatttgtcacctcggactggccgtcggattggggatgaaaagctgaggagagattcagctgaaccccagcgagccggaagatctctcgccaaaatgtgctggtgaagacagagtcgcgatcgctgacgatggtcagcggcacaccgtgcaggcgaacaatctccgcaaagaaggcggccgcaaccgaccgtcgccgtgtacgggtgggccaacggaatgaagtgagcaaacttggagaagcgatccaccaccgtcagaatgaccgtcttgccgcgaactcgtggaagcccctcaacgaagtccattgcaatgtcagcccagaccgctgacggtaccggcaatgattgcaggaggccggctggctgaagatgctctatcttgttccgttggcacgtgaggcacgcgcgcacatgctcttgcaccgtcgccctatcccgcgcgatatgaaagtccgcgcgaaggcgagagagagtcttctacgtgccctcatgtcccctgccgtgcgcgagcttgaggatggccggcagtgacggcgacgacagcggcacgaagacacgccccttgaacgtgatgaggccatcggtgaacgcccaggtcatcggtttgacccccttggcgatgtcgtcgcggatggcaactagggcaggtgtggcggccacctcacgacgcagctcgtcgaacagagaaaattggggtgccgataatgcaaacgccgccgccaagtgtttgtggacccccatttttataacagaaatcaatcgtgtaaaccgtacaatttccctggatcaagtagtctggtacacacgaatttatagctgaaataccaaatgctcatacacgagagtctagtacgaattattacaacataagcccgcaggcattatcttaaatcatcggaccgagcggtccggaatacaaccaaaagcagagtttagataaggcagcggaatttaggcagcggcatgccattgcacaggcaacgaccgtactaagacctattgggcaccatcgtcttcttctccctcctggtagtaggcataggggttctccgaagcttcatctcccgcttctgattaattttatatttgcaagggtgagtaccaaccgtactcaacaagccgccacatcaacaatacatatgataggggtatttcaaaggatggctttggttcttttgtgcaaagcaagttttataattcttttcacaaacttaagacctagcattgactgatcaaattttagtaccagtgtttgtatttaaacaacgacggttctgtccaccatccattgtgatcccaaggatagcttcccgccattgagtcgttatggttttctgaggacgtccactttcccctatctcaagaagtgactccaacagcatagaaatttcatcatgcaataacatatcccacacaagttaagaattcagagactagccaagtgtaatacatgtcccggtgctcaataaccgcgagcacggctattcgaatagttttggtttactcacactgcagtggatgtacactttacccacactccatgactgcccaacacatgagccttgtctcaacacatgagacgcgtcacggcaaagcctttcgataacctcgcattggcagtacccgctccatgaacttttcatcctcatgcactctaggcgtacacggtttctagcaatgagaggagttctggcgcacccgggaagggaagttttacacccatgtaattaagttataactaggctcaactcaacacacgacagtcctagcaatggcgacaccattgtagagcccctgccatacacatgagaaaccactatgcatggatactgcctccgctcggctatttactccgctaggtctaaccccattcgagaaatgtggttgtacgaggtcgtttcatgcttaacttcatggctcggtccttaattgaccggggacggtactagcctttcccggataccacccaaatccaccatccgccccggtctaaaacataggtttttaattcctttcttgtcaccattatcatggcaatgtggtgctcatgcctccacatgccgcatctcaattaccttcccaaaggtaattgcccaagcatatagcatttgataaatatgaatatgcaagattctagaatagcattctctaagcaagtgtcataattgactagggactcatacgtaattatggttacaaggaattgaagataaacaataacaaggcatggcataatcacaagtgggatgttcatcattgcatgcaatcttatttgtaaacaaaattaatttcacaattgggatcaacgtgatcaaggaatagtgatgacttgccttgctcgagatcttgtaggtcttgaccttcgcctggatccgcggctccctcgggctctatagttacgtgcgaaaattgatttgaattcggttagaattcaaataaaaacccaaataaatccaaatgaaagtcgaaagcgaaagtcaattcctttatattaattttactattcgcgaactaaagcaaacccaatttcgaattaaactattttgcgggtataaatatttgttgtcataagtttttaatttaatctacccgagcattacatccatataataggttagaaatttctatcgcgagctaaaaaacggacgaaatcctagaaatattataagacctaatttagtctatgactaaatgactaaatatgatacacggctaaaatccctagtttctaccgttaatcgattacttatagggattacccaaaaataatctataataatttatgataattcctatatttatttaattacatctaaattattaccgcgaattgatctcctatagatattactaaaaatgatctatagcaatctataaggattcatctaattgtttaattcgtaaataattagttctataatcaaattctagtactttaggtatttaaatagtaggagttcacctaacgatattttcattaatcctataatcaaattctagttattttaaattttctacacttccctaatctccctctaatttcctatttatttcctttttatttttcttttcttccctttctttttttcttttctttttctctctctcctctttttccctctttctcttttctctctctctttctttcctctcggtttctctccttctttctttcttctctccctcggcttctccctacatctctctctctcggctctctctctctacccggcggcacggcaacaaacagggggggcagcggctcaccgacggcggcggtgacgacggcgcacggcgcggcgcacttgggcggcggcgcggaggcactaaagcggcggcacgacagcacgaggacggcggcgcggcggcacgacggcggcggtgcgtggagaaggggagagggaggggaaagatggggaatgggtgtggggaggcttggggatggagggaaggggtttttatagggcgtggagaggaagaaagagaggggaagggggaagagaatgaaacgacggcggcgcggggcgcgacgcggcgggcgcgcggcgcgaggcgacgagacggcgcgcggctaggggtagaggaggggctgggctagggccacgtcgaacacctggcggccgatgaatagtgctctttttctattaaactgattttagtgtatttcccatataaatttgattccaaaattcctaatttttgcatatatgcatttactcaacatgtgtgttattccaaccaatggattcaccctagattaatattactcatatattatttatataatttatttgaagtcttaattagggttaattatcgtatttaaattcaattgatccaaatatggtcgcgacaatattttatttacttctatccccacctaatccttttttttaatttatattcattttaccaatttatttttagggttgatttctaattaactatcctttactcacgattaataaacttcgaaatcaaaatcaaataaaatgatcgaacaaaatcagcatgatgcaatttattaaaaagtttttgaaggcccatatttctagagtttagatttttgtcggtcgaattttcagggtgttacagtgttcgtcccgtcgtgaaagcacgtccgccaccacatttgtggagcccggcttgtattccacgacaaagtcaaaaccgaggagcttactagcccactggtgctgagggacggtggagaggcgctggtctaagaggaagcggcgcccccaataagtatggccgccaatgacgcaccgcctggacgaggccgatcaattcgcgttcgtaggcggcgagcttggcgtggcgcggcgcgatcgtcttgctgaagaatgcgaccggcccggcgccttgatgaagcacagcgcccggacctgagctcgatgcgtcgcactccacaatgaactccttgttgaaatccgggagctggaggactggagctgccgtgagtgcgtgttgtagttgtcgaaacgccgatgccactgtctcggaccagtggaagccttccttccgcagtagcgtcgtgaggggcgcggcgatggtgccgagtcgcggatgaaacggcggtagtagcccgccaagccgaggaagccccgaactgcgcacgcatttttgggcagcggccagtccaggacggcctggatcttgctccggtccatggcaacgccggcgcttgagataacgtgtcccaagtacgagatggaggagaggccaaactcacacttggatcgcttgaggcggagttggtgatcctgcagtgtctgcaacacggtgcgcacgtggcgaaggtgttccgaccatgacgaactgtaaattaatatatcgtcaaagaaaaccaacacgaaccggcggaggaacggaaagaggacgtcgttcatgaaagcctggaatgtggccgacgcattcgtcaagccgaacggcatgaccaagaactcaaataggccttggtgcgttcggaacgccgtcttgtgcacgtcctccgggtgcatccgcacttggtggtagccggaacgcatgtcaagcttggtgaagaacttggcgcctcgcagctcgtcgaacagctcctcagccaccggaatcgagaacttgtctttgacggtcttgtcgttgagggcgccgtagtcgatgcagaacctccacgtgccattccttttcttgatcagtagggccggggaggagaacgccgacgaactcgggcggatcacgccttgctgtagcatcgtgttgcactggcgctccaactcatctttctggatgtgggcgtagcggtacgggcgcaccgcgacggctgagacgccgtgttccaggcgtatgcgatggcagagatggcgctcaaaaggtaggccttgtggttcggtgaagaggtcctgaaagctgtcgagcagctcggacatgagttcgcccgtcgcgccgtcgatggtggccgcctagagaggtggtgcaggtgcgtctatgctggtccagatgacgcgattgttgggtgagccgaaggcaagggactgcttggcgaagtcccagagcgtcggtccgagagagccaagccattgggcacccaagacgacgtcgtagccgccgagaggaagcgcgtagaaatcgatgacgaaagtgtggtcgccgatggtgacacgctgggacggaaaacagcctggcgaggtgatgcgatcgccgtttgcaactgcgacgctgaggccgtggcgcggttccaggggaacacgggcgcggcgggcggcaacgtcgctgataaaattatgtgtggagccggagtcgaggagggcgacgaggtccgttgcgccgatgcgggcctgcaccttgatcgtgttgaatgtgggcgtgcggacgccggccagagcatgcagcgagatgctaggctcatctagcgtgagcgcatgcgccgtcggtgttctcctcagcttcctctgggaagctgatgacctcgacgacgaaggatttcttgcaacgatgtcccgccacgtacttctcgtcgcagttgtagcagaggccctcggaacggcgttgggccatctccgccggcgacaagcgcttgcgagggagagccgacaccaggggctgtttgctggtcgatgccgatgacgcggcgtccggcgccgtagacgcggcagatgcggcggacacgggcgccggcagggcagggagcgaaggccgtggtgtgcggccagagcgagccggcacggggtccgttgtgccgagttgaacccgctgctcatacgcccgggcgagcatgatcgtgtcgtccagtgaactcggccggcagagagctacatctgtcttgaggggattgacgaggcctgccgtgaacaattgcacctgctggttctcggatagtttggcgtcgcggcaagccaaggcgaggaagctattgatgtagtcgtccactgtgccggtgcgccaaagtgtcgtgagttcgccgagcgggctgtccgtcatgggtggcccaaagcgagtgtgcaccaacttgacgaagcgctgccacgatggttcgccggaattgggttacaatctgtagtaccataactgagcatcaccgagaagatgcaaagatgcataccagacgcgacgtgactccggtgtcttctggccacggaagaacgtctcacagcgattcagccagggaagcggatcgcctttgccgtcgtaagttggaaactccaacttggcacgaggaagaaaactgttgtcgacggtggagtcgtcgcccgactgcttgtcattgtcgccggtgggtggcggagcgccgcgcggcgcgtgcgtagcggaccccgacgtctctggcacgggcgacgagcgatggctggcctcgacgcgctggacggccagattgagggcgcggacttgctcggagtactcgaacgcggacgcctggacttgtgtgacgcggtcaggcaaactgctgagcttgggcgccaggggaaccaaaggttcgaggacgctcatcttcctggccaagtctgagatttgggccgccatggatgtcaggttcttggcgatttcgtcgagctgtgcttgagtggaagccatgggaacggaaccagagaaatctgataccaagttgtcacggacgaggagattggaaggaggattgcgacggaggaagtatttaaaggctgtaacagaacgtggtcctggacctcgtcggcgcggaggagccgtgttcggcaccgcaccggcaaggcaggaactgatactagattaatctgaactttgattgattacttccaacgaaagcagcttacaatttataagggagctaagggatagaatcctaacaactcaagagataaagatgactaacaaactcctaaactgaacagactaaaccgattactattcctcgtcacggttgtgtcggcggaactctgcgacggcgccgtgcacaatgcaatccccacatgacaatctcggcaagcagccaagcacacccaggagcataatgctctacctggagtcctggacagaccagcaatgatgaggttacaaaatcacgcacccaccgaaaaaactggcacaagattaacatattggggaaaaaaatgtaaagaggtagacaggtccaactgtatgtctgcagataattttccaattccatcggtttaccactacagacgccaccgcgagatacaaagcttcaagacactgttttcaagtcacaagcaccacatgcatgacagataaatataactgaaaaaagaagacggtacatgtcttgcgcaattgcaggtgttatgctggaacagggttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62282 - DNA, 970 bp, Oryza sativa
aagtgaaaggtgaggcaaacgcgcggttatataggcatcgatgaatacaaacacagcttgcttgcattattgatccatcaatcgatggatcgaccagctagctatgagcaaaaagggccaatttggcgccgaatttgcagatgggcgaattaaggccgtccaaactgaatgatttgatcacgtacgtccaatcctctctgcagcccagctacgagaaaataatgatctatccatcggttggtatacgtaggatccacgcaccgctttatttatgcatgcatgtgaaatcttaacagcaataagtacaataatcgcactgcgtcttaattaacttcttgtaaactgagtctgagagatgattaattgatcaggagtactacaatgagccgtacatcgtatctgcagtatatactttgcaaatgcattggattgttattggattggatcctttgaatatatgatcgcttaacacatgcaaatttaaaggtaatttattgtctgcatgtatatatgcacttagtacatatgtgcagcacaaagtactgacagataaagattttgaacatttgagattaattgacaaagcaggaaacataattaaggggtttttggcagaaggagacatggaaaaaaaaaagaggacagagaaaattcttctttgattgtgcggtcgatcagaatctagattacaacttatatatattgattgggtatacgaagtatgagattgtaaaaaaacaatatgtaattacttattacagatccaatagaaattaacattcatagatgagaaatgcccgtaggcttatattccctcatcagctaattgattttaaaaaataacttctatacttttgaggcctatggccatttctcatctatgaatgttaatttttgttggttctgttataaatatttagagatgaatatcactataattggcaaatataagcattgtaccattgtgcat

SEQ ID NO: 62283 - DNA, 19185 bp, Oryza sativa
gactaatatttcaacttggacaatatgtgtcagggttttggtgggacgtcatgatttgtgcttggaataaattagtgcagctaatccatcatgctgttaatttatatatatatatatatatatatggaccagtagggtcaagtaagatacagaagagatttgcagccatgttgttaattaattattattcatttatatcgtgtgcaaagggtgtatcctgcaagccaatgaccttgtactaatatatactatatatgttcacattagtgcctacgtgccctttaaaaaattgtacacatttgtagtatgttttcttggagttgttcatatactttcaatatatataaaaatgaggtacaaatagcaaataataaatttccatggtactatatatctattccgaggtagcggtagtacgtagtactactaattaattaatttgatagtacatgttctattgttttctatttaagaattgcaataagcaaattgtcatatattccttgatcgattgcagggtgcccaggaataatatgttgtcctatctatatgtaaatattgctaccgattcatattgaaatgaacaaagtgtacttttggcacgaggccggcactaatttaatcggtttccctcgacattttatgctggtccatcatatagaaaatatccccaatttattcctgttctcaacaattatgacaacacccaatagatcaggacattcagctcccaaaacaattttacgaataatgacttagatggttgttgcttatataatcttttacatatatatcatgtttggaacatatccgtgcacataagtttcccgtgaatattttgtatacacaactagcaaatgtcacagaaaattctagaaaagtttagacacatactcaggttaattaaatagttgctctaattaacagacattgtgtgagagaaaactaataaaacatacgtgtgctacaaacgcggaatcagtaatattggagtaataatcttctaaaaaatatacaaaagactagtgtagatgatgtacctgttttctgacggggcattgcgaagccattgtgcatcggtagtaggctctagggcaagggttacccttggccatcttctgcccgtacttcctccattggcatccatcactgatctacatatataaacatgtatatatgcttaaagttaatttaattactgattataaagcatatatataactttcagttttttcatcagctatatggtgcatgtgtaatagccggtttaatttgcaatgaagttcacaagtactccatccgtttcaggttaattataagactttctaacattgttcatatttatataaatgctaataaatctaagtacacatatatatttagattcattaatatatataaatatgggcaatactagaaagtcttatagtatgaaacggaggaagtataatacactacgaataaaattaattacttaccattggagcctcggatcgtgctcgcaccgacaccctggccttccggcacggcgccatctccgccgccggcgcctgctcgccgccgccattattctccccgccgctgccgctctccggcgtcagccgcgttaacgtcgctgccgccgccggcctcttgctaccaagagaaggcgacacgttctcgtcgccctcgccaccatcagagtcagctgttctatcgccgtccaccgccgccgccgctcgtcgccggtggctcgccggagacgccgccgcgagcgcgtccagcaactgcacgccggcgatcggagcctacaccaatcgatcgaacagtagcacgtacgtcaattgctattactgataaagactaaagtgatcgaaaaaatcaaggattagcatgtgccaactactactaagtaaatgcagcttagcttcagtttcaagttcttttgtgtttggtctcttgcagcatggattctctcttgtttgattctgtggctagaaacacactgcacacttgtgcatttgtatctcgatcgacacacgtcgatctcttgcaattaatttgttataaaagaatgatggatttgatcaccggcctaaataaatcatggtgttgaatttatgctgacacgtacggtatgcatgcacggtctcccttcgacgatcacaaaattcaaagggtgatgcttgaggcacacaccttaattaattaattggaaaatggatgcacagaagatgagaagagatcgatatatacatgcaaaaaaatgtgccaaataatgtatttctcttgactacagatctaggtaagtatactatcgaatttatcatgcaaaaatatgtgccaattatgagccaaaaacgtattgggcaatatacatgtaatgttggagttattagatatataaaggaatatatgcatcaaaaatagcaaatttatcgaattatatatgtgtacatatataattctatgttttagttacaatatgcatgggcatgtccatgatgcacctagaaaataaacatatgtataaatataatttttgaataattgacaaattagtgcagaggtttgacaaactagctaatcatgaatatttagcaagaaatcttgcacaaactaaaccgcacgtcactgtgataatcgagagtgccaatcaatattggttaggttcatccatataggtctatatccaaatgttttaggaaaaaatatatacatcattgacatcacggtctacattctgaattgaatagtagttggtaacagacttaatttacttgattagtttgattatgatctgaactaacgacatatttgaaccgcggcaatgcgtgcttgcacgatttgtgttaattagtggcgtctagcatctgcatgaccgtgtactgttcgtcgaaaaaaatcaattttttcccttaatcctcatcgatgagttaattgtgcatatgtatatatagaacaagaaatcaggagcagaataagccgtcgatcgttaatttgaaacacaaaatgggaagccaggttgcaatcagctatgcggatttataggagcagtttcatgtgagacataatttaattactagttgctgcgtaacatatcatcggtttcttctattgaaagaaaaacaaatagtaccatgtagtatataatttgctgcacatgaaagtacagcgttgactagagatcactataagttagtgtgagagaatcaaataagtcgtacgtgtatcaattttttggttgatcgatcaattagcagcagcaggccggaaaacatatttgatttgatcgggttaattgagattattgtcacgaattgcaaaaattagtattaattacatacctgctgctgatgcttggtgtgcagctgctgcgcctggacgagctggtggtagagggcgccatagctgctggtgagctcctccagcctccgccgcagccgccggttctcttcgccggcttgccggagctccccctccaccgtcgtcgccgccgcatccatctgctgcatatatatatataatgttatgaattaattccgacgtacgtactcccttaaggtcatgaaaagtatatatatatatgtgtgtgaattgatcccccataatagatcaagatgagtaaagtaagtaagatgcttaattaccttgctttggtgaatatttgactgccctttcttctcctcatgatgatcaccgtcgttgaccgctgtcagcaagtccagcgcagtctgctcgatcgatcgatcaaacacaatcagaaatactaatcaagatccatcgatcaagccatcgatcgagatcacatgcatcttgcaacctaaatcccataattcatgaaacatatatatgcaagcatggatgtatcgtcaagcaagctattagctagatcttgacgacgacgacgacgacttacgctgaccataaatccggcgtggctgctgctgatcccatccgcacggaggacgtcgtcgtcgtctctccggccggcaccggcaccggcggcggagaagaagtcgagctccttgatctcgcgggcgcacaagcctcctcgctcctcttccccctcctcgtgtcgttgcttctgcaccatcatctccatggatagagctcgatcgatcgatcagtagagtgagaaggagagaaatcaattaaagtaggggagagctagctaggtcgtagctagctagctttatatggctcttgctcctactactactcctagctagttagctaggttccaagagagagagagagagagagtgagaaattagtaaagtagtttaacctatagctagctaacgacgagaagctagcatatgtaacgtgaaacggaaagacttggacttggaccaaattatgcaagagaatggggatcggaatcgatggggatggtgggccagccatgtcagacggcggcgtacgtcagcgtgacaggtggatgaggcactcgcgtccacgtgtactgcatgggccgggtcaacggagtcaacgcgatgtagactccctttcgatcaccaagttgatcgatcgagataagctatagcctaggagtgatggtgcgtgcatgagaggatatgccacgctctgcagcaaacaattaactccattcagtacgatctctctctctctcaaacgtccatgattttttcggctagcatctataaagttgtgtgctagatgatctaagtttaaagtctcgcttcttctaattatctgatattaggttcttccctaatattcgcttcttctaatcatctctcttttacttgacttgatatcattaattacacaagaattaatcatattgattagatttatcttgcaaaatacattttttaaatataggctgtgtttagttcctcctccaaatttttttttgaagaatacggacacacatttgaagtattaaatatatactaataataaaacaaattacagattccgcctgtaaactgtgagacgaatttattaagtctaattaatttgccattagcaaatgtttactgtagcaccacattgtcaaatcacggcgtaattaggctcaaaagattcgtctcgtaatttacatgcaaactgtgtaattggtttttttcgtccacatttaatgctctatgcatgtatccaaacatttgatgtgacggaatttttggaagcttaaagggaactaaacacaaccatagtttcattatttttttttttgctatgtaaagaaagtaataaaccagtgtcaaccacttgcggattaatgcgcatgcacttgtagccaatcgaaatcaatatgcatgaaattcaaaaagataaacatgtggtaaactctctttcttcataagcgtagtttcatgagaaaggtttgatggcattttcacggccggatctatatatatctctacgactctacctagcgtgttggatccgttcttgcacattcacacaccatatggactgatgcctaagtgtacattatccagccgcaatatgggtggagaaatcatgaagaaattgacacatgaggcttagtatttagctagagtcaaggccttcatcagctagtagttgacaatatctgcatatatatcaagaactgaagaccttttcagtttagacttcagagtgcaaaaaccagctagggtaggttgtttctgcaagttaattagttgttgccatgatttgtatgtgaacactaagattattaactaatgaaacattgaaacactacttgtttttgtggacgttctccactgacacatgcattgacaatcttagcctgccggcgactagactgtacttgtcgatctacgccactacactgtttataatttttgagtctccattgacggctagctagaaattaaactgcaaaagatattaaggacaaacagtgctaggatattattgttcccttccatgatgatggagtactagctagtagacatcatctgtcaggaatcaattgaactgaagcaataacaatcacaaacatatcttttgttgtagactcatgaaatattaatttatttacagtgaaattgaataatcatgtaactacaacacatgaagcacaatatgagcagtatatttagttaatttcctatttgaattatatacgtggttctgagcttgcgtggtgatccgaattatttcaagttatatatattcacactctagtcatcttctatatgtatatatatttctcaagccaattattggttgctaaccaacaaaagataaaaagtagagtgcatacatatgaaattaaatatatttaattaattgcagccaacatggtccgattaaatatgtttacaagtagccaatgaaacttttagagactaatgaccatctggtccagctttaatgttagagaaagaaaacagggaaaacactagccaataaagtacaagcataaatcaatgtgatcaaatgtgtactactacgtcgtacagttagatatatcataaatatatcaccgtgacatacaaatatatttatatatgatggacaaccttaatcaggcatccaatcatatatcaagttgataagaggcaacgtgtgtttgttcaacctgcaggtcttaacaaaataaagaaatgaaataaaagctcctacaagacaaatatgcgtaggttagctaggcatacttgctccatcccaaaatatattagtttacttttgtaggctaaggctgtgtttgttcggataagaaaaagagaagaaatctctcatttttcgctatttttctttgcaaaaattatctataggaaagttactataaaaaaatatactacctccgtcccagaataattgtatttctataagattagagacagattagcaacacacaaaaatgaccataattactctataataagcacactgcatgcacacattacatacttaaacttgattaaaaggaaggttgggagatgaggatgaaaagatgggaggctaggagacaatatatcttcatctaattaatttattggattctacacataattagaaatacattttttttacaaaatttgtatggtaaaaatacaattatttaaggacggaggtagtattaattaatttttcaagttcagaataattaatactcaatcaatcatatgctaatgactcacatcgttttacgtatactctcaatcttctttttttctcctctcaaacacaccctactaaacttatttttaggtaggagggagtagcgtgcattcggtgcgtgcatgtgtgcagtggcggatttaggccatttctgtggggtcggctgaccccacagttttttgaaaaacaccctttaaatctcgattttcatgtataatccaaaaataattagagaaatgactctacttaaatataaatcactagtaattgatcctacaggtataaaatcctggctccgccactgcatgtgtggacttcattacttgataaagatcaagtagatagtatgatgtctagtgtgtatatgtatgtagcaaaggtgctgatgaaaacaaaacaagatcaatgctgagttactgtcttacatactgaccattatattacacacgtctctctccaaagaccatggccaagtctagtgtgtatatgtatgaccatttgcaaggaggagaatgtatgcaaagttgcttgcatttgtatcgatccttgatctgcatgcacttaatttctacatatgcatctcgtgtgcatgcatgggccggcctcattattgttttggtttaatttaataagtaagttaaagttccttcaaaaatatggctggtacgttatgtgtctatcaatggcaccacaagaatataattaacttatatatgaacatgcacatgcaagatcatgagaggccctagttataaatataattaacgatcactaattaatctagtcttcacaaggtgacatatgcgacattgttgaggtcaatcaccgacggccgtggaaagagaaaggcataataaagatcacaactcacaagtaaaatctgtaatttgcattgtgaggtaaacttgaaagcaaaaggcaaggaaaattaggagagagatcgatggatgagaacgacacgttgacgtgtatatgcagagacaaattaaggagctgagattgtattggcagagctactagctgcaagagaagatcgaccagaaacaaataaacagatcaatccatcgaattcttgttgatagcttttagctggtaaaagaaagcggcgcccagcttagagtcaatagcttaattagcttgcattgatctggagtcttctctggaccagactaagctactagtactacagcagtagttgttgatgatagtaaaaggtaatactagttctatgtattggtccagccaatagtccaacgagacaatccaattaaccatgcaactggaccaatttgcagaggaaattaagcagattaatatgcatatggaatatataatgtattttgtgtacattctagtttatatgatacagacatcagaggcgcctataccttctagctagctagttgatgcaaagttgatatgcatatcagagtagtccattaatttgtataccttgaaacttaagaatttaattaatttagcttagagaaagacattattgattcatcagaaatagatatatcttaatttcgagtaattaaggttgctaggttgatgcccatgaccgttttcttacctttcatgcagttaattataattctggcatatattgattgcaaccagaggccaaaattttccagttagctagaaggcgacatcgatcgtgaaggcgtcggaataagccgtcaggttcagagaggttaattcttcgtcaattcgcgtcgtttggagatcgcatggatagatggtatagtagctagcggccttgcatgtctgcttaattgatctatcaatcgacctgtatgtcttgaattcgtcagttcctttgaagattttgagactagaatgatcaacagatagctagctagctaggagctagacggccggaaaattcatcttagaattgaattgggcaaaaaaaaaaagaaggaaatgctctcttttaattcttcccatggatccttcgctttcagtatatattccttagctacaagtccaataaacgacggcgatctttttcacagctagctgagtttaggaaagacggataattcgcttatacttcaacacacatcttcacaagaaagctaactcataatttaattgtgaggatctttcgtagtcctaactacaagtctaacgaacaataacctcttctttctctttagagttacatgcaccaaccaataattcatgtgaaaaattgaaagaactggcgatgagtagtacttcacatgtataaacatgtatatgttcaatcccacacacaatgagagaaaataactacatgcatgcatgatgggttctctcacatccttaaggatgtgttcgctcgattgagttgggaaccttctcttgtgaaaacaagctagctctatagcgtatgattaattaaatattagaaaaactttaaaaattaattaatattatttttttcaataacttttcaatagctttttttaaaaaagcatacctttagcaatttggaagcgtgcatgcggaaaacagaaggggtatgagctgagaaattagactcctgaacacataccaccatttcaaagctaggaaggttgaactggtttagaagcaagtttacgtttagcaacataattgtgaattttcaatcctattctaacatgtaagttcagttttgattcctctctttaattatcacctcatataattgtgaacaacacgtacgggttaaataattaaaaatatgggtatgtacttgttaatttaataggattatctagtttttcacttacttgaaaatacccacaaatttcaattacttttggatgttttttacttacttgaaaatacccataaatttcaattacttttggacggctcatatcgtaccaagatttatacagtcatcctaacttattttctccttcccactctctgtcccccacaaggctgcaacatacaaagagattacaagcatgcaccaccgccactcatcaccttccccacaccctcctccccctttgttgcaagtgaaaggattacccggccaatctctctaacactctgtcccacgctctcctcctcctccccctcccctcccaccaaccgctccttctatgagtgatagcaagatatccccgcctcgccttcttcactactaaagatgccactgccgcctccaccttgtacttactcaggatattgcgtcctcacctgtcatcttcctccaaccctacggctcttgttccgcgtcattgttgcctcaccgtatgtaagcctttgtcaagcttcctcccctcttcctcctcaacccccgtcccgttccgacccccaccccaaagtcctaaactctgattcgctggcgctgaagaagagagaggttagccaccgtaccatcattgtcatgggtgagtactcaccatctccctccctctcatctcttggtgcctcctcttttgcacaggttgagggtgactaaaatttctcatcacaacaacgatcagtcacccctaattcaatcgctagctatgtacgtacctaaaagtcctccatcgatggaatcatggaaagatgtatctgaccttgtgaaaagcaacgtaacagctccaaatcaagtcgtaattaacatctacaaagaattgcgtaacacagtactgttcctttgattagatgtgcataattaatgcatatatgatatttccaggtcggcgctgccattgtcagttgctggtacctgcatctctgctggcctaatgtgtatgggtcctagctagcttaattctgcatggacggcaaagccatggaaaaaaacgatgaagctaagatccggttcagttcactccaaacttccccctaactcctaactttccatcacatcacatcatatccaaaactttcctacacacataaactctcaactttttttctaaactaccaactttcctcaaacttctccccaatttcagaaactaaacacagcctaactactccctctgtttcaggttataagatgttttaactttgatcaaagttaaactacttaaagttttaccaagtttataaaaaaatagtaatattttcaacccaagataaatttattatatatatataattactatatttgtttataaacttagttaaacttgaagccagtttgactttgactaaagccaaaacatgttaatctgaaacggagggagtacttaattagctagagtatctctcactcgaagtcaatttattgatgaatgcttgcatgaaatatatttgaccgatggatggatggatcgatcgtacgtagtgcatgttgatatctagtccaaagtcgtgcaagctcaaacatcacggcatttgactgacggtgacaaaacttaccaaagccatagtcaaatgaaagccatcttttttttattattattttcttagctaggtatcgagtgctgctggtaatgttgatcaccatgattaataatgtgtggcacggaggatggaatgtactaatgtttgaaaagaaatttccttttcaaaaggatgtgacaaaataaactaagtactgtgtgaaggagaaacaaaaaaaaaattccatcccaaaatttattttagaattcataattagattttgaggcgtgaatagatttctctctcaaagatatatactaattgactttcaataataaaaagtgtatccaaaccccaaataaataggatcagaattcactctgagcaaataaaagcccagggatctttaggcttaccagtctgtattcaaagcctcactcctatttgttagatattaggccattccctaatgttcgcgtttttttttactccgagcgagggattaggagccagagcactacatgatcgacttgtggagagcggaagattagggtccccaaagttttgggatctagctttgaggtctgctggagccactttttctttaaaaacacatccaattttttgtgataggaaatagcattagtcatctattgcgcatgctctaataataaccatgtgttatatatggtattcatgaatataactgtatgtatctttagttggtgtatagaggacatactctgtttggacatgtacaaaggtaatattcgatataatctcttaattaatacatattgtaaaatcaaaggtgtttttgattattattctgtgatgaacaattggcgtcggagattattggttttgctatttggaatttattcacgaagtggttttggagatgattggatttcacaggtgatctacaggtactgctgtttattggaccggtcagaccgggcatgtgctgccggtcagaccggcgcagcctgcggtctgaccggccgacgctgtgtcggtttcagtttcgagttgtttgtttggatatccgtgattgtttcatgattatggcttctagatgtatactatacgtatgtaatactgttgtttgctactaatgaatcaagttggagatagcttggtctcggaatatgggtttctttgtttatttcatgtgtaggtaacttgatgcctcaggagagtatttgcggtgatggaccgggagtcggcttggggacaagacgacgtccgtggtggtcagagatcatgcgggatacttaggctagagttgatgcacgtggttgatggagattccatatggcatacgatggaggtattgtgtgcgtatgggatacggagtcgaatttggaaggagtccgaatttgatatgattggttatgtaaagtttgtttcttgtactagagggtttcctaaggtgtttaggactcttagtatgagtttggtttgtggctttaggctgcctacctcgggtataaatagagggggagcgtgaggcttccctgtatcgcatttgagagcaattgagttgcgttttgagttagggtttcgagtttagtcgaaatttttgtaaggagtgctattggtgcactttgtaaacacagagagaatcaataaagtcgtcattcactttaagagttcttcaatttgtgtttcaccgggtttcggcggtctaaccggcgacataccggcggtcagactggcgacaagcgacggtcagaccggcgggagagagacggtcagaccggtggcggtgacagcaagcggcagctgatctcggtggtcagaccggagatctaatctcggtcagaccgacggcaaccaggcggtcagaccggcagagcaacttgcggtcacgatccgcgatccagtcgaattcgagaggtaacttttatttccgctaaaagttttcggtttttaggtataccaaccattcaccccctctggttggcttagttattgtgattcgatcctacacatagtatcacttagagatcatcctttctacaatagttaagataacaaaacctcttataaccattaatgcaccaaaataaacttttactacccttatttccttttattctctcccatgcaacaaaatttcttttaataaatgctaagaattgattctgagccattatcatgcatagcaacgatgttttccttaatcgtatacatgagggttgtcttatcctctgctcccctctcatttttctacgtcaccaaatttacttacgtatcaatatacgtgcccttatatcccaattttttaaccaaacaaatttgttagaaaacttccgcaagtttttttgcctctgaccattgaatcgccttgagatttttacatgaaggaaaaaaaattgctagaaaaaatttcacacatgtcacacgtaagattctggtgctaactaaccaaaccatagttgaatgaaaattttatatgttatatcatagttacatctaaaagtttttgactagaaaaacttgcggtagttttttaatactccctaaccaaattgtcagacttctggttccttcgtctctatcatgttgggcttcagatgatgggcctgggtggcccaagcccatgtttctcggcctttcttgaacacactctcactatcaggtacccactccacgatgatgggcctcgcgagctctcgcccgccgctcgtctccgcgccggcgacggcgacggcgaggctgcctcctcaccgccaccgccgccgccgcctctatctcagtgccacctcatgcgcttcgaccaattcctactcctccagcgtcctgtcccatggaggaacctgtgctccgcgctccctagtggcggcggagttgcagtcgcagtcgcggccgcctccgctcgccgccggcgtgtccgtacggggagacgccgcgacggggctcgcgttcctcctcttcgttctcgctgtggtatgccccccgcggattcgtctccccacttcgtcctgtcggttaattttcagtggttcgtcgagcagtgcgcgaggtgttcgatgcgagttctttgtttgcttttagtttcccttttcacaatgcgttgttgaagaggttcaatttcggataagtgttacatcattcgaatgcatcggtgtacatcaggatttcttgttctagggatatacatcaagatttgggtataggtgacaagtccaaagagcatgtcattcttgggctacagattcatcagtgctcttcacttgcaaatggcacttttgacttaggaattagtagaatggagagagaaatgtgtaaattcttctctctcatttttcttttttttttcatattagctgctgtcgaaggttgccttcagattcaatccaccacaaattttcaatgaatatatactatgacttcttagctactgtgagaggttacattcgttgtttcttatggtcaaagttagttagattatcctgataaatggatggagttttaactttatggatcctaaattcaggtgatgagttcctttctgtcactggccatcttctcatttccaacatggagagtgagtaaaatcatctaaacaaacactactttttccacagaacttcctctaacttaccctttttgtgtatgcgtgtgtgaattaggctctgaagcgattggaaattgctgtgcataaattgtcgaaagtagttgcagaagaggtaccaggaacactatcttcactaaagctatcatgcctggagatcaatgatttaactagccaactaaagaacttcaggtaatactcttttgtttttggtgagaaggtagcacattttatagcagtcaaaatgtaactgaaggaaaatgatagtatctattttttgttttattttgacattatgcagacaaaggctcatgataaatatatttggaaacaacagtagtgttgatgcaagatcacagactggatggccaaaacggggaaaaatatgacttatttaacctgtaagttttatggtaactcttagcttatcactcttgctgaaatgcattatcaagtcgatacatgtgtgtcacagtagcccttgacgacttgcagccacatcaaacatgttgtgatgcaagtaccaaactgtgccttgagccaagaccttccataaaagactggcattattgataatgagatgctttcttgtacaattacattttaagctatacttttttatttgcactgtctgtaatacatcgtgctccctacagctttgcatgtttcttgataaaaccttgttcatagtgcttcaaatcctctggtgttggtaggttgcatagtagggtaacccttgctgttgacactagatgtttgcactctgatgtggaaggatctatccgccatatctggacctcccaaacctgtcagaattagtaaaacagaaatgcttgagatgtcttgaaatcagaaggttgtgcaaaatataattgagacacttgatgagaacagaagaacaaagaagagataaaccatgtatcaccacttatgattctgatttctgaagacaacatactttacacaaactgaaagtttaagtgtatactactgctactaagcacctgcctcatacatatattctgctaattgagagttctgtctgtagaactgaaggtttacaggcaactagaagcaggtaacaggaaaccaaaagtgccttttgcaagatttttgcaactttgaggaaggctagaatgattgatgtaacttatatgaactttaggtaatacaattggacaaacttcctgactgatgctaatcttgtactagcattatgacttcaatataaatagtcagcatgatgtgttgacactatgagttatgggctgcaagagatgaccttgtttggcactttctgaacaattttcttcttagtgccttagtcagagaagactgctcggcagaaagtccaacttttttctgttgtaagtctcatctttcactctcctaacccccaactaacatggaatcttgatcttcctttcccaaatgatgaacttgccaataattactttgtttgatctaattgtaatctagtgttccagattctggtcagctggagtactgtactggtcctactaggcatattcaattaacaactacaatgacaagtaggttgtgtgatgaattatttatctgtttggatctttgaagaaaatagtacagtactctagaaagcaagtaagagaattttgattagtgggtaattaattaagctgttaataatttttacctggatggtacggccgagctgcatgggcttggccttcgcctggacggtctcgccgaggtgggccggcctgatgtggttgatggacagctgcacgccggcgaccctccggtagccggacgcgatgtagccgccgatgctcgccgccgcctccgccatcagcgccgacacgccgccgccgagcaccttgaacggctgcacgcaagcacgaacgtcgagacattttttttggaagccaagaaggacgggacggccggccggcggcggcgatcgtacctggcagcaggtggcggtgacgaggaggcggccgacgacctcgccggcggtgatggtggtgaactccattcccagggagtgcagagcattgtccggcgggccgtactccggcggccatggccagctactctctctctttccgtcctcgccggcgccggccattgctctgctcactccggtgaggtgagagagggcagaagaggaggccttgccggatatggttgggccggagtgcatatatattaatcagcccacttaatggcctgttcttttctaatcaaaggatggacgaatgcgcatgcttctttggtttttagttttaaaagtaatttttaactttatgatcgttaatttattcatttgtatcatctatactaattatcacaatcatgtaactattcagtcattcagatattcaacacaaaataattattctgtactccaccagtcctggaatgtaagaacatgtagacattttgtaagagattaaggttgaggtaagagttggttgtgattctttaagacgaataaggttgggttcttaagtctaccttcttaactttgcattcctggttgttcacatgcacgttttccaaactgctaaacggtagttttttaaaaaaattataggaaagttacttaaaaaatcatattaatatatttttttaatggtttagttaatacttaattaatcgtgtgttaaggcatgtatcgttttgcgtacgaaagaggagggttccgaacccctccttccctcctgaacacaacttcagtaggtagaaaaactataatggatggtttgtgattgattgatatgagaagtgtgtgatttatgtttttggataatttagatgtatatttctgaacagaggtagtaagtaaccaactaagctaaaccacttcaacttagtcattggttttaacgtatgtctagaatactatgttgtctaacttcggtactaaccaagttcttattaattactaatttggccatagaaaacctcaattgcttttgaccgcacactacattacattactacaaccaaggacatatctttgtcctccacacatcaatagaaaaccaacaactttataactttactttgttgtacataagcagagcttcaacctacagctttatctcttctctagtctagccaaattatttcagcttcaattaaaaatgagagtcgagctagctgatcaatgggtttagtttgtgttacaacttcattccagatccagctcttgaaaataaatttaaaagttagagccccggcaaacaaacatgcatatatatatcgatcaaaagaaaatttggtcctgaaagaggtgagttacgcaataagattagtactagcatcgtactctttccgtccaaaaaaagctcaacctagtaggagatttgaccgataactctctattcagatttgttgtactagtttttttttttttggaacggagggagtatgtttttaacaggcaatgtcgcaacaggtcgcgatcctatttacagctagctaattgcaagtcgtcaaaaattaatttcgattaattttgtatacttgcagttgtgcatatatatgcagtcgatcatatctaatccatcatgttcttacattccaggactggtggagtacagaattaatcagtacgatcaaaacgtgtgccacccatcgtgcagtattccactacttcgcgtacggcgcaatactcccatttttgttggttggattgtgggctttgtcccacttttgttgagcccaaaaagggccacagcccgtcctaaaagaaaagagcccagttatagttttctacataaaagaaaggaaaaagtacaccgaagttccctcaacttgtcatcgagttacaaaatcgtctcccaaccataaaaccaggtatccagcatcccttaactaaccaaaaccggtcacaataggtcctttagtggttttgaccccggttttatcctacgtggcggctgagtcagcacgggacccacgtgggccccacatgtcaggcggccacatcagcctcctctctctcccttttctcctcatctctcccttcctcatctccctctctcccttctgtaagtcaaccggcaggaggaggatggcgtcggcggccggcgacgggcgacgcggcagcggtgggggaggaactgcaggcgtgcggcggggggatgtagcgcccgttccgtcgtggcgcctagcgggaaaattatctcttaaaaaccctaatcgcgaaa

SEQ ID NO: 62284 - DNA, 5449 bp, Oryza sativa
  unsure (1)..(5449): unsure at all n locations
gcgcgcgcccgcgtggtcctcgcccgcaccgcgtggtcgccgcccggccccgctgccctgccgcgcctgcagccgctcggccccgcagccagcgcgcgtgctcgagccgcgcctctccatccgccgcgccctcccattgcaagccgcgcgcgcgtgccgagtggccgaccatctggtcgccgccgccgtcaccctctgccgcgccagcccgcgtctgtcgcccgtgtcgtcgcgccgctccaaacctctccgccgtcatcgccgtcgtcatcgcctcggccccgccactccgcgcgcaagccgccaagggacggaggccgagccctcctccctctgcctcgacgcccccgctcccctcccccttttcccaaagaagaaaggggcgagcccccttttctctccctcctttttccccttttcctcccgccggcgtcatcctccctccctcctgtcgccgttttggccgctagccggagcgacagctcgcgccttgaccgccaaagtcggtttccaaaccgacattgccgccccctataaacccaagcgccctcccttcccttttctcccattcttccctgtttctcgcccgcgccattgccgtccctctcgccgaccgcagccgtcgcgtgtgtgccggaggagctggtgcgcactaggacgcggaaggggactccgggcgctcgtcttcctcctcttccacggcccgaggccggagagatccctcccgcgccgtcggcctctcgtcacagcgcccctcctcacctcggtgatgcctccctccgttcttcctcctcgctccatctcctccccctagctttcggtagtagctcgagtagactccccgtagttagccggcgccgccccgaccgttgccgtcgctcgccgtgtgctcgccgccgtcgccgctcgagctccgtagcacccacacgtcgccagcctcgctcggcgtagctccgtccaatccgacgctagcatcgagttcccgaaaccgcgtagatgctctcaccgccgggaatcggtccctcgtgacctcgtcggcgtttccctcttccctccccgccggttgtcgccgccgcgattcgccgccgtcgaactccctctggcgaatccgagccgttggctcgtctcccctcatcacgaacaaccgcccggtgtgctagcttttgcccgtgtcgccgtggttcgctccgccgctcgccgccgccgcccgccgtccattcgcggccgggtcgtcgtctacctcccgccggcccgcgtggcagccacgtaggcgccacgtcggcgccagctcagcctagaccgggtcgagccgaccccggtcagtccctccccgtgcgcgcgttccaccgcgagccgtgaggctgcgcgtgggcccgctgcatccgcgtccaccgcgaaccgcgcgcgtgcaccgcgtccctccgccgcccgcgcgcatgagccgcgtactccctccgcacggtgagccgagccgctgacaagcgggtcccacccgggaccgcgcatggtgagcccggtccaccggctctctctctcctccctcccgcgcgcgcgcgtcttgggccgctctgggccaccttcttgggccggccggcccgttaagctcggccgagccgccctttctctcgggccgcgccctagccgcccgagggaagtctatattccctccctctccccttttcttttcttttcttttccaaaaaaaggggatttaattaaatccttttcctttagaccaaaaatccaataatcttagaagttcaatatctttccaaccgtaaatccgtttgactccgttcaaattccaaaatttctcaaatgtcgagatctatccaatggcacgcttagaggtcattaatagggctttattttcgccgtttgttgagttgccccattttgcgtgtagtttcggagcccgaagacccgcagtgcgaggatttcgaggatcaagctccagatctcgagcaaggcaagccacctttgaacatcttgagcctatatttgaaatctaattatattgcttgcaaaatattatgcattgataggattacacttaatctgttgttccgtctgcaaggcagattggcagacctacctaacttgttgcatttgatccttccattgttaattgctataccatgtccccttgtaaccatccagttgcgcctcgatattcgtgcaccctatgccagtatcgacggtcgccttcaaacttaaaatctgagtaacaacttgggtaaaactggagttttacaaaagacttggaaaacccgacacctgggtcggtgcttgtgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctcttgttggtctgggacccctctcgtcggcatatggtaaacctgtgttggctttggaaatgccttgtcatgaaagcttggaggtctcccgacgtggctgatccccacgggctgggtgatctgggttagtaatgtcgtgtgggtaaagtgtaccccctctgcagaggttaacaaactgttcgaacagccgtgcccacggtcatgggcggatgtgaggtgattcctagcgtagtttggtttgactactgcttgtgaaattgctgtgtgaaaaggggttcggtgtttgaaaaatctgcagctgatgggattagctaggcccgggtggccgtttgaaaagttgttggcccgggtggccgttgaaaaagctgttggccgggtgccaaccttgtttaaattctaaagactgatacattgcacatactccgaccggacgagacgcactgtctcatccgtgtcgtttgagaagcactcacttagttgtttcagaaaagagttcaaataaaattaattgcaaaaacaccagcctttccttgaagcctgcattaaacacttacttcccatggcttgctgagtactcccgtactcacccttgctctatataaataatccccccagttgctgaagaagatgaagcggatccagctgatgaggagttcttccaggagcaagccggctacgatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatattatgtctccctgtgataccagcactgtttcctgggactggtatcgattaacaggttaatttagagcgtcacgggctagttccggtcgggactagttcggggcgcgacaggggaggagcggcgggcgggctcctccaccagccgccgcccacgaggcaaaggagcaacgcgcgggcggacagcgggggcgggcggcgcgcgggcgggcggcggggggaggagcgacgcgcaggctcccccgccgggtgccgcccacccggcagaggaacggcgacgacgacacagcatcggcctcgtcggaggcaagcgcggcggccccaccctcctcgaccgcgaggcgggaaaagtgcatagcctccacgggaaaagagcccaggacattttcctctgaaaattaaaagcctagagcctggggggcacaggttcttggcactatttagcaaagatttgaactataatctatacagacctttcaaaaagtatctggtcaagggaaatgccaaaatcaaatgcaaccagtatatacattacaaccaactttatgaggacataaaacttttatccctacttcctcctcatttctgtatattaacacctgcatcaacaaaaaggcataggagaaaagcatgaaaatcacaaaattggaaacctctctttactaatgaacaatgaccactgggtcgtgctgagatttgcatttgacacataatgagatttgcatgttcgaatcagatttgaacacaaagtacgatttagtagaaaagatagacttgtctgaaggaacaagtactgtgtatcagggtagaacacttgaagaactgcacctcaaaggtgcaaagtaatcctgagagctgggagcaaaggaaagaaatactttactgccgaagttaagctcacaagacactctgcagtcggcaaaatgaagggtttaaaagtacaagagggagttctctgcctctgcatcctaaaatatcaaactcccaaaatctctgctttacaagaccatatagtagataaacttcaatcctttcttaattgcagtactctttttatgttgtactcctgaaaacccttttagttttatgtccagtaaaagtccaacgaataagcacaaaagtctgctcatgttcaattagatgactgaaatttgctactagagaatttgttgcccacgcacattttgctaacaaaactcttcattactggttgggggatgagttgaatcagctggtgtagcttagaacttgaacacgttgcggcactgcatatatgcatctaacacaactactccgtactcactgcacctaaaaatatgctaagaaaattatagaccgggcaaagctttagtaaaatatggaacacaatagaaatatgtaacaaaattttaaaaattggcaaaacatatggctcttgaggtttttttgctatcgtagcagatcacaaaacaaagctatgttaggtataagttaggtttaatctgaactagaaaacaaaaataacaaaactgtatacagctagtagaactgtactaactaaaaatgtgctgccattttttctggagatatatgaatggtatgcagtgtttgctacaatcttgagtcaatttgttgaacgctaattacagcagaaccggaagtgtgtagaactctagattctactagaaatggtcaggcatatcggaaactgaaagatacagtctgaacagaaacatttgaacagaaacagtttgaacaatagtcttgcctctgtagtttgcacaatgtgaagtagcacataggaattgctcactttggcacatttggaattgcttgggtctctagaaaggcatcgtcggccatggcccctaggctcctcttgctctgaactcctacagagaaaaacaatagaactatgtagctaaattttataaaagttgacaaagacaaagacaaagacaaaaacaaatacaaagacaaagatgcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62285 - DNA, 709 bp, Oryza sativa
ttaaatttaactcatggtgacgtagacgaatcttagacgtccatttctcgatccagtggtagtttctaaattttcactacatatgtgatttgcactacatattttctctgtttgtacgagttaatttatacatgagtttggtgattctcaccgacgtactatggccgattgagttggactatccatgtaactttcaatatatatatcagatatttgaatcaataactatatatatgtccctagtgtatgatccaaatttttttcattacagtttcagcgacacctaatgtttactatagttaatttatacatgggtttagtaatttctcacggactacggccaatcgattgtgttggatgattccatgtatagttttcacgatgatgctagtaggtgtcgagcctgcatggcggctacccctctttcctggctatcgaggtacttgtgcctctaatgataaaataattcacaaaaaaaatggtacttatatatttttcaataaagtgaatagtcaatcataatgtttaaatgtaaacaattataccgtatattaaaaatagaggtaatattaagtttattctgacgtctcttgccattctacatatatatatatatatatatatatatatatatatatatatatatatatatatatatatatatatatatatatatatatatatatatatatatacgcacatataaaca

SEQ ID NO: 62286 - DNA, 7990 bp, Oryza sativa
  unsure (1)..(7990): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgcagagtgaaaattaaatgagattaaaaaattcagagccaggagagctaacccacatgcaaatcatgattggattggatgtgccgcgcgtctcctccaactcatggctgtctattcctttcatccctatgatgatcatttcagaatagtttcatcctattaggtgtttgtttgttctaccatccaagcatgcaactaactaaactaacacaatctgtactttttttctcctacagaaaatgtagaggctggcaagagtggaagaactagtttttgtttgttaaaaaaatgtcaaacctaccaaattcagtctgaagaaagaaagacaatgatatactccgccaaagtataactaaagttcagaagccaactataactactgaagatgaggctataatactattgaaagtatatgtataatttttttctaaaactttaataacattcataagtacacccaaaacttatatacgcagaatatcttcccttaaataaaaaccataatcttaaagaggctgaatataatgtatttttgtgttatcacatctatggactaaaattaaagaattggaggaacttttcgttttgattgtgttccaaacaaaagaaaagaaaaaggaggagaagaattggaggggcagggacagcagggcagtggcatgtgatgtgaaccaaccaatgcaatgcaaagccgacccgacccgacggcgcgtttggtcagtcaaattaaaaccgggtgccagcgccggtgtggttacctcctccctcaccaacggctcagcctgccacctcaccctcacacaccaacccattacatctccctctctgtcctacgatttcacaggaattttggtacacagccatcaagaccatatattctttcttctattaattcccctgtctcccctctcactctattttattgcatcgttatatcgaaacaccagaaatattttaggttattattacaaccatatgttgtatagtatttgtaatacgctacaggtatatatatgttagagttacatgtgtacatattaaattggtattaaaataaaaggcgtcgtctaaatgttacccatatcatcttaccttcaactcttttgtaggttctattacagtaaatctccgtaatttctaagcatataacaaatatcatatcatgaaaatgttaaaatggcatttagaggatatgatcaatgtgtaacagtaatctccataaccatttaattatatatatcggttaccgcaatttaattaaaatgagcattttggacatcatgagtccatttcaactttgaatctgtatgacccgtttttgtgaaacttttttccttcacattctatcatatggtggtgcacaccctaataccattatcatctaaatgtttgacattgacctatccatacaagaaaggctctagaaatgcataaatgatctttaattaccaatatgttctcttgaggtatcggtctaagccttgtcagtcaacgtggatccttgatggcccaatctcctataatttgaccaattcaatattgttgttttgatagaagctaagtcaaaagtcggatgaatcaatcaaatgcattgaatctatccatgccacgtgtgtaaatcatgccataagaactgatataatttaattttatacctccctgatgtcaaattataccctagaaattttgaaccttctaaaccttcatattgttagattaatttttaccttaacataagccacgttagagtggaaccaacttttcagactcacgcaacgagctgcaatgatatttataaatattttaaatgatgacgcccataaactacatcagacaaaatgtaaaataccaaaaatattagtattgagaaagaagcaacataattcagtccagaatttaattttgaagctgttgagcaacccgggtaggaacccagcccactagcttatcctgcgttattttcatcaacttcaaaccatctccgttagcacataaatttttttatgtaaaagttcttttttaaaaaaatcaaaaaaatctaatttttaaatttgcaataattaatactaattaatcatatgcggtttcttgtatttcacgtgtcgccgaaaatctacctataactttaaaaaaacacacccttactcctagcaacaccttgacttctcgcatttacaaactatatacatagttttgagttccgctacttataatatggttataatacgaatgtaataaatataatacttttataaataaaaaaaattatagaaacaaccctctacatcctcctgataaacaaacacacatacattggcacatggcatttgctcctctgtcaatcaatcaattaacttaattaaaaaaggaaaagctaaaaccaggagagaaaagcacacgccttttccccccctcttcttctaacacgcgcgttctgacgacgaacacacggagatagagaaagagagagtagaggagagaggaagctgccgcaacgacgaccagttggctggctctcttctgtagcagtagcaactagcaaagctgctgtatttaagttcaccgcgggtcaccacaccagctcacacacgctgtgctgctgctgctgccgctgctcctcctcctcctcttacatcccatcctcgccgcgatttccttcgccgccgccgccggcttcgtcttcttccccggcgccggggcacgcgaaaaggtgcgatcttgacgccggattcggcgccctctcgccctccctccccgaaagttcgctgctttttgctccgatctgtgcccggaatctctcgtgggtggatggatggattggactcggtgtgatctcttcttctttcgctggtggttgctccgccctcggggggcggttcagggttggggatttgggtgggtttggtggctggttctttggtgggttgccggctctgaatctggagggagcttgggttgggttccctttcttggttggtcaactttgatagtagcgtttactgtgaggtgagggggaagaagaactagctcctctcgtttttagctgtgattgctgcgcctgattcgtttgattcggttgttcgtctgattttttttttctcgctgaattctgcggcttcttgagctttgccaaagaccacggtgtgttactctttccgttagttggaggagaacatgttagttgattaacagcttgttgcgattagctaactgcgtgtattcgaggttgcggtagcatatcaattaggaataatgtccaattttgtagcgtcatgattgcaattgaagttttactgtgttcaatcattggcgtagtacttgtaggtataggcaagattgatgtttcagtgctgtaggagttgtgtggatttaggacagtgctagggataaagatgcgattgatgattggtcgagcttctttggcatgcatcctgaattggagtggtgcgaggacatgaccgcgtgagctaccggcatgagtgaagcagtgtgcccatgcaaataatttttgcatgctgttcttccatgctattctgtttagtctagtgcagactttgaagtggttatgaacttgtcacatttaatcagttgcctcacattctgcccttgtgttcataggatacatgtttgatttacaaatatggcatccaattaataatgcaatgttctaaccactggaagggtggctgaatgaataatttaataaaatttccatctgatgtgtattattggtgtctagggctaatgtggtatgtaaccctgtaggaaattggtaattattaacgatgccactgcagaatgagctgtcttctcatcagctctaataggaaaaggtggttattagttctggccttaggcagatttcaatcctacctgggcatcctttgcttagtttgtttccagcatatcagtatatttggttccagtgaacttgccgtgctgatcaagaattgtagtggttaagtttgtctggtgaaagaagcagtgttacctgaaaaatgtggccaattgttttttgccgaattgagcaccccaaatctaaaacgtactcggattcagcaaccttgtcgtcttctgagtagtatcttgcatgccgtttctctttccgaaatcacacacatgagccaactcgcttgtccgtttccgataatactgggaagaagagacaaatgagataactcatatgtggttttagtagctcagcactaccattataccattcaccatgcattgatacgtggtaccttcaagtagttcatcgggcatttgtggacataattcatttgattgtcctggttgggttgagaaaatgcacaaaaagttacataaaaagaataaggaaatgatgggaacaaaatggcttgtggagaaattactgatagatcttttagcacctcctttatttattccacatatgtcatgttctatgcattccactctctgcaaggtaagtgtgaaccctgagttttcgaagttaatttatttcattcactttcctattatctccacactttcatcaggttatttgtccatctacatagtattaactagttcaatcatgtgtctgtttgaatgtcttatggtggtgtatttgtgtttgcacttctgcttgtgtttttcaatttgtgctcattcaatttctctctctttgaccgtctgtctgatgctacttttctgtaaactaaatgcatgttgctggtttctaataaaaatctgcatgattctgttccagggtttgtttctagtagaatatgtcgtgctttgcatgctgtggtgatgaagatactcaaggagtaccagacaacaggaatccatacccagggaaccatccagcaagtaatggcactgggccttttgttataatcatctgcattgtcccattacatactgtggtttacagatggtgctcaagttttactgaactgcaatttgtctgcagggagcgatgcatatcgcacagctgatccaactccaagaggtcctcaacctgtgaaagtgcaaccaattgcagtccccatcattcctgttgatgaaattagggaagtgactaagaattttggtgatgaagctttgattggtgaaggttcctttggcagagtgtattttggtgttctaagaaatggtagaagtgcagcggtcaaaaagctagactctagtaagcagccagaccaagaatttttggcacaggtttttttttatctctgttaggaattctgcaacaagttttctttttcttgcaactcatttcaaaatgcatccacaggtatctatggtgtcgaggcttaagcatgaacatgttgttgagctgcttggttattgtgttgatggaaatctccgtgtccttgcttatgagtttgcgactatgggttctcttcatgatatgcttcatggtatggtctttgcacatctgtgcttttgtttcctttattcatatcttgaactcttgatagaattatggtgttattttaaactttgaataccattaaatgtggaaattgtatgtttacaggaaggaagggtgttaaaggagctcaacctggtccagtcttatcatgggcacaacgtgtgaagatagctgttggggcagcaaaaggcctggagtatcttcatgagaaagcacagcctcatatcatacacagggacatcaagtccagcaatgttctccttttcatgatgatgttgctaaaatagctgactttgatttgtcaaaccaagctcctgacatggcagctcggcttcactctactagggttcttggaacctttggatatcatgcacctgagtatgttctggttttcttcaattctctataaaccttcagaattatatcaactactaatgttggtctaaattctgtggccaggtatgcaatgactggacagcttagctccaagagtgatgtgtacagttttggagttgttcttcttgagctattgaccggaaggaaacctgttgaccatacattaccaaggggacagcagagtcttgtgacttgggtaagtttcaatcgcatatgctattcgcggttattggaatattctggcttgcattctatttggtgggctgaattaatggtttattcaacattggcaggccaccccaaggcttagtgaagacaaggttaggcaatgtgttgactcaagacttggaggggactatcctcctaaagctgtcgcaaaggtatccgatattcagagacaacctcttttctgttttatcaccataggttattgaactagcagtctccagaaactatcttgacaacgtgcaaaaggaagctgatggctaaagattaattaaacagctaaccctaggattatatgtctgaaattcacatcgttcatgaagcatgtctggattcaacattaaatttgtcgtagatctattgtttgcagcacttgtacttgagattatgtttccttgtaagcccagtttttaaacatttgttcttctgtatgtttcaaacagtttgcagctgttgcggcgttatgcgttcagtatgaagcggactttcgaccaaacatgagcattgtcgtgaaagcgctgcaacccctgctgaatgctcgggcaactaaccctggagaaaatgccgggtcataaaactttggtctaccttttgtatgatagatattaagttaagaagtatgagacatcgatattgttcttgcggatgtgtggctggctggaagtgtgtacatttgtgattattcgtcccttgttgtaatcaccaaggttctacgcaaccgaaaatatttgattcttcgcatcgggtgagacataacttgtctgaaggtgacatgcatatctatctaccttactcaagagggaaaacaaaattctgcatcttgaactgaactgaactgaactgaacttgccttctcttgttctgcatttgattgatctttgtgcagaagaaatgcccccaaatttgtccatattttcttcccattacctcagcattgcagatttgggccttggcacggttgttcagaacaagtgcgtcctgtttgcatactgaacctctgaaattttcagagttcagaatcaggaactagctcaatcaactgaaaatgctaaagattagaacaagcgaaccatgccagcattaacataaccgcaacgcggccagacataaattaaggtagatctgtaactacaatattgcttaattatgagcttacataagctagcagcaactgcactacagtactacaatactacagactaatcttggatgtcggcaaattcagttggggcatcatctgacgactgatcatgcagcaatgacctacttgactacatctctggcttcctgaactatagactatgagcaaggtgctcacctaacactggaatatactactaagtagcattctttacacaggatgctgtttcatcgctttgtgagcatcactagtgcgagcattgacatggaggcgatgaacttgaagctctggttctcccagaagttgtgcttgtcatcacggtatgggacactgggttgcttcatgcccacctgatccttcagctccttcagttgcttgtctcttttctcaccagcctgaagaagc

SEQ ID NO: 62287 - DNA, 1165 bp, Oryza sativa
tttggctggcagtgaaaatgggtgatactaaaaaaatggggctttgctgaacgcgtgtttctgttagtatcagtttgacctgtacattttccacagataattattgcacaactgccgtagcagggatgcttcattcacatggtctagatttgttaattttaactgtcagagatcttgttagatgctcagggataaggcgtcatattcaatctcaagtgcctcgtccccagttgagataaccataaatgagcatggacagcaatgctagaagagaacatcatgtttgatgtgtcaagggacaaggataaatatgaacatactctctgaagttttcttatctgggaccgtgattcctgaaggcagaattcaagctttagaattctctttttcagttcctggtcggttctcttttgtttctccaactgttcaacaaacaagagatttcaagtaaatacaacattttagcacaaataacaagtttctttgtaatagtattcagcatttctatggatgaaagaaagagaaccgtatacctgtgactctagttcctttgttttgttcgtccagtgagcagataatatcctaatttcatctctcaatctggcaatctctgcatccttagcgttcagaagtttattgagattatcaatgttccttggtgatacatcagataagatctttagaagctcattatctttgttagacccaactttggcaactgcatccatgatatctgtttcgatcctcaaaacttcatctttgagttgcctctgtgagtattcccttgattcaagatccttctggagatgatccagctgctcacctagcttgttgactcgacgctcgtgttcttttagcgagctgtccttctcattcagctcttttaataatgacaagcattgtgactgagctgatttggctgatgcagcacttgcttctgctgtagcttgggtgactgacagtttcgatctaagatcgtccaactcgtggaagtactgcacataattagaatagttattgaggaagtgcatctgaattgcaaaagggactcattagagcgtcaaaaccagcatcaacattggtaattggtttgcggagacaatataaagtggagtctgaaagatgtaaaatagagagtaaaatttctcatcgccatgaatccaca

SEQ ID NO: 62288 - DNA, 6456 bp, Oryza sativa
acgcagttgctcatctttatcattcaagcatttctgcagcttactgatttcttcctccatgctcctcgcctttgtctcagcaaactgtgataagttttcccttgtcaaaaacaaaactcaacaacaatccggcagggaccaactacaaaaacaagaaacaaacctttctggtttgggattcccgaacaaacaactgctcctgtgaagcaagtttgttcctcacatccttgagctcagccgccaaagacaccacgtttctcctaaagcttaacttcttctctgtaagatccttcaacagcggatccaaatccgacgaagacacagaagatggtggtaccaccttctctgaaactgacatagccaagccccaaaatactgtttctcttccaatattagcaccaaaaacactgcttctggaatactgttatattctatccaagaacaacaaacaggacggctcaggcctcacagcaagtcatcaagcacccccatgaagaaagacaaaaacaagggagatgagctcttctttgaccaagccaaacacctctgtggttgcctcacaagaagcctcctatctcaggtcagtatgggccagcaggtagctttcgctgcagaaaacaataccaattttgagaggagatgaaaacatacaatgatgcttgctacatgcaacgtgttccgcttaaactactgatatgaaaacatccgctttcttcggatcaagggtacgagattgagtggagcctagacatttggcaactaagtgacagaagtgtagctttcagtactcatcataatattattgtattggcaatgaggaaaaaacaagcaaagtatacaaaatattattcacactacaagtgactgcctcatgccgatcaaatcacgcatctaattagtcaactgcacgcaccaggcagcaaattttgcatgttcttggtgcttgaagtcaacttgtttaacagtagagattaagtatggtgcaacaattaaaaataaaatgtgcggtagaacaatatagctatttttttggtgtctgttcttgtgttggaataaaaaagaacttttctggaatgccaaaaacttctcttgcgggacgctacgactaaaaatttactgaaaagaaggattgagacaaaaccagatgaaaaggaatctttcactgagctcacaaagagatgaggacaaaaaggaggctgtccagtgtccatccgaaaattttcaaacaaattcaaatttttggggaagaaaccgagagaagaaaaaaaatgcagcacaaaagtcgagaatttcccagtatgaaatctggagcgtaagtcctcataaatctcttacccttcttacttgaggattaattaattagagtgtgtgaacactctaattttcgttaagaatagtttggaaggcaaaaaaaaaattgaaaatttcgtacaagtacgaacaaatttaaaatacttcaaacagtggggaacagcataactcaaaaacactccagattccttagatttgagtgtaaaaaaaagcagagaaacagcagagagagcactgtaaaatcaccacccagaaactccgagctcttgatcttctcccataaattagccaaaaaaaatagcatgaatcgaatcatagtaagcatatttggaaccaaagataaactcaagtgccaaagaatcccctacctccatccgacgatgcaactcagctccaagaaacgagcacgcagatcacgagcgaaccaaaaataaaaataaataaaatcctcgtttccccctccacctcagatatcttactgactcactccactctctccttctcgcaagcagcagcaaactagcaccaactagggcttacgcgtcttcttcgggaagcgacagcagcggcgccggaatccgctcggggcggggaagggaaggccaggcagaagcaggcggcgacttaacttggcaccgcgcacggaaggagccacggcggcggggcgcggctgacgcggcggcggcggaggcggaggaggagattgggagtgaagacgacgacgagaatggaaggaaaggaggaggagatggttggggtggtgggatttcaaaaccgggggctgacaggtggggcccacgcggccagcgcgcggcaattccaaaaattttcgtcggggtgtgcgccacgtcggcgtacgcgtacgtacgcgtgtatttaatttgtattgtaccgtcagccgtagaggtcatgtgataggtacaggtaatcatcgtcacgagcctcgcctgtgttttctgtaccagctagctggatttttaattgtctgcatttcacacggtaataaagtttcagataaatcattgtaacaactttgtactcatgtcaagattagtaatattaggatgcatcatatgttattttaggttattatactttaaaatgaatatggcaactttctcgaacatcgaagatatcaacattaatacttccctgcttttaccaaatcatttgttatataataccactacattttccattagtaaaatccgataaaccggccccaaaatcacatcggaaaccgaacacggaagaaacatcatataagatccaaacataaaattgacaccgatacatgatatttgataacggagtttagccgaggtctacatctacgaggcactgattgcaggcgctcctacccgatccagcatattacaacgtatcagagttataacgaccatcggcgaacgccgccggtagccactacgttacgctatgctaagtcgctatacggttataacacgtatgtctttctatctaagagagattttaagatagaccctgacttttactctattcctatacctaatataactctaagttctaaactgtaactgactttgtatccatattcgacgtaatatatatcaaattgagtgatggagtcacaagtagctgattccgttgaccaagttttgatcctgatgtccgctaataacgttacacaaatggagattttcttagtaggaatataattgggttggggattttttttattggggatgtgtccccgtccctcagcgtacattaagaaggaatattcatagggttttttttttatgtttaattgacacatgcggcaagtgcatctcttatataattgaaaaaaatcgtgtggtggtatctcatatagtgtagagttggactaatgcgaggatgaaaatgtaatcagaatgccgcctgcatcggtatgtgcaattgtggactatgaaccagatagtaggaattgttttttatttgctcacagtcacaactcacaagctcctggagcgtgcgcggatggcctgcgagctcctcccccatacgccgtcactgccgccgccgccccgcctccagtgatggaaagtgagaggagagaaaagatgaaaaagagagagagagggggagaggtgaggatgaccatgtggggctcacatgtcggtgggtcccacttttgtgtgtgtgtgaatgacatgtcgatcccacaatttttttttactctaatgccacataagcaacacgtgggacgaagactgggtcaacaccgccatgtagacgccacgtcagacaaaacctcttctaaaaccatccagggatatagtttgcatcggttttgatagttggagaagttgatatacacgatttagtggttagaggtcatgaatcatactcaggttatagttgagagagcgaaagtataccttttcccacgctttaatcatgcgatttgggctgcctgatccatgatgagttttgatcggcctatgctggataaataccaatggcccatgaagagcagggagggacagaggagaatagtggaagcaggctttgcaactataacagcaggctccctttatttccaaggaattttttctttagatgacctgcacagttacaacaactagtgcgtatcttctataaatactgttggaattcaaatctgagcctaaaattaaacataaccgaattgttggtggctcaaagctaagcaaccagttgcgtgtcttcagataaggagtacaaaagagcttttcagaatgaacatcggtctgaagagaagtatcctaattagaacagaaaactggttcagactaaaatgccaaacagtaaaaaaacctcattagacatccttggtgaaataaattgttgcagagtagcaaaccatgcttgttttaacggcgacaaagtcaggtttggagagtaccagggtagctctgggagcccccccccccccccccccccccaaaaaaaaaaaacaaaaactaaaaactaaacaagaactacaattcctgtaactctccacaaacatggtcttctctaaaatggacatggcatgcagctgaacaaaaacataagaattctgctagccatcgctagcaattaaattgatgaggtgcaggctctgcactggtttaggttaacaattgatcaacagggaagaaaaggatcaggcagtgagtgaacacagatagcagctgaagtgttaaaaaggaaaattaggagcctcggttcgttcaatgattaccagcgatagggaagctattgctgcagatgaatacaggtaaatacaattgcataccactcacctgagcaaaattcttgaaaaaaaattacaaacgatgaaggggaaaaaaaaaggagatatctgtcagacaacctctgggccaccctgcaccggagtgaaccaggcaggaacgatcctctgcagccgtcggatggctcaaacatgcatcctagccgttaaaatcacgctctggcccggaggttatgtcggcatcaaccagacttgagagcttgcctccttattggtaaaggatgcaacggtacgagcctgtagaacagatcctgttcaagtaaggtcgtgccgcaagattccaggctgcagcttataagcagctcccgcttcttcaaaactggcgaggtggtactaaccggcagcgtcttgctttgccttccgtcaattgcgtaatgggtccggcccatctaaactctctccaagctaccgtctgcactctattatcctgagaacaagtataatagtgagctataagcttactataagcttataagcttatgtggaggagagaggtaaacaaaagagaatggtgctggctctcgtgcaagagctagcttaacacaagcttcaagacaaatacattaaatatataagtgagagatagagatagaagaaaaaaattatagctaacattatagctaatctattatatgtgttgactttagtataggctaatagtaggaagtgggctatattattatccttgctttgagacagattagcacaagcaatggatagattaatttataacagttgagctggaaaaataatcatatgacaactgacaaaattgctgcagtgtatcaaactgtcacaactaataagtcataggcgaacggtttcgtgaaccctgctaataagttgctccaattgcatatttgcattcagtaactaaacaaatacaatcattaccaactgtaatcttggtcattttatatccagctgaccaccttggaccaaatgtgtttagccactgtattattttaggaaacaaagcgctgatttatttgtttctggcttagtaaaaagaaacacaggaaacaaacttatcaatgcctccgctaaacaagttatctgaattccatctctcaagcaagaatatcagcttagctatagacaacgggagattattccctcggtggattggatttgcaacctggtaagtgctcgattgatcatgttctgtgtgcttctttgatcgagttatgcatccagtgatcgggatagtggcaagtgatggggcaaacagagaaaactgggggtcggagttcagttatccgactccctttgcttcagagaatttgagcagaatatgcctaaacagatatctggaaaatttgatggcagcattcttcttgttactcctcagaggaaactcaatcaaaaaagaatgcaatgtctcttctctgaagaggatgatgaagaagaaacaagcaaacaccagttgccagctgaagtcttctttgattcgcagatatatcatgtatttcaccttcgattcttctgacagaaaaataatgcacgtccgtcttctctgaagaatcgagccagctgcacccattcttcagataataaaggcatttcttcagaacaacagcaatggtaattaagtaatgacatagatcttgtctgaaaaaataatataaatagcatcgtagcatggtcaggatttatttagacagagagagtatttttttacatttcatatatatatatatatatatatatatatatatatatatatatatatatatatatatatatgagtatatatatatatatatgagtatatacctagttataagtattcgattcattacctacacctctcaacaaaacaactcaaaatttaactttatttcaca

SEQ ID NO: 62289 - DNA, 3323 bp, Oryza sativa
tatcatatactactatgatcctaccctctcaagtcttatctcttctccaaatgcctgaccaaatatgttcctacacatcctcttgcctaagatcatcctacaacattgcagttttgcagaacacagcattcgttacaaagcgaacagcggcgtccctgcattgctgttctgaagatcatcctcaagcgatgccgttgcgaagatctgctccgtgttgcgcgcccccatgtcactggagatcctctcacagagctgcaaaaacatttcaagaagaaattggtaatcttgctccagtttcagtcatagtcagtggcaactgcaaatctgcaattgtttagctgctgttacctgtctatacagtgcagggtctccgttggacttcctaagttctacaacatttacagaagggccaagctcaaaaacctgacataaaaaaaatggcaccccgcttcttttagctgaccagcagttgcatcgtgtttttgcattaaattttttttcgttctttgtgttttacctcggcggacaccataaatgactcagggttctttgatcccttgcaattgcgcattaatttgagctgaaaaataatgttcaaaccatttttagtttcttgaaacgtttaaggtagtgttagtatgtcctgtaaggctgtaatatgacgaagacgatgaaaggcttgtacagaccttgctgtgccccctctgaacttggaatcccaactccgtcgctgagctttcaatcttgtcgaaggcatccttgggtggatgcgttgatgtgaatctaatcctcctttgggacacttcctgcaacaagtcaggcaatgaattattcattccattttcccgtgaaaatgtaatcacaagtggcttaagacaagttcatccagggtgattatcaacagtttcctgggaaataagttatttcacttcaactgcatatgatattttgagaagatagaaacattctattttcaggttatttcatccttggtaaggagatggaagtgctggaaggaaatttctgaaaaggcactgtacaaacctcatcctcgaaaaaccctgaaagatcaagggatgatgccattccaatcaactggaaagcgttgatctgatgagaattcttatctccaggctcatcattgatttgcttcagaaaagaaaagaaaccaaaacttaccagtcagtagttgcaaacaccaaaattaaatttactgttcaggacatagataatccccaatggagtcatgaagtctactaatctctccctacctctttggcaggaagacgtgccccaaactgtacatcttcatcgtcatcatcatatggaagaacaggaatatagtccttctgaaaccattcgtgtgatttgatccctgccatgtcgatcctcttcatcggattgggttcaagaatcctccgaagaagattttgtgcactgtgtgaaagccactttgggatctgagtgtcacccttgaaaatctaatcaaaccgaataaacatagtaactaaaaatgatcagagaatacaataacagaataatattacttcggtttgatataaatcagtaccttctgatacagaacaacaatatttcggtcatcgaacggaagatatcctataagcattacataaaggattactccgcaagaccagatatctgacaaggatccatcatatcctttattctgcagaacctgcaagcatttagcacaaggttgagcaagctttacaagataataattcagttgaactgaaaggaactttcacttacctcaggagcaatatagttggggctaccacaggtagtatgcagcaatccatcattctgaaaagtaccaaactttacaattcagtgaaaaaaaatatttaagaaaaacattttgtacagctgaagtcgacaaatcataccccgaggtgttgaggtaaagcactaagaccaaaatcagagatcttgatgttgcctttttggtccacaagaacgttctcaggctgtaccaatggaataattttaacaagaattatgttacagattcatgaagccacaccgaccgatattgctaactaagtgcatcacagatgataattcataaaatttttagcagtttgccctaaaacaaatcttccattaccttgaggtctctgtggtagactcccctatcatggcaatagctaacaccatcaattaactgctgaaaaagcctccttccttctttctctgatagttttccctttactgcctatattatttttaatcgcaaagaattaacagcttcaaatgttagaacacaccatagtagctggcatgaaaatttttgcagcgaggaaatagcgtaaaagatcattgaaacaagggcttacaattctctcaaacagttcacctccattgacaaactcaagcaccatgtaaatcttagttttgctagcagcaacctgaatcaagagtcgaagaacaagattaagacgtgatcatgtgatgtgacattactctcttaagttagttgcttacatgaaactgaaccatagaattttctctcgttttcgtagtgaaagaaaaaaaaaacgtgacataaattcgacaacgacggtgctacccactagtcggcaatggccatgcgtgggcacatttgggatcacgagcacccgccggagatggagaagacggtgacgttgacggcgaacaattccggcgagaggcatccggttctcaccagacaaagtctccgtggtccagcaaaaataattgggggacccaccagacgacggtgcgccgcgtgggcccacactgccaggtggaccaacgccacgtggcacgagcctagtctacgtgcggctgcgggatcggctgctccacgtggcatttcacacggcggcgccgtcgacggcgagaaaccggcggccgcggcggcggaggcgaaccacgcaatttgcaagctaaataaatcactaataaataaataaaaaaaaagaaaactcgtgttttcgatcgaatctccggtgcgaactcaaactaatttcgacgaatccattatctaaataaactaatttggacgaattaggcggtttattaaggaagcgaagcgagagaaggatgaaatggaattttgacctcgtggaggcggacgacgtgggggtgcctgagcagcttgagcgtggcgatctcgcggcgaatctggtcgccggcgcggagggagacgacgcggccgcggtcgaggatcttgacggcgaagtggccgccggtggcgaggtggcgcgcgtacttcaccttgccgaagttgccctccccgagcgtcctccccatctcgtacccgcccagcagcgcct

SEQ ID NO: 62290 - DNA, 2033 bp, Oryza sativa
agtgggcagcaggtttacagcacacgtaaaaagtccacagagaaaagatggaagatgccgggctgtgtctgcaactgcaaaccacaaccacaaggttttgctcttgctgctaatcttgcattaatctgctatgtctccccatccccaagttggagtaaaagcagacgtttctagaattcgtgtcgtcgtgtccgtggttaattacatacactatttactatagtagtagtacttatcttccagggatgtggataattacatgttcacatcgatcctgtggtgtaaacatgtctctacatccattgattcatggcgcacacatcacacacagcggcaatgtatctcctaacatatgttttttttttctaaaagaaaagatggagaccagcgacatatttataatatcactaaaatcatattgaaattttgcttgtgtgtgtaatatttgtggatatcagaatttgaatcctgataaatggagtcatgcacttatgatttcaccatcataccaccgatgcttcttctccggtgttttagtattttttttagtacttgcatgcttgtattttatttatggatatgggagtaaaatacaatgccaaaaaaaaaatgcttatttgtaccattaagatatggacataacttaattggtaaggtttgttttggtatgacctgtctatccaaatctgagtctctccaacttaccacggtagatgacttaagttgtgtttgattgttgatagcaatggacctcgaggcacactaatgatttatgattttgtaaatctttaggtatgccggttcaacctttcagacatcttcatagtggtagaaaattagtatgcttataagggttagtgtgtacacatgtatataaacgtatgcgattgtactgtatttttcatagaaagtttcaataattaaagatatatctcttttgtaccgtgttttatgagaggtttcaatagttaaagacatctccatgtattcaagagcaatcacaccaatgcctaggtattattctctatctaaaataaattaaattttgcatataaatctggatataacctatatctacattcatatataaaattttattttaaaacggataaagtagagtgctgcaacttaaatttcaggtctcactgtgtgcttgttggcttacaactgtagccaaattttagtttctttatcatggtctatcgtcagccttcgcttttaaatcgctaataatacaggtataaaaaatatattttactcttaaattatctttgattcattcgtttaattctctatggtttattattagcgcaccatttcttgcataggatttgttaacacatatattcttgtaaaatatttttactctacaacatatggtcacacatgcaaaaaaaaaaaacatgttttttcagaaaaaaaacacacatgagataagtcgttgtaggattgtaggacacattgtgggtgcacttaacccatgaatgctgacgtcacggacagcgtctggcccacggtgggccctaggtgccacgtggcccaatcatgcttacccaaacagccccaaaccaatgtttcccgtgggagaaaagggtaacttttctggccttgtcaatctcaatcactttcacacccacgctaagcatgatcttgtgggctgaaatctctttcaaatgactaatctacccctcaatggcaccatcacatgcttgtttaaccacaagttgagacattttaggaaagtataatttgggaaatcagagcactgaaatgatatatgtggctgttgataattagcagaagctagcaagttgagacctttttggtgggcaattttgggaaattgatcagagcccagaaataatgtggctgaggataattagctaatctagcaaagagattaaagtgggcaaggaggataagactgtgtgcctggacaagcacaagcacagacaactggacaagagggcattatataatattatattacagattaaattattgggagcatccaaaaattaattaaaaaaact

SEQ ID NO: 62291 - DNA, 2712 bp, Oryza sativa
tggtggggccaccagttgcttgtgttgagaggtttgggatcctgcaaggctccaccatgtcaaccccccaaaaccatggggatcacattgattccttcatccattattcttaatcccgccacttggcggcgccacgtggcggattaatccaataagtctatgcatggggggtgagtcattaggtgaccacgtaggacccggtccaagtgtccagaaagtgacaattgaaggacatgatgcattgcatcatcacgttgctggggacaatccatatgcatgtgcatatgatcagagagtatgctagctaggaattgctgcttgtgcttgataatccgaatcaattgagggtgtgtttagttcacatcaaaattagaagtttgattgaaattggaacgatgtgacggaaaagttggatgtttatgtgtaggaaagttttgatgtgataaaaaagttaggagtttgaaaaaaaaagtttggaagtaaactcggcctgagtgtccgtatgatgtatgtgcgtatgactgattgataattctgttgaatgcagacgtgtgttcatatgcctgcatatctgttttgtcggtacaacattagtatggaaatttccctttttcctttccctatatgtcgagggttgagttttgtatttatccctagcttgtcggtgtaggcacaactatagtgtgcaacaatatccccttcattcaaaaataattagtttttaatttgaggagctacctctaaccaataatattttttataattaaattatgtgctcccccattttaaattacttgtgcgcttctagctttgtcctaaatcaatcttttctatctttgacgttaaacaatttctatctttaacattgatggtcaaaatgtcaaatatgatgttaaacatattgtctctttaaacatatatagattgtgtaaaaaaatgtatgtatgtttgttttggaaaataattttgtggtatcttcatttattgggatttcgcaaaatactttgaaacaaaaattactagtcaatgctaaattctgatgtccaaaacaatataatatgtttttatggacgggagagagtagcaatgctgttgtcaaattgtgttgataagtctaaatgcattgaattcaaatatatattttttaaaaaagctggacactaatagcaggtacaatagcaagctataagccagctataaccacatatcgagaagaaaagagaagagagagaagaaagcggactacagatttatagccggctgcaacacggactccaagacgaagaaagcggactacagatttatagccggctgcaacacggactccaagacgttatgtgtgtatgagaggtaggacagagtattaatggtgtagtatatttttatagataactattgtataaataagctattagattagctatagatgatttaaagccagtagttggctatactattgaacttgctctaaggaaggatccgatgtagaatttattaagaaagagggtgagtatgttccaccaaagtcgaacgcgggtcacagaaagcacaacgctacaccatgccatctgcgctacgtgcagcctcaattcaaatattcattacttttccttgttttagagatgaacacttgaatttaataaatatatcatcggacatcaacaggacataggatacaagagcacaaaaaaaacattagttctggctttaaaaaaaaacaagcaagagaggtttcttgcgatttgacaatccaacgaaattgatcgatcttgcgacgtacacgcgtacgagattacttaactcaccacgagtttgatcgcatatgtgccccgatctttgattctagaaaaccgataaattaacacgcacgctacttgtcttgatcatccaatttaggaattaaaaattcgataatcttgacgtttggtgactgatcacgcccccaacaacttttgatccacaatgcaaaaagtacagttctttatatttttcaaattgattccatgcaaatatagatttaatattttaaggagatactgagttgaaattcatagtacgtgcggaacaaattttcaaatgagggagaatcaataaaaagtgacatggtgtccgtcttctatacagtacggcaagatttgagggttttgaaatcgatttatattttttcctataatttatctttgtcttcttttcatgatcgatttcggtggcatgggtttctctaatgactatgctatgattgagtcgttgagactatactccatgtgcaccgatgagattgaataattaatccatcaatcttgttaaacaattaaagattaattaaacagagggaaagatatcaaggaggagagaagggaagggaagggaatgatatgacaagcgaaggaaaaagagacgacgagtacttaaatatgttagaaaacacttcgaaagattcatgtagttaattttgttatttatttcttggtgtgatttggctattgggtctaatttgggtaggaagtgatctctaagacaattcgagcacacaactcacggatgtctccatccatcgtgtctaccgctggcttcccattcgtcacatatagcacatggtttgtctagccgattaggtaacatttatgactgttgatatgtgggtatatatatatatatatatatatatatatatatatatatatatatatatatatatatatatatatatat

SEQ ID NO: 62292 - DNA, 9043 bp, Oryza sativa
tttaactcatgagttaatctgcgagttaaatttaactgatgatgacatggacgaatctcggacgtccatttctcgatccaacggtagttttcaagtttccactatatatgtggtttgcactacatatttttccgtacaaacatatgtaaaatgtcacaccaataacgatgtgtgaggttggacagccaggcaaccgtgtatacgtgccccacaactaatccacacatctgtttttgtttgtcactaaatattgctcctactgattgaaatcattagccaactatatatatatatatatatatatatatgtggttaatatttgtggccactaatatatacttatgtctcaatattatgattataaacctaatgaataacgacataataaaactatttttcaagacttttttttgcattcatttttgtttaaggaaaaaaaaaaggccagcaggaggaatatatgcaagaagaggagtacatcatactcaaaggaaaaaaatatgagataacaccgataaccctgagaagagattgacactatatccatgcaacccacgttaatggtaccatatatagggatgtaaacatacaatttaactacctggataaaaactcgcttgcttagtttttacttactagtataaaatttaaaagagacaattaataggatctgggaagcaaagaaaaaccgattgctggtcacactttacatatttagtactgcttacactcgaaggattttagctttagacaacctaaaataatactcactttattttgaaacatctagtattccgtcctagaaaaaagcaaatcctatgaatctggacacgcaaatgtctagattcgtagttagaatttgattttctttttttatggaaagatactacatatctatatgacattggttagtttatttttaactaaccaacgtcataaataaaatacgtagcaaagggagtatgataattcagaatttgaaagaaaaggttatattcaaaacggtaagtatatgtaaccgaggaaagttgttaattttcatatgcatcatgctgcacgtggatcagaagcacacctaccggtccaatttacctcttcatgtaaacgtctactaataaatattgggtcaatcagaccagaacaatctaaagtcttccaaccagctgggaaatgctgcgccctcagcgttttgcgctgtcgtggaccttgccgcgtcgcgacacgtcagcccgagctggaaaacggtaggatttcgcgagctctcgcatcggcccttctatttttgcaaaaaggcccttcattttattgataatttgttttaggtatatgctctttagtttgtactgtgttctgcgttcttatgtacagggcctctacaaactgcaatattctatgcaaagaagagaaaaatcgaaaaagaggagcacggtctgaataacagaaagtgagggccttttatgaaaaaaatacaacccaaaaccccccaccccacccaaaccctagccgccacttcccaccacctcctctccttccctcgctctgctctctccatgcccaggcgagggagtccgccgcctcgcctcctcacgcgagccactgctgtcgccgcaccatcgtactgtcgtcgccatcctcctctcgctccggtcgatgcatccgccaacgaggaggccgggaccgtcggatccggtgaccccggcctcctcgtcggcggaggggagaccgactgtcaccctctctactcttctccttctacgtccggcaccgctacaacgacggccgcgcggatcgcgtgaggcaacgggtggctgctccctactcttctccctctccctctccattctcttcctttgcagatcggcggaggcttgcaacaacaacaacggctgcgtgggtgagcaatcgaggaggccaggaatcaccagatccggaaggacggcggcccggttcggagagggagcatcccgatctgtggcattgaggcccattgtaagtgtcgatggcggtcgttccttcacagtggtgagttccagggggaaggccctgctcccctgccctttctttcttcactctccccctctctcggatccaaatccaaagatgatggggaggttccatgttacagatccagggccgctgggtctattgagctcggtatcgacggcagcagcagctcgggcaagatggaagaaatgtgtcagacactgcctcctccgagagcatacaccagcgacgaggccaaagtcgatcttccgcaaccccgtctggcattataacttgtaagtttttgttctttttggtgttcttggtagaccgatgaaaatggtgatggtctgacgtgcaaattgatgaaggtagggatgatatgatgtgtaggttgatgtttgaatggatatgcactttttgcgtgtgtagatgtaatacatgttcttgagcactttacaggttttgtggtggggtttattaccgactgacaaaaaactgagatacatgttcagttatttacagtggcacacatgaatgcggatagatagaatgctactccctccatctacttttgatagtcatatttccaaatctgaaaattttatttttgataggcatatttcaatctaacaacctatcatcttaatgactttctcggatttaatgcataactcttcattcttccacacataattggctacatgggcattgagaaatgtaaatattaatgaatcgcttgtttacgaggaatgactagtagcatgtttaaatggatgataagtacaattacttatccttggtctgtgtgccaagatgaaatatgactatcaaaagtagatggagggagtattgtttttctcttctatgagacctcttaagtactaacctattaactgcttgatatatcatattgcatatgtattcatctgttttgattcaaagatataagattcagaaatcagaatcacttcagcttcagcttgcttggagcacgccggcgcagggtttcctcgacgggtcttggctctgccgtgccctcctcgcgccgccctttcatactgacagttgttcgaggttgcctcccccgctcatggcgacctccacctcagttggagttgggaagctcctttcccgacgtccccacaacacggtgaccttggcctcaacccggtgctgctacgctcagctcaacggtgagccccttgatgtggtaaatccattgatgttgtagctaatatgtcatatgtttgcaacttcttacttcctctttccttctttgatgtaacaaagaaagtataacctcggtctttttagtaaaacaatatttctctaattagtatttgcgagaactatatatttccacacttcagttaatagaagaacatgcctcaattgacgatatatgcttatgagatctcacactatttttatccttggcaacaactggcttcaaaacttatatgattttttatttccataacagcaagttcagatgcatttcatcttttcttgcgtagttccagtggagcttaattattttgaatagaattcaaatgtcacttaatatttgcataaattcggtctccattgaagcaatgtttaatatttatgaaatacatttcaaatgcttgggcatgatgcgctataaatttagatcggttagaccatgttatcaaaacgaaatgtctatatcagcagcagggaacaacatccaacaaatttttggattcaagtactcgagctgtatggactttttcctaatctgaacatattgtcgagtgtttttgactgttgccaactaaaatggaaaacttttatttcagttgaatttctctgttccaaatttgaatacttaatcattgttttctcttttctaatatgtcttgtacttccttttctcttatacctgtatcttaaatgacaccatttagtatctaattcatgtgcctcattcttggtttcagattgctcaaactacaatgggcaataacaatattgcatttgagggcctcatttttggttgccctcacctgagcatatgtaggatacagcctgtggtgagtccgatgaatttgcaccgggagtggactgctgctggctactcataaattcttcctaagcttgattttataccttatatccctccttaataaagtgatagtaaatagaaataggattgaccgttctttgcttttcattttctattggcaatccttaatgtcatttgtaatgtccctgcttgggtggttgccttttattttatatcagtaaatgattacagaaaaaagatatgttgataaagtatgtcatttgctaattccattttattgtacagcttgggaacaaggtggccgaactgaccttctgcttgcttcctgcagatgatgccgttagtacagagttgttccctctctcagcctcccaccatcttctcctgtctctctctgagcatcacctccattgctgtcaaggtgatgtttgagctcaatcggtaggaggtcaatctggttgcactccatctcatttgagagttggttcttccctttcttctctaccttacatcaagatttgttcacttaaatttcttttgttttgcttcaggtcaaagaaggttgaatatgtaaataatttgccaacatgattttctcatattgggtggtttagtaagttaacacttaataccaatcacttcatttcagcttctcactaacaagcagccaaggtctcttcacggattattgtccatggatggccaagcttttcagcaaaatgaaaaggtgaaatataatgaaatattattcccttgctccataaagcttcagatgtggagtgagcttgctgctctgcaagctgacattccatttttaaatgtagagtgtgcttgaattaatcaaagaagcagatttatatacatcacaaacctttttttttatgctgttgctcatttaaaaaaattgtgaagtttgtgctgtctattacaattacatccagccgtgctattcatcttggccaaggaggccatcgcgtccatggcattttactccttgagtgcactgctttaatgctattataaacataaaagtgaacttatggaagtccagatttcctattgtaaatttttgtgctattctcatcaaacttcatactgtaaattctgttatgtgtaattcctattgcactattcttgttgtaagattaatcataaaagtttagagatgtttggacatgttgtattgtaaattgagatttaattttctatgaggagtaaactgtatattgcagatttggtcctcttataccataatgatttttccttcactttgtttacctaagtaatgacagactctcctctggatgccactggtgcagcgcgcaaagcgcgccttcgcctctagtaaaataaattggccggaccaaatgcctagtagatacaaatcggatcatgtggttttagcccctcgattcaatcccatcctaatttagttctgattaagatgttggcgggggtgggcagaaaaagaccgaaccgaaaagaccgggaccgagaccaaaaaattcggtcatcaatttggttctaggtagtgaaagaccgaatttttttcagtcaattcggatagtctcttcgggtaaccgaatagatcgaaaagaccgaattctcaaaaaaaaaaagtctaaatacaacctacaatccactatgtttaataggattaaactctaattttcacatccctatttcttctaggcatacaaccttacaagagtctttactcataagtgcttacaattttttttaaagatttttgtgttgaaaattttcattatttatttgcatatatgaaaatgttgttgaatttcggtcaggaccgagaccgagaccaaatttgtcggtcctgatatttttttcgctgaaattcggtcttcacttttcaaagaccgaaaaaaccgaaagaccgaaggccgagactgaaaagttttggttagatcgaatgtccaccccttaacaaatcgcgacatttctttcttaagttaattccacatcattggtatacgtttcactgatggtatttcctccattacattttaaatgtagccatgagttttcgtgttcaactttgatcgaccgtcttatttaaatttttttatgattaatatttttgttattattagatgataaaacatgaataatactttatacgtagcctatgttttttattttttttttaaaaaaataaattgacgaataattaaatttggacgcagaaacgtatgtctgcgctcaaaatggaacatagagtagcatttgtggccaaagtcaataaatttatgtccattcatcgacaagacggacgacgggagagaggttgacggtgaaatgaattgaattctgatcgatcgtgccgcgttgatatgattcatcacaattcataagccatggatcgatgatggatatatcggagcttgttgctttcaccggtttgtagaacagtaatacaacattttaaggatgatgatgatgttaattaattccgctgaaattgacgaagatattccggtcccagtggcgaatctagaatgtaaattgagcgagggctcgtgtgtatatatggcagtgtgactgaaataaaataagatatgtcaactaagtattttaagatgaaacccaaatgcatatgatgaaaggacaacgcattgctttctccattttaatttgcagttatattaatttatacacacaaatctatcaagaaattggtggtataactataacatatttgtcattggcaatttaatttgggcattgagtgtttgaggtagctttccttgccataatactagatttaagctaaatgctaattagagtcattagttgctaattagaggaaggggatcatggagctggggcttgcgcactgacaagccctagcagtggatccgccacagtccggtcctggataagttgcatctccgatcttccccaatattcgcgtggtgagtggtcaaaaacatatgacactttcgataagattcagtcaaacttttaaaatctcagctatcaataatttttcaaatgcttgatttgaagaaacagatatacatatatttgtctacaatttactatcacaacatatcaacatcatagtacatactgattagatttataaatatattttaatataaaattgattgtcacaattttaaaaggttgaagcaatccagatcacaggatcgactcccctctagggtccgcgcttaccgtgggggtacggtaggggtttccagcggtagggtttaatgaattttgcctaaattcaaaattccgaaaataaattgagaaaacttattgatgtagttcttgatttgtagtggcacatggtgaataaagtatttgaaaaagagtaagataaatttaaatttgagggcaaaacggaaagtacattacaaaatgtaaaaaagaaataatgaaatgggccttaggttgcacatttttatctggcccattaaggcccataagtggagaaaatatctcctggatcctctcatctctctttgttgctttctctccgcatacatactttcaaatgtatggttgttgaatcgttgttgttgaattattatgctacgagatgttgtattgcttcgaagtccataatatggaaaagatcataccgatttttgtattttacactcaaaagttaggtttacaagtatcatatatattcttgtaattatccccaatttctacatacatttaagtgttttttttatttttttgagaacgtttctgttttgcgaatatcgcggttaccgcgccgaaaccgcgaaaccgccaattttttaattcaaacatttgaggacgaatttcacgtggttttcggcggttaccgtggtaatggccttagcgcgggggaggggtgggggcgataacccccctcaaacggtaagggaaaccctgctcccctccccatcccacaagcacgtttttttttcctctctgtgtaaaactaatcttgacaccatccaacggccaacatgaaaccccacgcatatccaaaacggtaaaaataatcgacggatttctcccttaattttctgtaaaaaatgttaaaaagtgccaaaagttcttctgcaattgcgcagggccgtaatgatccaccatgaagtttcgtgtttatcttcaagttgtgttagttgtgccgtgccatgcatggctcatactaagttacatttgatgtaaattttcgtcaaccttgaaggaagatttttttttggtggagtcctttgaattaaatcatatatttttttgattttgttggtagatttttttttatgtgtcgtctctttatccttggttagttcctgataagtggctgcagctaatattaaagcaaagacagaatctatccattatttttttttataaaaaaatggcttagaattatcaaaccttttcgcagtatatccaatccaatctgggctcagaataaattcaaacattttttgcagtatatccaatctgggctcagtatatcctgcacggcctaataaatccaatcctgggctggggctaacttcggaagcgatgatccaacgttggctgggccgaaatttggatcatgatcaatggttaccatccaacctggactgggcccaaatttgatggtgatcattggtcccaagggaaaagtataccggaggtccctgaacttgtcaccgagataaaaaacgtccttgaaccgcaataccagacacccggggtcccccaactatacaaaacaggtcacccaacgtccttgaccccagttttgatctacgtggcaactgagtcagcgtggggcccacgtggccccacatgtcaggtgtccacatcatctctctttcgcctcttctctctcccttcctcccctctctgctctctctctctctcgcagaccaggccgacgggtagggagcagacggctgagcggcggcgctgcgacggcggccggcggacggcggcggcggcgccctcttcttcttctcccactccctggaccctgccgctcccgctccgtcctca

SEQ ID NO: 62293 - DNA, 2895 bp, Oryza sativa
agtcaacggcatcgaataactagggacggagggagtatatactgatacacatacattattccataaaatccacttaattaattaactaaagatataagatatagtatagctcgagctagctagcctatatatacacatggcactggctcttgcatctccacacacacacacacattcaattcacatacaaaaactaagctagctaagctaagctaagcgagattatcacagtagctagctagctagctgaattaattagcatgggattcacggtgacgaggacgagcaggtcgctggtggcgccgtcgtcgccgacgccggcggagacgctgccgctgtcggtgatcgaccgcgtggcggggctgcgccacctggtgcggtcgctgcacgtcttcgaggccggcggccgcaacggcggcggcgagccggcgagggtggtgatcagggaggcgctggggaaggcgctggtggagtaccacccgttcgccgggaggttcgtggagggcgacggcggcggcgaggtggcggtggcgtgcaccggcgagggggcgtggttcgtggaggcgacggcggcgtgcagcctggaggaggtgaagctgctggaccacccgatggtgatccccaaggaggagctcctgccggagccggcgcccgacgtccagccgctcgacatcctctcatgatgcaggtatatatttatggattcaaattcaggatttttgaatttcctacaaagtttcgctagactttgtattcttataaggaataataacgtaactaatctggatcgatgatcatattgctaactccatcctacaatatacgagattttatccatacagttatatggagtaaaaaacatatatattaattattgcatatgtagtgcccaacattataaagatttatatatgtaccgtctttactttaaataaacgggtggacatctacttatactacatcatcacataatatgtatgattttgtcaatataattagtataaagtcacttatattataggatggaggtagcatatatatattcgtatattgataactagctaagtggtatcatcatctacggaccattatatgatttggcgggagatcaattatagtagatttactgtctaatattaaaaagatttatgtatagccatctttactctaaattctagctatgctacttagggtctgtttgggagagcttctagctgctagaatttctcccagaattagaagctcctcagacagttcagcttttggtttagattctgagaagttgtacttgtatgatctagaaaataaactagaagccagaagttataggaaacctagctttttttagattctcaaaagctagctaccgactaactatttcttagaattttaagcaccccaaactaacccctaaactggttacaaagacatggcatgctttagcgcgttggatgcatgggccatgcatgcatatgcgttcttatatatatatatatatatatatatatatatatatatatatatatatatatctcctttggttgtgctacacgtggtgtgtccccatatgtagatgagatcgtggcatgcatcgatatcaacatgtacaactaaactattctcgatgatcactgatcactcactatcggggtaggtaagtcgatcaatcggatggctctctccatcttgcaatcttcgattccctttattttatttaatagtatacaataaagaaatatatatccacgtataccatataatcatttatcatacatgtgctgtttatgtgtctactcgtaaaagtgtgttctttttaattatatgctcaaaagatttataaatgatgaagaccatatatatatatatatatatatatatatatatatatatatatatatatatatatatgcaagtcatcaacacactgtacaaaattctcacaaaaattttcccatatatatgttcataaatcaatatcaggatttgataactctggttgatagagtcatgcaccagtaattttacccataaactatatataaaataaaatcgtggacaaatcccccactaataaactgtgttggtacactctagtaaataataaagaaatctggtggcctcccacagccacatattattgtgttgaagtcggtcgtcgatcacatataaaccaacaacaaaagggggccacacaaaaggccgcatattaatttatttccagttgattaacaaaatgaccctatatactatcttttcttgcttggtggaaaagaaaagctagaggtcagttaattataagtaaaatataattaatcacaccatgtgtcttgctgtgaacactgtactggaagaagttaggtacacacattatgtagtgctacgcactacgtgttgaaattaaatgtgctctgtttgcttgcacaacatccatttgtcaggcatgcagacaggcaacttatatgcgtgtatgcagctcaggcatcctctcgagaatccattatcatccatctctttcgcaacttcgcgagaagtgtacatgtacgtacccacactacaaaattagatggatcacctaccgcattatattagttacctctgtttggtaatgcatcttacactctcccatctgtttggtataaaacttttaatacatatctcaacgattcagaagtaaatacagtaaaataaactatgatgaaaactcacaaaatcaacttcaaaataaagtttaataatttaaattttgacttataaacatatataggcagtacatgttcaagattaataggtaattaatgttctttttagattgtggaatatttcgttaattactgaaacatctttcagtaaagtttgtgacgtgttgttatttgttgcatcaaaattatatgtgta

SEQ ID NO: 62294 - DNA, 2755 bp, Oryza sativa
acactccaactaatcttaagcaaaacagctagtagcataatgcacgaattttgtacttagataatccactgtcttctcaaagtctttcgatcaattactttcaccagcttgtgtagcaaaagattgatttgtgccgaacatactttagcacacgaaccggccacacttggatcaaattaaagggccttttctctagctagtgttggattatatcatgaaccatgattattttgcttcaattttcaatcgagagagacttggcaagtactaaagatttaaaaaaattatatagctagtggataatccatgccagtggaaatgcaaaactagctacagttgattatgaccaggtatcgatcggtccaggatttttcaggtgggcgccgctggtatacctgaaactgtagaacaattaatactccctccttccctaaatgtttgtcaccgttgacttttttaacatgttttaccgttcgttttattgaaaacttttgtgatatgtgtataactatatgtatacatcaaagtatatttaataataaatcaaatgatagaaaagaattaccaattacttaaattttttgaataagacgaacggtcaaacatttttaaaaaagtcagcggcgtcaaatattttaggatgaaggtagtatattctaactgagccttttatttattttaatttcactgcttgttctcaaataaaaaatggtatataattttcatgagattcatgaaaaggaaacaaagatcttctctcattgaatctagagttgccttgactaatagtagtacatgtggttcagtggatgtggaaagtttgttggtgaaaaggtaggctacacagtgggcaatagtaattttgacttagtgttcttttacgtccacagtcttcaacataggagtactaactttggtcatcattttgtagttacagtaaaatataagaataaaaatataatattatgaaaacatttttaacaacaaatttgtatagatcttttgttgagttaaagaaacatgggggaaaaggtagcgtggggtagcccttaatgtaggacgccgttgacttttcgaccaacgtttaaccattcgttttattcaaaatttttacgtaaatatgaaaatatttatgtcatgcttaaataatattgatgacgaatcaaatcacaataagataaatgataattgcataaattttttgaataagatgaatagtcaaacgttagataaaaaaatcaacggcgtcatacattaaaatatagaggtgtagtacattataggacccactagccactagagttaaaatcattccgtgcccgcaaatattactcgtgtactggtgcacttttaacgtaaggaatttagagaggatatatgggtggttctcgtctctttaaccttacatcaaacatgaccattcgcgtatgatatatgctttttttctctctctgtaatcgtggaaaaaagaaattcaaaaaacctgacggtcaagtggaaaagaattaatggagggcttcgttagtgcttaataagttgttgtgtcggtaaaagggacggtttaaccacccgcacgtaaggttgatgatcgatctacggactacgatccaacggttcacgatgcgtgatgcgatataccagtatgtgatgtgacaatgaacggtggttgctgcgtcgttactagatgatgctagaacactcacaatctcacttagctctcactaacaaagtgataagctctagtactatctacctaattagttagtgacaatcaccaacatttgattttaattacctaccaactcaattttcttcaaatccgttgaaaattgaatcgatatgtataaaattcagcaaaattacaatgaaatgaaattgagatgcccaggtagtgcagtgacagaagatatatggtttcaaaccctaaaattccgtgttcaatccaaaacatgcttaaattttctttttaaaaaatgtttggaggaagtctctcttttcaaatcctttttttacaaaaattacaatgacattgatcatgttaattatttttaaaaattgtttgtagggagtctctcccttcaaatcttgtttttttaaaaaataagaatgaaattgatcatgtgtgttttaaatttgcaggtgacggagttcacgtgtggcgggttcgtggtggggctcatctcggtgcacaccatcgccgacggcctcggcgccggccagttcatcaacgccgtcgcggactacgcgcgcggcctcgccaagccgcgggtgtcgccggtgtgggcgcgcgacgccatcccggacccgcccaggatgccggcgccgccaccgcggctggagctgctcgacctccgctacttcaccgtcgacctcagcccggaccacatcgccaaggtcaagtccgccttcttcgagtccaccggccaccgctgctccgccttcgacgtctgcgtcgccaagacatggcaggcccgcacccgcgccctcgtcgccgccgccgccgccgccggagacgacgaccaggagcgccgcaccgtgcgcgtctgcttcttcgccaacacgcgccacctgatgctcaagggggacggcgcggcggcggcggcgacggggttctacggcaactgcttctacccggtggcggcggtggcgagcggcggcgaggtggccggcgccgacatcgtcgacgtggtgcgcatcgtccgggacgcgaaggcgaggctcgccgccgacgtggcgcggtgggcggtgggcgggt

SEQ ID NO: 62295 - DNA, 18015 bp, Oryza sativa
ctgtgtgtttgtagatcttgttaactactatagtgctcaagtgccgagtggaataatggttgctgtaatttgtacaccgagttaattatgatggagctttttattttttttccaaaaaggcacctcctcttttgatctaaactactacctgatctgttccacgaaaacttactcactctttccaaaaaaaatatagcatccaaaatttatcccaaaatagatacggttataattatattagcatttcaattttaagtattccttattgaaattcttctccaccttaccctcaaccatcgatcctcttatttaatggaagcatatagattatttttcctctgccaatttatcctttgaatgctataattgcatttttttttcaaaaccaaatggagggcacgcacattagaattgtgctccagactaaatggaggatgtgttcgctattacctgttcccaaccagaaccctccgcacgaaaaacggagcggtttattagcgcgtgattaattaagtattagctatttttttcaaaaatgaattaatttgatttttttaagcaactttcgtatagaaacttttcgtaaaaaacgtaccgtttagcagtttgaaaagcgtacgcacgaaaaacgagaaagagtggttgggaaaaggggtgtccgaacacaccctaatacccacacggtatcatgccattcttaaacgagatcccacactcttacaaaaccccattattatgaactcggcttcaaagatcttccattatccaccagcattttagggcccctttgaatcgcagggtagaaaaaacggaggaataggaaaacacaggattctaacaggaattgaagtgtaaaacagatgattgtaaaacacaggaatggtcatttgattagagcgcaggaaaaacgcaggaatcggatgagagagatagactcaaaggaaatttttcaagaggttagagctcttgctaaattttcttcaaaatccacatgcaatgtactattttataggaatttcataagatttggaaagcttcaatcctttgaatcaaaggaacaaataggaaaattttctataggatttgaatcctatgaaattcctatataaatcctttgattcaaaggggcccttagaaggcccccacccacttcttgatccccacctaacttggagcctatgattactcatttgatccgctagctcaattacctgatggctgatcgatgcgctcctagatgacctgtctaatttgactcgaatcacctgttcattcaggggttcgcattaagattgctttgtccaccttaattaggatcacatcgtgtgattttagatcactgatcgaccacctgctcctgtgacattttggtcgtcattctattcctcatcatctatatctccgtactgaacaggacattcgttgatcgagacctgataggaattcgttcggttaatttgagttggtcagaaagttggtgaaggagatttgaacttactgtcgctttagctggccagtactccagtagtatccccccagctgtctgacgtagacacctacatcgatgagaatatatagcaagcaagcctaattaatctgtcatatatagcaaatatttactgtagcaccacattgttaaatcatgatgcaattaggcttaaaaaattcgtctcttaatttacatgcaaactatacaattagtttttttcatccatatttaatgctctatacatgtgtgtaagacattcgatgtgatgtaatttttggaagtttgaaggaaaataaacagtcctcgtttcgtttatgtttcagactgttgcaagcttacttcaggctgccgtcggcctgacgctaccttttctatccttttggaggggaccaagctactacatgtacatgttgggagatttgcatttcagatggaaacaaaagttcagatcattggatgaatgtctctcaaagttcttatacaaatatctataaataatcaacttttatatatatcgtgtttggatacagtggtacacagaaaattaattaatggttcaatttgccatttgaaataaacgaaaaaagtcccggccttcttttctgctaaatggatgaatggattaatatacacgtttcccaaacttttaaacggtacttaatcacgtgaaatgaaaaatcattagcgcctgattaattgagttataattatttcaaacttgaaaaatatattttcttatattttaaaacaactttatatagaaatttttcacaagaaacatattgtttagcaatttaaaatacgtgctaacagaaactgaagtaaaatatctatattaaattcttaatcccaaaaaaagtacctaataataccttaaaagtccaaattcttctgttgttataagattttgggccgtctgataaatttaccgtcattctttctcttcttatatcatccaacccatcttgcgatctttttttttttgagggggtaaagggcaggagctctgccaatttcatatcaggagaagggagaaaacagagtttgtgcaagctatggttgaggataggatttttaggtaatgcaaagcaactagtaagaggatatgagtgctactcatctaagttatgagctccatcataggtcttacacatggcgatgattgaatcaacaacttacatcactgtgctataggcgccgttgaaaatcctggtatttcattgaagccaaataccccaagctatatagtatatagatgaagaggtgatcaaagcttctttgttacttgaccatctcttttctacacgctgtccaccaacctagcatatccccatcaaagcttcttctttttttccttgacccatcttgcgatctagggccaataaaatcgaaaacgggctgaaagtaggtctggttttcttgattagggcccaattccagcccccaaggcttgttttgggccgtttacacaaaatcttgttttggctccatttctcaatgaaaaatggaattggaactgaaaaaaaaaaggaagacgaagatgacaaatttaaagtttaaacaggcaaaaagttggtgccattcctgctaaaaaactagcttccgtatatatccgaaaactgattttctgatgattgtaagattccggcttctgacgatgatcagaactgtctgatggaactcacggttggtaaaacaaaaactgaaaatttggttgaattgaaatattatctcatcacatgcttcttggtttcaaagaaactttaattttgttttgacagttggaatcgatttgattcggatcacatctagcttttgtaacaaatcaatcctgcaggaccaatatagctttgcatgaaaatgacctgaagaatgcatatgagaaaagataaaagcaagctcttgaaccatgcattttgctcttcagttttcactagatgtactacaggccaaggaattggaatcgatatatcgacttgatccagaatgatattgttgccgattcatcgcgagtcgccatccgtcaatttcattagttcactgatgatgacctacaaatcttaatgccgggctagcttgcttgctgctagctgatgatcagtagtattagtcagggttcacaattccgacgaaaactggccgaatttcatgaaattttgaggtttcgacgaggcttggaagtagaagccatctgagatttcgatgaacttcatccaaattcaactttgaattgataaaaaaaggaaaaaaaatcttataaatagtatgatattcatagaacctattgtgatataaattttcgaaaaaaaataatgtattccgtgtatttactgaaatttatagtaggaaagaaaagaataatgaattaaaaaaggaaaacaatttcagtttacttctttttctagttatcgattgaaatttcgatgattttgcttggaatttcgctaaaatcgaccggttttcacgagctaatcggtaaactcagggaatttgtattcaaattttggtttatgaaatttgttcagaatctaccgatttttttactagatttcgcgaaaaccgttattccgccagagctcaaaacgggaggccatctcgaaatcgtaaaccctggtattagtactacggcaagtgttgatgatcatggcctaattagtgcatgcacggttcaacttattgttaggagtactagctattttagctaacaatgtttgcgtctaattattggttggacttcgactctgatggcgatgaagatgactaagggggtatttaggccatgtttttttcagcttgggattattataatctagattattaagtcagattactataaactagattgttgtaatctgtagtagaataagcggttagttgtttctttcctagattattagagcctagattattgggtttgcaagtctaaagagagagtggggtggcatggtgggtaatttttcacccaataatctggaaaagctcacctaaatgagcttatcagattataataagctggactctagattataataagctactttaataagttgtttgtttctttcagtttactcccaataatctgaattataataattcaaagatgaaagaaacgggaccttagattcaggggtgtaaagttttggcgtatcatatcgggtattataaagggtgtcgcatggggtattcaggcactaataaaaagactaattacagtatccgtcagtaaaccgcgagacaaatttattaagcctaattaatccgtcattagtatatgtttactgtagcaccacattgtcaaatcatggaacaattaggcttaaaaaatttgtttcgcaaagtagtcgcaatctatataattagttatttattagcctatgtttaatactttatgcaggtgtttaaatattcgatgtgacagggtctaaattttttttacgggattaataaggccttaaactcagaagagaaaaagaactatatacagtagcataatccaagagacctgtctctgacacgacattacgtgtacatgtacttattccgtcccaaaataaattaacttctaccttctcattcactctcggttcgtaaatcgaaaatttttattctttcaatatcccttatctacctatccaccaatactaatttgctattaattaggagtattttagtcttttattctcttctttaatcatgcattaagaagttaggagttgtttcttggacagagagagtagtatgcatcaatcatgtacccgatgactgatgacgaagacaaagcaagtcagaaattagtcaaagggtgctcctttcaccgtcttggtcatgtactcatgttcctgctccctccgtcttaaaatataaacacattttcagtatagcgagaaattaaatatttttaatttaactattaatagtaaaaaaaattaaaaaatcaatcatataaaattgatattattagatttatcatcaaataaactatcataatatgtactttttatttaaaacatcttgattttatagatattattggttaaagtagtatttcgaataccgtgttaaagtttaaaaatatttatattttagaacgaaggagcatatggttacgtgcaggctgcttctacttatcaattcggtacaacatatgctttgcatgctgacgcagcaaaataaaagcgcctggctaagctcagctctcaactaatctgtcaagcttataaattctaatatgattatagactagttgtcagccataacacggaagtagtaagatggagttacgaagatagatatcgacagaatttacgggtacagaaacctagtttgatataatctagcataataaatctgaataatgttttttttatggagggattactcatcacatgcataaaatcacatatactctctcgtctctaaaatatcttattttttttacttctttatttgcccacaaatacttcattttaaagcactatagcttgaaaattgaaagtgaacaacaaatacattaaagtttaagaaaagcattaagcttaaaaattaaaagtgaaaaacaaatacattagaatttgaaaaaaaaaggtaaagagcaatatagtcttttcacttttgcattaattttgagggaaactacggcatgcgtttaccgtcggagtaaaccttatcaataacgcgataaaaacaatttacaatgtagaggtgggaggggagatgtagagctttaggagttttgtactacttccgttccaaattaattgttgctttgaattttttttcttataacgtttgactattagtcttatttaaaaaattagtataaatataaaaaaggataagtgatacttaaagtacttatgatagtgcaagtcacaaacaaaaataataataattctataattttttaaataagacgaatgattaaaccttagaaacaaaaactcaaaacaaccagtattttgggacagagatagtacagttgtacaagaagcagaagcgtcaacccaagagactaattaagagtggcttgaggcgaaggggggcatcgatgtgaccagaggagaaaatcattaatgcagcattgtctgagatggtgatcagtttcgtccatgttattgaaagctttgttgtttcggcacttccaaatgttgcaggttatcatggggagtatggtgctctagatccgccggggaaaggggcgggtctgcagtacaagtgtaaaaccaatagcaaaattgtttatccatatatatattataacaccatggtataaacataattagtatactatgacaccaatacacccgttatgatactaacgaatcgattttctggatccatcactggtcggagaaggtgtgttgagttgggggctggacaagccagaggtcctcaagcgatggtagtagccttgagatgctcacgctctgcgctatgtttagatccaaagtttttctttaaactttcaactttttcatcacatcaaaactttcctatacacacaaacttccaacttttacatcataaatttcaaccaaacacttctaattttggtgtgaactaatacactcctggttgcccggggacagcgtagaaagaggtgctcaacatctttaacaagggggcagctgaagtggcagttgggagatgaagcaatcgccctacgaaagcagtgatcgttggtgaaaattcgtctccggtgcagcgtccagagaaaagttgatgtgtgagataggtaaaattgatgtcttttctaggatggaggtagtagaatcgataggtggcatatatatgcgggaacgtatcacgtggaaaccagggaagctgtgcaaacttacaaactctcaatcaagaccacataatcaccatctgatggctaggaatagaggtgggctaattctgcacttaagcgcccaccattagccatactaatcttgcttttttcaaatcaccccctccccctaatccccagcgcgcacgccgcctgttcgtttctcccgtcctgtccacgagttgcccatgagtcgctgccgccgtcgtccgcgtgtcgcccgtgagtggctgccgccgtggtacgcgagtcgccgccgacctggccctcaagtcacagccgcacaccagcgagtcggcatggagtcctcgcccgcgacgccagcaagacgtttttcaatgtttcacagtttcagtgctgatcagtgcttggaaaaaacagcatgaatgtttcagtgttttagtgattgtaaacaccttgtaaaaattctggtagaagcaactgagatacaatttttcaatgtttcagtgtttcaatttcacacacattgctgaatcattaaaacacacaagttcattacataggaggcaccattgctgaatcactaaaaaattagcatgaattttcaatgatatgagtcttctggtacaaacaactgggatacaatttttcaataaatttcacacacaatgctccacacacaagttcattacacaggaggcacaattgccatcgcagaacctttggttcaggcattacagtcccagacgaggacgccctttgttcaggcacaattgccattactcagtttctgatccagtactgactgaagccgtggcaggactgcccttgggtgcctgctgcacatgtgtgacaatagcaaaccactgaccatgaaccttgaggtactcatcatgccacacatcgagcctgacctgtaggaagttgtcatgctgcctctcactgctgatggagtcctagtaatcgctggcagtgaagccccttctcattttttgccggtgatgcgcaggtgccggtgaagcgttgctgccgatgatgcgccacgctgctgcccgtggctccaattcgtgccctacagaactgggcaaaggtgccaccgtcgaggacatcctgaaccggaccaccaccgtcgaggacatctccctggcggccgccagaaaggccacctccgaccaccactgcgtggctggcgaagcccaacgcgggactcatgaggcgacgcggctggatctgagatggcgcggcggatcagaggcggcggctggatcgtgagtcgtggggagacgatactggcgtaggggctcgggtgtaaaagtgatgggaggcggatggcgcagggggtgttttgcaaaatagacagagcggctggcgggcggttatttgcaaatttagcccacctctatctctagccatcggatgctcatcctgtggatatgattgagagttttcaaggttgcacaggctccttggtttccacctgatatgctccctaatatttgcagtaggactacacatttgggacaagtgattagtagtggagcaagtaatggctaatataatcaaacgttcttgcttgattagttagtatatgcagggtgtagttatgcgtgccgctgatcgagctgatgaaacagttggagaggatcgagttggagtagtaacaaagtacaagtagtagatgggcgtggctgcaggtagcatctactggagtactctatcttgtttgcatgtaccacgtatctatctatcaatctatctactccctccgtccagattttgagtttttcatgcactgtttgatcacttgtcttattaaaaaaatttaaaattattatttatttgtttgtgatttactttattattcaaagtattttaagcacaactttttattttttatatttatataaatttttttaataagacaagtgataaataataaaaaaaacttaaaatttcttatattatgggacggatgtaatatctatcagctcatagaaagtaatcattatatgctccagccaataatgcatcacattttgcacggtcaccaagaaaagcacaatcataccacgtaccacgcccccacataaccacatgacgcgcacatacatatataaacagatcaaacatgtaaaaagattaagggtaattttttctaacgaagattaagggtaaattaattagtcaatgaggaattgcatgcctcagtttgttgtcgcatgattacaagtatgcaattgagctatcctacaaaggaattaggattatagggtcatctctctactaaggctatgttcggctataagggatgggaactaatccctttcacaaaaaaaacacagcggttcattagcgtgtgattaattaaatattagtttttttaaaaaataaattaatatgatttttaagcaacttttgtgcagggaatttttccaaaaaaacctttaacagtttgaaaagcgtatgcgcgaaaaatgtggggagtgggttcccaactctaggtgccggacgcagcctaaatacttttctatcacactatactaaatcgatcatctcgctccgatcatccaaaattccatccaaatatatacgcggatggaatttatacatgggaattggtagtttaatttgtgacagaaattgtaatgaatttcagtcatctccaatctagcactggaattagaagtgaggcggaaatgaggaggggatgatcagaggtgatagcaacttatcggtggcatcgcggcgacggcgaggccctcttcttcggcaaaaaagactaaggttttggggcggaggttggggtggaaagggagggttcccaagagcttagaggcagggatggtcttgagtggccatcggactggtggtgggcggtgaggcggcaagagcatcgttggagtcatgaggatgaagattggtggtgggtggggcgacagaggctgtgggtgttaggacacggtgatcgacggcaaatccgcccgcatgccatgggagaatggtgtggcctccaaatagttagtcaggtagacctcacgtgtggcgccattgataacttttggtcagcagacgaggctagggttagtgccgatgagtttgatatgctcaatcgagctcccatatgtatggttgtgcatgaggaggggaaaaggagatgagaggataaggttcaatatttatgcatgaatcacaaagttttttcgcgaacatgtaaaaggattacacgtcaatatattagaagaaaagagttatagttacacagcatgaatcacgaagtgatcctgaccgtccaaaagattaactgaaattattttcaggcagcttagaattagacaatctcttcctgatttctatgtgcacatcaatgctgcatatcatgccaaactaaactctaagagatcacttaaggaacacgtacgtacctctctgtatgtgtgttctacctgataatctatatccaacaaaaagtcatcaattatgagtgacccaattaaaacttgtttaatttcattcatcaattcagcatgcacgacacaaaccatataaatataatagtacatcatcgatcatacaaaattgttttttttttaatttgtactgcactgcatatggttggcattccttgcatgcaactactatctataaatctatctaggaaattattatgaaaggttagctaatcaatctctatagtagatttgatcccacatgaataatgaatagttgggggcagcttgcatcaatgcttggatggtccctgcagttcttgatcgagctggctcgaattattgcaggacagaaccctgccggccagatagctaaataaccagtatatatgtacacacatatgattcaactttcaaggagaaaagatcactgcactattattagtagagtactaaactacagccgaaagcaaaacctacaagttaagagtggttaagtactaacacacctcactctagctctctctagatctcttttcctccctcaaaagaagaggattgaaaatggaaaacaatgaaactatagctacttccctaatttaattatcaaatcaaagtgaagcaaaaaaagatgaaacctttgccgagtaaaacccggagatggctagtgcatcattgcatctatgtgaaagaaggggttttttttttccggttggtaccaaatatgtgctagcaaatcttttcactttatacatatatatcaaggataaataattatccttgtctgaacattgccaaacggctcatgattatgtactccatggaattaatagaagaggcagagatggtgcacacaaatgaaagctggtcctctgcaacatgtatatgatctttttgtagggcacacttcaaaggacacaagccatttcttccctaaaaagagatcgatgaacaggaccattcctgcataggccagatctttttgtttggcctcatcacagcaaagttctatccaagtgcttgcatccaaagggaaaggattagcaactatattatcactgcagaatgaagctgacctgtcaaatatttttttgtgcaacatcaataatatggattggcaataattaacatatattgtgtgaaatgagcataacacaactggttagatttctggtagtggaacaaatttaacacatgtggtcatatttacgactaattattttttcaatggtaggtgacgtacacgttgacagcgagccactcatggtaattttgtcaatcttaaactataccgatacaattaatctttcagatgtgctcatagggttaaggtgtgagcatttatacgagttagtgtatgcacattatgagcatatgtgtttatactatgtttttaaaagaataattaacgtatattctaggggataaagagtacaataaataccagtggtagctagctcggaggattgtagagggaaagcatgtagtagtagctagctccaaggacaaatgattgaaagcaatggccatgatgaacagggcacattcatccatccaaccataactgtggtgagaggtaagtgtatgaacaccaacgaagctgagcagggaagaacatccatgtccagagaaaactatttatatatctaattaatcgctggtgtacaatccaacatttcaacagggtctttactgcaatcacattactagccagtactcccttactaccaacctgtgttcaccaatcaattccaatactgttcacatgcttggaacagtacggtctgaggtggccttgccggtcgtcttcctcccctcatcttcttcctaattagcatgtttctgtcagaaaatagatagtggccctgattagttccaaaataattttttaaacttccaacttttccatcacgtcaaaactttcctacacacacaaacttccaacttttctgtcacatcgttccaattttaactaaactttcaattttggtatgaactaatcatagccaatgtcaacccgttaatggatgtgtagatgaaacattgatgtaggctaataagtagcctctcacatagtttacttgttagtttatcggtcgcaaccaaaatttaaattctaaaagttgaatttagaggggtttttttttatcataatccatttttcaatattaccttttaaactgctgctaacataaatatatttctggttgcttcattcttttcctagggctcattaacaagcaaccagtagtagtcataatcaaggtggttactgaatgattaatacaacagttaggaggaagacctggatgatgacctgatctactcctatctatctatccagtaatataactcgtggatgattagattaggagttaattctgatgtggctgcttgctgaatactactactagtagtacaactgcaagtgatgctttgactatgtgtggcgatggacagctgaagacagaggtcggtaggggtccacgggttcttgaccctgaccacaagcaaacaagagccggattttttatgttttggtcctttttaaaaaacatattttcaaactaggcctcataaaaaacttatggggcaattactgatatgcatccctagagatgttggtgctgataccagatctttgcgctaatcatagacgctgaacacctcctaagagcaactttttttttcttccaaatactattgatttactgtcaaattttgaaaaaaatgacaaatcaatgtatcctaatttatttatgctagtttatttatatttgagaggaggatatgagtccctagctcctccctatctgtaaatttatgcacggacacatgattttttttctcaataggggctgggaacgagaaagagggaggaacctacatcctcatcctagattaagaatttgtaaataaaaataaattagtcggaatgaattagaatatattgatctatcaattttctaaaattaatagtaaaccaataggagaaaacctaaataaagaggcaacaccaaactaatttgcgtcaaacctagacactcgatgctggagtatttggtacagagacattgcgcttcgatgccaacgtccttgacgtcgaggtagaggtccatatctgcaacaaacttttcaggggtctaattgtaaatatattttttaaaacgagcaaagtttgttaggggcctatttgcaaaatatatttttttaaaatagctaaaatgtaaacaaaattgaacaaatcaaagacccacgccgcagcaaaagcgagcccctcgatgccgtcaaacgtcgtcatctatatttcaacacctactctcacgtgaagattaacgtctgatgtctacgtaaaaaaagttactacaatttcctgatatcgttcatattaagttgcatgtggtggtaaagtatttttgttagatgaaagaaaggatatgaacgattgaaaggaaaaggtactgtttctatttgtaatttggcaaatagatactttcataaattttgcgtgcttttctggattatattatatttatttatttattcagcttaagtcgtttcatttgatttggtttgcatgcataagtcaggtaccaaaaggtttagactcgagaggaaacaacctaataagctaaagaaaaaagaaagaagcaaacaaaattattttttgtgaaacttttatatccttgttattagcggtttaaagtttaagtctcaaaaatagacgatgataaaaaaaaaaacctaaaatcaactgtaaaattaagtttcaaacgtagaaaatttggctccgacttaatataacaagcaaacaattaatgccgatcttactgaaaaaccacatttgtataaggagagtgattacaatgctagaggtatatccttgtatatatccataccattacacttgtccagtcgtccagataatgtgattcacatatttcagcaatacaattaattctagtacttgtaaattaaccagatctagtcgaccgacaatggtcatatataaaacaaaaattgtaaaatactaaaaagctttcataaacctgtacagcagcagacggcaagcaaccagagaaatgtgatggcagaggatgaaaaaccatgtgaaatgtcccggaattttccccacctttatttatctatttatttagatcaaacttttgtatttctccaattatattattatgatattaagcaagcaagaaattcggacagtgtcgggtagctgagcaaaggtgccagtgtgctttgctttttaactctgcacctttctctttagcttctcctcgcaaatcgcaatccccatctctccttcgtctttagctcatctcttgattgatccacctcgttgttctttgattgattggtgctttctttgagaggcattggtggtggagatcgatcaagaatcgtggtttgcttgtgcttttctgagttctttgcaatggatggtggattgtagtttggtgttgcgaatcttgggtttgcagagcatgtcggagtcgagcagggcgttcggagtgaatgcgtcgtcgtcgtcgtccggcggcggcggcggcggcgaggcggtggctggaacgacggggaagaatggtggcggggggagcgtggcgttccaccggctgttcgcgttcgcggacggcacggacgcggcgctgatgctgctcgggacgctgggcgcggtggcgaacggcgccgcgctgccgttcatgaccgtgctgttcggcggcctcatcgacgccttcggcggcgccgcgggcggcgacgtcgtggcgcgcgtctccgaggtgtcgctccagttcatctacctcgccgtcgcctcggccgccgcgtcgttcatccgtaagtgcgccgcgccgcgccaccacttgactcgcaatctcgctcgcagcgacaagctcaccgtgatcgatcgtgttcttcatcagaggtggcgtgctggatgatcaccggcgagcggcaggcggcgcggatacggagtctgtacctgaggacgatactccggcaggaggtcgccttcttcgacaagcacaccaacaccggcgaggtggtgggcaggatgtccggcgacacggtgctgatccaggacgccatgggggagaaggtgggcaagttcgtccagctcctcgtcacgttcctgggcggcttcggcgtggcgttcgcgcaggggtggctcctcaccctcgtcatgctcgccaccatcccgccgctcgtcctctccggcgccgtcatgtccaatgtcgtcgccaggatggcgtcgctcggccaggccgcctacgccgacgcctccgtcgtcgtcgagcagaccatcggctccatcagaacagtaaaaacattccgtcgaacacctcagctaccatccatttctccgcgccgccatggccctgaacacccggctcaacacaggttgcgtcgttcaccggcgagaagcaggcggtggcgaagtacagtaggtcactgaagagagcgtacagctccggcgtcagggaggggctcgccgccggcgtgggcatgggcacggtgatggtgctcctcttctgtggctactcattggggatttggtacggtgccaagctgattctggagaagggatacaccggagctcaggtcatgaatgtcatcttcgccgtgctcaccggctcgctgtaagtttcgccgccccgcgagcttcttgatcaattcttcagaaagaatactaagtttgtagcaaatttaagagcatgaaagtttttagtattgaaacaaaatgaatatcatgaaagaagtatgattgacaaatagtcttgtcaaggatattaagagtatggaagtttttaggattgaaaaaaaaatgaatatcatgacaagtatgattgacaaatagtcttgtcagaaggataataagagtatgaaactttttaggattgaaaaaaaatatatcattagagaaagattcaggtagttatttggtgattgataaagtggggtcttactacacattgggataatttggattttgtggtgatttagacatgttaggcaaagaagctaagttagctgctgtgttgacagtgataagcacttgtgtttcgtgagcaacctgctaaaccaactgtgcacgtatggtctgttcatttgtagcagcagcaagctaagtgtgaatatccactttgtctttttggtgtcaacattgtaccaattcactgtcataaaagttgaattatctcattcaaccaaagtaatatatgcttttggatttacgccgattgtattttcatagtcttcttttattaaaaaaagatgcttcttctcatctccttttccttcagaaagaacctcatcagataattttagtgtttgagtttgcaatggtcactgaattttctactacagtctcattatgccaatcaacttttaccatgattacatatggtattttttttcaattaaactaacaggcataaactatttattacttcctgaagctgaaactttactattacattcactagagctctaggtcaggcatcaccaagcatgaaagcattcgcgggagggcaggctgcggcatacaagatgtttgagacaatcaacagggagccagagatcgatgcgtacagcgccacaggtaggaagctagatgacattcagggggatatcgagttcagaaacgtttacttttcgtacccgacaaggcccgatgagcaaatattcagagggttctcgcttgccatacagagtggaacaactgttgcattggttggacagagtgggagtggaaaatcaacagtcatcagcttaatcgagcggttttacgaccctcagctcggtgaagttctaattgatggagtgaatctcaaggagttgcagctaaggtggatcagaagtaaaattggccttgtgagccaggagccaatcttgtttgctgctagcattatagataacatagcttatggcagggataatgctacaaatcaggaaattagagctgcagctgagcttgctaatgcctccaaattcattgataaaatgccccaggtcagtggactgcttaaccccttgaacttgtaaatagtacatcaataactgcataaattgtgttgaaaactagaaatggctacatatagaagaattttagctattaagagaagcttgaactatatattctgtatcatatattgagcatctgtaggtcacaacatgtcacagggttttgctactttggttggtgaacatggaacacaattatctggtgggcagaagcaaagaattgccattgcagagcaattctgaaagatccaagg

SEQ ID NO: 62296 - DNA, 3626 bp, Oryza sativa
  unsure (1)..(3626): unsure at all n locations
caggaaaacagtcatgattctgaggatgcaaattaccagaacaagtcaggcaagaagagtgattctgggattcgctcgggcaaacaatcgttttcgtaccagtcgactcctcagagatcatctagggacaacagtaacaatcactcattctcagtatctgctactcctctagaaattgatgtccagggtggttcaccaaagaagatagctgaagaaacaccacaggaagtgcctctcagtcgcctcgcagcgcttaacaaaccagagatcccagtgcttctgcttggttctgttgcttctgctgtcagtggagttatcttcccaatctttgcgatacttttatccaatgtgatcaaagcattttatgagcccccacaagtgctaaagaaggatgctgagttttggtcatcgatgttcttagtgtttggggcagtgtacttcttgtcacttcctattggctcataccttttttcagtggctgggtgtaggttgatcagaaggatcagactgatgacttttgagaaggttgtaaatatggagattgaatggtttgatcatccagaaaactcaagtggatcaatcggagcaaggctatcggccgatgcagcaaaaattagggggcttgtgggtgatgcacttcaactggttgtgcagaatttagcaacattagttgctggtttgttgattgcttttatatcaaactgggagctatctctgatcatcttggcgttgataccactcatcggcgtcaacggatggatccagatgaagtttattcagggattcagtgcagatgcaaaggtaatcataaaaatgttgaaacaccaaattcttttgtttcagtcaatcttttagcaaatcttgtatcttcaaattcttttgccttggatactcaaatttagatagtttgtcaacactgcattgattctcaattattactgcagatgatgtatgaagaggcaagccaagtggcaaatgatgcagtgagcagcataaggacagtagcctcattttcagctgaagagaagtaatggatttgtacaagatgaaatgtgaaggaccactaagaacaggaatcaggacggcgataataagtggtatcggtttcggtgtttctatcttcctgctgtttggagtctatgcagccagcttctatgccggtgctcggcttgtcgaggacaggaaaacaacatttcctaacgttttcagggtatgtgcagtgttcactacaagatatttacagactcaaacttttaaactttttaggcacttgcatgtcaatatgctagttgaagatttgcacgtcaatatgctagttgaatatagatttttcaaaggggcattgagatttaaacttcaaggtggctagtttgttataaatgatgcaatgcttaggcttagttaaatataatttcaaagtgaaagatatcatatcttgggcatcttattgcaggtgtttcttgctctcacaatggcagcaattggggtgtcacacactagcaacctcacatcagattcttccaaggcaaaatcagctgtatcttctatattcgccatcgtagaccgtaaatctaggattgatccaagtgatgatgctggagtgagcttagaaccactaagaggcgatatcgagttccagcatgtgagcttcagatatcctacacgaccagatgttcagatcttttgtaacgactctgtcgctctaacacattcaactnnctgcgaaaggtacccaacacctccctttaatttgcagcactattagagcctattaacaacacactcataacaggtattctgaagactaaatcctaatggtttttattctggcagcactgttgcntcttgttcggagcagaggcggtagtcgggtaaatccgacagccgatatcacttgcttcagaggttctatgactccggatgcaggctcatatacttnctagtatggagtggacattcanaaagtttcagctaaggtggctaaggcaacagatgggtctagtgagtcaagaaccagctctgttcaatgacacgattcgcgcaaacatcgcgtatgggaaggaaggggatgcgacagaatcagacatcgtatcctccgcgcaattggcgaatgcgcacaagttcatcagctcattgcatcaggtgaaattcaaattgcccgtcccaaccagctcaccctcattcattcagacattgtgttcatgtttctgacagaaaatgtgttacctgaaaaaaatgcagggataatgaaaccatggtcggggagcgtggagctcagctatccggagggcagaagcaacgcatcgcgatcgcccgcgccattgtcaaggatcccaagatcctccttctcgatgaagccacgagtgcgctcgacgcagaatcggagcgcgtcgtccaagatgcgctggaccgggtgatgatgaacaggaccacggtgatcgtggcacaccggctgtccacaattcagggcgcagacatgatcgcggtggtgaagaacgggatgatcatcgagaaggggaagcatgatgcattgatcggcatcaaggatggagcttacgcctccctcgtcgccctccatgtttctgctgctgccatttcgtagcagatctagcagacgccatggatgaaaagatcatggtttgttgctgaatctgtgagaggagcaagagactggtgtaactgtagcttgtgcaggctccagctcttgtcatccagcagcagcagcagaagaagaaaaatttgatgaacacaaatatgtcatgtatacatagatagataagatcatacaaagatgtgcaaatgtaaatgcaacgagttgtatgaatgaatgttcatatgatatgaagcagatgatgatgatgatatggatattcattggcatagttgtgatgctttgttcttgttcttgcctccaaagtttccccccatataagaaaagaacctgatgattggatttaatctttttttgaaacctaatgattggatttaatcgagaaacaagaatcagctgagcaaagataatcttaagagggcaagccaatttgctaaagcaaacacaattttgtcaacagtgacttgagagtcactggataattaatcaatgatgaacctcctgtaagaaactgaagatgtaccaatttcattaggatgaagagataatcctaatgctgcagataaactcttccaaagcaatgaaaaaaacaacaggttcaacacttgacagtaatatatctttagttatcttcaattttttttttgtggaaaagaaaatctgaagttctgaattttcttactcccggtgcagggcagacacggtccacggaacgagcgacctcgacgaccagtcaaaccgccgcgtgctgctgacgtggcagtcatctcagccgtccaaactcgtctaccgccaaccaacagccaggatctctcccccccacgaccaccgcctcattggtccacataagccgcagcccaccgcccagccaaccacggcctgccacgtacgaacccaaggggcaaaaccgtaaattcctagcaacccagacgccgacgcgtcgactcgtcgcaacgcaacctgaggagggaaaaaaaagagaaaaagaaaaaaagaaaaggaataaaaataaaaa

SEQ ID NO: 62297 - DNA, 706 bp, Oryza sativa
gctgagattaacaatgcatattttgcttgaactttacttgggttgtaaaaattagacagatgattcgttttgtagtgtgacatttgtgtgagctaggagcttaggactagaattgaattgctgcaaatgttttaatgcaggaagccacagagctactgctggaggagttgaatcgaatgagggatgaggagggcgaactgaagaagaagatgaaggaggacaaggatgcaatgaaagcactcaagaagcagcagaaggaagcaatgaaggctgccacgacgatgaaatgcaatgatgatgactcctctgaatcaagtgaatcaagtgagagtgagtgtgaggagcagatgatgacaatgagctgcgttgccactgttaccatgccgcaaattggggaaggcgttgcgatctcaacgacagttccccaagttgctgcatccgatgtcgcaacagcaccagcaatggagtatgacaaggctgcaatgaaggccatgaagaagagagaaaaggaagagaagaaagccgcaaagatggctatgaagatgaagaagaaggaaaagaagatggccacattgactctctgcaaggatgaagacagcacctcatgctcctcagaatctagcgacagcgagtgcgaggaggttgtcagaatgagctgctgtgctacgataaccacaccacaaacacaaccctcgagcaccgtttt

SEQ ID NO: 62298 - DNA, 756 bp, Oryza sativa
ccggcctcgccggacgcccatgctccggcctcgccggagccgatgaacgccgcggcgagcgtggcggcgccggctagcgcctcgccgtggccagcgcgccgcagaggacggccacgccggacgcccacactccggcctcgccggagccgatgaacgccgcgcatctcctcctccagctcttgggtccagcagttcccggccatggcagtggctcgctggcccgcgcgctactactactgcttcttcttggtcggctgccaccatcgggcgggctcgacgaccttggggaacttgtcgagcatggcggggaggagaggcagcgggtaggcggcatcgagcgcgagcacccggtccatggcgtccagggagatgaggacggagcgggagcgacaaggtctagggagaaggagaagaagaagagggcgacgacgccgccgccgccgccgtccgccggccgccgtcgcggcgccgccgctcagcaccgctcgccgcccagccgtctcggtctgctccctacccatcggcccggcctgcgcgagagagagagagagtagagagggaaggaagagagagaagaggggaaagagagatgacgtgtacacctggcatgtggggcccacgtgggtcccacgctgattcagctgccacgtagactaaaaccggggtcaaaaccaccaagggaccttgggtgaccggttttatatagttggaggaccccgagtgtctgtggtattacggttcaaggacgttttttat

SEQ ID NO: 62299 - DNA, 25699 bp, Oryza sativa
  unsure (1)..(25699): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacactttgcgcatcattatttcttgcacagtacagtcgaaaagaagcttgtgcaagctgaaatgcatcccatgtatggctgcaggagctacataaaggaacactcgattattggatgaaaaaacaaaactaaatgggacttacgatacatacaacaaagacatgatgaatatgatacctctgaacaactgatatcaaggcttggcgaaaatgagatgctgcatacgatgaaaatgaatttctccaatataatacatatggaatcccctgggaatgaaagtgtcaaaaacacaaattccaaaatcacaaataagattctgaagtaataggagagtaggaattgttgttgaaagaaaaaagctcagtaaaactgcaaaaaaaatttgtaaatgttagcaatcatcttgccgaaaaatgaatagcaattgctcatcttacaagcatataatgatataaacattccaacaatagaacaacacctatgctagacaaaataaactaaacaaatgcagtttgagtatagtaattgtttatggaaactaagctcatgctacacatcagagcaattttttttttaaaaaaaagtatgaggaatcatttggatatttacaagtatatatgcatcccaacaagcagattcacaactgtggcaaaaagacatatggaacaatccacaacctgttcacaaatttttttaaaaaaaactaattgaaaatatcacaaaacaaactacctttaactgaagagattgagcaagcttttccccagcaggaacttccaaataaacctgtataaaagcttagacagtaagataaatagatagaaggaagacgaccatggaaaaattggaaaagaaaaccgtttatgaaacaaaacagaaaaacaaggagcataaggttttaaaaaataaaatgttagtagctacaagtcagacaaatataagtggaatatgtaaatcaagttatgggcattaaaaaaacaaaatattggaatatcagttttaagaaccaagttggagctgttgtgttgcgtttgtgttgtgattacatgtttaagctgttgacggaatacgattgttaaattaattgtggagtgtttgaggaatcaaactgaggttagataaatcctactccctccaggttgataatacttgtcgttttggacaaggctattgtcaaactttaaaaactttgactataaataacatctaaaatatttgtcttagaagtatggtgaccatatatatagactgatcttaaaaagtacttcaataaaatcatatatttattgatatttctatatatatatatatatagtaataaaaaatagtggtcaaagttgtttttaaagaccgtgcccttgtccaaagcgacaagtattatcagtccaaagagagtattatacaacttctgattcatccacatttgttcatttttttgcctcttaagtacgtgaccaagcattgcttttgcctcttaagcatgccagcaccagtattgacatgcatctcaacagttaatgcaaggtattagaggaaaagaacccataaaaagtgtttcgggaaatatgtgtgtcccacaaattcttatagaagccctaagaaaattgcccaacattttctacggagggagtataaatgtctgtcacataaataaaatcgaacagcacaatgaaacggaagcttatggtagtatcagttatcatttaattgaaagctaagagcgctgaccaacattgttgctagctaagagtttggtgcttactatggtcggaaaaggtggactaatgagtgaactaaatatctgtggatcagatacatcagcatcgccccagacaagtgtaccaatttcttcctcattctcaagctgctgaccctggaggtacatcaagttgggctgcacagcctgttgcgctttccggaattgatcaactgtgggattgatcagcgtatgcacctgcatcccgagccggttcataacacaacaaaagaaatgcatcaccacagtaaacagcaaaagcctactaacctccaatctcccagacgagatcagctctgggaatggatatgaaagccgtggtcgcttcacctcgggcaccagaccaggtggcttctgctgtttgtctgtaaccttcccacatagcaccgcaagcagcgtgcagttcaccagtgagctgctttggatttgagccatggctgaaccggtaaaatcacatctccccaattcagctcactccaccattgaaccctgcaacaccactagcaacagcaaatcattcatgaaactgagatcacccgaaccagtgcgtggatcaaaaagcaaactgaacagcttaagagattgactgaaaggttaaatatttcgggtgactgagaactagcaattcctggtcgtctagttttcagtcacctgaaaatttaaaatgtgtcagtcacatttgcaacctttggatctgcacatccaatgatagcagtttgtccatgctatgttgaatcaaacaaaatggttacaattccaagtgggcccattacaaaataataaaaaaaaagaacagtttggtaagtagtttggtcttttgcttgtgtccagaggattggcttcctcgttctgtgggctttaaacaccggcttaatgtgtcaggaacatttccgctcttccggcgagatttaattgctgctagtttagcccaggaagaaagaatatatttgtgtaacacttttggttgttactccttcatacttctttcctaaaactgtatgggtaaatctgtgctagctgaacaaacattactttactgtgatagattgccaatcgcaaaatataacatgtgtatgtaattttcaatttacaactccaataccaccgtaaaatttgatacaagaaaaattaacatgcttctgcattcgacaaatgcaaactggaaccatctacaagagaagaatgaacatccaacagtacaataattgcattagcctgcagtggaaatagcactataatgtgcaattcaaaaatatcaacacaatgtgcaattttgaattgattatctttatttaccagggcataaaaaaatttcttttacctatggtttccctaataactgcatttggtttattttaaaattgcacaaacatataaactgcaagacataacgatgagcacttcgcgaagcatacaaactacaaatcgcaatcaactaactgacacctgaaccaaaatcgattcacatacaggcctcaccaacatactgcatggcacaatgggacaagtaaagatgttcatgaagctgagatcactaaaccagtgcacggaccaaaaagcaaaccgaacagcttaaaaaaatgactgaaaaaattgaatatttcaggtgactgaaaactgcaactcccttcacgaaatttccagccaaaatcagaacaaacaagcaccaaatcgaaccaagcgaaccgaaccgaatcgaatcgagcaaccataccaggagacccaaatcgacgagcgcagcccaaaaccccgcgactccgagccgctatgacaccggcggcaggatgcgctcgatttgtgcggcgacggctagggcaaaagcgtggaggcgagagagcatggaaccctaatttagccgccgcacaaatccccctcttcgaatcattaataatacagacagaacgagaggggaataaacgcgtggtgaatcgcacgcgagccgacccccatcccgtcaaaatcaaatccagtcaaccactccggaaaaaaagaatctatctgtctaaccaaaaaaaaggaaaaccactggaattttaacctaaatccaccaaccctcctccccgtcttaatccctccgcggattagcaatgcaaacccctcaaataataaataaccgagcaagtagcaatctccaggaaatattttgattggccgggacgaaccgctcgagccactggagatcgtagtcgtaccgtgcacggaagcggaatccacagctcctgcttgatccctcctgcgcttcctgttcccctcgtggcgaggatgatgatgatgatgatgacggcgacgacgaccgcggcgatgattcatttacctgcggagaggaataaaaacaaagagcacggattaaattagctttttttcttttcgcagcgggatcgcgaggaaaagttgggaggaaattatacgaattctttttctgcggtttttttttcctcttccttctctctgattctctgctgctgcacgagtgctttttagattttttttggccacagcacagcctagttgcgatcgtatgttgttttggcgatttgggtttggttggttccggtggtgatcggaggaaggaatttgggtggggggaatcggggagcgtgcgacgcgacgccatgtggattgatgtggtgagattggtgcgtggagttcgtgctggttcgtcggcctctggataccgggggaagggtcagggcctcaggggacgggctgtccctgacttgtgagcccacagggctttgggagaataaaagcgagtaggctgtcctaaaataagtgcaatgacaagtattcataagtgcaatgacaaatattcgtatccaaagtttgactatcggtcttgtttaaaaaatttatgaaaaaaattaaaaaaaatagtttttatcatctaatgacaaaaaaatattaatcataaaaaaatttaaataagacaaatagtaaatgttgttaatgttgatcataaaaaaacttttaataagataaataataaacgttggatatgaacgtataaaactgtacttgtttttgagatggaaatctcaaaagagtattactatagggagattttttttttggaaaacagtggcgggaatatccccacggtagattttcatttcataaataaaagcataataaaaaatttggggagattatttgctatgtacaccctctgattcttttttacgatggcgtcatagattaaggatgtaggtagtacattgatttgattatattactttcttactcaaagttgtacgtacgatgtaatattgatgtgattcaacgagttcctgtctaatagagaaaaataagagatattcccttctcccaaaatatattcactccgttctaaaatagattatctaaaatataataatctaggggcctcatcggatggctgtttgggccaaggcttttcagccaaagcccatcgtctcacttattgggctgagagctttcagccaaatataggtagggcccgcaaggatgttggagcatacaatactcatcaatccatttaagccaaataagccaatcaatggattttctttagctgaattgaagaagccaactttggcttatcagccaaagcttttggcttaccgatgaggacatagaataataatccctccatttacttttgatagtcatatttttatcttggcacatagaccaaggataagtaattttacttatcatccatttaaacatgctactagtcatttctcgtaaacaagcgattcattaatatttacatttctcaaggcccatgtagccaatcatgtgtggaagaatagagagtcacgcattaaatccgagaaaatcattaagaggataggttgttggattgaaatatgactatcaaaaataaaatttttagatttggaaatatgactatcaaaagtagatggagggagtattagacacaaccttgtaagttagtactactagaaaagatgctcgtgcgttgcaacgggtagaaccaatttaatttgtaaatagtgtcggtggataaataatcacaacccattgtttcgtttattcatgtgtttatccggatgacttgttaccaaataaaatactatttgtgagaaaatcttttatatacatgttcttaactactcaaaagcaaatgttgtaaaataaagtacgataaaaaaccaaaaagtcgaattcaaaattaagttctaaaatttaaaatttgacttataggaataagcataacccaaacaatgagaccttcaaacacgagctcgatttgtcgtcaggttctatatcaagtcgggcagaaattgataactgacgaaatcatcaacttcgatcatcctttatttcagttggcatgatctttttgaaagtaaaactgattcttatggattgttgttatggtatccctggtagtacgtacgagcatgtgtgaagactgatttgacatcatgctaacatgtcccatgaatcgtatcgtgaaatacgaatagaatcgaatgatttgggcaacaacgtacgtgatatccacactgactgtgaattttcattcgcttggtatccacatcacacggactctctttcatagttcgctcgcgagtcgtgacttcgcaatgcatgttacgcatgacgggaattgcatacggacgacgtaccatagttttgataaaaacatcttcaattttaaaatcgtgggcgagtgcaacaaagtcctagtcggacatgtggcaagggcaaatcacgtgcgcgaggcgttgcgagcccaatcacggtggggcacaaaggcgcgggtagaaaacggacttaggtgcgagcccaatcgctacgtgcgacaaggggcgcgtgaaaagatgcatgcccaattaattcgcctgcgtcttgataagagggacactctggcataagaaaaaaaatgaaatgatttgacagaaaaaaattaaaaccgatttaaacacggatgatgtaccaaaattctagcaaaaatattttaaatttttataatagtagagataaatatgtactatgttgtatcaaatccagtggttgctatatctttggacgaaaggagtaagaaatatagtcactaaaaaaatcataaaagaaacacatgctacaagatattactaaaatatctagaagaatacaatacaaatggtggaatctagataatatgagacgaagtgctaattatatggagggtaattctctttgtcatatgaagatctcgagactcgagagccaaatctggctggttttctatatatatgttcttgtagcatcatatgtcaaattaatatgatgtcctcaattgtattgttttcactcaagaataatacagtaaacttgagggtaaaaaagaaacacctacttgaaaatatcataaaacatattattttagagatgaatcaagagatgtaaaatccattttttttctttttaaatccatatggatttctagtaggcatgtctgttgaaggagtttttaaggaggaataggagttagaacttaagatggacaaggctattaactactttgttcagttaggggacatgaaagtaaggtgggaatggagatttaatcacattgtctattgtatcgtgatgtttgcttgctatcaagccatggcacctggcagggtggtaaactgttaagtgataccaccaacaatcaccaattagcctgtctaaattctcatctagataccccaaatatcatagttaagtgttagggcctgtttggtacagctccaactcctaaatataactccaggagttgagtctggagtggagttgtggagctgcctaaatccagctccacaactctagtatattttgtgagagagctccacccaactccactcccagttctggtggagctgaaactatttggctgagctccagctccagaaggggtggagctggagctggagctgtgccaaacaggcccttaacttgtagatggtgtactggtgtatcattttattgctttttcctaagtaaaccattcacagtatcattgtacacagaaatctgagttctacgcaataaaatatccctagtggcttggttatacatcctcaatgaaaagtgcctatataggcatacaggtgcttaaggagagaaaataaatgacaaaaatcatcaagtatctcgtattagattggtatcctaagatgcaagtaatttgatgggtgctccaattgcttccaatttgatacatgtaggaaagtcattatttaggtctagtatcgcctccgacgaagagttgaatgcctacgccaaacatctcgctaatccgacatggcaaataaccagtttagtttcataagcacctttctaagcatttgtgttgggatgacctatgcgctcccctcctggttccaccacctctttctcttcccaattcctgctccaaaattatcccatgaggcgggacactaatttctcaaattactatattctctatattatgtatggattggataaattataccggttcttctcttgcataattctgattccattccatcttagtagtaaattcaccataatttagcccctgctgatctcatccttcgatgatacttttactaccattaatagttatttttactctattttgctaagataatggtaatagtaattcagtaattcttttcaccattaggatgtcattgagtgatttcttttccattatgatcgcacaacataaagtaaatgaattgcacatgtaatctaaaacaaataaaaggaatacattttggaccagagtacagctacgattgacgccgccaccaccatcctcctcttcgcctatcctccatgttgctgcatggagcgccagaaggactctctggagacgaatccgtcggcatagatgttcaactactgcatcctccaaatctagctggcgtagaggacgatgttgacaatagattggccagccaatgccatagcctctagatttggtcgacacgcatatacgattcagaggatgaggctcgatgctggtgtcgcacttcaccatcgcatgcgcccaataaagccatgctactcaatttcgatctgaaaaaataaaaatggtggattggtacatgaggatattgcagattgcaataaatacatatattatgcgaacaagataacttaaaacataccctatttgagggtaggagcgttggggttgactacttagatgtaggagggacacaccaagcattgctcggggtatgaggcatgacatagttctgatttaaactaatacctttcttctaatatagtacatcattcaatagaatacttaacaataagacttgatggtatcaagcattgtgaaagatttcaataaagcataagaaactagatgaatcccacattataatctttatgggctatgtacattgttgatgcccttacatatcatgttttatttatttatttattttcagagtggtgatgaagagtcaccaccaccaccaataacatgtgggccatgatgtcaaagtactttgctagctttttttttcttacttgtgtgtagtagttttgtagtccctaaccgctcttgctctgatagactaattttgttttaaccaaggaaaaactgattttttaacaagtacataatatttctttaactatttaaaatagtttgttgtaacgcacaggtatttagctagtattgtatataaaaaatagttgacaatgatcttcccaaaattttgcaggtttggcttctgagttctgctacggatgtggagggcaatcggccgtcattaatcgtagttgcagcacagcgtaagatcgttttctattcaatctagtatttgttttgaacgcataaatttctcatagaatttacggaaactttcagtttaaataatcctactgcccataacagattttctacgatctgatgatgccgtcgtagtactagcaggagagtagttatctgttacaggattctcaacatttcgattctaatcagttggactaccgttgacaagctgtagagaactgaatgaagcaaccataaaaaaaaaacatgttaagcgatttagaagcctaggctagaaaatacactacaatgaaacaaaaaaaaaatctaaaatcaagtttcaagattcaaattttggccgctgttaataaaccaacaaccgtacaatgagattcacacaaaaaaacaagacatgttcatcaaaactataagtttggattagctcaacatagaaccttgcccttgctatgacggtgcaagtgagctgcccattctctcaacattcagcatcgacaccacctttgcacaactacaaattgccattgcccttgtatccttcacctagctgaaaagaacgtgaaaaataataggttaatccctttcataagatgtttctagtccactccaactccgtttgcattaagaattacctggttttgacaccatatttcccttcactctgtccttcgcaagggatgcagaccatcttggcggatggtgatatagaccatttgcaatagcttcatcttcatcttggtttgtgcaaaagaaaagaagccgatccacatcttgtctatcgaacgaagatactggagtgccatttacagaagcaattccaagtggaaccaggcttttgtaagacgtttcttgagcaagatatttcaaaacctacacagttcaaacgaatcttcagtcagtgatgaacaagggtataaaacatgatatgttttagtttcgtagtggataaattgtcagtatatcacacatattaccaagctgtctagtcagtgtcatttaaacttttctgagaaaattaacctgtgctgcccacttaggtaaggtcatcaagacttcaaaagtggaagctccagaagccacggacattgaagtcaaaggctcggctgaagatggtctatcatcctcgctaactgagacaacacgaactaaccggcggctctcaataagttctttcttaatatgcttctccaaaagctacagaaaaagcgaatggcactgcaaatatcagaccgaagactaaaaaaatgctccataaatacaaaaccataccttgtcatcaaaacaggtttgcggactgccagaatgaagcagtgacacgtgtgaagaactggatgttgtgatatcacaacatattgtaaccaccccgtctaatagagttgaatcaacatgaagaggaggagcagcactgcaaagagaaatgttgtgagcagaaacaagctaaaagttttatagcaatcatgcaagcaacgatgcagaactgcaaataagaataagaagcacaacttaaaaaatgattacaaaaagatacatgttaaatattctattacaatgtagtttacattttacaagacataccaataaaagcatttagtttgttaccataaagttttgtctttagcctatagggaaatgttacctcagttaacctttaaattatagcagcaaaatataagttagctcatttgatatatcatcagtttgagctttaaatatttctgtggcatagaaaattacgatatgattactgaagcaaggacacagacacaaacataactcacacgtgagcaacaatgtttaagatacaacaggttgcaagatattgaatatgtattatacagcagttgaagatacctgactctatcctggagtttgcaccatcgaaactgaaaaaaggagagaagaaaataaaaacattaaaaaggtcctaccaacaattttgctacttgcatcatttttctcgtgcggtttactagacaaaaatgaacagagactagcagtatgtgccatattatcttgttcctaaattcatggtacataaaatggtgctagcaaaatatgagtgtattgcaacaatcaacaaatatacaagttccaattttaaaatttttatatatttcatgaaaaaaacatatacatttgcaatcccacatcaaccatcagaaaaataaatctacaaattagaagatcccaccaaccaaaagagggggtggtgggatggcagacccaccagtcaccaccactactactaagttcttggatgtgggtatgctgcacagtctaaaatgaaaatttacaactcagaaagtgagactatgagcaatctacatcaagcttcactccataaccatgcaagcatggactatggaacctagacccaccagctcgtataagctgcttacaagtagcaatactgactggtggccactagcacattacttaggatgcagcagtatttatgatttgtaagttagcatcacatacttcattactccaataacctagcatttcgacaaaataggtctctggggtaatactctattcagaactcagcactaattagacgtagaaaataaaaagcagcaacatatggtaactagaaaaaggattgacacatacttcaatattgagaagagcattcaaaccatcctctagtgagttcaatatagatgaatcctgtaaaagagatggaagtacaatcattgatttggaataagaaaaattgccatattttagaagaaaaatctcggcatgatcgcttttacttataggggtgcaatgtgctccacaaataagaagctttaagtgcacatcttcatcgtatatctttatgtctggaaaatattcggaggtatcttcttcctcagccattttgtttccaggaggggtgatatatatccttggagcatccccaagtagatgaggcccaagcatgagacgttgcacctcattatttcttacgcagtattgttcaaacgaagtatatgcaagctgaaatgcatcccatgcatggctgcatgagctacaaacaggaatacacaattattggataaatacacaaaacttaatggcttgaaatatattcaacaaatgcaagatggacatgagatacctcggaacaactgacatcaaggaatggcgaaaatgagatgctgcaaacgatgataatgaatatctccaatacattatatatgaaatcccctagcaatgaaagagtgtgaaaattacaaatatgaaattagaaataagattccaaagtaataacagagcacgaattgttgttttttttttgggggggggggagagggggtggggagcttagtaaaattgccagaaaatataaattagtaatcagcatgtgggaaaatggacagtactgcagatattaaaagcacagaattatataaaaaatccatcaatagaacctcactatgccagtcaaaacaagttaaacaaatgcagtttagtaattgttttgtggaaactaagctctataatactctacaagaaaatgatatttttaacaataaatggggacatttggatattgcatccacaaagcagattcccacctatgtggcaaaatgagatttgcagcaataaacaatctacaagctcaaatgtaaataagaaacagctacttgaaaatatcagaaaacagactaccttcgattgaagagattgagcaatcttttctccacttggaacttccaaataaacctgtattagagcttaaaaggtaagataagtagctacaaggaagaagactaaggaaaaattggaaagaacaacttttattaaactaaacaggaaaatgggcagaggaagctgaagaagaaatttaattgttagtagctacaagtcagaaaaatatacctggaatatataaacaagcttccaagggttaaaaaacaaaaattaaaatatgtaattttaagggccaatctgttaatctctaaattggcccttaaatcacaataaacctcagtaacaaagggagcctagatgcatgcaattatgaactactacctctgcagaactatataaggcatatattttcatcgcattaaaccatgatatccaattagataacctaaatgcccatatttatagctccataagagtattaatgctatcgctgcctggctctaatcccagctgcatgcatgcatgaattaatcatactattgatcactcaaataaaagatcaataccgtatgctaagagtggtgataactactttagcaagcgctctagcacccaaattatacaaattggcaaacttcatcagcaaacactaataactaaagtggatcagtaaaccaaacatgtaagggagcatatagatataactataaactgcagcgctaaaagaagcatagtccaggtgctatgggagctgaagcgccaagcagccaaacatcactacccaaaaatcggcgctaggcgcctgttagccacctgcgattatgcattacatggtgtattaggcggctaaccatcctttggtgctcttatgctgctattttagtgttgtattgtgtaatttttatgtaatatgcttgctaatttcctaggcaccagctctgcagaccctctagggctcttgtattgtctatcatttgccggtttaagttagacatgataatatgatgtagtacatagaaaaccagcatagtttggtgcttactatggtaggaaaaggcggacaaatgagtgaagaaaatatctgtggatccgatacatcagcatcgccccagacaagtctaccaatttcttcctccttgtcaagctgctgaccctggaagtacatgaagcggggctgcaaagcacgttgtgcctccagaaattgatcaaccgtaggattgatcagcgtgtgcacctgcatgccaacttttcaagttcagaactgaaacaaaatatgtacttaagagcaagtttaatagtagagctaactactagctataagccaatctaaaagtagcattagagctcacatgtctaataaattggttataaggttgcctctaaatttcttctctcactttctctcatttatataattaattcatttatcttagagcatatgtatagctagcttttgcataagagctcaaacttattattttcctggttatctcaggggcatatccatcgctggggctggggggcttgtcggggctcaatccccagctctagctgccgaacctatcagccactacaagctgcaacgcagtactgagagccaataagaatggcgaaaacttaaaaacctgcgagcattaattggccagattgcttgttagcttgttaatcctatcacataatagatgagcagattctgagattttacctcatgtgccaactagtcaacgtggagaattccagtttattaattttggtttttttaatgttccaaaaactataaagtcatagataatttgggaatttggttatacggttaaactattgacttggccatgggctgcaccaacaattttgaattataatttggttagacaatgcatgttttctttgttttatttataaattaattaactgagttagaaaatgacaggcatatgcatatttacttggctgctaaaataatttacatgtatatgagcacaccctcgattttcattcaagattcgccactgggttatatctcctccacataggtttatcttgaaataccaaaaattttagtgcaaaattagtatctcgacactcccagtacttcttaaggatggtaaaataactctatgagttttgtcttttgcactggtttccaacaagaagcaggcttcaagagtgtactgcacatttttcggtttcaaggtagtgccatggtttcatatacttatccaagtacaattccaggtcaaggaaagctccttacctaatctgttatctgatcaactgatagagcaatgaaccagatggatttgttcttgcaagatgcttgttaggcagagaagggaactagcttactaagctagaaaacgtactatatctatgcttgctttgaagtggaacagcaggctgtcacagctgatggtattcagtgtgacgcgccacagtagtcgtgatggacagctatagtagcgtgccaggaatagagtgaaatgggcctgcgcgctcacatgagttgtgttgggttgttgggcctgcgagctcatgctgttgcttagctgtaaggtctataagacaagggaccactcggtggggaagacatcatgaatgaaaaggaagaaaactaatcctcccccaaactttctctgttctctcctctgttcttcctatccccttctgttcttcccaaaatccccatctatttctgaaatcatcgctgcgaatattacagtggtatcagattcaggtcgttcgtggtcgatttaggctcatattctctcgatccggctggtaaaattcctatgctcaggtaggcggctacccttgggtgcggctgctgtaaatccggttctggttcggctggatttggaggagtctttcaccacggcgccgatcaaactctccgctcccttgcgccaatctctcgacgccatggaggctaagcttctcgagaagctggactccctcacgctgtgtatggaggctttggacgacaagttaaccaagcagagcggccgaattgatcaagtcgctaccaaggtggatctcgccatggatgctgtggccgctttgcagaaggagcaagtgcaggcggcgcagctgcacaagcaagccatggcttcagaaccggtgagtattttgggttccccgtcttctctatcagtggcaagtctgggcacaacaacaccaccaccaccaccacctcctcctcctccaccgctggttttttctaagtcaatatctcgttgggggaatggtgaatctagtgcgggttgtgatggggggttgcgcgctaagagttgtcttccgaagatggattttccacgttttgatggggctgatgtgagagtctggattgatatgtgtgagacattttgagatgtaccagattcctcctgtatttcaagtttcagcagctgttcttcacatgtcggggaatgctgcccagtggtatcaatcgtttaagctcgtggaggaagttgctaattggtctcagtttcgacatgctgttgtttgtgagtttgagagcacctcgcaacgtgagaagattcaggctctgcaaactttaagacaggcaggttctgtggctgaatataagcatcaatttgattctcttgtctatcagatccgtgtatttgatccatcagtgggaggtttgatgctggtgtatcgtttttatgttggggcttaaggaggacattcgtgcagcagtgatggttcagttgcctaccacagttcagcaagctgctgctgtggcattgatgcaagagagtgttctacttgaattgagtactaagcaatctaagcgattgatgtataaaccattgcctaccaaaggggagttgcctcagggtggtactgatactcctgctattaagcctgaacgagcagaactatggaaggctcgacagttaagggattatcgaagagccaatggtctttgtttcaaatgtggggataaatattctcctgagcaccagtgtgcgctgggtggtcagattaaagctatgcaagttactgaagtgattccggatgatcttttgaatgcagtgactgctgaagaagactctgaccaggatgagaattgtcatatttcactcaattccctgtctggtgctagtcatgtgaacactatcagactccgagctttggtccagaataaggtgttgctcttactggtcgactctggcagttctcatagtttcttggactataactttgctcaactcttgggattgcagttgcagcccattgctccctccctggttaaagtagctaatggtgattgtatacactgtcagtttatggttcctcagtttacttggtggtttcaagggcgtactttcacttatgatatgagagttgttcctttgggtggacatgatgctattttggggatggactggttggcacagtggggtgatatgtcttgcaattgggccaacaaaactttgaagtttatgtatcagggtacttgggttgaacttcagggagtccctgattctcctccccaaactgagttgagtgctatgtctttgtctcaggttcttaagtgtcaaaaagggtgtgatatatgggcagctgcactgctggaaacagctgacttcccttctgctgattcagttccacctgctgtttctcagttagtgcatgagtttgctgatgtttttcaagatccacacagtttaccacctcacagagtttatgatcacgctattactcttttccctggttcagctcctgtgaatagcaaaccttatcggtattctcctttgcaaaaagatgagattgaaagtcaggtcaaggacatgattgattctgggttgatcactcccagtatgagcccttttgcttctcctgttttattggttaaaaagaaggatggcacgtggcgtttttgtgtggattatcgcaaactcaactctattactgtgaaaagtaagtttcctatgcctattgttgatgaattgcttgatgagcttgctggtactcgtttcttctctaaacttgacttgaaagctggctatcatcaaatatggatggtggaggatgatgaatataaaactgcttttaaaacacaccatggtcaatttcaattccatgtgatgccgtttgggttgaccaatgccccttctacttttcaatgtgtgatgaattcagtgtttgcacccttaatcaggaagtatgttttggtgtttatggatgatattctagtgtacagtcctgatttaccgtctcatctcacacacttgaaacaagtttttgaactgctgagacaacacaagttatatgccaaaaggtccaagtgttcttttgcctgttctcaattggagtatttgggacacataatttcagatcaaggagtcagtactgatcctactaagactgcagctatgttggcttggccagtccctgccaatgtgacagaactcagagggtttttggggcttacagggtattatagaaagtttgttaaaaattatagtatcctggcaaaacctttaactgtcttactacagaagaaagcgttccagtggtctgatgatgctcagcaggcttttcagaagctgaaacttgctatgagttcaactcctgtactggctttgcccgatttctcccaaccttttattttggaaactgatgcttgtgcgtttggagtgggagctgtcctcagtcagcataatcatcctattgcatattatagcaagacattgggagtggctaatcagaagctttctatatatgaaaaagagttcctggtgattatgatggctgtggataagtggcgttgttatttgtaacgatgcccttttatcattcgcactgatcacaaaagtctttgtcatctcaatatcaggttctggggactgatttacagcaaaaggcaatgactaaattgatggggttacaatatactttccagtataagaaaggagtggagaacgtggtagctgatgctttgtctcgagtgcctcctcagtctcacttatctgctctgtcagtggctagccccatttggttgcaggaagtgttaaactcgtatgctgtggatactcaggctcagaagttattggtagaattggcagtccattctcctaatgatcagggttattctttgactgatggtctcattcgtcatcatggtcgcatttggataggagctaatctgggtttgcagactaagttaatcactgcttttcattcctctccaattggtggtcactcgggcactatggccacttatcaccggctcaaaaagttgttctcttgggttggtctgaaaactgcagtattcaactttgttaaacagtgtcaaatctgccaacaagctaaacatgagcattgtcgattgcctgggttgttagttcctttaccagtaccgaaagaagcttggatcgacatctcgatggattttattgaaggtttgcccaaatctgatggttacactgttatacttgttgtggtggatcgtttcactaaatttgctagtttcattcctttgagacacccttatactgcttcacaagtagcggtcacagtggataaatttgtgtttaagacccatggcttaccacagtcaattgtgtcggatcatgacaaagtgttcactagtcgtttttggggtgatttgtttaaagtatggaacactcaattgaacatgagtacggcatatcatcctcaaaccgacgggcaaaccgaaagagtgaatcagtgtctcgagatgtatttgaggtgcatgattcaagctactcccaccaaatggaacagttggctgcatttggctgagtactggtataatacatcttttcatacatctttgggttgttcccctcacaaagctttgtttggagtggaacctcatatcagtcaagtgccggtgctgctgtcctcagttcatcattctgtggtggacttaatttctgaacgcaatcagttgtctgtctttttacagcaacagttacaacgagcacaattgcgtatgaagcataaggctgataaagggcgatctgagcgttccttttctgttggtgatcatgtctttcttcgcttgcaaccttatgctcagtcttcggtggtgaatcgcccatatcccaaactggcattcaagttctttggaccatttcaaatcttggagaaagttgggtcggcagcttatcgtctggctttacctgaaggcagtgcggtccatcctgtgtttcatgtgtctcaactcaaagctcatgtgccagatcacactccagtgtttacttctctacccacaccggttgtactggatgctgccgatgtgtggcctgaactgattctggacaggcgtctggtaaaaaaggggaatgcagctcatgttcaggtgcttatcaagtggtcatctctgtctgctgatgatgccacctgggaggattatgatgtgttgaagacacgattcccttctgcgccagcttggggacaagctgcatctttggcgggcggtactgtcacagctgatggtattcagtgcgacgcgccacagtagtcgtgatggacagctacagtagcgttccaggaatagagtgaaatgggcctgcgcgctcacatgagttatgttgggttgttgggcctgcgagctcatgctgttgcttagctgtaaggtctataagacaagggaccactcggtggggaagacatcatgaatgaaaaggaagaaaactaatcctcccccaaactttctctgttatctcctctgttcttcctctgttcttcctatccccttctgttcttcccaaaatccccatctatttctgaaatcatcgctgcgaatattacacaggctaatatggaaccacaagagagcaaatggaaagtaggtttagattttaggggttttgacaacaaagtgagccacttaatttaatacacaactgtaaaagtgtaaagatctgtttgcaacatgatttatattcatccttccatctgtgctaacaagatttggctcgatcaattggctattggggtaatattgcgaaatggattgctttgctggccatgaataggatagttgaaacttgcaagagtgatttctttagttaatcaaggcacacatgcatgtttacgagtttctataagtaatattatatgatagatgatattaacctgtgctgcgatcctattttaacttcattagccatgtgtgggttgtcgtcatgtgtataaaacacttttggtattattttaggccgaattaataaaactgaagtgaaacgagtatttgcctgcgcgcggcgtgtcgccgcctgggcacgtctattaagtataagtgagtggtgacaccagtgccccaacatcctcgatctgccccttagcctactactacctccgtctcagaaagactgcagttttgcactatttatatctactgtttgattgtccgtcttatttaaaaaatttttatgattagtatttttgttgttattagatgataaaacatgaatattactttatatgtgactattttttatgttttttaaaataagacggacagtcaaatattggacatgaaaatttcataactgcacttaaaataaaataaaataaaataaaataagatggagataatattaaacttgctctaaaaaaaataaatagcaaaaggatacttacgtccaacctcccggatgagatcaactccgggaatgggaatgacggccgcggccgctgggactcgggcactggatcaggtggcatccgctgcttgcctaccttaccgcacagcactgcgagcatcgtgcacttcacccttgagccgctcgggaaatgaggcatggttgaacaaagaacaccacagatccgcaaccgctgaaccctgcaaaggcctgccacaccaagcacaacaacagatcaaacctccacaaaaacatgtcaacccaaaactaacaagaactaaaacgaaaagagaaaatcaaacaacacaccagatctggatctagcaaatcgaacctctaacacaagcccgaaatcaatcgactaccacaacacgaaaccggggacttccgagacgctaggacgccggcggaggtgcaaggcgcgctcgatttggtggcggcggcggcggcggcggcggaggaggaggaaggggtagagctgggttgtgaggggcaacaatgctatgaaccctagcacaatcctctcttcgagcatttaatagagccaaaaatgagggggaaacgccaatcaatccccagaagcaagcaaaaaaggcaagatcgtaacggcaaaaaaaaaaatgattgccgggagggacgaacccgctccagccagtggagatcgaacggcgcacggaagcggccgggtatctcctcaactcctcacattgctacggctgctgatgctaatgccgtcgcggtggagatatccctagcacgtttccccttctcgcggtcgcgtccacgacgagatggtgatgacgacgacgacgattcatagcttgcggagagaaaaacaaaaacaaaagagtaaattaaacaaggtgacgaattaatttagcattttcgcagcgaaattgcaaggagaagtggagagaacaaaaatgcatacgaatatgttccgtgtttttttctgggcgcgtacctcagctttgattatctgctgctgctgcttttggggtttttcggccgcatccacctcgagagcaatacgcgatcggatgcgtcgctgaggtgagaaattggacattcggtcactaatgccattacgtggaatggcgtcgttaaaatatcacttccaaccgataccaaacatttattttgccatttcagccatttcataaaattttcaccatttttcacacttcaactgaccaagatatctttctctcctgcagtttctttcacctcctcatccggcgaacatgtgggaagaggcgaggctgtgcgaggagaaggggaagaggcagcgctgtgcgaggagatgttctggacaccgtcgccggcaagagaatgacgaggcggccgtcctcgtgaagcgcgagcacccgggccgcgctgtagcggccgacgcggcgaggcgcgagcacttggaccgcacggcggcgtctgactcagtggccgcggcctgccatttgtggtcggcgtttgacttgatgacgcggcggaaggatcctcttgatggactgaagctatactccggcgacgagcactactggttcgtgagctcttcatcttcctcctctcctcctcttgatccacatgtccatcctccattcttgtttcatggctgtttcttgatttgattctgctcgtcgttcgtgacaaagcatgcgtgcagtcggtcgggttcatgtcacgtccgaaaattcactagtaatttccgaacttatttgtgcataaaatcctcgtccaggaatcagccgaggtacacaaactgacaatttaatatacagattcatcaaattaactaaaacgataaatacttacttaagaggcacttagtcctcaccatgaagaaaactgcagcggaaaataaaatctagcgaagctccggctccactcccacaggcagctcaactggggtataagccaaacgtcttctcctcctagatcctttttcttcaactgaggttgattgattattgcaagaatgagcatatgacatactcaacaagccacatagcaaatatgcaagtgcacaaggataccaaaggatggcataatataggctcatttgcaaaagcagcatttagcaaaacatttaagagaaataaaacagtggagtaattaatcagaaattttaatcaacactgaacaacacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccacccataaccgcgggcacggctattcgaatagttttactctggccagaggtgtaccactgtacccacaagacacagccccacaacatgtcaccatgtgcctcaataccaccacggtacctcggaaaggagctgtgacaataccccttgcacaacacaatccaccacagcgcacctttcctggatcataatcacccccttataaacaaggcatagactccccagcgacccccgtgggcttatctccgccacttctcagtctggtgctctgcaatgaatcatgctatacaaaaggtaaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataataatgagtcataagtaatcccaatagtgtgctaatgtttctaagcatggctaagcaatcatatctaatatctagctgaaccaatatatatagctcaactagtcaagttataataacccaaggtatcaaggaataaagtaatcaatgcaaacgggccataacaaaggaatagattcacaccacccagtgatattcgaaaagaaatgcacagttgaaataaatagagaatttaaatataggatcaacatgctcaaaggattgtgtttaggatctgtgtgacttgtcttgcaataatcggtcttcaattaatcttcttgaatacttccggcgcactcacgaaccttcgcaacgacggaaacgacaagctaacacgtaaaacgaagaaaaagactaataaaaaccaaataaacaatacataaaaagtaaacaaacatgtagatcataattttagatgaattatgagacttgaacggcctcattctgacttcatatgaatttattatgaattttacaagattaaatcggattaaaacacttatatggattttaattgaattatgacgcaataatgaattatttttgaaaaggaaaagggaattattgcgtcatcaaaggcggtccgggtgcacgggacggtctaaggaaacgaacggccgagatcgatcttatccaaaacggacggccgagatcgaacggtccacgaccgggccacggcagacggccacgatgacgtcagcggcgacgtcacctccggcggcggctcgggagcgcaagctcgccggcgaacgacggcgcgaggacgcgaacggagggcaccaggacgtagagagcgacgcggcgaactcaccgatgaccaaaacgacg

SEQ ID NO: 62300 - DNA, 3573 bp, Oryza sativa
gctagggcgcttccgacggcgaaagacgaaggcgagggtggcgacgggaagcggaggacctggggatccttttataggggttgaaaggtggcggcgaaggcccacggcgaccggcgacgagaaggaaaggttagggttcggaggagagagaccgatctgaatcgacctcgaatccacggatttccaaacgaaattagccgatgattccaaaagagaaaaggtagaggagatcccgaagaacatttcccctctattgatttcaccggagaaggaaagacgcggccgaatttggaaggagacgacggcggcgcggcgctagggttcgggcggcggcgactggaggaagacgacgggtccgacaggtggggcccacctgtcagcggctgagagagaggaggaaggggcgcggcggactgggccgactgggccggggagggagagagaaaaagagaggttttgggtcggctttcggcccaaagccaaaagagacttttaaaaacctttttcaatttaaattattcatgaaatgcaattccatttattaaaaatacttccttggctcaaataaatcccagaaaaaaatctaggaaccatagaatcaagtaaagtatttaacaaaattttatctagcccaattttatattgagatttagcaaattaaaattagatcttctcttttagtcttttaagatcatttctaataattccttttaaacaacaatttataatttaaggatttttaaacaagaaaagctctcaacaattataattagatcattattgatcaaataattactgaactgttctttgtatcatttaggaattgagctctgaaaaatctgagaaaatttcagagagttgacttaatcatggagaatttaataaaaattaaatccatccatgctttatatttaggaaattttatttcccacatttaacttcacttgtaaattaatgaacatttaatataaattctaataataatttattaaataatttataaatcctgaaacaaaaatcaggatgtgacagttcacggcggcgccggtgttcgcctcagccaggatctggttcgtcgtgttcggcgtcgctcgccgctgcgtacttaatttctcctgtcacctcgccgccggtgagtaaactaaccgccgcgccattgttgcaacgtggggtgcggcgtgctgtacgataggcaggggcagttcgacgggagcacgacggcgacggtggagtacatgacgggtaggggcggcgagcgaggtgaatatcttggcgatggagcacttcttaccgttgtcccctcctcctcctcgcttttgcttccagccaacgttggtcatagcggtggcgacggcgtcgtcgaggctgagcggtggtcctcgcttgtgacggcgacgaggtggtggaggtcggagagaaataacgcccggaagggtattttggtcagcctgggtgtgtaattaggtaaaaatagagagaattggcccaaatggcaaaacaaatgtttgacatcggttggaagtggcattttaacgacgcggaatggcattgtggcgaaacccactctttgcagtggcttaatgtccaatttctccgctggggtggtgttgtgttttgctcttggctttggatccggaggagtacttttgggcggaaatcgggatcgcacggcaggtctccgaccgggaggcgtgcgagcgccgagtggatgcgccatgttggattgcttcagagtgcgatggtgtgcgtccagttcctgcttgttcgtccggctcttgatatttcgatgacatcagcgcaaatgaacgatactagggcaagggggactagggaagtagggaggggatagacggtccatgagagagaggatgcccagacttgcacgcggggccaactaaataacttttttttactttaacttaagtgtgtttagttcacgccaagattagaagtttcattgaaattggaacgatgtgatggaaaaattagaagtttgtgcgtatgaaagttttgatgtgatgaaaaatttagaagtttgaagaaaaagttaggaattaaaccaggccttattctaaaactagcacgagcctcgtggtcataattttttttcacataatcttaacttaacttttctgtcgtcactgcgatttcatccgtcaattttgtgctaatttatcattcatatacgagcgcatacgattacgccatagactcgtccccgatcccctagcacgtatataagaaaacttaatccccatacgtttgtgacgacctaaaccccaagtcctaccgattctaaaagtgagttaagaaattattaggaggagactcatatcagtataagagtaagaaaatccccaaaattcaaaacctttattttgatttttccaaaaattctgaaaccctaaactcagaaattccccaaaaattaagaatccaaatcctgatttcagttaaccccaaaccagcgaatccccaactcaatgagaaaccctacgacactgagtttagggttagttcgtcggatttcgcggcgcacggcacgagctccgccgtgtgcgtgctcctccaaactctcagttgcctttgtgcgactggtgcatggcttcacgcgccgccgtgcatcccttagccgccgtcttggaccggcctcgcacccacatcagttagtcgcgcgaggtcgaggctcaccacattatagtcttgatacgtgtcgtggaggagaactaaggtaggaagaggaatcgacgcatggcatcagctcgcagcgtgccgttaccaccattaccgccatttcgctcggtgccagtggcctcggctcgcacgaattgtcaacttggccatgacatcccattgcatgtcgccgccctaggctcgctggggccatgcgcggcatcaagttcgccgtgcatgggtgcctcaatgttgtcgctgcgtagtcgccgctgctccatcagcgttcccgtgaccgcgacccctcacctagtgttggaaaaatcgggtcggggagaaatgggaatagggttagtgacggagcgtggggctcctcaccgggagaccgctcaggcccccctttgccggttcggccgggggccctgggtgagattctaagctcctagtctatgtgtggaaggttcgcgagaatggaaacacacaagacacgggcgatgtatacaggttcgggccgctgagaagcgtaataccctactcctgtgtttttgtggatctatgtatgaagaagctacaaaagagctggagaaccagagagctcttactctctccctctctgatcgttctggatcccaaaaaaaattcatctcccttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttg

SEQ ID NO: 62301 - DNA, 13439 bp, Oryza sativa
caacgtgccacctccaggagctaacacgccgaccccggctagggatgagtgctggaggctctcatcctgacgggatggggcgaggcgtgcgtcagaccgcctgtcgccacctaacccacgatctgatcggtctgtgactggtcacagaccggataaacgagcgcgctgcactgcgttacatacggcgtgacgcgctcgtccaaaccgcaataaatgcggttaggtgagccccgctgcgctcacctaacccatacacgcggcgcaaaacctacaaggggtcggggcgcctcagccctcggggccgaaacgggagcggtccgacccctcgggaagacaaagaggggggcggccacatcaccctcgggcccgacccccccgagggggtcaggcctcgtgggtgattgctcctgcccaagcctctagtcatgatactcccggtcccatgtcaccgacagtagcccccggcgttatgccagggcgatcgccctccccgagggaagcggtcgggcgtgacgccacttctaaggcctggtgacaggtggggccggttcctacaggtgccgtcgaactacatcacccagagggtggtgtgaggcagctgcgatgggcccgagctggcctcgggggcggagacgagctcgggagctggggtccactccgccacaaagtcggcgagggcctggctcttgatcgcgtggcttggttcaaagcgcaaatcgaattcagagagttcgattgcccatttcaccacccgtccagtaccctctcggttatacaagatttggccgaggggataagacgtaaccaccgtgacctgatgcgcctggaaataatggcgcagtttcctcgaagccatcagaatagcgtaaagcatcttctaggcctgagggtatcgggtcttggcgtcccggagggcctcactaacaaagtagacgggccgctgcacctttcggtggggccgatcctcttcgctaggggccacatccctggggcactctttgtccaagcggcctcgcggggtgcactcgtcttctgtgccgacgacctcggggtcggaggacgacaggggcggccttcccacagtggcctcggggccgtcctgggggtcgggggctcctggcgtcgtctgacaagcgggcaaagggccaactccggtcgtcaggggccttaggccaccgttcggctcgggggcctcttctccctgcactctcccgggtcgagtcggcacagggttagcctcggggtcagagggcgataggtgcggccttcccgcagtggcctcggggccatcctgggggtcgggggcgcctggcaccgtcggacaagcaggtggagggccagctccggccgtcgggggccttgggccgccgttcggctcgggggcctctcctccctgctctctctctctcttcgggcagaatcccggcggtcgcaaatcgtgcgcatcagcaagggaaaaccgaccgacaataatgagcggcccctcggctcgcgtttgccttcaactccgacgaggagtgcggtgacgacggtgcggacgacagcgacggcgaggccggctacccgggcgcgtcggagtgagcccccaggcctccgccaatcttaatagcctttccttcttcttccgaggccttcgggcccccttcttgttataggctgatttaatctgcaatcaaataaagagaaaatttttgtgtcaatttcatttgttctgtgtatgagacgaggatggtctgtgccacggtccttctgtgtcttggcttgaacaagggctcgtgcccaggtcccagcctcaaacggcgcggatcaaggctagtgcctggggagatccacatgtcgagactggccaggccgggagcgtggtgaccgagggttatgggtgacccgattgtgggtttttgccgattcccccccggagttcaccacgtcccggggcacggctcggttctgggccccttttggcgattttagccgacccgagcccccgagggtaggattgagcacgagtgacctatttcaagtcaagattcttcaaaaggaaacaaaagcacagacacagcctttaggaaatcgaaaatgcttttattgaaatacggaagagaaaaaagataagcccccggccaaccctgcacgcccgggggggcgcagggttggcccgagcccaagacctgacacccgacccctactaggggtagaagcgacgaaggtgttcgatgttccacgggttaggcagctctgtgccgtcgcccgtggccaaccgaacggagcccggccgggggacaccgatcactcgatacggaccctcccacattggtgagagcttgctcaatccagcacgcgtttggacgcggcgtaggacgaggtcgtcgacgcagagtgatcgggcccggacatggcgctgatggtagcgccgcaggctctgctggtagcgcgcggctcggagggccgcgcgccgccttcgctcttccaagtagccgaggtcagggagcgtcggcttccttctttttgtcgctcgcaggcctcccctttcgggtggccagcgaaatgccatcgacggcgaggacatgaccctcgtcgtcggaatgggccgacctcttcttcctcctcctgtcccgccgccctgaccgagcggcggacccgggggcggccgaagttgccacaccggaaccggaggggttccaagtccaggcctcctccttgcgagccactcggtccgcgagctgaaaaagctccgcggtagtctggggctctttggaggcgatcttttcgagcatgcggttgtgccgcacaccccccctgaacaagtagatcaccgcgtgtgcagggatgcatggtatggtgttgcggacttgatagaaccgctgaatgtacgagcgaagtgactcatcatcccttcgctatactgcgtgcaggtccgcttcttcacctgggcgcggatatgtgccttgaaagttcatggtgaactgttggcacaaatcctcccaggagtggaccgacgcgggtggcaagttcgttagccaaccccgtgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgatgtgacactccggacgaggaggcgccctcctttgcgtgggcagcacgtcggccattacgccggcgctcgataccgatgcgggcatccggccccccacgcagatcttcctgggtcggaggcgctgacgaaggagtggcggccgaatggcgagcaacagccgccgctcgccgcgccctccgccttgacgacacggagccggtggtagcagcgccagaggtcttggtggcggaggaccgcccaccagcacctaggcgctgccgtgccgtcatgactaagttggccacgtcgtccagccaacgttgggctggagactccgggtcagggacaatgggcgggtgacgtaggagcgcgcccgcagcttggagcgcgccctggggcgtgctgccgtcgccgtagacgaggaggtgacgctccccatctcgccgcccttccccatcacccgtggatgtcgaagtcgcggatccttcgaccctctcgagcgcctcctcccgcctaggactttggcgtggagggggcggtggagtacgagctcgacggcgtgggttcggctccccgtcgtcaccgctaacactcggagagaggttgtgcgcctttgcttgttcggccattgggctgaacaggaaaagcttggcgcacacgaaagaatgcgagagcttagaaaaacacacgcagagccccctacctggcgcgccagatgacggagcgtggggctcctcaccgggagaccgctcaggcccccctttgccggttcggccgggggccctgggtgagattctaagctcctagtctatgtgtggaaggttcgcgagaatggaaacacacaagacacgggcgatgtatacaggttcgggccgctgagaagcgtaataccctactcctgtgtttttgtggatctatgtatgaagaagctacaaaagagctggcgaaccagagagctcttactctctccctctctgatcgttctggatcccaaaaaaaattcatctcccttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgcgtcagtttatcaatctgcatattcgcccctcttcatacaatgtcttgcttgtaatggttaggatgaagcctggcatatatctgaccgggtccaacgtgccacctccaggagctaacacgccgaccccggctagggatgagtgcttggaggctctcatcctgacgggatggggcgaggcgtgcgtcagaccgcctgtcgccacctaacccacgatctgatcggtctgtgactggtcacagaccggataaacgagcgcgctgcactgcgttacatacggcgtgacgcgctcgtccaaaccgcaataaatgcggttaggtgagccccgctgcgctcacctaacccatacacgcggcgcaaaacctacaaggggtcggggcgcctcagccctcggggccgaaacgggagcggtccgacccctcgggaagacaaagaggggggcggccacatcaccctcgggcccaaccccccccccccccgagggggtcaggcctcgtgggtgattgctcctgcccaagcctctagtcatgatactcccggtcctatgtcaccgacagttagggtttcagctggtggcaattttttctggggtttatcgatggcccatgactctcccgcactgcatcagccacccatcagagatcatcgcaatccattaggataggacaactcacactgacaggtcgcacttggtcttcgcgtgcctcacgggccagctctggcctctgggccacggccgatctttgggccaaattgaatttctcttattattgcccgaattaatgatttcctctttatataaatgcattttaatccgtttaagcaattatttgatgacataaagttgcattataaactttcttatgcaattgagatcatatgtagctaaatggaaccaacaagaaatttggctacaaaatttaatttatcaccattattcatatattaatgttaattttaccttatgtcactttatgttttaatattttattattccatattgtcttacgatatgaaggaataggtttttatttatgtgcacaattaatatattttatttcaatcatgtcatttcactctattttggcccaatgatattatggaaatcttacgggctgggccgaagagacgcagaccaagcagagggacataggaggcagcggattaggctgcggctgaaaaggaaggaaggaatgggctttcgacccaaaagcaaggaaggattttaattaacctttccaattataatgtatagcgataccaatattttaatttttttctcagctcctaataattgtggtgccattggaaaaaatgacttttattgtaccactggaaaaaaacgactttacccgttgcaataaacgagcatttttctagtagtatttttttcacattttattaattaaatatattaaaatagtaatagaatttttaattaatggcaatatgttcgtgcattgcaatgggtgaaactaatatttatattatcgatggagtagatcgtgactacggtgttcgcagggtatagggatcgttagtaccatgatatacgtgagattgtggtaaaagagacggagaaaaatatttttatataggttcgggccccttatctatatggtaacaacctactcctgttggtcgaagccggtattgctcttattcatcaaaatcacataagtacaatatttgggataacatatctggtcatcgtcgacttggtgacatggaacaccacatgagggtggtcttctccctcgaatatgaactcggcgaggtttgggtagcgctagatccctcatgtctgcctctggggctccggattggatctatctgggcttatctctcatgccgatatctattggtgttggcttgtattggtctctattctgactggacgtgtcctctcctccaagagggtcttctttttatacccacggatatcctattgtccaagtagaactagcgagacaagtatgtatacgatttgagtagttcttgtagtttctctgtagaactctgtttctccttccttatccggaacacctcccgtatatgaggcatggttttgtataagacttggtatatggtgggccccgccgagcttaactcaagactattgagtatgccttatccatagcactgacaaatattaacaaaaaaaataaatcctaataattaaaatttaagtatcataatgataaggaaaattttatttttttttcactaaatttcttgttggttccatttggcaaaaaaagaaattcaaagtgcaaaaatattcctaaatggtaagtccgttgggccaagacgataaaggaaataatttaaaatgcacatgcataatttgctgcagatatatagcttaaaatgaaggctcaaggtgactaaaattaattactaatttgtgactaaaataattactaattaagtattataatatgtaattttcgggtgaaacataaatgaaaaatgaaatttttaccaacatgccggtggtggcccaaaaggcgtgcttgcttatgaggcatgagatggcctagcatccgcgtgagtgtgacatcctagactaattaggatttgaactgtgtgacccataagagttgtgtgcgcatgtttagtactaccttgatagttgagtaaggttgaaaccaacttataagggtttgtcactccaaccatatcactcccggtttaacccttttactgaagcgaggacgaacgtgtaaatgagatggtatgtgtaagtggaccctcccatcggatgggctgggctacaccgttgtggtgggcgggatgttacaaatggtatcagagctgaccctcgtggttgcacatacggataaatgtgcgtgcatattggtttcagagccgaccgtcgcggttgcgcgtatgggtctatgcgtgcatattggatttgctagatgtacggatgtgcgctaagagggaacatgttcctggatttgcctatatgcttgtgcaactatacaagtaagttggactgacaaggacatcgggtcttttgaggggtgtgtgtgacatcatggcctaattgggatttggcctgtgtagccacggggatgtcgggtcctttgagaagagttgtgtgatatcctggcccaattaaaatttgacatgtatggcccataagagctatgtgcatggttagtatcacctttctaatctagcaaggttgaaaccaacttacaagagcttgtccctccaaccatatcacttacgggctaacccttttacacaaaacgaggatgaaagtgtatgtgagctcacccattggatgggttgggctaatgccgcacacagctccggcggagttgaagccaacggcgcacaatgggtcgacgtccccaaattaacacaagtcggatgttcttgcgagttgagggtcgacgacgccaaggtgatagcagcagcggcgatggcgcacggcaggctgaggccggtgaaccacaccccaccacggcttctcttccttggtgtcgccaaagccgcggccgaggcaagcctcagtctcatgcggccaacttaagtagggaccggtttgggcggtggagtcgaactgcgacaacacggatgcgtgatgtggcagcgacactcgcgtgaagggaaccggcatgaagctagtggaggagctcagaggtgcacatgcgggttgaagttggtgccacatggggagggctccaacgaccgaggtcccgatccggtgagttaagccccaagttctttagggtttgcaccgatttagggttttgatttgggtttgcaatttgggaatttagggtccttgatttgggggaattgaaaatcagggtttataatttggggaaaatacatgggaaggatttagttggcattctgttatattctatgtatatttatgaatcaaattggcactcgttattccttttctttttctttttatctaccgtcatgtgcagttgaatcaatactaatataaggcctacatcccttaaaaaaccttctatgcaaggtcacaatgcatttctcaatactaatataataccaatctctatcacattatctggtgaatttctcaatacatctgccctccatttggaaataaaaaaaatggtcgaaatggcattgtagcaagatggcttcgtttcaaagtggcattataacaaagccacattccggagtggcatttcagcaaaaccccaccctgaagatggcaaaatatcaattttctcgttaatgcaaggatgtggtttggaaaaaataatagcttgtgttaacacattttggaggaaaatatctcataaaaagtgcttcgggaaatgtgcgccccacaaaattctatagatcccggagaaaatcacgtacatttacattttctatggaggggtattaatgttcgtcacataaataaaatcaatagcacattaaatcagaagcttatgaaatgggaaataagtgataagcgatttagaagcctaggctagaaaatacactacactgaaaaaaaaatctctaatatcaacattcaagattcaaattttggttgcagttaataaaccaacaagtaacattcagatcaacactaaaataagttaggttcatcaaactacaagtttggattccctcacatatgactactgtcagctcgattctttgaatatcgcatccaaattttcatgcagttcattgtgccaaacaatgagccttgcccatgctatgacatactgttcatgtgcgagtgagtaatcaccaactttagcatcgacaccgcctttgccccactccacattgtcgctgcccttgtaaccgatctgcctcgctgaaaagagcatgcaaataataggttaacccctttcaaagatgtttctagtccactccaactccattagcactaaaaattacctggttttgaacctatacttcccttcactctgtccttctcaagggatgcagaccatcttggcagatcggaatataaatcattttcaatatcttcatcttcatcttggtttgtgcaaaagaaaagaagtggacccacgccttgtctattgaatgaacaaactagagtgccatctacacaagcaattccaagtggaatcaggcttttgttctgtttctggagcaggatatttcaaaacctacagaattcaaataaagtttccgttagtgatcaacaagggtataaaacaccatatgtttgagttttgtagtgtataaattgtcagtatatcacacacaacaccaaggacgctggagaagcgaaggaagcacttgatttggtggctgcagcggcggcggaaagggtagagcggggctgcagggtgttagatgtatatgtattcttgtatttccccattgtataaggggcttttgtgcatatttacccactcttgtacctgtatatatttgggcctagtgcccctataacgaatagaagtgctattcataacaaaggagtgagagagctacgaaccctagtttagcctcagcacaaatccccctctcgaagcatttaatacagccagaatgaaggggaaaacgccaataaatagcagagcaattagaaatcacgagaggcaagacaaaatggcaaagatcataacgcgaaaaaaaatgattggccgagaggacgagagtgacgaacctctcaagccacaggagatcaaatggtgcacggatcacatagctacggctgttgcggatgctgatgccgcccccacgatggataacatgccatccagtaaaagagatggaagtattgattagaataagaaaaatgcaatattacataagaaaatagtactaatttagtcatgattgataaagcttactcgggtgcatggtaagaagtgttccggggaaatatgtgtcccacaaattcttatagaagctctaagaaaatcacctaacattttctacggagtataaatgtccgtcacataaataaagtcctacagcgcattgaaacagaagcttaatgtagtatcagtcatcatttaattgaaagctatacttctcttcactctgtccttcgcaagggatgcagaccatctggcagatcggaatataaatcatttccaatagcttcatcttcatcttggttcgtgcaaaaaagaagaagccgatccacgccttgtctatcgaatgaagaaactgaagtgccatctacacaagcaattccgagtggaaccaggcttttgtaagacgtttcttgagcaagatatttcaaaaccagcagagttcaaataaatcttcagttagtgataaacaagggtataaaacaccatatgttttgagtttagtagtgtatcgattatcagtatatcacacataacaccaaggatgccggcagaagcacaagaagcatttgatttggtggcggcaacggcagcagaaagggtagagcggggctgtgggggcgagagagctatgaaccctagtttagcctcagcacaaatccccctcttgaatcatttaatacagccagaatgaaggggaaaacgctaataaatagccaagcaattagaaatcactataggcgagacaaaacggcaaagatcatgatgccaaaagaaaaattatttggccgggaggaccagagtgacgaacctctcaagccacgggagatcaaatggtgcacggatcacatagctatagctgccgcggatgctgatgccgccgctgcggcagatcacatagcatcatgtaaaagagatgaaagtactgattggaataagaaaaatgcaatattacataagaaaatagtactaatttagtcatgattgagaaaagcttactagggtgcatggtaaaaagtgtttcgggaaatatgtgtgtcccacaaattcttatagaagccctaagaaaatcgcctaacattttctacggggtaagtatattgggcttttgcttgtgtccacaggactggcttcctcgttgtgtgcagttcaaacaccggcttaatgtgtcgggaacatttctgctcttctggcaagatttaattgctgctaatttagcccaactaactagcatcctgtgaaagagatggaagcatgattattggttggaataagaaaaatgtcatattatgtactccctccgttctaaaataaataaacctagtacgggatatgatagagaaagtatatgtgagtggtgacaccggtgccctaacatcctggatccaccccttagccaactattaaacttgctctacaaaaataaacagcaaaaggatagtcacgtccaaccttccagacgagatcaactccgggaatgggaatgacggccacagccgctgggactcgggcattggaccaggtggcgtccgctgcttgcctaccttaccgcacagcactgcaagcatcgtgcacttcacccttgagctgctcaggaaatgaggcatggttgaacaaaaaaacaccacagatccgcaaccgttgaaccctgcaaaggcctgccacaccaaaaatacatctcaacccaaaactaacaagaactacgacgaaccaagaaaatcaaaccaacacgccagatatggatctagcaaatcgaagctctaacagaagaccgaaatcgactaccacaacacgaaggagcaaggcgtgctcgacttggtggcggcagcggcagaggaaggggtagagctaggatgtgggggcgagaatgctatgaaccctaacacaaatccccctctccgagaatttagtagagccaaaaacaaagggaaaattgccaattaatccccaaaagcaagcaaaaaaggcaagatcgtaacggcaaaaaaaattgattgccaagagggacgaaccgctcgagccagtggagatcgaactgcgcaaggaagcagggatctccccaattcctcacattgctacagctgctgcggatgctaatgctgccgccgcagcggatcacatagcatcctgtaaaagagatgaaagtactgattggaacaagaaaaatgcaatattacataagaaaatagtactaatttagtcattatggataaagcttactagggtgcatggtaaaaagtgtttcgggaaatatgtgtcccacaaattcttatagaagccctaagaaaatcgcctaacattttctacggagtataaatgtccatcacataaataaaatcgaacagcgcattgaaacgaaagcttatggtagtatcggttatcatttatttgaaagctaagagcagtgaccaacattgttgcaataagctaagagtttggtgcttactatggtcggaaaaggtggactagtgagtgaactaaatatctatggatcagatacatcagcctcgccccagacaagtgtaccaatttcttcctcattctcaagctgctgaccctggaggtacatcaagttgggctgcacagcctgttttgctttccgaaatttggattcgctcaacatagagcctcgcccttgcgatgcttgttgatgtgcaagtgagttgtgcattctctcaacattcagcactgacaacacctttgcacaactacaaattgccgttgcccttgtatccttcacctagctgaaaagaacgtgaaaaacaataggttaatccctttcataagatgtttctagtccactccaactccattagcactaagaatcacctggttttgacacaaaatttctcttcactctgtccttcgcaagggatgcagaccatcttggcagatggtgatatagaccatttccaatagcttcatcttcatcttggtttgtgcaaaagaaaagaagccgatccacatcttctttatcgaacgaagaaactggagtatcatttacagaagcaattccaagtggaaccaggcttttgtaagacgtttcttgagcaagatatttcaaaacctacacaattcaaacaaatcttcagttgtcaatatatattgagtttagcagtggataaat

SEQ ID NO: 62302 - DNA, 1655 bp, Oryza sativa
tctaacagagctgaatcaacatgaagaggaggagcagcgctgcaaagagaaatattgtgagcagaaacaagctaaacattatatagtaatcatgcaagcaacgatgcagaactgcaaataagaataagaagcacaacttaaaatatgattaaaaaaggatacaggttaaattctctatcgcgcagtagtttacattttacacaccaataaaagcatttaatttgtgttaccattaagttttgtctttagtctatatggaaatgtaacctcagttaacctctaaattatagcagcaaaatacaggttagctcatttgatatatcaccaatttaagcttcaaatatttttgtggcatagaaaattacgatatgattgcgacatgagcaatagtgtttaagacacaacaggttgcgagatattgaatatgtattatacagcacacataactcacacatgagcaatagtgtttaagacacagatgcaaacataactcacacatgagcaatagtgtttaagacacaacaggttgcgaggtattgaatatgtagtatacagcagctgaagatacctgactctatcctggagtttgcaccaccgaaactgaaaagagagaagaaaatcaaacattaaaaaaaggccctatcaacaattttactacttgcatcatttttctcgtgcagtttaatagacaagaatgaattgacactgtgcagtatgtgccatattatcttgttcctaaattcatggtacataaaatttgcatacaatggtgctagcaaaataccggtgtattgcaacaatcaacaaatatacatatatttcatgaaaaaaaacatatacatttgcaatccacatcaatcagaaaataaatccacaaattagaagatcccaccaaacaaaagaggaggtggtgggatggcagacccaccaatcaccaccaccactactaagttcttagatgtgggtatgctgcatagtctaaaatgaaaatttacgtctcagaaaacgagactatgactaatctacaggaagcttcactccataaccatgcaagtatagactttggaacctagccccaccagcttgtataagctgcttacaagtagcaatagtggtcgatggccactagcccgttacttacgatgcaacaatatttatgatttgtaagttagcataatagcatcacgtacttcattactccaataacctagaatttctacaaaataggtctctgggtaatactccattacagaactcagcacgaattagatgtagaaaataaaaagcagcaacattgatttgacacatacttcaatattgagaagagcattcaaaccatcctctagtgagttcaatatagatgaatcctgtaaaagggatggaaatacaatcattgatttggaataagaaaaattgccatattttagaataaaaatctcggcatgatcgcttcaacttacatgggtgcaatgtgctccacagataagaagctttaagtgcacatcttcatcgtatatctttatgtctggaaagtattcagaggtatcttcttcctcagccattttgtttccaggaggggtgatatatatccttggagcatccccaagaagatgaggcccaagcataagacgttgcacgtcattatttcttacaca

SEQ ID NO: 62303 - DNA, 20061 bp, Oryza sativa
  unsure (1)..(20061): unsure at all n locations
ctatgccagtcaaaacaagttaaacaaatgcaatttagtaattgttttatagaaactaagctctataatactctacagaaaaaaaattgaacaacaaatggggacatttggatattgcatcgataaagcagattcccacctacgtggtaaaagatatttgcagcaataagcaatctacaggctcaaatgtaaataagaaacagcgacttgaaaatatcagaaaatagactaccttcgattgaagagattgagcaatcttttctccacttggaacttccaaataaacctgaattagatcttaaaaggtaagataagtagctacaacgaagaagactaaggaaaaattggaaagaataactttcattaactaaacaggaaaacaggcagaggaaggttaagaagaaattgaattgttactagctacaagtcagataaatatatctggaatatataaacaaggttacaagggttaaaaaacaaaaaataaaataagtaattttaagggccaatctgttaatctctaaattggcccttaaatcacaatcaacctcaataacaaagggagcctagatgcacgcaattatgaactactccctctgcagaactatataaggcatgtatttttatcgcattaaaccatcaaatccaattagataacctaaatgcccatatttatagctccataagagtattaatgctatcgctgcctggctctaatcccagctgcatgcatgcatgaactaatcatactatcgatcactcaattgaaagatcaataccgtatgctaagagcggtgataacactaaactaaaagatcaataccgtatgctaagagcggtcataaccactttagcaagcactctagcacccaattatacaaattgccaaacttcatcagcaaacactaataactaaagtggatcagtaaaccaaacatgtaaggaagcatagatatagctataaactgcagcgctaaaagaagcatagtccaggtgctatgggagctgaagcgccaagcagccaaacatcagaactcaaaaatcggtgctaggcgcctgttagccacctgcgattatgcattacatgctgtattaggcggctaaccaaccttaggtgctcttgtgcttctattttagtgttgtattgtgtaatttttatgtaatatgcttgctaatttcctaggcaccagctctgcagaccctctagggctcctgtattgtctcatttgccggtttaagttagacatgataatatgatgtagtacatagaaaatcagcagagtttggtgcttactatggtaggaataggcggacaaaaaagcatagatatagctataaattgcagtgctaaaagaagcatagtacaggtgctatgggagctcaagcgccaagcaggccagcagccaaacatcagtactcaaaaattggcgctaggtgtctgtcagccacctgctattatgcattacatggtgtattaagcggctaaccaacctaaggtgctcttatgcttctatttccgtgttgtattgtgtaatttttatgtaatatgcttgctaatttcctaggccaggctcttgtattgtctaacatttgccggtttaagttagacatgataaaatggtataatacatagaaaatcagcagagtttggtgcttactatggtaggaaaaggcgaacaaatgagtgaactaaatgtctgtggatcagaaacatcagcatcgccccaaacaagtgcgccgatttcttcctcattgtcaagcagctgtccctggaggtatatgaagcggggctgcaaagcccgttgtgcctccagaaattgatcaaccgtaggattgatcagcgtgtgcacctgcatgcccaaatttccaagttcagaactgacaaacaaaatatgtacttaagaccaagtttaatagtaaagctaactactagctataaggcaatcgaaaattagcattagaattcacatgtgtaacagattggttataaggttgcctctaaatttcttctctctttctctcatgtatatataattaattaatgcatttatcttagcatgtgtatagctagcttttgcataagagttaacactattttcttggttatcacaggggcatatccatcactggggcttgtcggggctcaagtcccagctctggccgccaaacctatcagccactgcttcagccactgcaagctgcaacgcagtactgagagcctataaggatggtgaaaacttaaaaacctgttatctgatcaactgatagagcgatgaaccagatggaattgttctcgcaagatgcttgttaggcagagaggggaactagcttactaagctagaaaacgtactatatctatgcttgctttgaagtggaacagcatgctaatatggaaccacaagagagaaaatggaaagtaggtttagattttaggggttttgtcaacaaaagtgagccacttaatttaatacacaactgtaaaagtgtaaagatctgtttgcaacatgatttatattcatcattgcatctatgctaacaagatttggctcgatcaattggctattggggccgttttgcgaaatggattgctttgctggccatgaataggatgctgaaacttgcaagagtgattttttatttaatcacggcacacatgcatgtttacaaatttctataagcaatattatatgatagataatattaacctgtgctgcgatcctattttaacttcattggccatgtgtggattgtaatcatgtgtataaaatacttttggtattattttaggccgaataaataaaactgaagtgaaacgagtatttgcctaagcgcagcatgtcgaaacgcgggcacgtctagtaagtgagtggtaacacctgtgccccaacatcctagatcacctgtgccccaacatcttagatccgtcccttagcctactattaaacttgctctagaaaaataaacagcaaaagatacttacatccaacctcccggacgagatcaactccaggaatgggaatgacggccgcggccgctgggactcgggcactggaccaggtggcgtccgctgcttgcctaccttaccgcacagaactgcaagcatcgtgcacttcacccttgagccgctcttgaaatgagacatggttgaacttgaacgctgcaaggctgcaaaaccaatagcaacaacagaccaaacctcctccataaaaaatctccacccaaaaccaaccgagcaaatcaaacaaaaagatctccacccggaaccaaaaaggaacgaatagaaccgagcaaatacaacagatcggatcgagcagaataaatcggatcgagcagaacaaatcggatcgagcagagaaaatcgatcgagcaaatctaacctaacaggagaccaaaatcgactatcacaacaccgaaccgggactcacgagacgctaggacgctggcggaggcgcaaagcgggctcgatttggcggcggcggcggcggcggcggaggaagaggagagggtagagctgggatgttagggcgagaatgtgatgaaccctagcacaaatcccctctccaagcatttaatagagccaaaaatgaggggaaaacgccaattaatccccagaagcaagcaaaaaaggtaatatcgtaacggcaaaaaaaaaatgagaggagagtgacgaaccgagccagtggagatcgaacggcgcacggattcctcacattgctacggctgctgatgctgctactgatgccgccgcggtggagatatccctagcacgcttccccttgtcgcgcttgcatccgcgatgggatgatgatgacgacgatgactcataacttgcagagagaaacaaaaacaagatgacggattaaattacagcgggatagcgaggaaaagtgggggaaaatgcgatgcataccttctctccgatccgtgctgatttttgggatttttttttggccgcatccagcgcatacgcgatcgatgcgccgccggggtggtgatgtggtcggctcctgtcttcgattccggcggggatcggaggaattttggatgggattggggaaggggcgacgcggcggcggtggatggtgaggcagttcatgcttgttcgtcgggttcttgaggaacgctcgcgttgcgattactagcggagtagcggggagccggggagccaggttgggtcttgggtgaggaatgtcacaaggtgaggtgaatctcggcactcatccaacgtagatgcaacggctaagattcatccacatcattcaaattttactcgcaaatttactcaggattaaaaattttgctggcggtgggtggggaggggatggacggccgtctcaggctaacatgcgggaccaacaataatttttaattcttttttaaattcatggcactgtttaaaacattttttcctctactcggagttaaaaaataatcggtacagtactacttgagaatgagttcccaacccatctcccttattttccacatgcacgttttttaaactgctaaacggtacgtgttttgtgaaaagtttatataggaaagttgctctaaaaatcatattaatctattttttaaattttttattgctaaaacttagttaatcatgtgataatctatcgctccgttttccgtgcggagtggaggggtttccgttgggatgaaaacgtagcggatactgatggataatgctcataccatattagttttcatagttttttttcagatgctgttaacaaccaaatgtttttccatgtcagcagatgcggaaacaaatacggatagtttgaatacggaacaaaaacggattatctcgaatacaaataagaatcgaatatgatcggacacaaatacgaaaacatttttttctcggaacaagaaaaccaactcaacttttaatagaaacaaatatccaacatatataattacctcattttatataaaatatagtataatttataaatattttttagaaaaaataaataatattaatagcgtggactagtgtcaagagatgaactactattaaaatctgaaaaggtatattgaaggacatggagttataaagaaatggggtatgggtcatggcttctgaggatatccgaatagcactattcaccggattttcgaattattttccatatccatcaaaaattccgataccatattcgtattcgtatccgggagaaaatatatgtattcatattcgtatccgaagtatccgagaattatccgatccaaaagatattcgtatttgtttttctccggagcggacggaaactatccgctcagttttcatcccttcccaaccagttttcatcccttcccaacccctccaaaacaacacagccttaattaacatagaataatatttttaaaaaaacttgataaatataatctttacagtacttcattaacatagaataatattttgaaaaataaacttcaaaaatagcttacaacaattggtctaaaaaactatgaaatatttttgatttggaaaatagataaatagcttacaacaattgattttgcgtttagaaaaatagataaccaaaatttagaaaaggctaaaaagaaccgtgcctatattatacatttgatttggttatattgttactttattattgaaatttgtatattcattttaatattaagaagcaatatgtctaatagtaagtaaacaattctatcagagcggttcttttaatttattctaaaacaatacccatagttagatctctagtaaacatttaattttaaattgtaaatttaacattttacatttgtttagcatgccataatggattcaaatatgtctgacttttctaagaattggtatgaagtgataccaacgagaatgtgagcttgacatgcatatgagtaaatatattcacaaaccttatattgacaaactcctactatgcattaaggcaacatcaagttgccacatattgcatagacttttaaagagctataaacacttttcgactgtaaatgctgcattaaacaagttaaaaataccaatccataatatataagcttttaggttttaggtatttggtcgacacttaaggacaagtttaaatgtccgtgtaatttactcaagagcaatatatagtttctaattgggtcatatcaagtctaatggaattttgatcattggaattttgccctaaagcgttatatttcattattctcccctccacccaccctatccctgattgagtgaaaattgtcacatttgttcgcttgcatgctttaccacttgttaggtcatcaacatattttagatagagaacgttgctttcattaatttatctgtcaactatgtcaacaaaagacaactcaaaatagaggatagtgcatgtataagatatgatatggccttcaatataaacctacttatgttcctctaccttttccctcatattttgtgttcgagcaatctcttcacaaaaaataatactaagccatttatatcccatgcccgctcttcatatatttgacgtgatgagacaacttcttttttttttctcgaggagggcaactttgtttgatgatgcttacaaacaacttgttcactgaaatgtaaaaatttgcttactaggatatatagacttgtatgtttataaagtgacatatttctattcatctatcttattatatttttcacctttttagtgggctatttgaatggcatgaaaaaggcggagatatcccctcgagagataaaaccattttccctactaaatggcatggctctaactttttttaatgaaacaatggtctggctctaaatcttgactattgtagaaaacatagtttgtatataaataaggagcttgcattgcggtgtgtggggtaaatcatacactccttacatcccaaaatgtatgacgccgttatctttttgcataacgtttgatcattcattttatttaaaaatttagtataaatataagtaaatattatagttcatttgacgataaaacaagtcacaacaaaataaacaatatttatataataagatggatggtcaaacgttatgcgaaaagtcaacgacgtcatgtatttcatgatggagggagtaaattttgtggaatcgtgaacatgacgttttacatagtactactatgatactagaatataacaattttgcaaatattttgaaaaaataatttatttatggcaaaatcgtaatgatattaatttacttctaaataaccctctaatgggctttcaattttgtgtttgtcgaaagttgagaattgaagtataatagtaatatatgagcaacattgctacattggtaaaaaaggtactaaaaaggatacttgtccgacacatggaaagcatagccatcgtagtgatggtcacagtggtcgctgcatgggcgaggatggaggggttgactttggggatggtcggtgtcaatggtaccgctgttgcggctatgatggcacacaactgcttttagttggttgatcaacaccaccaacccacaaccatcgtctctgccgagatgttagccatcatgtcgtcatagccgcatagtgtcgttgtcttgtcacctccaccgatactaacaccaccactccaccagtcgtcatcgctgccgcctttctcaccattgcgatatgatcatcttcttgaccgatcaatcgatctatgcgcagttgccgccttcaggtgcatgcattagtatatggaggagatctgggttatctcgtcttgccatgcaaacatagtctaaatatatgaatgtggcttacataggacaacgaaacgaagctggaacacatgaacaatctcggtgttgcttggattaacacacgacgaaaacattttttgctttttaagtagtagagaaatgcatatttagtaaaaaaaaaaattttgtagcttttaataaattagaaattttgtttgagagctcttaaaatttcaattttatcacattcagttgaccggttctagcatgccaccgacgattgtataagcaatatagtgtgactgtcgtcggtgtggcaccttttttttatatatattttgagctttcatctatctctatttatttcaatttcagagacatacgtggaatgtaaggcgtgttgaattgttgattttttttctaacgaagtcttaaggtctcatcggttacccatattccgtggcttattagagaataaaaattaattataggtaaaacttttacatatgtgttcttagcgattaggaatatggcttattagagaataaaaattaataggtaaaaattttacatatgtgttcttagcgatttaaaggccaatgctgaaaaaaaaaactacgtataaaatatcttaaaatcaattcaaaattaagtttgaaaattcaaattttaactttggttttggcttattaggggaccaatgagcctcttacgtttttcttttcttttgaccaccgctatttgttttccttccaaagtatcattatttatttcacattttatattatatcttccttagtttttcctaatttttattttgcaaattttcagactgtgtaatgtttattatagtctagtggtattgttaactcatttgaaggatctagatattcctagtttagtttattgataatgagcttagatgtcgggtcccaaaactaatgattcggaaaccgacatgtttagactgtatcaagccctggatcagtagattgatataggttcaacgatctggatcttcattgcatacatttgatcaaggttttaaaggagattcctttacataaaataatagggtatttacaaacttgtggctaactattacagcagaagctatacgatgacataactctagtgttttgctatagagttaaaccatctatctaatctatacttgagaactaagttaaaatgagattaacttatatgattgaacttccagcttcggcaagaactccaaaatgactctgaaaaaggggttgaagcgagggtgagtacaacgtactcagcaagctattatattaaccaacaatgaatgcatgaaatggtaacttctgtgtagaactaggtttacttgcagaaagcagagaatattgaaggaaagtctataatgttttaaatgcaacagtatttaataaagtttgaaattatgttctaaccaagatgccattgtgagccccaatgcccgataaccgcgagcacggctattcgaatagttttaataatattcatactgcagtagatgtacgctttacccgcaatccatgacgtgccaaacacattagccttgtcatgtcaaagcttttcggttactaacatcagtggtacctgttccatgaaccctagtccccatgcgctctgaacgtaacgttatcagcagcgagaggagttctggtgttcccggggtttttagagagaactggttgagagacccccgtcatctcaatcaggttttcataatacacacacagctcgcgagataatcaagatatttacctgcgcctcggtaaatatcacaatcgccctgctcggcgtaagtttgcctcctgcgcgaggacttaagaagaaccactatacagaggtaccacttttgctagataacttaatcagctaggtctatgcccatacgagaattgcggtcgtactcgtatgttcttcacatgtacttggcaatcttatgtcggttggaacagtactagccacccggaaatcaaccatttctaccgtactgttccaatctaagttcattatattttatgcagtctaactaggcagggctaagcaaaagctagcatatctggtttgctatgttcaggttatgcatttgaaatcatgtatgactaatgcatagaatagagatatagaatatagggcatttatgctcaaaggagaggaataataacttgccttgctctaacgcaaataaatccgagataggcaacctgattatccgatccttgaaataccacaggttgccattcaaaatataacagactctactgtagaagaggaagatccaaattcaataaaagccatagaataacaagaaaacgacaaacggttaagagggctagggtttagtgtataacctatcttttctatagggtatagggattattggctaatattttatgtgcaggttctaaagggttggaggctaaggtggataagagattaagcaactagggtcgcttatatttcatgcatgggcttctgtggtttggaggataggaaatatactggataaatgatgtggttaagtaggcatgtggctggtataggtcaaggtcaggctttgatagaacagtggctagagtttagttgttctcgagtcgatgctgaaatagtatagcatatcggctcgtaattcttgcataggctatgggtagttggagggtaaatggttgagattatagctggcggggagtctggctaataagctgactaaggtttcaattgtctaagccgatatcgaggtaggataaatatcggctagggtttgggtgttcgctagtcgtcgctaaagcatgacgactatgtttggtatcttctctagccagtgtcaacagacaatataatggctagagggatgggaggtttgtgcaggtttagtggggcagaagtgttactccgacaaccgtgagtggcggcggagcggctaggatcacacatggcccgagagctaactgtgcggcgtgctgtggaggtcgatggaatagtgaagctccgaccgctataggcatcgaggcgtggggtgctaggagcagcacttcgaccttaggtttggttttgccgggctttacaaccaacggttcgacgtcggggccagtagaccacacgaacgtccccatggaaggcgtaaagttccaaccggcggctttttagtggctaatgggtatttttgggtaaaagaaaatatttgaaaaaggcaaatataaattcaaatgatatttgaataaattcaaataaaattataaaataacaaattaggcatcaaaatgaagcatttgaatttatatgaatttaggtccaggtttcactgagatcggatctacggtttaggagatatgggcttctaaagattgggatttgaattaaataaagaaaatatgaaaggttactattcatgggcctacctgtcagtgcctattcccttttctcttctttctcttcttctcgtcttcttcttcctcccgcttcacagagagccgagagaagggagaagagagggagaaaggggcgctggtgctccggtggtcgataggctgcgacgtcggcggcaaaacatgttcccgagcgacgcgcatccggggagggtggtagctagctaggtggagagggagatggccggaacagcgacggcaggagctcaactccggcgataagagaaggtggtggtggcggtttatctcaaggtggagggagaggggaaaggggaaaaatggaatcacctcgtcgaggcgaagccaatggcgcgaggatttggttagtggagctctggtgagggagatcgggcggtggcggcaatagccggttatggctgggagagagaagggaaagagcttttagctcgatgtgtgggggagaaaggatgggctcgccggtatttataggcttcaaaggtcggttcgcagaggaggagggcgacgaaggcacggctgcagcgacgtgaaggaaagaatgacgacaccggttctttcctcccattggacgttggagtcggttcggcttgcagatgtcgtcagcgaggtgaggtggtggctgacgtaagattgggcggcagaggaggaaggcaaggcacggcgtcggtggagtggggacgaagagaacggcgccggcttgattccttagcggcgaggtttgcggcggcgtgcgccgtgcacggcacgcgcactgagaggaggagggaggcggctgggttgtgggttgaattgggccggctcggcttagctgggccggcagcccaagaggaaggaggaaaatagaaagaaaaaggattgggccaaaaggaagaaagaacggagtttcggcccgatgacaaaaaggaagaaatctaatttgtatacttgatttggataactaggttttgcgaagaatttgaattcggagagaattcacaaaggagatttcctaatttatttgagtgcaatatttagaggtggaatttgagggaatttatttggaagcactcaaataggaagggaaattaatagtattcctcaaaatatttttggggatgtggtacgaaaataggtggaggcaaaagaatacgatttgaaccctaaaatatatggcatgggtttcaaggaattgtttgaggctaaaaggaaatttaggtgacaaggatataatttattttcttagcacaagagcaattattcacaatatttgtaataatattattcttgtgccgagaaggaaatcaagccacgggaattaaattagcggctagatcaaaaggaagaatttagatatttggcgataaataagaatatgtttggaatcaaaggataggtttaaaatcaaaggatgggtcgacaattaaatccaattggaatcgtttggtttaggttctaggacaatagtggagaatttcttggaccataattcataaaaaatagaaaggggttttcaaactaaatttgaataaaagaatttttgtcaaaagaaggttttaaaccaaatcaagaaatacctcaatttaaccaaatatatattttaaaataaaaaacattttagagattaaataccgcataaggattctgtgcaagttagttttaggaggtccctctaattatattgtcctaagtttaagaagttattaagaacataagaatcggcatgatgcaggattggaaaatgacacattttcaagatgttacattagaactccagagagactgcaagctgcaagaaagctcgagcgatgtggcatctctttctttgttacatgtgtatttatttatttatttttcgcatatgactccataatctattttaaaagctagttctgccaattgcaccaactttagaagtattgaatattgattgattaaaaacattttctacccctaactcgaacgacaataatatttgaagctagagagatggtactagttaaaaaagtttggagtttgaattaaacaaacatggccaacatgaagatgaagacaatgacactagcattctcattagccaaaccagcgttaagtccttaagtatatgtcgatttccataaggaatgacacacaaattcaatgaacaaaaataaaattacctaatgtggtataaaaaaatcaatagatgctccaagccagcgatagcagtccaccctgtcttaaaaaatgagttgaaagcaaaattggaagagagaaagagctgtagccggcgactaaattagcgccaactcctcacgagttacaagatagtcagggccggtcctgggtttttgggccccaggacgaaaacttatattgaggcccttatatatctatataaactaatacatatatttatataatcttataaacacaacatttaatattcgatttgataaaatattatctatatataacattttaaaacttcaaagagaaataacataatcataaacacttactagttggcactttcaaaattttggctcattgatgcattagcattacttgtgaaaaattctgtcaatagttcctcgttgtgtttcaatgaaatcatccgaacgctttttccgtttccttttttcgctaccggatgcatattttctcgaccacatgattaatgttgtgctgaaaaaataatcatcatgtgctggtgattttttatttatgaagaggagaaaaagatggggaaatttaacagatgaaatttacctcgaacgagggacacgacccgacgagcgtggtgagccgcgactgcgagcgccgagcagcagaagcaggcgagtagcaggcgcctggcgcggtggcgccgatcggccgatgaggcgatgagcaacactgcaacaggagttgaggagcaacagacgcctgcccgtggacctaccggagtggattggtcattggacatctgacatcggctngcaatccnntgatggcncnntctagctccgtagtacttactatacgtacgacatctccatgagcatcgtagggctgtacgcgccgacaggtgcaggatngtcatgatcgtctttctctcttccttttgatctcgctctaggctcttggtctgactggactagtctccatttgggcccattgtgcgccattcatccctatgtgtgggccctctacatactttgggtagtccacatggtcggccgcacgggctgaccctagggtcggccctgaagatagtgcaaagcttaagtaattggctcacgaatagctgagcagtacttgctctatacaaatgaaaaagatacaatgtgataaataaaatgaaaaataatatttagaaaattatgcactgcagcttattattgtactctaaccatggctctacatgatatggaaatttttggagccatccactggctatactattgatctcgctcttagcgccattttccaaccatggcgccctaaagccaacaaactttccaccacacttaaaagcgatatttcgggaatatgcatatgtaaaccaccaacagtcacccactcacctgttaatccgcccacattctcatcccagatacccaaacgccgctgccgtagttaatccactcacccactcctcagactgttgagtgcctcctatttaatctccgcgcgaagacgtgcgagagaaaccgccgcgaaacgaggcaatggcgtcggggtcttccagttccaacgacgccgccgccgacctcaccgtcctcgtcgacgacttctacttctccgtcctctcccacggccgcaacgacgacgacgactccgccgatggagacgacggcgagctcttcccgatatccgacgagaagtacgcctccgagctgcagctccaggaggtgatcatgtcgtcctccgtggcggccaccacggcgcgctcctcgtcggcgccggttatcttcataggtgagtgctcctcctcccacgccgcgtcgtcgtcgtctcggttgacctcgatccccgccgccgccgcgacgacgctcgtcttctgcaagatctgcatggacgccgtgccgccgtccgccgcgcaccgcgcgagccgcgggtgcgaccacgccttctgcgcggcgtgcctcgcgggctacgtcggcgccaagatccaggagaggatcgccgacgtccggtgccccgaggagcggtgccgcggcgcgctcgacccggagctctgccaggggatcctcccgcgggaggtgttcgaccggtggggcgcggcgctgtgcgaggccatggtgctcgccgccccgagggcgtactgcccgttcaaggactgctcggcgatgatgctggacgacgccggcgaggccgtcaccgagtcggagtgcccgagctgccggcgcctcttctgcgcgcagtgcgccgtgccgtggcacgccggcgtcgactgcgcggcgtacaagaagctcggcaagggggacaggggcaaggaggacctgctggtggtggagatggccaaggggaagaagtggaagaggtgccccaagtgcaagtacttcgtggagaagtcccaaggttgcctgcacatcacctgcaggtgctgcatcattttatcgttcagatgtcttttcttccatatcttgaattttctttgcaggagtatatatgttgtatcaaattgtttttgagatgatcatgatcatcacaacattttgcaggtgtggcttcgagttctgctatggatgtggagggcagtggggcgttactcatgcgagttgcagcactgcatgagaattccagtttaattttggctgggctgatctgattgaatttttctgtgttctcagtgagaccctagtagcatcaattatcatatttaggagaccgatggtcatcagtagcatgaattatatgtcattctctcaccgaattaagtttcggttatcaaaagtatgaacttggagctaatttctaaatctaaattcgctacacatggcacacagctaccgcgataatattcgcttgaataccacattcaaattatttgcaatctatatattgtctgttaaacgttcgaccttgcttcatttgaccattttagatctgtgagtgattaaaagtgcttccaatgtgtatacactcgggtgttcaataattcttctggtaaatgatgtacccgttaacataagttagtccaatcttccggagatgtgtataggggtagtgtgtgcgtttatagcgatgggtatatgcgtgttataatcgtctgcgtttgtaacgtgtttcctaaaaaaatatgtactagctggctagctgccattctggcccgttctagcctccttgttttgttaattagacagaattgagagtatgtagcaccacagaaaaaagggttagttatcgaattgtttccatctcttcaatgttagcacttgtaaacttgtggatcttgtccatttatttgatccctcaaatccgatgcatgaggccttctttgaaatggacgaatctcaaagtttttcttttgagcaatttaactacatccaatgatttttcttttaacataaaaactgcgtgttatggtgccataaaaaggttgcatccggttttatggctaatagttccatcaatattcctccaattgttaatggactgactgctgtaaattttttcagtcccaatcagaacgcaagataggaaaaaacaccagaattgaaatggttactttcatataaattgagtcagcctaaaattatactattttacctaggctgagttttttttcccaactttcctaactcatctacatttttcaaactgctaaatgattttttttaaaaaaaattatatacgaaagttgctttaaaaattcatatttatcaaaattttaattttttagctaatagttaattaatgatgcattagaagccttagtagattggtgccaaaacagtgcatttggcgcatattacaactgtaacaatatttaggcaccacaagtcccaaacaaattactagctgattcttaaaacgaaaaataattctggcccattccatctcaaaactattgttgcaaatgtgcaatgatcaatattggcacgatgactgtgtttatttcctttcaaacttctaatttttccgtcacatcaaatgtttggatatatgcatggagcattaaatgtggaaaaaaaatcaattgcgcagtttgcatgtaaattgcgagacgaatcttttaagcctaattacgccatgatttagcaatgtggtgctacaataaatatttgctaatgacgattaattaagtttaatagattcgtctcgcagtttacaggcagaatctgtaatttgttttattattattctacgtttaatactttaaatgtgtgttcgtatatgtcaaaagaatttcgccaaaacacaggccatcttttttttagagcaatattgggacatcttgggggaacgtggagcaaaccgcacgaacacgtcccgggaaactgaaacggtaggccggctcctcaactcccactaaacccaacccaacggaaaaaaaataccaacagaacccaccaaatccccacgttcctagggttaaagttaaacagatggatttggtcggtttttaccaagcgaagataaagcggttcatttatgttaaatctatccactaccccaactacatcgatcgatcaccgcattttcagcagcgagaaagctttcccatctttcccggcaaagctggcgccgcgcacgcgagccatggcgatggcggaagcggccgagggacagcggccgcggcagcggcagcgtcggcagccgcagccgcagcggcagcagcatccaagctgcggcatctgcatggagcccatgccgccctccgaggcgcaccgcggcggcggcggcggctgcgcgcacgccttctgccgcgcgtgcctcgcgggccacgtccgcgccaaggtcgagtccggcggcggcgcgggcgccgtgcgttgccccgacccgtcgtgcggcggcgcgctcgacccggagctgtgccgcggcgcgctcccgggggacgtgttccgagcggtggtgcgcggcgctctgcgaggccatgttcgccggcgcgcggcggacgtactgcccgtaccctggctgctccgagatgatggtcgccgacgccgacgacgaggggtgcgcgggcgtgacgcagtcggagtgccaggcgtgcaggcggctgttctgcgcgcggtgcggcgtgccgtggcacgccggcgtgagctgcgccgagttcgggcggctcggcgagggggagcgcgggcgggaggacctgctgctggtgcaggccgcgcggaacggcgggtggaagcgctgcccgcgctgcaggttctacgtcgagaagtcccacggctgcctccacatcacatgcaggtgcgccatctgtgatccgaggctctgtcgctggtgatcttcttctatactgccccgttcttttacgatgaagataaagattttaactcggtttctgttaacacgtttttcaaactccgagaaaaacacacgaaacagcacgttttatgtgtgaactttatatatgaaagttatctttaaagtatcaaatatgtattattttaagtttgtaataattaaaacttaattaatcatacgttaatatctttttttatgcccgtatttaatctgaatctttataagattagaacgtaggctactatctaaactaaagatccatttgttaccacggatattataagagataaagaaataagtatagatggtacgtaacaaaagtattaacgtgtggaaagtatagaaacttatatgtcaacctagagatatcattgctaattaacatcacttaaagatatatgctttagggcagtagagttacattgatgatttatttgtgattaatcacttaaagataatgtatctatgtctggattcaccaataatgccatgccaggtgcggctttgaattctgctatggatgtgggagacagtggcagctgatacatgacggctgctctgggtaacgatgccctggtggtgataatactcctcgatgatagtcaagcagaagtcgatttaattacaagcgaacatgcactgatctctcgctcgaatgacatatgccacttaatgtttttttttaatgtttgtttcgttgatcttttctgatcacttggactcaacagtgaacacaggttttcctactgcctttattttttatgggaatttccgtgatgaatccatttgtatgggagtctagaaatttcctggtggaacaattgtgtcgaagtcttactcttcctcttagatgcaccaacttttgcccattttttgggagttgattaaactgattcttatgaagtatgaacgtcatgcaaaattcaggctgaagatgaaaaacgcgtcctccaaacgaggagaaagttgatgttttgccaccctatccggtgcgcttggataagatacaaccctctacattgcaactaataaatgtcacccattttgttgtaacctctaggattttcctctgttttgggattaagcgaattttaatttctctttgctctctagttcgtcactttaccataatatcccatccggatctgatacctcactagtatcaactgatatttgttgatataagatttgatattttattgatatttgttgatataagatatgatatttgttgatataagatctgatactatatcgatagcaactgatgtacctattgataaccaatcaataccaggttgatatcctctcttccccctcgatatcttatctggtgacgatgacttgcacctcaacgacgcctctctcctctttggcgaaggcggcatgctccccgtcggcgtggaacccttctccggtaaagacccctcccttcccccacccctctctctctggagacgagctccctaatgacacgacgagctccctaatgacacaacaagctggagaagt

SEQ ID NO: 62304 - DNA, 8539 bp, Oryza sativa
gcgcgcggttcttctccgccgggtatgaggccacctccggccgcatgaacgagacggcggaggtcaggtcgccgctcgacaccgatgggcacgggacccacacggcctccatcgccgccggccgctacgtgttcccggcgtccaccctcggctacgcccggggcgtggctgccgggatggcgcccaaggcacgcctcgccgcgtacaaggtgtgctgggtgggcggctgcttcgactccgacatccttgcggctttcgatgccgccgtcgccgacggcgtcgatgtcgtgtccctcagcgtcggtggcgtcgtcgtgccgtactaccttgacgccattgccattggggcattcggggcgacggaggctgggattgttgtttcggcttcggccggcaatggcggccctggtgggctcactgtgaccaatgtggctccctggatggccaccgttggcgctgggtccatggaccgcgccttcccggccaacgtgcagctcggcaatggtcaagtgctcgacggtgtcagcgtgtacggcgggccagcgctccaatccggcaagatgtatgagcttgtatatgctggagcaagcagcggcgctgcctcgtctgcggctgacggctactcggcgtccatgtgcctcgacggctcgctcgaccccgccgcggtgcggggcaagatcgtggtgtgcgaccgcggcgtgaactcgcgcgccgccaagggcgacgtggttcaccgcgcgggcggcatcgggatggtgctcgccaacggggtgttcgacggggagggcctcgtcgccgactgccacgttctgccagccacagccgtcggcgcggccgctggcgacaagctccgtaagtacattgggtcgtcgacgcggcaggcgccggccaccggcaccatcttgttcgaaggcacccacctcggcgtgcatccggcgcctgtggtggccgcgttctccgcgcgtggccccaatccccaatccccggaaatactcaagccagacctgattgcccccggcctaaacatcctcgccgcatggcccagcggcgtcgggccggccggcatcccctccgacggccgccgcacggaattcaacatcctctcgggcacgtccatggcttgcccgcacatctccggcctcgccgcattgctcaaggcggcgcatcctacctggagccccgcggcgatcaagtcagcgctcatgaccaccgcctacatcaaggacaacagcaacggcaccatggtggacgagtccacgggcgtcgtggccgacgtgttcgacttcggcgcagggcacgttgacccgatgcgcgccatggaccctggtctcgtctaccacatcacccccgtggactacgtcaacttcctctgcaacctgaactacgccgagcagaacatccgggcggtcacgcggcgccccgcggactgccgcggcgcgcggcgcgcggggcacgccgggaacctcaactacccgtccatgtccgccacgttcgccgcggacggcaccagggcgacgatgaagacccacttcatccggacggtgaccaacgtcggcggcgggcgcgcggtgtaccgcgcgacggtgaggtcgcccgaggggtgcgcggtgaccgtgcagccgcggcagctggcgttccggcgcgacgggcagaagctgagcttcacggtgcgggtggaggccgcggcgccagccaagaagatggagcccgggagctcgcaggtgaggagcggcgcggtgacgtggagcgacgggaggcacgccgtgaacaccccggtcgtcgtgacagtgcaagcgccgctgcagtaaagacgacaaatccgacgcgatcatctcagtgttgttcagtgagtgagacattgctccttggaccataattgcattagtatctagtagtgttagtattattattattatacatatgtataagcttaagctatactgggactctagctcagggttctgtaatcttcttcttctacctccctttcagtctcctcatcttgatcatctcttcttttcttctctgaagcatatgccattattatgtggttttgcagtggtgctactactaccaccacagtaccactacaatgtgagggttttcaagaggttttatgatgtgtgtaaagaggcaaggaattaatccaatcatctgtgctatcaacacccatggtcctcacctgagctcacatggacgtgtgagactcgattgagagatttggcccaacgtgtacttgctagtgtaccacctggatcaagcttaactgccttcaattcaacctacctcatcctcctcctcctgcctcttgaattttttgggaggagatggagggaaagccaaaggcggctgcctgccgctgctgctgggaggaggagcatcagcaaagcaaggcaaaaaatcatcatcatcatacgcggcgtggcttttccgaaaggggccttgcactgtgagagcaattacgtggcatcaatggcagcgaaagggggtggcaaaagctggtgcggtccggagaccaaaaatgaagcttgtgcctgggcggaacatgctgcaagttattgctgcaatgccgtgctcgggacaaggatttacttacagaagccgtcccttgacggtgctagtggccatacagagacttttgtgtgtaagggtggtgtggtttacctgtgctggtgggtgggtgactgttttgtgttcccccatgatgctaaacaactgatgataataaccgcttttagtagtactgctgctggatattgtatcgaataatgtttgttgagttgttgacttgatttgaccacatgtaagtagtgctacgtactccctccgtccataatacgagggattccctccgtcccataatataagagattttgagtgtactccctccgccccataatataaaggattttaagtttttcttgtactgtttaaccactcgtcttattaaaaattttttgaaattattatttatttattttgaattactttattatctaaagcatttaagcacaacttttcgtttttatatttgcataatttttttaataaaataagtggtcaaacaatataaacaaaaatttaaaatcacttatattataggacagagggagtacagaccatggctagtggattaatgtactatagtactctactactaggagattgtgaccagggaggcgatttttttttaattttcttttactgttgggatcacacgcacttgtggagctgtcgtgagtggaacacagaactacagaagaaatagtgcaccgagatctttttttttttactaccagaaatttatttcaactagaaacatagaacatgttcgatcatacaggtttccgatctgaagaggtttttcagagagcttcctttgcaccgtgcaagtgtaaccacgcggcattttcttgttggttcgttttattccatccggccagctctactaaacacaaacacaagtgcttatcaaagcacaggcatgtgttagctatgcccgtgatgctcacggctcacggctctaccatgttcacttaattctaccatctgctacacgcagttacatgcaaatgcaatgcgagacaagacttgtaattcttgcattgagcctcatgagtacacactattgaaactaaccccactcgtaacacatggatgcacgcgttaccaactaactcagggaggtaacaagactttgaacatgcacgtaaacttgcacgcgaatatgtatgcacggttacatcattagtacatgatagtgatactcaaaagtcaaaacgtgcactcggcagatatatcaacatgtagctatatattgcaaagacagtaactgtggcttctatctttcaaaaagaaaaggaaagaaaagaaaagaaaagaaaaagaaatgcggcatgcgaatctctaatagtcagcactcctaatggaaaaacaactgctctgactaacttgtttctaggcttacgtcttctttgtactttaacctttttcctcactgtcatcgccggatatcgaaattcaataggccaaatttaggggaaaataagcaatcacaaacgtggtgaaaacttgaaaactaccgttggatcgagaaatgaacatccgagattcgttcacgtcatcatgagtaaaaattttactcccaacaaaattttttactcatgagtaaatctgcgagtgaaatttttaatcgtgatgatgtggaagaatttcggacgtctatttttcgattcaacggtagttttcaagtttccatcacatatacagcttccaccatatattttctccaaattcagggggaataagtccacattgactcccttaaaagtgacccgaatctaatccgtgaccctcaaccgcaaaatggataggacgactcttcgaactattgaaactagtgcaatttgactccctcagcggttttgtagggcggttttactgatgtggcgttgacgtggcaatgttgacctagtcttcatctcatgtggcgcttctgtggcatttgaattaaaaaatatacgtggacccatctgtcattcataaaaaaaaatatattgtgggacccactgacatgcgggacccacgtgtcatcccctctctctccccttcaccggtctgcaggggcgggacttgacgggcggcgacagcaggcaggcgatagtagggaggcggcggcggcgagcaaccaatagtagcgcggcggcggtcgagggactagtcggcggcgggccagagcggcaacggtcgttgcgaggtccgtgcctttccccacacatggatctcgccgaagccgaggtgacgcagatgtttccctccatctcgccgatctcctagaacggtcgggcctccacctcgggcgacgcggggaactcgtgggggtagcctttctccgagtagtattagaggtcgaagccgatggaggtgtgccagaaggcgcggccgcggtcgccgaggaggaggactcgacctgctcgacgattgagatcccggaagagacgctccactcccatgtcctagaggaggaggaatccatgaagcccccgtcctcggcctcggcagtgctcgccgccgaccggctccagatcgacgccgccgacgcatctccccgccgaccgcccagccgtcgctcgtccttgggcaggccgcttcctcccacggcgacggcgagctgcgatcagggagcggggtagggagcagcgcgagggacgtcgctgcccgccgcagccttcgcttcgtcgcccgaacgcggacggctcagccatcgctcctcggggcgcgctgccgccgatctgcatgggacacctctgggagatcggcgagatggagggcaagagagaaagagaagagaaagggggagagaaagagagaagggagagggaggaggaagaagagaaagaggatgacgtgtggatcctatatgtcagtggggccgtggcctatatgtcagtggggcctatatgtgggtcctatatttttgtaatttaatgccacgtaagcgccacgtgggataaagattaggtcaatatcaccacgtcagcaccatatcagcaaaaccaccctccaaaaccgctgagggagttaaattgcaccggtttcaatagttcgaggagtcatcttatccggttttgctgttgatcagggtcatgtattagattagggtcacttttaagacagttaaagtggacttattccaattcagggcaagagcgggaccgattgctgatttgctgtctcatagatcgacacaatctaggggcccattatgctagccctgaaaaggtttcgtgaggacatgcttaagtgcagcccaattgtctctggacagccatggctccgcgacttaaagtgcagccctagtgaagtgatcagggcggaaggtctacgtgcaggggaataagttcactttaggtccctaaattagacaccgagtttgaaattcaaatataacgggtgcctcaacttacagaaccagtatgcccaaaattccaagcaatatagtgcttgattttaactaacgtggtgagtgagacctatatggagccccatatgtcaggcctatttctctttctctattatccctagtgagagtggattttaaactcttgagagtcgagagaacgtccccacgttgcttgcatgctatttaaatagttatgaacttttttaaaaaaataataagaagactatgaatacacgttttctagctgtaatttaatttgatttttcgttgcgactgttgaacttgaatgtttgtagagtgatatatcacatattaataaacattctcagtttttttaatttttcttaactatttaagtgacacgtaaataacgagggattgtttctcctctctgtatcttccataccccatctctcatatctctctccctcgccgcccccttctcatcggccccctgccacagtcgtagccggtcggaagcaggcccctcgtggcccccgcgtgacagctgcccagcactcgtagccgtgttcctccctttgcagggaaggcatcttcttgccggcccacactactggagaaatcatctttggtcgatcggccaaatttcacaatagtcccggttttattaaaaaccgagactaaaaaacatctttagtcccggttggtcacaccaaccgggaaaaaagatcggcatacgtggagatcgaggcatgcgtgcggatcggatcgagatagctatctcctccctcctcccggttctatctcctcctcctctcctttaactcctctcctcctctcctcacttaccatatctgttcctctccttctcattctcctcccctctcctccccacttctctgcacacccctcctccccacttctatgcacgcggcggccggctgcacggagggcggcgcccggtggccggcggaaggcggcaacctgcgtggcggcgtggccgtgcggcaggtggcggcctgcgcgggcggcgggcggcgaggcggcggccggattttttttttttttgagaatttgtgatttggatctgagatgtatttgatttgtgtgtaatatgaatatgtgatgtatttgtgatgaattttgtagaacttgtgatgtaattttttaaagattttgtgatgtatttggagatgatctatttgaggatttggaggtgataatcgatttgggattttacgatttggggatgggggatggagtgaaatcaatatattaaaaacaatgaagaaaagaagaaaaataaaagagcaaccgaacctagcccggctccatttcactaaccgggactaaagatagatttttactcccaattatttcacacgggaaacaggggttatccaccgggagtaaaaaacattttgctaaattggagtaacaacaaacaaagaagcgagcttcttgctgctgctagctaaccccgtatcctaccggcgctgcagccatcgagacgaccggttgtcgccgtccaaacccaacagacaagcgctccctttctcattcattgattcatttgtcaattaattagtgcgcatgcgcgaagatgaacgatcggctgctgctaagcttggtacgtaattctgcgcgcggcgtgtccgtatgatcaggtgagagattcattcaatttattttcagagatcgatccgacaatccatcagttcccaatatactgcaggatttttattttgcaatttgcatgccatgaggcacgcatgagcttactatacctatcttatacgcagcctgaggccatgccgacgccttcggagtcgatgtagccactggggaatcggggatgcctgagccagcctcgccttcgcggccatcggcgcgagctgtgttggcacaggagtgggtcgacgcggcgatggaggtaggccgcattcgaggtcgacctcgttgatctcacgagggtaggagcagctggcagccaccgcagcgctccttcccctccagctgctagccacgcctaccacgctggctccccgccggccatcgtcgcaagaaggtgaggactgaagaatagaggaagagaggtgcagggcctcatctttccgcttatacttatccttatctgccaaaatttaaatttgcaaccttaaatttgaaacggattttaaggtttttttatcgaagtttatttttcagccttttcttttggatcgataagaacacatatataaaagttttatttgcaaattacttttcgtttgtaaatatgccgatagctcctcaagagaggataggaacttgggaagaactagtagctgactcatcttaccacatcaattaaaatagtgcataatactaccaagaaccttaggtaatcggttttgtaaattaagagactgttatatctgatatttcggtttagagatgaatcttatactgggcgataattttagggacctaaagagaactatttaatgtgcaggctagaccgccatagtagttgggtcgtgacagagttgcgacttacgtgcgggtcataaactttgggccagaagcggagatgcgacttaggaggaaaaagtacaccgaaggtccctcaacttg

SEQ ID NO: 62305 - DNA, 2138 bp, Oryza sativa
tggccaccacagccgcagccgtcgccggccgtcgtcgcggcgccgccctcctcctctcccgcctcgccccgctgagctccgggccggccaccgcccttcaccgccggagttgcgatcaccgttgcctcgctggctcgccgcgcctcgcaagggaggaagagagagacaagaaaagaggggaaacagaaaagatgaagtgtcatactgacatgtggggcccacgtgggcccacgctgactcagctgccacgtaagacaaaactagggtcaaaactgccgagggacctattttgaccggttttgtatagttaagggaccctatatatctggttttgtggttggaggacgattttgtattcggatgacaagttgagggaccttcggtgtactttttccaacttaggagaacgtagtttacgtgcgtgcggtgtttgttgggccagatatgtgctgcgacatccgtatgggccatcatcaatttcatcactgcatgggccagtgggctgagcttagatgcgacatcgcaagtcgcctgtcgggccgtaacttccatgcacgaatgcatcgagctcagctgtggcctggaaatctgaattgatcgaatttgatcatctcactactccctccatcctctaatataagagattttcacattttacttgcactgttttaccattcgtcttatttaaaatattttaaaattattatttattttttacttactttattattcaaagtcttttaagcacaacttttcgtcttttatatttgcacaatttttttttaagtaagacgagtgatcaaatagtgtaagtaaaatgttaaaatcccttatattagggatggatggagtagtacagtaggtttcatggcgtgtgcattcgttttacgcatgacatgccttgatgcggaatgtgatgtgtgtctgtactgcagagtgtagttctttttgggccctgtttagttttcaaaaagtttttctcaaaaacatcacatcgaatttttggacacttccataaaacattaaatatagataaaaataaaaactaattgcatagttagagaggaaattgcgagacgaatcttttgagtctaattagttcatgattagccataagtgttacagtaacccacatgcgctaatgacgaattaattaggctcaaaagattcgtctcgcggtttctaggcaagttatgaaattagttttttcattcgtgtctgaaaactccttccgatatccggtcaaacgtccgatgtgacactcaacaattttcatttcgcgaactaaacggggccttggtgcggggtgcagactgcagtgtgtagtttagagaaggtttgctttgccctcctggactctcctatccacgcacatcatcatcattcatcatgcgcgaaccggaacaacgagagggtgaaaaaacgtgcggagcccatgccacgggagcactagtgcgatgcagctcatcgtctacggcggcggagcggaaatacttggaccctggagatcaaaacgccggagattcctgcgtgcgctgcgctcgccggattacacgagccacaattctatcgttcgcggtgactgacacacctgctcacatgcttgtcccgtcaagccttactttaaacttgaacattactatagtatttcaaaagaatgctactcctatttataaccacgtttcaaaagttaaaaaaaaatcgctatagtattattgtatttgtgctcctcgaaatttgaaaaaaacgagatgacaatggtgcatgtctaaatatctggctatttaatttgtagatgtatgcgcagccttcctgtgcttggccgcttgggccctgtcggtttgctcaccagctttggtccactccacccatcgtgcctggcagcgtttatgcgtagtagtacgtgcgcacacagttttgtgacacgagactgcgtgcgcagatgtctgggaggcgaattacaacatgtgtgtgcacataacgtaggggctggtgattggtaaatgctgacgacgcaaaataaatgacccgaaccacattctagacaatcaagtggggggtatagggtgtacgcactggtggagaagtgctttttagtcccggttcgtaaccccctgtagtcccggtatccgggacta

SEQ ID NO: 62306 - DNA, 2854 bp, Oryza sativa
ctatcctaaatataagcatttttagctataaatctggacaactgtatattcagattcatagctaaaagttgttacattttgggatagaggtagtacactcctagttctatagtactttctctgtaaaaaaatctctattttatcaaatcattattatagaatcttaaatatgtatcgaccttaagatgccaattttttagttgataactagtagtctggtatatagttatataggtatcagttattaaatcggtacctatactattatggctatgtttagatccaaactttggatccaaactttcaactttttctatcacatcaacttgtcatacacacacaacttttcagccacatcgtaccaatttcaacccaaactttcaactttggaaggaactaaaacagcctatgcattggtactcttaaattaattccggctgagaaaacggtacctatagccgattcttaactagcaccaataaaggttcctgccgtagtgaatcataatacaactatttctcattttatctattcccaatataattattatctattttgataaactctggcataatgattactttaaaaatagatttattttaaaataaataaaaggagttaaaaataaggttgtgtttagttcacgctaaaattgaaagtttggttgaaattggaataatgtgatggaaaagttggaagttcatgtgtaggaaagttttgatgtgatggaaaagttggaagtttaaagaaatattttggaactaaacacggcgtaaatgtattattgcgtgaaggaagtactagctactactccctccgtcccacaatataagggattttgagtttttgcttgcaacatttgaccactcgtcttatttaaattttttttacaaatataaaaaatgaaaagttgtcttaaagtactgtagataataaagtaagtcacaaataaaataaataataatttcaaaaattttaaataagacgagtgttcaaacgttgcatgtaaaaactcaaaatctcttatattataggacacatggagtactagctagcatcagcagcagtcgtgaccaaattcgtaagcatcgatctctgtcaagccttgctgtttactgtacgagtgaccacacaaacgaggagaagtgggtactcgtacgtagccatagctaacagctgtggctctgactcctctatctgaagttctgaacctctctataccgcccatgcctgtacgccctgagctgggaaaacgctcgcgccgctcgtactcctacaaaaaaaaaaaagcacgtacaacaaaccctgaacccacacggccgggcggccggatgaggccgcgacacgcagagccgagccgttgcgatgcgcgcggctgtacgctgccacttgcggcatgggcgcagggcgcatggcgtgcaggtagcgggctatcggccagagccagccggcaacgcggggcgcggcgggggcctgaacgactcttcgtcctctcgtcgtcttgtgatatctgagccctcgagccccgcatgcatatggtactcctagtagtacgcgcacgcggtgacgcggacgcaggctttccccgtcatatccctgcgtcctaccgaggcagcaggcggcatccgtctggttgcgatgcgagcgcccacgagaggccgccactgtcacgccctccatccccacgtaccgcgtcggtaggctagatgccctgtatggtgtactatactcgagcgggcaaggccaacgatactagtatgcgaaatcaaccaatctaataaaataaaccgcactgatgcatggggcctacctgtcatccgattaaagcccagtaccacctgggacccacctaattagcagttcttgttccttccttggaagggactcctatgcgtgagtgacctggcgaggcaatcggacttgcaattattggccacggtcaatcgaacctatagccacgtaaaaaaggagacgtcaaacaggatgaaaacacgttagttatggatttggataattgtgtgtctaatttatagccaaaagttattatattttgggacggaggtagcacctggtaaatcatagctctattttgcttttaaatcgttgtatttttttatttgcatctatgtccattatgtgtagtatgcccctaagtattacaaacatataaggtctacctcttccctttccacatctttttctgcctctccccttctcgttcctaggcgacgccgcttctcccgtcaactctcccttcccacagtggcgccgcctctcctctctctctctctttctcttaggtagcaccaccaagaaagcgtggatcaacgcatggatggctgatggacgagccggaggaggggatcgatgtggcaaagacgaataatcgacgacagaggtagggatcaacgtgacggctgtgtggatcaacgcatcggtggcagattgacgtggcggcgatcggccaagtagcaggcccgacacccgacggtggcagatcgatgcagcgatggccgacggagcttcttgggtaggctcttctcccccgtccatcccctttccatcttcttcctcggtgcgggagccacaacggtgtagggcgaggcctctccctaatacggtacctcgccctttcctcaccgtggctctgacgaaattacgtaaccctctggcagggggtcacgcagttttgcttgggtgcggtcccatccgagctgacacgaatattcctctcaggctgtcggtgacatggaaccgggagtatcatgactagaggcttgaggcagacacaatcgcccacgtggcctggcaccctcggggggcgtcgggcccgagggtgatgcgttcgccctcc

SEQ ID NO: 62307 - DNA, 5594 bp, Oryza sativa
gagcgtgtcacgtcgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgaatatgcagattgataaactgacacgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaaaaggtggggtaagtccccacaaaaaagagagaaatggtgcatgtggtatccccttaagatataaaaggaggaccttgcccactgagatgggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcacaggcgaggtgagatcatgctccagtttggagcattggccatggccttaagggcttgtttacctcattaccaattctccccccccccaaaaaaaacacaatatgttgaaaactggactagcacatcttaagattttatttaaatgtgtgcatgcatatccctatgagcacttataaaagctggattggtatatcttaaaatttacaaattcatcgtaaacttaatgagttgagctatgctcactgtgcacctcattgccaattctaaccaactaaattttggtctttttgaacacaccaactctctaagacataggaataggaaaaatgtatgaatagaatatatgtatattttaatccatagaaattttttaagaggtttgagtggatgaaaattttcctatgttttctctctacgaattgtaggaaaggaaattttttttctttgattttcctatacctacatttctatataccaaataacactcataggaactaattctaaggaatctaagtcctttagttttcctcccaaaacgaataggcccttaagaactttaccagaaaaaaggaagggtgcttgggatgaaagagtgcgcttgggactctctttattggattgattctggtttctttccatcaaccataaaactttagatccaatatctcgtgtgtatgagcaaagggtgtggccaagaagctggcagctgaccaagccccttcaaccctacctagctatattcactgtgcgaataaaacccaaaccaagcatatctcaacactaccaaattttagtcgatttgggttgagcaataaatcaaacaagtcttaagtgcattttgtacgcattttattatggttaattcgcttgtttctctgccaccaaagaaaggcacacctcaaaagagggcagggagttcccgctttatgttaagtataaaagcgtcgagtcaacttatgagaaaaactaggtaaaaaaaaaacttacatatgtatggttaattgagcaaagaaaaaacacggagagccaaaaccaaaaatatacatgtgacggcacaactgctaagacccgacacaagttatcgttgacgagcttatcacgagacaagcagatgtaacagggttgcattggcattaattacccaaggcttgattgggcattacccaattttggtagcaatcctaacataaacaaaacgcccatagctgtaccaacattttggatggtgataagatctttcacgtcccaaaatccacataatatgactccatccgatccatcgatattattctccaacataatggctgtcgtagctgatgaccctgtcgatctatgatcaatttgaggatagcatggtgccaaactgccaactatgtatgcatacacttgacatcaatcagatctggaacttaacttgtaggggctcgatccagggccctagctatagcttgctacattaagcaatcccgttgaaaattgcacgtagtacattacaaaaaatcggacatatatgggcgtatgttgctgtcaagccagggtttctctagctagatacttttcatctgacatttgatcttcctctgcaaccgcgactagccagccaccgataactaatctacgattaattagttttctaaatggaagaagtactaattgacgacatgaaagtatgaaacaatatatatgaaatcagtaagacatggcagcatgtagcagcgcatggctttgtcgatcgatcggtttcataattcatacgcttagcaaaatactaattaagtcgaaatgggccgcctctcaaacctctaactgaaacattttataatcaccgataaacgggtttaagatgaaattaactatgtattgtaaacacaacatgttttctttaatactgcatcctttctttttataattaggattttttaggacggatgttgaagcaccaaacttgtgtgtcgtctcccatgattgtgttgatgcgtgtcgaatcaaatcctactagttgacaagcatgggcataatagtattctcgtttgacgaaattgatcaagttatctttaaccactcctagtgtcggaacttattacaatattattagtggcagacctcaagcattttactattagaaggatgagcctgggaggttagagaagaatctaaaagtgcattgttagatgtgtctgtaacaaatcattagtaccaaaagatagatatgcagctaaatatagttaagctagctaggtgaagaagagaaggatacaatatatatacaattaaggccacaaagcaaggcaaatatgatgatgtccttttgttgcttcctctggccactcttgtggttggttcccttaattcttgcaatgggggattactgcatgattagctgattgccttttccattaattaatcaaactgcactggtgcatgcatgtaaggtggcacgttgtattttattttgtgctttggcctgccggctcactactgaattcaattgggtgtcccctctaaaataaaaggaggattgcattggggtgtctcgcactcgcaagtcatcaaagtagagcggttggtccttgaaaagaatacgaaatctatttggactttggactttagaagttaaggcaactaccattacattcagactgggacttttgggacagctgggatgctaaagcgatccctcatccatcgccgtacgtgcctgcaaattaaactccttttgccgtgtacaaaaatgtgtttagcataaactcgtacaatataattaaccagaggccaaaaagattatgtttttgtgtgcagagagcaggacagagtgttgattagcagctggaggacgtgcattactcaaatctgaaaacctcaatttgggttcagtttgttgcgtagctagctttgactgatgactctggacggcagctgatacgtggcatgcaattagctccatcattttggcgctaatttagcgaaatggacgcgtcagtgacagattatatcgtagcgcaacgcaatgacggcaccaaactaaagaaaaatttttcagagcaatttcggcgtgatattgatatgtggtgtgcaataaaggcaggaacagtatgagctcttgtaattgcctgcatacttgtttctgaattgtcactgttgcaatgtacaggtatcatggaaatgtcacgtcagtgcatgctggttgattgtttaaatcaagtcctaatccaatcaggataccaaacagttacactattcagtaccaaatctgcatagaaaacggaaattttcacaggatccatgcagatgcagggcggcgtcgcactcttgcatggaattcatgtgtttcagacatgacattatacctgtcaggattaaattggagagagcacattggttaatttcatgttgctcacttaatgcagtagtacctaattgatttagcacttgccaattggagtataattagcgaggaatcatcaaaatcataatgctaatactgtcgaacacaatcttgcgccacaagggcagatatctccgagcgattcccatgctatcctcgcttcgttctgcatcagctacagtacaagcgagaacgcatccggatcaaatctcctagctccggcggatcaaacagtgaacacttaccaacaaaaagaagcgatttgattaatggaaacctaagtagcagagcatcatatatctagatgaattaacaagagcaggggcggaattagccatggatggggaccctgtcccaacttccaggcacatgtctgtcactttcagcaatcttaatttcgtatttgctgatctatctatctatcagaaatggaatatagatttattatatatttttcttggaattttttggagacctggctgctctgtttgtgtgtctggtacgcacacgatgcaatatagaattgactaaagacgtcctgaatagttgatattcacgtttttcgctttggtagtttgatgtagacttttgtctgcatctgcagaagccacaattcaacttgaaagtgttgcgccgcatgcagctatattaagtttttcatatatattttttaattattgtcctcaatgtgtcgtcgatcagaaccactcgttagaaactacaaacactgtttatagattctttacggtttttatttttttcgtagagtgtagtttattgattggaactactattattatatactccattcagtattaaaaacatactactactgttttagatattcacaatattttaaaacaaatttaaacagtagtatatgcatattgcagcatatttataaaaggtgtacttctacaatgctctctactcgtggcataaacgatttaacacaactatctgtatataccaactgtggaaatgatctatgagaaaaggaaaatgagaagattgagaagatacgcaaaaaagataatggaaatgacaagattgagaagatacgtaaaaaaatgagccattagcgtatgattaattgactattaattatttaaaacttgataaatgaattgatatgattttttaaatgcaacttttctatataatatttttaaaggaaaaagtatgaattatccccccgaactatcacggtcgatcgaattacccccctgaaccacaaaaccagacatccttcacccgaactatgcaaactggacaaataacccatctagctcaatccacggtggttttggtactacatggtagtccagttagcaatttcttttttaaaaaaatcaacaggccccacatgttagtttcaccctctac

SEQ ID NO: 62308 - DNA, 4940 bp, Oryza sativa
gcgggctaattcgatcgactgtgatagttcagaggggtaaatcgtattttatcctttaaaaaataatgtttaacagttcaggaagcatgtactcataaaaacgagacaaatcttctccctttaattccatcctaaacaaacgttatcattgatttatgatttatgcgatgggtagaaaaactatttaaaaaagttctatggtttgcctttggcatgtgatccattacaagaatcgtcatctattaatgtggattcaacgaaatgccatcgaacacgtgcttctcttctctttcttttccatcattgtctagattcattaacatcaatatggatgtggaaaatgctaaaatgacttacattgtgaaacgaagggagtatattttacgagacaatcatggcttacataccctttccattctaaaatattttagcctaggacacgaattaatcctaggatatgtttcatttgatcttaagtaggactttcctgatcctctacatattcccaaaacagaggaatggaattacccctacttaagcttccaaacagggcattgactggtccagcaattccatgacgtttcattgtaccacccctccatttggatgtaggcacacagctaagctgcaagcctacatatagcatgtccaactcagtcataatttgttgcgttgctatgacgaccgcgacgaacttgcctcgatcagctgttctgctcatctgcatttctgcatacaggcacgcagccagttgtttatttgcagaaattcaggtttttggattatttccagtgcacgcatggaagtatagcaattaggccaagcaccagccaagatttgcatgagcctggccagtctgttgcacagttgcagactgcatgaggatatgcacaccagctgttccttgttttggtgcaccaattcttacagtcaaaactcaccaaaatttaagcagggagaagtcttcagaaagaaatactgtactacaacaaagctgtaagcacacaaattggaacagttagcaagtaccactccctctgtttttaaacacctggttatgctattactttattatcatgccgcacatttcagaaatttattaatttttcaacatttacaaatttattagcagctgaaataatgccaatggttgtcactgcgtgacttgtgagactaagggcatgttttgcacaactttagctccaattctagatttccttagctggagcctaactaaataattttagctccacataaaacatgaacagagttgggtggaacgctcctacaaaataaactagagagttcacagctccactctacccaactcctgaaactaaatttataaattggagctctacaaggacctaaaattaagggtgccaactattagagaatgttttcgcgaacgcaactagtattgaatgtaacaatctcgacgatgtttggatgaactagctgctctaaatttagaacttgaagctctaccaaggctcaaaattacaactgctgtagccgtgcgacaaccaggtcagccgaactccgccctcatttctcaagcagtacggatcatacctgaaatttaaatatataaaataaattcaaaaaacggagaattcgctacttgacagttcacccttcgctgtaacaccgtgagtttactgcaaccatattaccaggagccagccttgcaaacgcaagagaaaagagagagagaaaaaaaaaacaaattcagctctattcacctccgaacaaaacgctacagttgcctctccactgttgctcgctcagcgccaaactaatctccccggttataccgctcgccgacatgtgggccccacacccctcccccccttcttctcttctccctccccccatatatagcgagccagccttcctctccaccttcccaatcataatcatcatcgcctactccctctctctctctaaaacctcgctgtctttctctatctagcgggtcgcggtgagtcgtcgtcgtcgtcgccggcgatggggaagggaggcgggctgagcaagctgaggtgcatgatcaggaggtggcactcgtcgagccgcatcgcgcgggcgccgccgtcggcgggggagctggaggagggctcttttgcggcggcggggagggcggcgtcgttccacggcgcggacgaggtgcccaaggggctccacccggtgtacgtcggcaagtcgcggcggcggtacctcatcgccgaggagctcgtcggccacccgctgttccagaacctcgtcgaccgcaccggcggcggcggcggcggcggcgccgcgaccgtcgtcggctgcgaggtcgtgctgttcgagcacctgctctggatgctggagaacgccgacccgcagccggagtccctcgacgagctcgtcgagtactacgcctgctgagaaaggccgccgcgccgcgccgcgcggcttacctccccccaccaccaccggccgtgacggcggcggcgacgcgccggagttggaagcttccagaagctgcggtaaaatctttcgaaaaaaaaaatctgtgttttggtaggggtagaagtgaaatttcggacgccggggtcgaagtgaagagtacgaagcggcagctagcgttttttttttacttaaccccggcgtcggtgctaattggggaatttaccatttgttactgtgctgttaattctctgatcgttcatgtattagctattgggtttctcattatttctttattttgccccaaaataagatctatgggcaaacatgcccatcggtccaatgtacattccagtgtaaaaaattatcatgtaattgccgagttaatttgtcaccttctgctacattgtgcttaatagaaggctttcattatagggttgagattttttttagataatggaaacgggtaatatctccgtcctttgcccatatgcacatagccataggattgagaatgttctctttttgttcaatataatctgccctgtttcggtgctgatatgccatcacaaggtgataagagtttacgatttgtggcatgttgtcctatactaccttcatgtaatttctcactgagtaggaaatcttaaagtacttggatttcacgtggcaaatgattaatattaatttttttttgaccgtattgcttaacaaaagaatttcaaggatatcaatcaagggcctattcactttgatatcattttcaaccttaccaaattttgataaaattttcaaaaaaaaaagtggctatatttagtttgctaccaaattttaataactatataagaaatcctgctaaaattttgataagttatcaaaattttgacaatattttttttagcatcaaagtgaacatgtctcaagtattggtccatacatatcttgtaaagcaggcatgttatgtattctactctttccttatttcccttataaaatcatatatagaattccacttctacaggtgtagttgagaactgacctatacattgccgaggtgatttatcagatattaccttatttgtcgtcttttcacgtaacataactattcatcttatttaaaatattagtataaatatataaaaatataagttagtattgtaatttctttgatgataaaataactcataagaaagtaaataatatttatattttcaaataaaatgaatgattaaatattatttaaaaagtccatatggtcatacatgtttattggagggaccatttggatgacggccacctatacgagtgtatgccattctgtagattcatgatagtaatcttgtttattctaacttgatactactatcttatataccaggataaatctcctaaataaaaaaaagaggtccttgtatgctgcgtgctggtcatcgtaagattgggttgaattggaacaaaaatgcaagtgacctgatttaggacctctttaaatcaaagaatttatggagaaatttcctatttgtccctttgaatcaagggttaattggatcaatgccactacaaatatgtcaaattagaaaaatgtcactgctattcacgatattggttgggtaccactgcaattttaagaaattggagcgatgccactccgtcgcgttttctatccactccccgttaatgtagtcaattagtgttatattataatcctctgatttttccaattccttaatttttatcgttcttatgattcaaaggggcgttaaccaaagagagtgaagacactatacgcactatatatccaagtgagatctagcgcagttgttattgtgactgcacaataataactactattcgttccgcggttcaaggtcattgctacagtaacatctgaacatcactcaaggttacagtgtttttgctagctacagtagccaaacgcgtcttcacccttcgtgtcagatcctatgacgtgctactatacagtagccaaacgcatctgcgcccttcgttttagatcctatgatgcacgtttgtctgcttaatttgcagttacagatactaccaacgaatcaccaagttcacaggaactggatccggcactatcacgctcttggtttctccaatgaccacaatggtacttgtgcacgtaagaatctgattgactaaagataccatgaatcgctggtacatgacattttgatgttgacctgcgtctacgaagaaatttgtcattttttccctgcgtctacaaagaaatttaagtttacttttttgtgctgtgtaaatattagggatacgtccattttacaaccatcccataatataagacacgcacgcttttaagatttaacttttaaaatatttgatcaacaatttatacagtaggaattaaattttatttgatacaaataatatcattggattgaaatttaaatttactttcatatgattatttttttcaacaagctttatagtatatgtgaaattataagctaaatagtattatt

SEQ ID NO: 62309 - DNA, 14147 bp, Oryza sativa
  unsure (1)..(14147): unsure at all n locations
tgggtataaatacaagcccccctaggaggagaggggacaggaaacaatagatcaacatacaagccaacatacgccaagacaagctgccggatatcgacatcggagataagcctagttagtccccatacggttcctacgaccaccgtcaggagggatctagcgttgtctctgatctaaccggacacggattcgaggaggaagactactctgttgtcgactacgggatgggtttatgaccgccaagtcgacaacagatagataggttaccccaaatattgtactggtgtgattatgatgaataagagcaacaccggcttcggccaacaggatgtagggctattacctgtaataaggggcccgaacctgtataaaaatcctcatccccatctcttttacctcaatctcgcatatatcctagtaccaactgtcagggttatggataccacatacctaatagtagttgactaaatctcgacaggacccaccacttaccatgtcctatacgaaaacaaactgcagatataggaggagttccagataaggaaagacaacagagttctacatggaaacaacaagtactactcggattgtatccatattggtttccctagttctacttggacaaggggacacctatgagtataaatacaaggccttctacgagataggggagacagacaatcaatacccaccatagaagacacgaacaatagatcaagacagaagatcaacatacaagccaacatacgtcaagacaagatgccagatattgactttagagataggcacggctagtcccctacggtgtcccggatactatcaggagagacgaaagcgctatctctgatctcgccgggtacgaactcgaggaggaagactactctgttgtcgactacgagtcagacctttagaccgccatgtcgacaacagttagataggctaccccaaatattgtactggtgtgattatggtgaataagagcaataccggcttcggccaacaggatgtagggttattacctaacaattcaggggcccgaacctgtataaaaatcctcgtctctgtctcttttacctcagtctcgcgtatatcctagtaccaacgatccccatactatgcaaataccggaatcgcgacatcaaacgtcgacaccaacgatccccatactatgcaaataccgtagtcgtgacatcaaacgtcgacaaaaatgataaaaagatatgaaacaaaatggaaataattttgttatttttactgtccatttcctttggtttgccgagtttttaattattttggaaattactttttcacagtgtgataaattgtcgtatttataaatacccctagtaggctagtacatgcggctcatgtctccatttctgatactaatttttccatcttactacttttattatgtttcaaagaaaaagtatgatcaaggaaatggttcagcttgttgtacatgttccgaccgattcatccctaatacatttactcctatatgtgaaaacactctctttttttcaaatgttttggaagaccttttttttttttgcaaatttcaatgcgtttttttaaattatacagtacaacacaaacactcacaacgcacatacactcaccctctataaacgcacgtacgcaaaccctacccctatgagtactctttgaagattggaccggcaaatcatggggattaacgaagtcaccacagacgtctcgctgtcgatgggtacgttgtctaccaccgaaagaacaataccgctaaatcctaaaaaattaactttcatggagagtcgaacccagaaattaaggtgctactgaggctattataaccaccaaattacgtgtcctttcgtacgtactattttttaatatcgggcagcacggtgggacatgagattctctcctacctacgccaacttctcgccaaaataaaactgacgacacacaccagcgtagacagttgattagttgacccacattaattactgtgcgaagctggcgtccgcacaagagtcccacactcccatgcgcagccgacaagaggtactccctccgtctccgtttcaggttaacgttttaactttgatcaaagttaaattattttaaatttaattaaatttatagaagaaatagtaacatttaattattaacttgatgacactaatttagtaaatattactatatttatatataaactcagttaaatttaaaatagtttgactttgatcaaagtcaaaacgtcttataagctaaaaggaggaagtagtatatattggtattgctcttcgcttactgctatttatgaaattatcaggttttaacgttaccgaaatttggtagaggtaactaaccaaacataactttatcattgctatcgtatcaaatcaaacaaacattgataattccgaaagttctctaaaaaaaactctattaaattttagtaaggcttcaaaccaatcaaaaccaacgctaacaaattttggtaagattgattttaacagtaaagtgaacaagctctactagtactttcttctcaattcacccctccaacaaatgcctaattatatgggcacagtctgtttcttcctcaatctactcccctagccgattcctaattatataggtctggcctgtcgtaaaacagggatacaaatatcttactagcatgagtaataatgcagtgcccgtgcgttaaggatgttcgtgcatggccgccgacagacgctgaggcagaggagtggaaaaacacactggctgatggactcaaatgagtgctagagatgcaggtgctgcaacagggaagccgtagaacaagtgcagcagccaagaaagttctcagccagctctgcagttcatgatggggaaggagggaggcccatccatcgatctagcttgtactactaaggccctgtttatattttaactttttttcttcagatttttaacttttctatcacattaaacttttctaacacacacaaacttctcacttttctgtcacattattccaatttcttcaaacttctaattttggcgcggaactaaacatagcttaactctgtgtatgtatgttagctgaaactgcaaagtgtgtgcaagctcatttcgaagctgcctgcatgctatcttcttttctttatttttgttaactaaagacttatctgcttataatcatcacccattgcaatgataaatcaaccaaagcagcgagcatgcactccaactaattaacaattgcttgaccggtcctatactcctattctcatatggaccacggccaaccaatgactagctccattgatcctcatgttaggggacacaagattaatatatctatctaagctagctaagaacacatttcatttcagtgagttcaatattgacaacttggattgcctcttaaaggatggcacgcacgatcggagacggctttgctctggccatcatatcccggcgattaaacaaatcaagtttttttttatatgttcagaactttaaacaaatcaagtggtgctatctagctaagctaggacaaacgaaggctctcatggtctcatcctgtttcagtgtagtagcttgctaaccgaaatggaggttttgaatttggttaaattaggttcgaagtcggttgattaagtatgattttggagcataatttgacggtgatgtttgatcatcttcctggaggagaatattttgatgatcgattcggttttacattggctgccggctggccgatcgagttagctggccgctgcctggtgatagtaggtggactgtcttaagtacatgcatgatagctaacacatatccaaccaatccaaaattttggtttgagatctcttaagcttaggtgaacacaaacaatcgtccatgcaatcttatttggaatctactgtgcactgaagtccttttccatcaaaaatcaacgtctagatctcaaaggattttgtagtacagtgtatacaatactgacctgtacaattgtactactatccagtggctctggacatgaaccagctttaagattcgtgcgatgcagagtacgcttgtactagtacattcaaaggaggaaaacgatgtacattggcggctaataactggcactggcctagtcaatatcgtatctgtgcgtacgattaacacctgtaagcaattagagcaagctatagtgagtgcccctgttttgattctttcgtcttttcagcaagcacaatatatcctttgctggaatgcaacaggagcattaaatcgtaagtgatttaattaatttgatcgtgtacaaatcttggaattaatagggatccgtttggggccgtgacacactctagctgtacggttaattaccatgtgtagactcagcttatagcaaggtcgatcgatagtacacctagagtatagccaaaccattgaaccacactacagctataaaaattttcggcaaaatttaccacatgacacgcaaaaaacgtgtaattggctagaagacaccgcaaaaacgtgacacggctgatggacactataaaaaaacgtgttaattggccgtaggacaccggtcttgttattttattatttctgggtcaaaagtggtgataaaattttcaaaatagcgagattgcccctggcgccatcttcccccacctgaaatcacaaaagttttgttgttgacggcgaggtagctggcgtggaggtggcagacagcacggaggtggacgtggtcggggagggatgggaggtggagcagcacgatccctagcagttggaggagcatgagatcctggcacggtggcgaaggctgctgcgctgtcgccatcctcctcctcatcgttggcggcggtgtggagcggcagacggcgcggatgcggacgtggtcagggagggatgagaggtggaggagcacgagccctcgcagatccgccaagaaatcctgccacggcagtgaaggctgttgcgccgccgccatcctcctcattgtcgccagtgccggcggcggcggcatggagcggcagatggcgcggatacagacgtggtcggggagggacgggaggtggaggagcacaagccctcgcagatccgccgagagatcctgccacagcggcgaaggctactgcgccgccgccaccctcctcgtcgtcgtcggtgccgccggcggcggtgtggagtgcgaggaggaggtggctgccaatgtcgtcatcgtcggtgccggcggcggtggcgtggagtgcgaggaggaggtggccgccagtgtcgtcatcgtcggtgccggtggcggtggtgtggagtgcgaggaggaggtggccgccagtgtcgccccaccgtgcctccgaggccaccatgctgttcccggcgaagtcaatgggaaggagaaaagaaggaaagagaaggagaaaaagaaggaaagaaggggcaatccgggtatttagaaaaatatatcatctcttttgactcggaaataataaaataatacgactagtgtcctatggtcaattaaacgtttttttgtagtgtccattagccgtttcactttttgtggtatctcccagcaaattacacttttttgcgtaccctatggcaaatttaccaaaattttcatatcatctttagcccatttaattgctcacttatataatatttaactatagatacatgctatgttattaatactttaactatctcgttctcccacaaagttaattggttttgaggttatggttcaactgacccgtttctcttctctctcctcctcgcccaattctattttagcataaatttattgtggcaagtcctgtagcctacttacttgcttgtaggccactcccattgaagtgagagatacaacgaatttcatctaaacgaaagtatgtctacaccgtttctaatacagtttgtctcttgcatgtataatgtattcactgctaaatacaagttcttcttttggtttgcatttcagcaacgctgctggactgttgatcttcttcagaagcggggtatcgataaccactctgcttgcctcttttgcgcttaggagcttgagacggcgaaccacatccttcttgactatgtgttcactcatcaggtctatctccgtgtgctatcacctcctggctgagatgccctctcttccccgtgacagctggctatagaactggtggccatcctccaggtcctgtttacttgaacacttccgcatcggcttcgactccttggtactcctggtctcttggctgtggaaggaacgaaactccaggattttcgactccgcgcttgcttcgatctctgtggttatggagtccatccgctcagagggccagctttggtctttagctagcattgccgcttttagggattttctgggagtgtagcgtggttctgccccttcccacacttcggagttgcatttttagccgtcgtagtactttcctagctttggtttttgttttgttttttttcttcccttggtataggccggtctgtccgattacgttgtgtaatagaactcttttctttctactatattgacgtacgatcattttacgcgtttgaaaagaaaatattacctactatgaaataacaaaaatgaaactatgcattgcatgtgttatttcaatcattaattaattaattaaatgttttgttgcttatatggtaccgttgaaaacataaaaatgacatctactgggaatggtattacgctcttaatttggttcagatcttgaaccgaccagctaaaattaacctaattagttattagggcatcggacgcgcttttttttttttgtaataatatgctcactgttagcttgtacactgtaccagtactacaacaaacctatgattgtaataagtctatttaaagcaccacaagacaaaaaaaatattactattgctaagttttcgtacgacaaggggacggagaagacaagctaatatgccattagctatgtagcttgaagagctgttgcagtctgctaggacatgcttaatcggaacacaagaacttgatcggtacatcgtgtgctagttgtgtttgtaaaagcaatgaaaacaacacgggttaagcggttattgatgggtgcaaaccggtaaaatatgacagaatttgtgagataaacgcaataaccaggaggttgttggtgattagtcgaggattggtatatatttgaagcctgattggttttgctaatcctagctgctagtattatgcatagttgttctctctaaatattttaggaaaaattacgacttaccttgctaaactattacgacattatgaattatcccttaaccataaaaccggacatttaaatccctaaactatctataatggatgaataaccccctcgacctaatccggagctgttttgtcataagtgatgtacgcaaccaacaattttctttaaaaaaaattggtgagacccacttgtcagactctctctcctctctctctatcccctcttcccctctctctcaagggcgttgtcgggagtgtcaaccaagtcgccgacgatgggcagtcgtgaaggtgcgcagagcaaacggtggaggcggcggcctagaatggcggcgcagggagcagtgtggtggtggtggagattggtccatggcggcgaggtggagaggatccggtggctggtgacggaggcgggggtcgatggcaccattgacgaggagctcacgtgatcccaggtggagagcagaggatggtgtcggcagagggcaggcctgccctccacctgggcaccggaaggatggcgctgcnaatggcggcgacggcttgggcgagggaggccgacaacagaggacccggatgagggcacaacagtggtctcctggccaccacccgcctctctgccacgcccaccgctcgctgcaccaccgccacacccgtagtggcccagcagccaccgccctcgagaaaaaggggaagaggggaaatagagagaggagagaaagtctgacaggtgagccccatcatttttttaaaataaaaatgctggttggattgctacatgtatgtcacgtagaacaaaaccaaccggattgggttgaggcgggttattcatccggtatagacagtttagggtttaaaatatccagttttgtggtttagagggataattcgtactgttacaatagttcagctgggtaattcgtacttttttcaatattttactacttatgttcccaaaaaggataatatccaacctcaaaattttagatcattaagagattaaacggtattaggatttaataggtcaaaaatgcattaatagatttgtcatgaaacatggtttcagatggttatattgacgaaaacaacacgggttccgcggttattgatcggtgcaaacaggtaaaattgaacaaaatgtttgagataaacgcaataactaggaggttggtgatgattggacaaaattttatcttgatcgatcctttagtttgtatctaaaacagaggatgaaaattaataaaaggtgccctacaccaaggtcgaatgtttacgattccgatcaattttcatgaaaaccgctaggttctgatttacgaaagccgagcagttttacctggtttttgaaattaaccgaaaaagagaaatgctatagaacaatatctcgttgggacaggatgatacctcactcgtattatcttatacctagtaggtggctgatatatcccgttcggacgggatgatacctatcacttgatacctgatagttatcggttgataccgagatattatatgatacctcatacctagaaggtaccattccgtccgaacggaataccgtccaatagtattggagtaccgaaaaattatcatcggtttctactagtttccaccggttttggataaacaaccggcgggccggtttttggatcgaaaccggtgatgtgaaccctgccctacacgaaacaatgggctccttatccctggccataataatgctcgctgctgttcgacataaatagtgtgggtgatggcaaaatatccatcgacccgtccgtgcgagccgagctgccgaggtacgtacagttggcgtaatgatctcgttgcccactcacaacttggaaggagctcctgttctccatgatgatgatgtttaagttagttgctcgttcagttcactcctccatactcaattctcatgtactcctatcgcttcaagcataagctgcatgacaacggagggcctacagccgcgtaggccacaaaatgcaggccctcccgttcttagggcccgtttagttccaaaaagttttttctcaaaacatcacatcgaatttttagacacatgcatagagtattaaatataaataaataaaaagaaaaactaattacacagttatgggggaaatagcgagacgaatcttttaagcctaattagtccgtgattagccataagttctacagtaacccacatgtgctaatgacggcttaattagactcaaaagattcgtctcgcggtttcccggcgagttctgaaattagttttttcattcgtgtccgaaaactccttccgacatccggttaaacgtccgatgtgacacccaaaaattttcttttctccaactaaacacgcccttaattccttcccgaaagtagctgcagtgttcactcctcttacgggcccaaccatcctgacaaactgccggccttcggcgacacgctattgttagcttttttttttttaagaaacacagtaccaacgcacgcgcttataacgcgcgcatactcactcctatgaaggctcacacgcacaacttatctctatgagcacctttgaaagactgggtcgacatatttgaaattgacgaagtcaccgtaggtgcctcgttgtcgatggaccactgaaagaataattagttataaatacgagcaccggtaccaaatctagaatttaaacccgaacgagctggttccaccataataaatctaaccaattgaattgaattatgctcattttcgtgtgaacttgtttagtatcgaacccagtggcggatctgttattggacgacaggggcacatttaaagggctcagtttgagttagggtttacaatttcgaaattggatttttttgccgggtggaccgaaatttcggaaattccaaatttttttggacgaaattatttgaaattttgactgattttgaatgaatttaaataaaagctgaccaaattcacaaaaaattgcaaaaccctgaaaatttcgggtgagatgtgagcttgctggtgggggacgaaattaccgaaatttcagaaatttagaaacgaaaccctggtttgagtatgacacgaatcaactaggtaaaaaaatgagtaataatccagaacctttaatttgcatgttgaaagaaatgaaagaaatttgcgtggggccaacgtggaagcttatttaccctataattcaccaactgtgtcttatatcctcattcctcattgatcggtcaggatcacccaaatcaaatccaacggcccacgttactcccaccttccccatactctctctctctctccgcaaactctgccccatacagatcgcctcacgcacaatcgcgcaatctccgctcccgctctcgcatcgctccctctctgcgccatcgctagcgctagccgtcgcctcaactcgccgccgccgccaatcgatcatcgccatcgctccctctttcccatcgctagcgcagccgtcgcctcaactcgccgccgccgccaacgacgaccaacgacgtccacgtcgtcgatctcctccgcacctccgccggaactccctcaccgatctgctccccccgcaccgatttctcccgtccgcatcgccaccgacggtcgcctttgccgatctactccgcgcccctgcctggacacccacgcgaccatgcccaaggtgtcataggccgattccgaacaggtacaatatccattcaataaatttgtgctcacaagaatttgactacgttaagatctgaattcctgcttttttgagttctaaattttgtaatgcagataaaatagtgttacagagaatttggtaatgcagataaaataatgttacagagcccttcttttacaactggaccccctccatccctttgtgtcatcaaatgggttatttgtatactacaaattctgggaatcaattgagttccgttgtactattgcaactggtaataggattttattaccgtactccattttactacaagttgcaaaataggacggtgatacaggtaatcaaattgaagcgacaaatctatagttttccctcgtatatcctattttgtacaatgacaaagtatttgtccgaaaattctttttcacctttgtttatttgagattgacctcgggatataatttgtctcctatgtttcagcagtaattcactaggtttatcccttgatgaacacaatttctatatattatgaatatcgggaggggttttgattttggaccagacatttcgagttgcttgctcctttgaagaatcatgctacaaggcctggtaatcaggagttccaaaaaacatactcgaactggcttttttaaaaaacttgttttaagatcacttatgaacttagtataatactcactttcaagtttatgtgaggccttgtcaatacgtatatctaaagtctgaacatgctagaaaatataattattgcattcttttcttattatatgtttgtttttaagctacagtgaaagtattgactgttgtatacttgtgtgaactaatctatattaacagtttatattggccatgtagttacagagtgctaggctatggcagcggcatggcaaatacctggctgcatcttcactggcttttttcgctcggcaaatgtatttctgatttttccaagtcgtagttttttccatacatagaagtaaactgtgctcccaatgttttctgtctcatttattgctttcaaaacagaaatgaggccaattgtagaaaatgtattgtgctggaagttgtggctaggaaaaatggctgctgggctaattgtactgagttacctattaatgttagttggataaaccaattagtacttcttttatcaaaaaatgatgtttttaatttatgtatagtagtaactctgatcatgtttttttatgtcatcatgatcaatgaatattttcatttgttgaggttagccttgtaggtttatacccatttttcatgattacatatccatatgccatgtttggtgttgataattcaccagttccttatatagttttacatgaaaatctttaggaaggtcggaaacaacagtgcaagcatgacttcctatcgattgttgtgcaacgttgatgatgttttgtagctcatgatgtgatttatggctgattagtacttttgctgctacatattttgtcaaaatacatgccattagattggtgtccagtgaatttattaggttgtgtgaccagtgcagataaatttgaagtgtgtactcttttctaaagtgaacagcgcatgttgcagccttcagtgatccaaacatctaaatcagtgagtttcagctgtctcttttacttctgagcatgatgaagggctttaattatattaccctcttattatccagatatagtaatatgatatgtctaagccatctatcttccttctttgtatgaagggcatgcggtacattcatgtgttcttgaaaaagtgtaaacatatcaattctgaaatttcagggaaacctccatagatttgattttggtcagtttgtaaatagcggtaatgctcaatctctgatttagactttagaacaggaactatttcctaatcaataatgctcaactccctacgtacatctaatattttactttacaaggctcaactattttttctgttttatgggaagacgaaataccctggtacggttttaaattagacatgtaattttacactgaacatctctgctctaccaacatagttaaaattttgtcaaattactttcacctcactgcaaaagtggaggaaaaggctacaagacatgtgtggcctaccagtagaagcagtaccaaaaaggccattgagttgaaggtattataaatttttcagtcttcttcacatcaattatccgaatggcattatttcatagatcatgatatatggtatgagattaggagcagaagttgactctggtgatgcagcagctactgggtcccaacggggatgcttaacaattgaatatcttataatgaatcatgtaatttttaatgtctgcagttttacaagaacctctctaacaccttaaaggatgttgtttagaaatcagacaatcctcaaagtcaaccttcctagagtaacttgggagaatagggatgggtgaactaccatcttattcttttgaatcaatgttcctgtttttagaggctagaaaaggagaaaggatgtttattgcacttgtaactagatgtgaatggccctgtaaactatgtttggtctccactattgttgtatgtgctcttatttataagagaatccttatccttgtgacagctcaagcgaagttgatcatgcaatgggttttatgtatcatgaagttttgtattaaattagtatattgtgagcaacaagtatgatttgttggccactatgaaattgtttgattctcaacattaatctatttttctatctatcaccgttgtgttatgaaaaatcgccgtagcgttagcaggggaatattactagttagacaaggtcgtccccaacgtggagggctggaaagcgcaggcccatcacccatcaagcaggaagcagctgaacaaacttggagcataattgagggatgtcaggtgaacatattccacaaatctttggagaaaatagcaaattcaaagcccgttaggaaacagcctgtttgtagcccaatttaatactacaaattgctatacaatgtaggaataagttcaccagagttccctcaacttagctgcaagattttttgaggtcccttaaccacaaaaccagaaatgtgtacccctgaacttatacaaccgtacacataaggttgtatggcagtatatatgggtggtttcgctgatgtagcatcctagtcagcaaaataatttaaaaaggtacgtgaggcccacatatcatctgcacatactccctccgtttaaaattgtt

SEQ ID NO: 62310 - DNA, 3118 bp, Oryza sativa
aatccaacgacctatcatcttaatgattttctcgaatttaatgcgtgactctccattcttccatacatgattggctacataggcattgagaaatgtaaatattaattaatcgcttgtttacgaggaatgactagtagcatatttaaatggatgataagtacaattacttatccttggtctgtgtgtcaagataaaatatgactattaaaagtagatggagggagtataaatcaataattcaacatggaagagaaaaagttaatactagtgaccatcttgagggatccggctgatgctaccgatcaagcaagttggtaccgcacgattcactcctcagtttgccatgaacaacttgcacgtaaaaggttgctttcgatcgagcacaagtgaaaaggattaacgaatatatgatctataattctgtatcctgcctaagtagctaggttaggtctgtggttaatttcctttcttcaataatactagccacttaaagtcatgcaaacgcgctgacatgagatgtcatctttattaaaaatcctaaaattgttttgtctttataattatagtggtcttttcactaaatgttacttattgcgaagtagtccatatgttacatatagtactactacgcgatattattccttttttttttggcacaacaatcattcttatttcatgtctcaaaattaatcagcaatagactacttagtgcagcccattaagtgcccaattagtaaatgggatctaaatagcaagaatttgtagtattttggcttgatttttcaatcaaatgccctttgacacatccagatagaataaaaatagagagagctggcattcccctctccacagaactttaaatcgaaatataaaaatggccaaactgcgctaaaaaaaattccaaaatacaacagagaaaacatcactaaaatttatccttacccatttttaacgaattggtacagagtgtgtcaatttgattgacaaaagcaggagaaaatcgagttgtacaggtataaaagggaaacttcacacaacgaaaaaggttaagctataagctctgaaagatgttttgctccctcaaggcctatattttggcctgaaagatgttttgctccctcaaggtctagattttggcctgctccttgatctttgtgctcaccgctattgctgagagttctttatgttagaatattcttcggttttcctctttagagatttcccacgccgtaagaaggatgagagtgtgcaccctttttttaaggcctcagcccgtggccagcatcacccaccattcatagattgccgtggttgcgctccatattttcaggttgatttgctcacgtgatgtccaagtgaaatcttgtttgagattttcctcatatacatacactctgtaagtatgtggaaggatgtttctttggtgtattggcagagtgtgcaataaatattatttggccaaccacatattgttaatttatcaaacatctatactctgttttgcaccattaacatatgaaaacacactatatcttttgttcgatattctctataaattttcttataatcatttgcatgcattactagaactaactatattccataccgcttcttctactagggaatagcctgaaactagtagggaaactagttccctatgttttttcatagggaaccctttcatggggaaagatttctggggtaatagaagtgccctaccgttatagctctaaaagcgtaggaaaatttcatagggtttgaaatggtacggaactttgcttacatagcattgtatccagtatgtatagtaactttccttaggtttctaaaactgcaaggatatttttatttaatatattttcctgctcatgatacctcaattatttcccttcaaaacgttaaaatagtaggttcacacttacatcagggtttacacttccatgctattagttcaaacattctaaaatcaaaatgggataagatctttcaaaggaggggagtagtttccaccagcatggctagatgcattaacatacctagagaaattctggccaaagtactttctgaattctcttttttctaatagtggatgggcggggatgatggtgaagaaataatttgagctacaaagcatgattttttggtgaaaagtttagggattatatggagggcggccatgggaaccagggataaccagaagtgatggcatgtgtgaagcatgtcccctaatttcacctgactagggagagatttgttagaggcagctagagtttttctctatggaataggctttgttcggaagtcccctttctcaactttttctttttttttgcgcgcacgattttaaactgctagataaagtgtttttttataaaaaaaaagttgctttaaaaatcatatcaatctattttaaagtattttttaactaatatacttaattaatcatgcattaaaatatcgctccgttataagtgcaagtgatggagccatggaagttgctaacccatgcaaacgaaagcagccttaggcaggagcttgtatggagaggagagagatatatcaacggaaatatgctattggaaaataattggattgacctatgacatggaggaaaatgaaaaaagaactagtgagaacactaatattttggacactaatacggtaagtttggtgggccgtttgttccttacgaatattgtaaaactgggagagaagaaaaatctccctacattcctagaatggtttgagggctgctacaaaacgggatcccgttgcaacgggatagacatattaactattttcttgcacaggtatcgtgtaccatgtagctggtatcataacaggtatcaggtactgtctcataaaaggatatctcgttccaacggaataccgttgtctaggttttctgaatggtttagtacgtgaatttctatttccctttacctacacacactctaataggcaaataattaatcggtaaggaacacggcgatttttaccaccgttgtggcggaaaatgtgggttacccgaagtaaaaagcggagtgcccggaagccggagcaccctattctgttgctcccgggagccacttaaatgccccctctcggagcatgctgg

SEQ ID NO: 62311 - DNA, 27045 bp, Oryza sativa
  unsure (1)..(27045): unsure at all n locations
cccgcggccttagctagcaaaccagcgtgctcctcctctcctccacacacaatccgatcggtagccgcgggctcgttgttgcgatggccggcaagaacgggagcctctacgcggtgctcggcgtcgccagcgactgctccgacgccgacctgcgcaccgcctaccgcaagctcgccatggtacggtgctgattcctctgctttgctctgttttttttttttttgccgatttaaccgtctcccagtggctgtttgtctccgggcagaaatggcacccggacaagtgcggcgccgccgggagctcagccggcggcggtgcagaggcggccaaggtgaggttccagaagatccagggagcctacgccggtaattaaatctcagccaccttcttcgtcttcctctgcttctgaccagtgctcagagcacaagctgccattgatttcggacgctgagatttttttttagcttctcgttgatcggtcttcgctgctgttacggtctgtccgttcccgttgtttcaccattctgacagcgacgtggttttaactgaacagtgctctccgatcccaacaagaggatcctctatgacgtcggagcctacgacagcgacggcgatgatgatgtaacagcattttccggccttttttatctctttttttttgcaccaatcaatgataaagatattttgtggccggcttgtgtgctgacttggtcgtgccaattcacgtgcagggcgccggtgaaattctcggcgacattctcgaggccatgaacaaaaccggccctacggtaacaaacctatctgaattcgaatttcgacgtgaactttaaaaattcgatgtaaattcacaccctgttcatgcatgttggtgtggtgaacgcgtgcgcaggagaatggcaagaacgagagcttcgaagacctgcagaggcagttcgaggagctgttcctccggccgccggcgccggcgccgccgacgtcgtcgtcgttccggtcggcggtacgtgactgtcgtgtcgtacaccactgattcctctgactgatacgacgagacacagcagttacctagctgtatgtcctttctgattagtgactaaacaggccatctttttcttcagaaattaactttcccattttttttagagtgtgcgtcgctttctctgacaactgtttgcacacaagcatgtcgggagaagagcacgagctgtcgttttatacggcatgcaaattacagtaatggttaggtgcattgcatcctcttgcctgcccaagcttagagaagattatccataaacagtttggtcgcttaattaattataagcacagaataggttttcttgcgctacatggacactgattacgtacacaagatttaataacccttgactaactctgtatttctatctgtgcctgataatctgcagcaagaggacgctgggaagtcttcaaagagaagggccggaagaacgtagaagtacgtacttttggccgaagatttttgtactgcaacatttttgaatctatttcgtacgtgcagtgctcaagacgaccgtcatttgtgctaataattaagctgattgatcaagaagaaaacgattcagataatgatatgacgcactgatgatctagggcagtaacctgtaatctcaataacacctttggcagacgtcattcggtttgcatgtatgcgggtggctattaatttgcctagctagaaattggccaatttaaagtttggccacacgtcaattcttatatgaatatgtgcaatattgtcaaatctgggtacttctccctgatgaattaaatgaagaaaaatgagggctaatgatcaacagattatccagattcatacccaaaatttattatattttgggatcggtggaggcagtattattgattggaatgttcagttgtccatccatgtgcagtataagaaatattgaggtgggggcagtaaaagattattttaaatttccatgcaattttgcatagaacaaaaaaaaaagaattgagtttgatataatactctttagcttccatttccaaagatacactattttaaaaatagaattggatttatatgcaactcttaatttcaacctcaatagataaaatttcctcccaacgttttttagataataaaattggttcacatctctgatctctatcaataggcaagaaaccaatcagttctaaaacataaataaaataactcgagaatatgggacattcacatctccctcctaataagatccagttgaaaaatactaggccgtttctatgaatttgaggccacagtgtgaaatacaaaaggcaccgtatttatatataaagtcacatctccaaatttattctacatatggagcatcaaaaaagaaaacattatgaaatatttatacacttgatgctgtcagaaattttatctattttatggataaaatataatgaattgagtatatttcacaaaactatatgtattttggccgaattatcgcaaaactataaatttaagacgttgtaccacaaaactacagatttaagaccaaacataaaaaaacactatagatttaatacttaaatatcacaaaactactgtttaaatttctaccactactattttgtaagagtcataagtgttgtagttttgtatttcatttggtgcaaaacatgtagttttgagataattttgtttctaaacatgtagtttcatgaaacttcatcttaaatatgtagttcttcgataattttgattctaaacctgtagttttgtgatacatcaccttaaatatgtagttttgtgatagattgagaaaagtacatgtagttttatgaaatttactctagtgaatttgagggtaagattttacacataatgcttttgaaagtacatgacaattcttttctcgattttttttaaatatttattagttggtgtgtacggtgtttacacagaaaacttttgtgcacatgatacgatacgttctccagtaactgaactcaaaatataaacgatatttgaattaaggaaagatttgctacaggacatccaaaaaaacgtataattagctaagggacattgcaaaaacacgtatttgatgtgaggcaccgcaaaaaaaattggtaattagttgctagacacccgcaccactattttattatatctagagtaaatggagagagagaaacaaccacaaaagtatgattttgctccagccggccatgtagctcgcatatagctccgataccgcggtggccacgagatgtccggaaccgacgcagccctcatactgcagcgatgatgagtgcaggaatgacgctaagccacgggcccactcaagtgggccccctcgaaccccctagagagccgcctccctggtgacgacggcgcgtgtcgcggcgctgcggtgagaccaactgcgaccgcctgcactccatggtgtcctgctcgagatgaaccaggaggtggtcacacattgtgcttgcctgcaagggtagtatgtggcgaagcaccatcgtcggtgtggccctcgcactgcagcggcaacgagttcaggaacgacgcgaagctataggcccagggaggtcctctcaaacccccccaagagagccagcgacaacggcgggtgggacgacagcgtcgtagctgtatgcaaggtggacttggcatgcagggcaaaattgtacttttgtgactatttctctcactattttctttggatattataaaataataccgcaggcatctaacatataattatcagtttttttatgtcccatagcataacatgtttttcgatgtttcctaactaattatattccttttaatttcttatagtaaattttaccaaaaagaaattaaattcgcagataacgacgatagcaatcacgtcgcccttttcgctacaattaataataagggtcgcacgcatagacgtactacatctacgtctacgtgttagtacatgacagaaggcaaaggaagaccctcgaagaacatgggcatctcaactggacagggcagcttttggcattgatgataccggggacccattttatgtgtgtgtggatggatcagtgctgagaaacctgtgatggtcatcgatcagagaccagcagttgcaggaacacaacgccgcgcaccttctagctacctacacatgccaaaatttaacttggccggccgtccgcgagcttaatttctagccaatctcttatagctgattggttggcctgttgctggcacaagcactgaccacacatgtttttctgcatacaccagatcaaacctatcatgatagttcatcgctggatttttcacaatttgatctttttgaaaactttattttacaaatagactcttaaaatacttatcttagaaatgatccttttttggacgccagagtcgcgccgtggtccaattggatggcgccagcaactctggcacagttctcctaccaccgtgatgactggtcggcgccgacgtggcaggggaaacgcgccaatgaggttggcgccgccccctcccgcacccacgccatttttttcctcctccctagtgtagaggagagatgtgcaactttttttatttttcttttattttttgatattttttcatacttaggagcacacagaaaccaaccatagaaaagttaaactcaaatggatgaaatatgtgacctgtaaaattttccaaaactctaccaaaaagcttctcgcctcgaaaacacaatcttgcaaccgaaatttgaaggttctaatttttccaaacctagcagagcaagggaaaaacggatataacttcttttctgcagatatccgtggatatataatttacctgattccgagtccgtatgagaaagttatacctgttttaaggaaggacacacgaatataaaaggaaaaaactcaacaaaccctaattctttttataggatgtaaaaaaacaatgtactatttttttactaaggaaaaaacaaaaaaaaagaacaggaaagctcttactgatataatcttgagtgaatttgagaagagtggagagatagcaagagcaagcaagagtggcattcggactcaagcgctaggggggtggggggatgggggcagagatgctggcgtgctccccctaccatgtcagtttctggttgccatggtggcaagggggcagcgccagagaggttgacgccgtcccgttggacgacgacgccagcaactctagcgccccaaaatagactatttctggataagtttttttaggggtctatttgtgaaataagcttttcaaaagaatcaagttgtgaaaaatccagaattcatcaccgcttatttgaaaataacgcccgcacgcgcgcgctctctctctctctctcagtgtcttaatttatgaggtctcttaaattttatagggtagcaaccacaccaaacacacttaaaattttggtatgcctatgcaattgtcacaaaatttatctctaaacccatccaattctcttcaaactggtatgatagcaatttaaatatgcccaaaatctaaacttttttatcatagtactcgaggcatacaccatcgaccctccatgctagggcaataatgaatctggtcatctcaagcgtgtagcagctggatccgccacgccaaggaggggggagggagctgctttgctagggagaggtggagaaaccgttgcaccggtcggggaaaggtggcaattgctcggtcatgtgaggtggggaggagtcttgggacttaggccttgtttagttgggggaaaattttgggattggttttcacattggatatgcggacatacatttaaagtattaagcgtagtctaataacaaaaaaatacagattccggcaagaaactgtgagacgaatttattaagactaattaatccatcattagtaaatatttactgtagcaccacattgtcaaatcatggcgcaattaggcttaaaagattcgtctcgcaatttacacgtaatctgtgtaattggtttttttcttacatttaatactccatgcatgtgtgcaagcattcgatatgacagcgtgaaaatttttgttttggaaactaaacaggccttaaaataccagagtgcttgggcagctcggctcaactagttttttttttttaaggtcagcaggaagatgttggaacttaatgaatgggccttagcccactcgaagattaattctttggcaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcctggcagggcagggcagggcaggcggcgcgcgtgcacgacgtacgcgttgaatggtccgaaaaattggctcctcacccttgcgcagatgcagcctccttttgtaaccgacccgccgtcttcacgcaatatatgcgaaaatcagtctagggtttgcctcctactctgtactgcgccgtcgctcgtagactactccatcccgctcgccagcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgctgcgcatatttgatctgttcatgttattctgcgtagtttacatgtgtagaactaatgatgcgttcatgctagttttcatctgtaatgtcatgatttatttatggaataaattaaatcattatatgctgcccataatctcaacaatccaaaaaccttattataggcattgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggtactgcactcaaacacaagagacaggaatactccgttgaggggttgattgcgtctcttgatgttgaggagaaagctcgggaaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatctacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaacagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggatgttaagacagcttttcttaatggagagctggatgaggagatctatatggatcaacctgatgggtttgtacttgaaggtcaagaaggcaaagtgtgcaaattgttgaagtctttgtatggtctgaaacaagctcctaagcaatggcatgagaaatttgacaaaacattgacatctgcaggctttgcagtcaatgaggcaaataaatgtgtatactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgagatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatattgctactgttgaggcagaatggttgcgtgatctattaatggatctgcctgttgttgaaaaaccagtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcctgtgaattagatcctgggaagaacaaaccattaataaactagaggagagtaccaatatatataccctctccaagtgaagatgcatatactctcgtgagctgcaaggcaggttggctatgccttaatgagttctgttggctttaattagcaaagatgttgtcctgcagagcattcttgaaggaactcacctttgtgagcttgactgttggtcgcagtccatgaagattttgggtgaatcttctaggaagcttactaaagacctaggagtatgacttatacgctccacccgaggggtagtctacaaacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaaggcaggatgccctcctagccacttgaagcatgtgtggtggagagaagaggggaaacacacgcgcgcgctcgctcgcctcgcctcgcctggcacggcagggcagggtaggcgcgcgtgcacgacgtacgcgtcgaatggtccgaaaaattggctcctcacccttgcgcagatgcagctccctttgcagtttgtttngctgcaaattcggattcgtttttgttttggaaacgttccgaaaaatccgatgcatgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgatcgccagcgtgcaccagcgatcgggagagcaggtctccggaacctctgcctttgacgtcctgcaccgggagaaggcggcaataaggtttttgggaagtgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgctgcgcatatttgatctgttcatgttattctgcgtagtttacatgtgtagatctaatgatgcgttcatgctagttttcatctgtaatgtcatgatttatttatggaataaattaaatcattatatgctgcccataatctcaacagaagacaagcacgagtaatagattttctaggccggttcattaaaaaaccaatactgataagatattattactggttttttttcagtctaaagcgtactcccagcaaaaagcatcaacgatgcagaaatcaatgtaccgattgtggtataatagagttgtaattcactaattattccggatgctcgccaaatctgaaaaaacctggcgaaaaacaacaatctagatatgtattttgaatgatttgcatggtttggttacacatagaagtacggttgattggtctgtcaagaaattttcatttttctaaataatgtgtgtttctttatataccttctctaatttttcctccattgtacttataatcagtagacttttcctcccaactaatagtggatataacgttaagataataccttttcaagcactcctggcaaaaatccaagcatatatgcatctttgtctgcgggcatctcccacgagtggagttgcacaagttgctgaacgcagtggatgtgatatgcggtgactcccagcaagcagtatctctatctctgaaatggacccagagatctctatctagatacacttgtaaaaccaaacaatcactcaagcagttgcctggtagcaacggccaaaagctattcttaacagtatcttctactactagcgataaataaaacctattcgtcattttagcaagtgtaattttaaccataatttcaacagtagtactgcataaatataacctctggtttaaagagaataaaaaattattcatcattttattaagtgtaattttaaccatttatttgatgtaacatatgccatattacatgtgaattttactataccattatatatcttaatcccatttttttattaatatctcttttctttgatatttttttactaacatttttttccacacactatgatatgcaatataatagaatgattcaaatccattgaatgcgaagtagtgcggctataataaatccgttgcattatgaaattacccgccatatcatttatttgtcctagagcttatatatgtcgtaaactgtttaccaataatattaaggtaaaacttttatatttattcttagtgattttaaaatgtatgtcgaaaaataaactatgaaatcccaaaattatttttagctgttgtcggcacatagaaaaaattatgcgcatgcatacatgcggcaacttttcgggagcaacttgggcgcaggaccagtttcagggcagatagtacaaacaaatacttctccatctgaccgtaccgaagtctctcgacctgaacaattttaattccgatcgcacgcaggtggtggtggtggtggtggtggtggtggtggcgccggcctgcgtcgccggcgacggcgacggcgacggatgaggcgcaacttgcagctcgccggcctaatccgaatcgacagcaacagtagaacaaaccggaaaaaggcacatactacttgcatttgcatgggcaacttggatgaaataatttttgttatctctgtagctgctgctgattctctcttagcttgatcgatcgatggaaaagtttggaaacgtctttggtcaaggggagaataactctttgcatttgcctttttggggcaagttggactgccagttgggaggagctatttcgggaaaggtgcgtggttttgggttggatcgaattgccgaccatatgcctgcgtgccagtggatcttgaaactactaatcaggttttctatgtgccagcaagctgaagtgactggcatgcatgcgtgtgcacagcaagcgcatccagcctgtacctaaaagtggatgtacgtcccctgtgagggtttaatcctgtccaccgcgagtgcaccctccatcccgaaaattgaatcatgtttatgaaacggagggagggagtacacacaagatattgaatcatgtttaggcagctataaccatgaggagtatattacaacaacgtaacatgtcatcgaaaaacattagtatctcaaatgataccttctcgtatactgttagatgtatgatatctccgtatatcgtgaacttattgtaggatactaaagtatatttcctaccctaaaagcttgcccttccacaaccaatgtgagactatttaataatttattattcacattccacaaccaatgtgagactatttaacaatctaccaattcacatacattggtgtccctcagccgttcatcgccccttcatcgtttcctcacggtcccttaccctttcacaaccaatatgagtctattcgacaatctctcccttcacatatatattggtgtccctcagctgttcatcgccccttcatcgtttccccacagtccctcaagtatacggccccgcaggcacccatggtccatcaggccttcacacactttgtctctcgggctagagatgatgaaatagccaggctctaataccaattataggatcgtaaagggtttttcccaccccaaaagctagtcattgaggtgaggggctcccccacttatatattaaatctcttacccttccacaaccaatgtgttactattcaacactcatatgtaggagatatgtcttattagtaacactgaaaattctcttcttttgtttttctctcgtagttttattggatttttttggaaaaaaaaacttaaaaatagattaatatgattttttaaagcaactttcctatagaaacttttttgcaaaacacgcaccgtttagtattttgaaaagcatgtacatgaaaaacaaagagatgagttgggaacttaagggaaagactcggccttagcagtttttatgggatgtgggataagatgagaataggaggaggactacggtgcttttataatctatactactttaaatgatcctattgatagtgtccgtgtctgtcttaacgttacaagctgacatgtggaaccataaagatccccacatatggacgttctttttttatatgacattatatgcctactcaattaactatactatatatataaacttgtaccttttacttttgtttttatcttttataatatccattgtaatgcatgggactttagagatgaccaaacatgccccaactacaactagagctgccttccctagcccagctgatttttactactaagcctatgggcttgttgggcccatctttatgggcttttggaccaaattgtcttgcaagattaggcctagcagaatggctgaccaaatcagatataacacgggcttcttgtaaattgtctcgattttgctagaaatttgctagaaaattgtctaaccacttgaaaaggcctgaacaaagatcatctaacagtgaaagctttctggagtacatacctacatcaatagaaacttttttaagcttcatgttcctacatgatcagtcactacaaagctcaattaattgctctggagcatgacctgtgaaggtcaattcactcggagaattaacaccgaagcaaatagagtaacatgcgtatactaactgttactactacggagtactcctaccatttagaacaagttaattggatttgcgaaaactccaaatgcaattaattaagcagctcaaacccattcaattaacctaattaattagcctctcccgctgtaattacccagcccctatataaaaccgagcgcttacatgcatccaccacacaaacgcagaaagccatcgttttcatagcgcaagaaaacttctcctacgaagcagactagctgagcaaaagctcaacaatggccgccaagaccaccacgctcgccgccgtctcctcctgcctcctcctagcccagcagcttctcctcctcgcgcccgccacgacggccacgtcgatccccgtcggcggcggcggcggtggctccacggcctcatcgaccgtcccggtgtcctcgcacagggacagcgacgacgccgacgccgacgtgccgcccttcttccccttccccggcggctcgggcgcggcggcggggtgctggaacgcggtgctccgcgctgaggtctgcgccggggacgtcctccgctcggtggcgtcgctcctgctgcacgacggcgagcgccacccgtggggcgtccacgtcggcgcgccctgctgcggcgtgctccaaaccgtcggcgaccggtgcttccgcgacctgctcaccgactcgccgttccgcccgctctacgctcccctcgtcaaccacgtgtgcagcgccctccccgtcggcggcggcgtcacccccatccaccgccactgagctagatcgccggccggccgccggccgtcgtcagagaagacgcatccaataagtgagaatataatagacgatatgatcagtaaaatcgatgctacagtgctactccgtactagagatgatcaattcattaaggttttatacgcactttgctagcgctaattttcttctctgacatgtaataacacgacaggaatttgttcctcctatttacacattttctttttggaaataatgaatacaaatggtttttttttttggataatataagttctctgtgaaaattaatgggctgcatggtgggcataattcgggacttcgggtaggcctaaatctcggcctattcgcatgggcgagccaggatttgctacgtaggttcgagcgaatacctacgttcttttgatatcctttaacatcgagttcgattttcgtacttgaacagttgaactggtgcaattggtctcttaattataaaaactggtgcaatataggttttaaggcggtttggatagggtttcagctaacgtctacatggctaatttgactcaatattcatttgacgtgacacatgatggagaattaaaaactaaaacaaaatgtatgggcccatatatcagtcaaactataaaaatttaagaatagtgggacccacgagtctcttctctatcttctacccttcacttttgctttgttcccatttcctctctcgtcggatccctccccaattcaccatcacgccagagtgccacccacagcctcgactactcggaaggtatcctctctagactctacccttgccaccacctcctcctttatcgccgcagcagtcggattgctcatctgtggtggctcagatttgttttcttttgttcttttattgttgtgatttggctccaactttcttggaccgtgtcgagagctttgcttagtatgatcttttgagttggtttgggcaatctaccgcagattgttctccatatccatccgcggattcatttgcttcgtgccagcatcgtggctaattgtttccacgaaatttggttcgtgccgccactgctcagaatgagatcgattgatcgatccacgccgccaccgtgcagaatgagctcggccaccaccgatgccgcccgagaggagctctcgatccacgcccgcagacgtcgtgatagataataccacgttagatgaagatcgaatcaaattagtcacgtatgtgccacgttagctgaaatcactatctaaaccgtcttggtacctatattgcaccgattttagggacctattgtatctggtattgcggtttaagaatagaatcgaactcgctgtcaagttaaggaatctaaattaaacttgttcctaggttcgaataaaggtccattggaaagaggaattcaaggtgggttagttatgggccttccctctgcaggctaaatccaagctgacaatagcagcccacactgcaaatctcacctcatggcaaacaaaaaacgggagagaaaaaaaaaggcttgtttcgcatggatatagataagttccaactctcctgaagttagtgactaaccaaaccgttttagttttaactaaaaagaaagttgagcgaatagactagagtggtctagaaaatttgaactacatgagtggaacgggatttgggcgactccacagcaccgcttcatactctgtttatgaattaaatttagaagttggaatcttacgaaacagaaaaaaaaacagttatttccattgaacggtgtgcccgcgttcatgtatggagcattgctatacgcacgatcagagtacgatatgtcgtagtctctggtgtatgctgtaaatatgggtccaacatgtttccacctaatcaataatcatgcatggtaggatcgtcccaaaatcgtacaaatttcatcataataagaaaaggaatttcggccaagtttagttccaaaatttttcttcgaacttccaacttttccattacatcaaagctttcctacacacacaaactttcaacttttttgtcacattgtttcaatttcaaccaaacttttaattttaacgtgaactaaacccacccgaatccttcgtgtatgtgcacggaaagattccacgcacggaccacgattccatctctcatgtcagagcgagcggctactgttccttcgccatcctctcccagagccacagtgccagtgctcctgctacacgtgtactccctccgtctaaaaaaagacaaactgtgggttcccgtgccaacatttaactgtctgtcttatatgattttttttataattattattttcgttgttgttagatgataaaacatgattaatactttatgcgtggcttatatttttaatttttttttataatttttttaaataagacggacgattaaatgttagacacggaaaccagggttttttttttttttttgaccgagggagtagatgctgtcactgctgccgtgaaccgatcgtatattcgtctcctgggctcctggcgggccaggcaaacactgcaaagagctactactagaacttggaagacacagcgagcactgtgcagtggtgcagaaataggcgtctcaatctcccaattttggccaggcatgtggttgtggtagccatcctgcaataataattgccaaaagagaaaccaaattgcttgccaaccatcacctgcctactatcacggagacgggaaacgtccataagagcaagtttaatagtatagccaactactagctccaatttatctatagccaatttaatagcttattcatataacagttacatactacctccgctttttaatagatgaagccgttgatttttctcacatatttgaccattcgtcttatttaaaaattttatgcaaatgtataagatataaatcactcttaaagtactatgagtaataaaacaactcataacaaaataaattataattacgtaaattttttgaataagacgaatggtcaaacatgtgagaaaaagtcaacggcgtcatctattagaaaacggaggtaatactacactattaatacctagtctcacttatcatacacatgctgtcttagatccgtgctacagctggctataaatctgtagcccgctgctcttctctctcctcatttatcttcttaaaatatgtttgcagctgacttatagcctgctattgtacttgctctcagtggtggctgcaacgcagacagacgggctaattttcgccgcgaaattgtactgctactactgctatctttgtggtggttgatctatgcagatcttgattttgatggagttaatttctagtgtttttgtcaaatcgcgtattagaaggggaggcagaaacacactgagtatctgtagttaattttgatggggatggtagttgtaatctgtggccgtgccggcgtcgatcggtggcagcggcgacacgcaaatgcgagagccggccgcacgtacgcagcgcgcgtgtggcgtttgcgtcttctacgtgccgggcccgcgctcacaccaggcaccggctctgcctatctaccggcgaatctgtgtgatctcccaactctttcaagctagcactaacgagttgatcttaacgcgaccgcgtaaaaggattatgcgtcaatatgttaatagagttttagttacgagttgatcctggtgaaccgtttgaaaatatataatattttgtagctctatatctgaataagggtatatgtttatatatatagctaaaaattattatatttttaaatgaaggtaatatatatacttaagtagagtaaaagtttagaggaactcgcgtcagcacgagcgttttagataaatgcaccattgtattcaccggccgatacctttaattcaaccaatatgcaaaattgcaaatacggcttaccgtgtgccatcagcgtagagccgtggacataatagatggcaccaatgagaaaatgacactaggggctgtttggtttatatactaacattgcctagggttgccatagttttcttgctaagcttgtctaaggttaggcgaacaaatttggcataacattttggctagcaatctataacattgccacacttttacgagacaatgacacgtgagaccaaagtgctagaaaaaaaatcttgccacaagtgtgacaatgaaccaaacgcatggctaacttagtcaaatctacctaacttgaggtgtggcaaagtgtggcaacatgcggtcacgaaccaaacaacccctacgtcaccgccttgttatgagtgccgaccgtaatctcacctactcccacgaaaggcacagtcaattgctgtgccattagtcataattaaccacagccacaggatcttcatcttaacctcatctagcctattgttgtagcgtcctgtccacaaaaacacacacacacagctcgatggaatcatacaaatgtttctaaaaaaaacaaacgcagtaaacaattacaagcaacagatcgatcagtcgatatcgcttttggcatggtgtaaacatgcattgcatcgattttgcgcgtacataatttgtcttccctactgtcttcttcaatcttctcatatctctcctattataaaaccatgatcgatcgagcaagcgaatccttactctcgctctgaataaatataacattacgtacagtagcgaaattttaattgtgttgccgagataccgacgcgataaataaaacgaattaacaatgcactcttacccacggtcggtgacgtcattgtaattaagtaaagctcctcgcatgcatgatatcacgctggctaatcaacagccgagcttgccctcattgacccacaaatatcccaatcatcgacgcctttaccaaattttccaaccgctactgtttcagctgcttgtctccacgcacacaccagttagtacatcacttaattataatattacttatcggaaacagatggagagacaaatgtaaatagttagaattaattatagcataattaagcatgcatatatataaggcattgttctttcagattatccatcggatcattgaaataggttatttgttccattgtttaaaaaactaagctttctaaaaacccttttcttctactgcatgaattagaccatttattttaaacaatttgttaagtttattgttttaaaatatttaatataccatatattccagtagataatcctaacagtaatattcttgataataatctaatggttaataatattcaattattttaaaaaaaaccattattactgctccacaatgagtagtactctctccatcccattttaagtgcaaccatgaattttcgcgtccaactttgatcgtcggttttatttaaaaactttttataattaatatttttgttgttatgagatcataaaacatgaatagtactttactcatgacttatgtttttaaatttttttaaaaaaattaaataagacagacgatcaaagttggatgtggaaaaccatgctgtatttaaaatgagacagagggagtatatttttgttcttgagaactgaatgagtagtattttgaaaagctatagctgatcgatctggtccagaattccagatgttgactggacactgcccggacactgacgcttatgtggtgtgtggaggatgctgtggatagatgctgctgcttgctttgctatgcccggcaagccctcagcctcaataattgccgcttacgggtggctggggccctcacatgacagagatctccatacaacgcctctggagattgcatgattccttacgcatgtcaggctatatagaagtaaacgacacgatgtagtagtagtctactaactattttacattctctggagattcatgctttgctcatcaccacttttcttttacagcactctttgttagtgttgagatcagataggagttgagaaaggaggaagagggtaattctagttttgagtgagattactaagattgataagcggcgctactagaggtaggggtgggcattcggtctacccgagaaattcggttcgattctttggtcttttggaaaattcggtcttcaaaatcacgagaccgatcgatcttcaagaaaacacaagaccgagcgcttcggtcttcggttagttcggttcggtctcagtcattgaccgaactaaccgtaacaatggtttcaacaacagaaaaaataatcgcaactcagatgaaagactataagtctacaatatgaggatgcccctagcaagtactagcaagtagagcactgattcaggaaaaaaaaagcaaatcaagcagccaagcagcaagtagagcacgatttaggaaaaaaaagagaagcaaatcaagcaaatcgatcatgccatgtattggatctcgtcaatcttcactccaccagaagctccagatcccatcaatctcatctcccatcgtcattgttcccccgctccatcgctttcatcaagggctggccgacctcttccgccatcgatgcctctttcgccacggggtgcggctggccggcaggcggcaggggcgctacagggcgcacggccttcttccgccatgagaggcaaacgagcagctcggcgcaggttgccgctagcaacgcctccgcgcagtggggactggggagttgccaattcttttttttttctgaaactcgatcgtggcctcgtgggtaggaggataaagtcgtgacgtagttgttttgtagctggatggggcgatgattttgctcaggtgatgaggtattgggcctagtgggctgagatttcacatatgttattgggccactgatatattttggtttttttggtcaattctgttaactgagtcctaagaccttttgaccgaactaatttagttaaaagtgctgaccgaatttcttggtcactttggttcggtttttcggttcggtctttttctgcccaccccctaactggaggaagggcgcaacaacattaaggctatttacagtgtgtcgacctggagttccgccctaaggtgccagcaacgaatttgtctaccacgttcagcgcgactacgtcctccttgaagattgataaaccctgagctccactcaagacactcaaggctgttgttggcccgatctttcggtgaattgatgagaactacaatttggaagaaatgttgacgacccaactacaaccgtatgagacgttgttatgttgcgccttagcgatcgatacaccactccgtaggttgttgatcttgccggtgcagatcaaccttattcctgcaagcaaaccgaagaaataagtaagaacaagataaaagcaatgtgaattgcaaataagaattgcatacaaatgataagttggggttccgtaacgagcaaaccgacaatctaaccgatcacgggattacacggcaaagcaacaaagctaaactttaatctaacgaaaacccaagaaaccctgaacgggtacctagctatttaaagaggtgggaggacgacctaggggtccctagggtcgtgctacacctgtttggggcgcaccccacatgggccccacttgggctggggtcccaaacgaagttacaaggcccattggcccaatataggtgacgtagcaccttgtttctgcgattgccgttgactgatatggaatttgggaacaaggctggattctttggaaagtggactctgagaatttttcatcaagtactcatggagccaaaacggagttcgtatgcaaatttagcggctgtttgaagtcagcaatgtagtgggtggccgaatcagattccagcacttggacatcttgatcttgatgtgagcgacggttgtatcaatggtatccttggacacatcaaagattgtcgtctcccggcgaagccgcgtgagcctgatgtatcaggatgagtctacgtgactagcatagcaatgggttgatgctatattggggagatcgtgccctcacgacatggtgtagcccccgtaccccctctccccctcacacgcacaccctagcgtcttcccaagctacggtgggtagagaaccagcgtggagagacgaaaagaggggcctacctttccagtgccactcctggcgctttgacctcaccgatgccgccaaggtgggtggagaacacggtagtgatgacctcaaggaaaactccaaatctagcccctaagaggtcctcctaatcgtcatcgatcactatccggctcacccgagcctactgttgctgctcaccgccatcaacctcgttcttgatccgccgcccattgctcctactgctaccaaatccattgngagagaggcgccccgctgtcacagagcttgtcgttgggggagagaagtcactggagaggagggaggcggatagaagcggtgacacgagagaggagataggaagaagaaattttagggcatcttcgccgaggtggagcaaccgaggggggggggggagggggagggtcgggaattagagaggggggaggaagaaaaaggataggaaagggactgacatatggttctagcaaatggataagggttatttgtggtcaattttattgtcacagggtataaaatataaatagttttaattgatttgaaaaaataaaatatcattaggaataactagggatctgagtgcaaaaaggtactagtactcaatatttagatatttaattagatgatattttgtaagagaacttatactagtaggagatttgctatacatgtataaaaatgaactagttgtctctcttttttttggaagaaatggtagtatcaaaatattgtgctgttacaatccagatttcacagggatatgctatcagggatagcttgtccagatgtcttgagaccatgtcaacatccaaaattgacactttgtttgtcctggagcacaagtagaagtactaattttgttaggaggagctaaggaatacagagtatctaacaaacgatacgttttgttttgtcaggtcagatgcttctttcactgatgatgcaacaatgcttccactgtgcttagccatactttgaatgagaaagccacaataaattcattagctaagggcatgtacaatggttgtcaatagtggtttcttagcgttgctaattaggaatacttgttgacatgaaagaaagagaaagaggagagacaaaacatcgttatcatgcataacaacggcttaacaacgactcttaatcactacaatatggaaatatggttgcatgagggtaaaaaaatagaaagaatattaataaaaggaatattttttagttaatgattagagtctttatcgtctcaactattgtaaagatatggtctctaaataatcttatattgtttaagaaaccatacttgtctctaccattgaacataccctaattctttgtgtttggacgtccttaatttcagaaacaaatctttgattggtaattggttctaaatctttgattggtaattggttctccaacgagcaagcaataacattaattttatatgattattttttttattttttttattaatagtcaaagttaaaaatatttgacttgtcactatgctaaaaatgttcatatttagagacggagtgagtacaattcacgaatctgccccactagaccaaaagagaacgaaagctgtctgcttcagcacttcgatctctactacagcaaaatagagcttttgactaattaattgctgactcgaaagcagtttttcaggggagaaaaaactgtttttggctaggttcgcttttggaaaatgctaagctgttctgtgtatactttaatttggagtactagctgatctagatatttttgttccttttccccattctgctagccccacctcctttggcagataactttgagtggtgtgagtatgacttatctctactattataaaaattgaaaatattttcgctaatattttgatatgtcatccgtgtatgactcggtttttaaatttgtttgattttgaaaatagatatctgtatttgagttggtttctaagatcgttcacttttggtaatacataaggaatcatataagaaatttgtttaaaaaaactcgcatgctaacttgatatgattggactcctaactacagctcatgattttctaaaaatatatatatccaagtgaactcctacagtgaatttcatcttaactaaaccatataacaataataagattaaaatagacttcacccgttgcaacacacggatattttttctagtgtatatctagtgtgtatgttttttatagctccaactcttagggcctgttcggcacagctccagctctagctccacctctcatagagctggagttctgccaaacagtttcagctccacctaaaatgggagtgaagctgagtggag

SEQ ID NO: 62312 - DNA, 1808 bp, Oryza sativa
agagctccacccagatctactcctattttaggtggagctaaaattgtttggctgagctctagctctagaagaggtagagctgaagttaaagctgtgccaattagacactacattcaaataattaacatcggctatatgcatgcacaaaaagttgaatgactattgctaactctattttttaatccgtttttcttctaaaagtatttacgcaaatggacaaacatacctagatattctgaatgttacttctaatgctagatctattggtgcatttttcactttaagaattaattcattatatttttggtcaacatttgagaaaaaagtcaattacatcttatattaaagaaaggagatatacagtacacatctatatcaacattttatctcgtacttgggtaaatatttggaagataagcatatatctaacgttaataaatatctagccaactcacatactcatttctcatttgctctaacgcaaaaaagggaagcatttaggctcaagtttagtcctaaaaaaaatagtttcatatcatcctcacttcagttcattctgcagatcatttttttagaaggcaattactatttctattaactaatataataccgagtagaaggaaaagacctaatataggggtggtcgtgacacgtgatcagtctgatcgacgcaaatgcgcctcccctagctcttggctcccctttccacatgcacttttaaaaattcaaatcaattcaaaaaataagtttcaagaaaaagagaaacaaaatagaaaaatatctacagcacgtaaaaaaatccgtgtatataaattttacatatagaaatatatgcattgcaaactttatacatataaactttatgtataaccccaaaaaaaaactttatgtatagaaacattctcagtaaaaagtattttaatttaaattcaaatttaaatttaaatcaggtatatgaacttttgaatataaactttatgtgtataattgtgtggcatatattgactaatacaatatgtatataatgaattaattcctattaaaatgaaacattgaaacgatagctcccagcggttagatctccctcattagcgattcctagaagtagagcatgcagatagctcgcttgtcatcattatccacagcatgcgattaacgtgacctagtggctaattatgggtagtttagtggctaattaagtgatgaaggtgggggccccactacgtggcgtgttacagttgtcctgagaggtgtggatcttatccgttacgtggacgctgcttccgtgggtcaaacacccctccgcttctcctgccccggggagcccagctcgctcctccgatcggctcgccccagctcagctcatgtctcggctcagtttcaatctggtactccatccgtcctaaaacgttgtactagatgtaagatgtccagatttaccgtattgaaatattacattctgaattgcaacattttagaaaggaggaggtaactcgtaggggtgaaaatggaacgagtattcataagccgtccgactgatctaaggctcacagtctcacacggaggatataggagagagaaaagaatactcggtacaatgcaagtttaaatttgaattcactacaaattatgtgataggatataaaataagtgtatctttgcttatgttccgtattatcaaacgtgtagtaaatatattataaagttaaaatattgactagtcactattttaattatgagctcacatgtatactgcatattatctttttttttcttggtgtatcgttttactccctccgtttcactat

SEQ ID NO: 62313 - DNA, 2248 bp, Oryza sativa
gaaacggaggaagtaacacctaggtttaatatttatttgttaattagagatacaaatatatatatatatattttttttctgaatttgattcaaagggggaaaatataggatatgatacatgataagtaataagttatcaaatactatctccgtcgtaaaataactttatttttcacccattccgcacgtaccaatgtaaaagcaaaatgataagaacaccctccactattaaatcccaatacaattgtttttcacttaattcagttctagtatttgttccattctttcacaaacttcaatacaatgattgctcaaagataaatttagtatgggataaagattaccttattttgagatgggggagtactatatattctctattccaactccgagcaagtgagcaacaaatatgggagaggatacataataagtaattatttcacgggtactattcgtttatgagaaatgacagagtcagtgttacagaaaagtatacttcttatacctatatttatgactaccgggaataacgtatacctggtcctttatggaagagtatgttcaaaaatagatgtcagactctgatccgtatgctacaaagtcttatctgttcatagcctatttgaatcacgagttctatttagacaagaggttgtttgtccgtataaatacaaagcccctagggaggagagtgcattggatcataaaccgtaaccacaagccatatcccatatcgaatatcaatcgggaggaaaccctaaatctagtctttgattacaagttgctagtttagtcctcaccgaaggtaagctggtaggccaaattagctagcttgctcttcctttataatcggtgtaacacatctcatagcagctgtacatataaactagattatggctattaccccatttcggatgcttgaccgcttgaaccaaccagtataaaattcattatcttccgttttcttttttccaatattagatataccctcatacgccttttaaaatatcgtcattgagcttaacctttcttaatttttaggggcaattgtaaattcaccactattttgaatcgttattgtaagactgctactaaaaaattgcaaaaatgctattagaactgccattaaaatggcatccttgcaaaatttttatggataaaaaaaaatgacgtacgtgatccgacagtatccatcctgtaccgctcgaaaaaaattattgagcttgccgagccgagccgagccgagccgtggagccaggaaagaggtgaaaatccacacaaccacctgttattatctcccctatttctaaattacaccaagccccctaatatctcggcggaatcctctccaactcccctcccctcacctctctcctctataaaaaccctcccctccccatccacccatcctcctccaactccaacggatcactcaccttgcctcgccctcgccctggccaccatccaacgacgtcgactcgtcgccggcgacgactccgggccgcgcacatacgcctggtaatacgtactacgcgggaaccaaatcttacgcacgcgcgcacgaacgcccatggggctccttgaccagctctgggacgagacggtggccggcccgcgcccggactccggcctcggcaagctccgcaagtactcctccttctcgccctcctcctcctccgccgccgccgccgcccccgggacggcgccgccggatgcgccggccgcgacggtgacgcgcagcatcaccatcgtccggccgccgtcgctgtccgtcccgtcgccgcgcggcggcggcggcgagtacagctcgtccgtgccgtcctccccagccagcgcgccggactccccgttcgcgtcaggtgggggtctcctctgttttttttttctttctctctcttggattctggattggcgtgtagtagagccgccctcgcatcgatgcactgtagaactctagatctgcgttcgtggttggttggttgggggattggatcccgatgcgacgagagaccatggttgcgtgtcaatctggtgagctttttccatggaaatgggagagagacaaaaaaatcatcaaaattgtttgttgctttttatgctttatgccttgagtgcggctgatgcagtcaacagaatacagatctacggagttcattcatctgttcttgattgatgctatctgtggagttcatctaatcaagaaatggtggatcgtagtagtctgatagtacagggggggtgcaggaat

SEQ ID NO: 62314 - DNA, 20679 bp, Oryza sativa
aattcctgcagcctagtagtgatagtgttagtggagtcataggcgatctagctagagagatgtctgaaatggtatgaggatgtaatgagagtgttcgctctgtatcctcctctgtaattaagcactatggaagtaagaaaaaaaatggaaagccatgcctttgctgctttctttcagctcgtgtataaatcttgcttcaacatgcaaggcgactgtatgtaaattttcctgaactgaattgctcaagaaacatgataactggtgatactagctggaggaacaagattcttcaatctagagaggggttccattttgtcttcatcagtctgaactctgaacaatctctggtcattttttttgctttctctgtagacctgaatctagtgattcccagcaggaaatagctctcgctcggttctatatggctgcaaactctttatgcttgtcaacttgcaagtatatggatttgcttttctagagaaaacaaatataccaagatcccaattggatggatccctttgtgtggacaaataaatgatgctctacgatcttattctatattcctatctgtcccgtcagaaccctgaacccatcggtctaaaaaaatataggaaaggaaatagagatagctttattcattaatcatattcatgaggtcaaaatcaaatcgataggttcttaggaaaaagaaaaaaaatactgaagacgacatctgatctgaaaggctctagcttattatgttactcgttcttgagaagtagccatggtaggatcagaggaaacagattagccactggaccaaccaggtcaaaaaacgagaagtgatggtaccctccatccaatcatccatggcaaaccggatgagtttaaccaaagcaagacactgaggaattgaaaacagaacaaaagttggtgctgcaacctgatgaacctctcgatgagctggaaacatgatcttccaactagtttggtattatctgctcgagagaggcagagagtactgaatccactctcgaatctcgattagttccatgtgggcgctagttttctctgcatcaaattggctcttggaacattccatgtgagaggtagtaggttcttgcctgggaaaggttggtgccggatacctgtaggcaaacctggtgtaccttcctgtctcaccctctcgcctctcgtgccgtctctgtccgtgtcgccaagaacctgtttcttgacctacgtactctcatctagtcatctgtacctaccggcagatcatttgtttcaggccaaggtcgcttcaattcttgatcaatcgaaatgtttgcagtaacaacagcatgcgtgttgcttgcagattgttccattcagattttcagacttgcagagggaaaaaggaggcagtgctatactgtcattaagcctgctaatggactgagatccagaccaaaaccgccccagttcacttgtctctatagtacacttctaaaccaatccaattcaattcatagtttgcagaaaccaaaccaatccaatccactcacagagcaagcccaaacaaatccaaaccaagtgcagacaaatggattcaacccattctcaacccatttccaacccaaaggaaatgcacaatattactctgaacaccaacaggcatcgtcatcttcttcctcctccctcctttggtcagctccgggaggatgagcagcttgcagagggcatcaatggaggatgagcagcttgcagagctcgtacagggtcgtgggagcatctggcgctcccgtgcgccacgtcgtcgccgccgccgcagcgaaggagcctcaccagcgctgggatgccgcgaccaccgcgagcgcgttcaccgactcaccgtcgcgaggctcgtgagcactacagccgtgaccaccgcggctgcaccgccgtaggacttctcccccaagtccgcaccaccgcaccaccattgtccgccacaagccccacgttgccccgcccttctcccccatgatggcggccgcggccacggccttcgatgccgtcgctgttgccgcgggcagccagaagatccggagccatggttgattttttggggactttgtgaagggagaaggtttgccggaggagggagaggaaggtagcaagccaccggcgacgaagtcgagctagcgatggcggcgatgtggttgtcgacttctcagggagacgatgggattggggccaatccagtggatacccatgggttgaatccaatctgggaccaaacttttgcagccaaaactaaaccaatccaaaccatttcccatctccatccaaaccagtccagtccatcaggtgcagcaacccatttccacccgcccaaagctaacccacactgaaatccaacccactatatccacttaaacccagtccattagcaggcttaactgtcatagtgaggtcgtcagtgatgggggcaaggcaatgatcaaggtgaagggtggttaggatcgatggagatgcatggcgtgaggtttgttcgtttgcttgctagctggagcctctatctggctaccgttgccgagctgtgaggctggggatggtgtcagattggtcgatcttgtgcagactgaaatcgttgggcattttgctttcagggaactgaacatgcgttttcagggtaaactgacactgactgtcgtttattgaaaatgatcaatataatcaatacaggggataccgtttgcatcaatggggacgtagctcatatggtagagcgctcgcttcgcatgcgagaggcacggggttcgattccccgcgtctccattttgtcattctttttgctgtcctagaaatctagaatctctggagaatttgttgcttgcagttgcagttctttcctgcaggaaatgcaaccgacgacccaaaagacagcaggtaaaacgccttcgatccacctcctgttgatacacaggtcaccaggtgagtgcgaatttgactgccattgatatcagatgatgtgtgtacatattgactatgtatctgaacagtatatgttttgtggactcaccaatggttggtactgtgcttgtcgcatgctcctgctctcgtgacttagtcagccgccaagccgcagtgttcaccagctgatcgcgctctagctctacccaggagggggctaggtcaattggcaatacgaaagcagggggacaccacaagcacgagttttctcttggaaccatagcgtggttgacgtgtttgaatagacacaaaatgtgttcttccatttatttggagtttgggcaaatggacaggccgctgacggtggcggcccatcgaaacaaagccttcccagttagtaggaataagttcactttgactcccttaaaagtgacccgaatctaatccatgaccctcaactaaaaccagttcaatttgactccctcggcagttttgaagagcggtttcgctgacatggcgcctacgtggcagtgctgaccaggtcttcgtactacttggcgttaacatgacgcttaagtggcattagaattaaaaatatatatgcggggcccattggtcattcaaaaaaaaagttgtaggccccactgatataatgatatgtggggccaacataaatcacttcttcctcctccctctttccctcccttttctctctctttctctccctttctcatcggttcttcctcttcggttggcggcgggcggccatggtgtctcttcccctgctgtcgggccctcgccgctggggcggaatgggccgagaaccccgtccccactgttggatactgacgccgccgctccccgttgttgtggcgatttgcgttgttgtggcgggctccagatcgctagagagcgaggccgtggccatggcggccgccgcggcatctttggccatggaggagggaagggatggatcggatgagggtgcgggggcgggtgcgggtggtggcgagctctaggtcatcggagagagaggccgcaaccgctgaccgccgctgccaacgaagaaagagggaatataggaggggagtcacataggcgccacgtcagcgaaatcatcaagagagttaaattgaaccggttttaaaagtttggggtagagatatttggttttatggtttaggataacggattagatttcgattgatcacaaattgaacttattcccagttagtactgcgccgatgccgcgggcgcccaccggcaagatcggcagcccgagaatccgttccaggaagtgacagctgacagctgacaagcacccccccgcgacgaggcccaacccgcgcccggcgtggcatcgactcgattgccccatgcccaagcaggctacggcccatctgacgacgcatcgcgcggcggaacaggcgacccgcgagcctaacgacgaaatcctcgggagccggggagccccggaccgggcaacaccggcctttactagagatttgccagctttgcagagaactggtttcttcccttattggtccaactagtgcacaataatcacttttccgattaaaacaagacttcgcgcgtacctttcaagcgttacactacacacacgaatacgagtgtaccatttaacacacgattaaaaagacgcgaatattagagaataatctagtattaaataattagaaagagtgaggcttcgaatttaggtcatctagcccaccatcttatggagttagccggaagacctctggacgtttctcatttaacacacgattaaaatgtgtaaagccaaaagtaaaatcatgtgttgattagtcccggttataaacaattatcaaaggtaataaaaaaagaaaaatgtatgaattatcgtcctgaaacgaattaccccctaagcttgaataccaaatattactccctccgtctctaaatattactccctccgtccctagacatgttccacatctagattcgtagtaataggatacgtcacattcaactaaaatcccttatatttagagacgaatggagtacctgacaagcgtgtaatagttgagttgtaaaatgtcaagtattcgagtttaagggtgtaattcaatcgtctgctatagtttagggggtaattcaaactttttccataaaaaaaaggttgtgttggcgtgttaatttcattgaatatggtaggaataaaacactatacaaatatcagattgtgacacactgtgttcatatttatgaagtgatgataaattaatttggggaagtgtcggagccgcaagattggaccagctaggtaaagctagtcagacgggcgggtaactatagtatgactgatagtatgtgaacggtcagaccggtagactctatgttggagtcagtttcgggttgattttttggaatatgttgattacttcatattcatgacttctagatggtttctatatgtaagatatactgttgtgtgctaatataaatcaagttggaaaaaaaacttttactcggataatgtttctttggttgtttatgtgacggtgttgcttgaaacctcgagagtttttttggtgatagatcggaactagacttgggagaagttgaagtccagacaatcaaagatatcatgcggtatactaagtctatagagaacaacacacgtggatgtgaagtttttatgtggcatacaaaagaaattgtgtgcatatgtaaggagtgaaatttggattagagcataagtttggaaagattgaagttcgaagttataaggggatgtgtgtatcactggtttgaaaggttttctatgtgattatgatttcttattctggttggattcgtcgctataggtagtcatgtttaagggtataaatcacttgtatgattctggggcaaaatcacttttgcgatggtattttatggaacttacactcgttgatagcatttcttggattttggtgtttgtcaattgcattttttggattttcaatattcatgatagcccttattttcctcaggatgttacatcagttatattagtgatatcagtgtatatatcagtttcccactgaatccctgaaagtatcacaggaccatttgagtgagatacctgaacgtactaaagccgaccgacacaaacgcgcgcacatgcacaatttctaacagcgaacttgctttgatccaaagaaaaatccttttcacgggtattagctaaacaagttctttcgttaatactggctgtgccatcgttgagccaaaaatcacatctgggttaacaactctgatgtgcaagttttcgttttccaggcagccgggagtcatggtggccacgcatggtggtcttgggcaccatggcgccggtctctgtcccattccgttccattgatttttttttttaaaaaaacatttgatccggttgtctcttccgtgcatacagtttgtgcttttttcttggtgctgataggcaagtcctcacctaccaagctcgatcgatcaaagtcttttctagcttccaggttgacagcttcttggtgtcacaatttgcatggcttcttcttgccattgcaatttccctgattatatatcctccttagctttgatttctttttctcttgcaagacctccttgtcatgcatgtaaaggttcgtttttatctgagtttttttggggtcttaacatagtggtagcaggtgagttgcagggggcattagttagtgcattactattgctgacagcgttccaccggtgtacttacatgagtttgcctatttacatcagtatagatatagaagtagaacggctcacctttctcttgttagatcatgactcttgatgactgttgacttgacccgttgctgtcgttgcactgtttccagcttcatctaaagctcagttttgctgcaggctagttttcttgcttgaaatcgagaaatttggactgatgttgatcgtggagtgtgatcacaggcgctcctttcttcgatgaatgtaacaaaaatctgtaaaatttccataattacgttggtttatagtatgcttgagctagctgaactcaactggaagtgcactggccacagttccagaatccagcagaaattagagggccattaatttgtcactcgtcaggcagaatctttgcaacttgttctatcaaatatcctggagagtacagttcatgcttacagccaaacagacatctgtttaggacagtagcggcggcagcaatcacgggcacggcccaaaattgtactacacccgtttgtttccccttgagccgatcgcatgtttgtccttctgtttggcatctaaattttggtcatttaaactcaccagaggtgacaattttttgtgtaatctgttcatgtcaacgttgtggtcacggcctatacatggagtacctaagctaggcacaaacttttgctgcaatttttttttatttctgtccaattgatcgtgaactatcttgtatctttcaggttgtatgtttgtaagactatactgcagtaaaaaaaaccaattcttgcattgactgaatggacttcaaagttcaaccaaattggtcgttttcgaaggacagagattaacacgtctttcaggatcaaggtggactgcttgtgcgagctagattagagcaagttgggacgactacttgactagtattctaatcgaaatgcaccactgttttgcactgagagctggtggtaaatgtccaattcatcgtagcatactatcagcccaacatggtgtttggttgctctctctgataggtccatttttacttctttgaattgctgaatctgacatttttctctatcagtggagctttactatggcatcagttaacctttattatatataagacagtagtttttaccatgagtgtgatttcatgtcatactttccatccaatttctttccaacttttttggtctagtctgctccaagctaagtaaagctacaaaattcgcatcaaacgagcacaaaattagatacaacagttgtgtgattctcgcagacggtattgtttattctcaacaagaaaagatggatttgtttcggtttggtgacaaaacgatgaaatgccaaacaacaactgcacttgtctatttcactcgggggtggactgatgacatgttacagctggttggttctgactggtgtcatctcatcttctagaggcataacaagaacaaactacctaacaaggcgtacaaaacaagcttttatctttagttccttctctgaatctactgctaaccactcttctcatcaccaagtccccgataaagtttggttaccagtaagaaagaaaaatatgagatcctctcatggaaagtgaaatgcaggagcaaaaaaatggaagaaaagattgactactttcacctttgagagctgtgtgtgactgttcttttcccccagataatggaaatggttctcatggctggttgtaatgcatttttcatcagtcatcagcaatggcagttcccagctttctacaaccaccgcgatttgacttgatgattctgcaatggatatggatatcggcttgattcagttttaggtgagaattagatgctaacaagcaattagcaggtgatcgaaattcaggtctagctagtgctagatacgtcccctcgatatgctagattgttattctccctggtgcgccggaagtccttgttgttttctgaaaatttcaagacatgtttgacgtgcagagatgcatcattgcatccacggacagtcttggtcgaatcaatcaccggcgagattaatgtcgtgcaaacttggatatgatattggttttgtcctgatagaatcatggaatctatatatatgtatctggtcattcaaaagtagaagcaaaatgcagaagctgaaatcatgcgacatatattgatatatacctataacattggtcatcactcgttgatcaaaagtacatgacagtaatataatgccacagagataagtgaataaaatgagagggaaaataaaaacatatcacgacgataaggaggagtactttgctcctctgccggccggcgagacaaacgctaaggcacctaaacgatagggaatattttgcagtggtctgatcgatgctatcagtgatgttgccattaacaaatctgcactaacaatggtcttccggattgctagcttaatgcttaatcaaacgcaggtcatgtgtgatagctagtttgacgtcttccctgatctagctcaagggagtagaggcggtttgtccggttatatgctttattttttcttggggtttagttccacgtcgcatgttaatgatttagagtgcgacgtaaaagatggataaattcttacatactatactattgtttttggtggttggtttttttgggtccatgctcaacgagacatgatctaagatgctattctaatttcgtgcagtagaggaggccactcgtggtttagccaagttataaatgcgaagatttacaagtggacgaacacttgacccaacaggtaaacatgtcatatctggctttatacgttcaagtgtgaacccaagtcatcttacagaactcctttctcatttcaatcctagcctgcttcctatataagaggaggccacttcttgtgtattgagttggactcttgaactcaattgctacatgcatccttgatgcatgcagagatatactccagcaattttgaggggctttaattaagttcaattgttacttttctagaccgaactcaattatcactggcgaaaagaaagcaaagaaccctatatagggagcttacaaataacgcttggatcttttctttcaaacagatagatatggtggaggccatccatgagctcgtgcagctaggaaacctcatatccactacccaactcaacgcaaacacaaaagatgatatagtttgggtagcacatccctccggactatattagacaaaaagtgtgtacctcttgcgattccaaggagcgattctagaaccaaactacaactacaattagctttggaaagcacaggccgaaccgaaacataggttctttggatggttgatcatgcaccacaaagccctaattgccaaaaactcctcgtccgatattggatttgtgattggatatgttctctctgtacataagcttttgaagacacggatcacgtattcagggattgtgcatacacaaggagagtttgggagatggcatctgtaaaaaagggctttgcatatgccaagatagacgcctctataaagagttggatatcaacaataacatcatcgggacggccacaagaagcaggtcaagcctcggtgctttcacttcctagtggaacatgtggttagaaagaaatagaatgactttccaagaaaaacaatgtgtaaaatcaaaggtgtttttgattattattctgtgatgaacaattgggcattggagattattggttttgttatttggaatttattcacgaagtggttttggagatgattggaatttacgggtgaatttacaggatactgttgttatttcatgtgaccggtcaaaccgggtagtgtgtgccggtcagaccaggggtgatcgagcggtcggaccggccagctcgcggtctgaacggccgatgctatctcggtttctgtttcgggttggttatttggatatctgtgattatttcatgattatggcttctagatggatattatatgtatgtaatactgttgtttgctactaatgagtcaagttggagatagcttggttttagaatatggtttctttgtttatttcatgtgtaggtgacttgatgcctcgggagagtatttgcggtgatggaccaggagttggcttggggataagacgacatccgtagtggtcagagatcatgcgggatacttaggttagagttaatgcacgtggttgatggagattccgtatggcatacgatggaggtattgtgtgcgtatgggatgcggagtcgaatttggaaggagtccaaatttggtacgattggttatgtaaagtttctttcttgtactagaggattcctaaggtgtttaggactcaagtatgagtttggttcgtggctttaggctgcttacctcgggtataaatagagggggagcgtgaggcttcccggtatcgcttttgagagcaattgagttgagctttgagttagggtttcgagtttagtcaaaatttttgtaaggagtgctgttggtgcactttgtaaacacagagagaatcaataaagtcgtcatccactttaagagttcttcgatttgtgtttaccgggtttcggcggtctaaccggcgatctaccggcggtcagaccagcggcatcgcggcggtctgaccggcgggcacacggcggtcagaccggcggcgacaggagtcggcggcaggcaatctcggtggttcgactgatcgatctacatcggtcagaccgacattcatcaggcggtccgaccgatgcaactacttcggtcagaccgcgatccgtcgaattcgagggtaacttttatttccgctaaaatttttcggtttttgggtataccaaacattcaccccccctctggttggcttagttcttgtgattcgatcctacacaatgtgatgagattgcggtagtgggtctcatcttggaagacctagaccaacaagccctagcttttaaactgccctagaggcggggctttcaatttattgtaacctcgccaggttgtaatctcctcttaatcccatctccctctgaaatttattttgtattctttgaattttatttcttctcaatatatccagcagagctctttgatatagatactagttacatgcatccttgatatatatgtactctgacaatcttccatgtctctccacaactatgttttagggtcaacttcgattgctagatgtaccattgatggagagagcgaaggtgtactcactcttctgttatcttaaaaaaaaaaagagaagcaaacactactgtcatttacaaacaacatagatgaacacatttgacaacaaaatggatcatagtacttttttttcctagaaagaacacatattctattttcttaattttgtctattaagatagataaaaataaccctccacatttactctggaggctggaaattttcacattactctgagaaaaagaaaaaagaagttagaccattagcttgttctgttggcagggataaaacccaatcgaattcagatggatagtaatcataccatattctaaaacatacttttaaagtggattcggagcaggtgcgtatagtgtgcatatgttataaagatagataaaaaagaagacaccacctttgttctagaggctagaaattcttatattaatcaaagaaaaggagaaagataagaatcattcaattgtgaagatctaaattataatggtatagatcggttgatatagtttatagaaaatatgattttatctatggaaaatgaagttaagagttgtatatgaaatccaatacgacttttaaaatccatcgatataaatcctatatatctataaagttcatccccactaagtgtagttaatgctaattctcatttctctcgtgaagccacatcacctcaattgtttttagcttatggatgattcatcaagggtgtaaattccatctcttctccccaaaaggcacactatacaacccaatcatttataacctatggataattgataaaggtaaaaaaaaatatataaacacatgaaaaaattgtatagtaggtaagaaagaaaattttagaactcatacatactatattattacacaattctcccacaaaaatgcgcggggtacccatctagtatacatttacatctatgtaatcaaaagttaaatgttgtagactaaatccaattattattatgtacctaggccccttgaatgttacataggaaaatcagctagttttacggtccttaaaaaataattattattatgtacccatctagtatacatttacatctatgtaatcaaaagttaaatgttgtagactaaatccaattattattatgtacctaggccccttgaatgttacataggaaaatcagctagtggtttacattatatgactagagagtttacggtccttaaaaaataatacttatataactatagatatcaaaatttttcactaaaaattttggtacctagtggctagacataccaatttttacatgaaaaaatatggtaactcccgatattatcttaagaataatacatttaccattacatagccattacagatggcttataaattgggataccattcaagaccccaagcctccaactactcatttgcttgcaagcttaaacttggcagttgttcaaagctttgtccatagtttaatctgtctatcctttaggatatgcatggtcacaccacatgcagtgtttcacatcagttacgttgatcttctattcaattttctcttactccatataatatgatcattcagtcaccagttggtattcagattttaaaatgtttgtcgattaagacatgaatcatatttctcaacttatacgtacgcaatgaattgaacaataaaacccaattaagttactaatcttttaaagacaaaatgacggatatctctgccattttttagagacacaaattaagctactaatccaatctgtgcaattagcgctgaagaaacagtagtgaatcttgggctgtgtccaggagtggcgcctgacctttggaggtccatattacacgtcccaatccaaagttgttaatgacgtcttgcctctctagagcctcaccttgttgcatcctgcacgcattgtgcgtatcaaattggacatctataatctcggtgtttggtagcctatcctgtacatgggtttgtacaattggatcgattacctcatacataaccactgcgtgttgggctatcggcaccggcacaccgccgtcctacagctagagtatatatgatactgacacatcacacaagcaaccgctcaatattgcatctaattataaacattttgttagaatgatgataaaataattctctctgaaaagagagaaacacctgtcaaaattagggtggaaaacaatcagataattgtcattgattaatatttgataatagtgtagaaagatgactttttatataggatcagagcctccaaaataataaccttatatcctattaggattgatatgtatgaatagtatatgtatacaaggatgtataaagataaatctagtcgactagaaaaaaaaaagaggaaattctgatgacagagtttgctagatgtaatcggcgaattggtcttcaagtaccgatctccttgattggataattcagatatggttttggtgtcattagtttgattatgggttcgattactcgatgtcctaactccctcttgggtgggggcggattcagaaatgatggggaggagggattcatctttttcttatgctttcggcccccctacttttctttccccttccttccctctctctctctatgaggatccaacggggtagggggcttgagcccctggtactcacgttgaatctgctcatgcatgggctatatatttacacctttagtctcttacttctcagggattaataaatacaatcttggtattgtcctgaacagtcctgctcgagtccggggcaattttaatgaagctattttgtattttcttatttgctcggagagatatatctgatttggggaacctttcccaacacattggtatattttagcctgatcttaggccctaattcactctccatggacgaatcttgtggaggaaatctaaagggctttgggttctcgcttctctctaaggtggaacatggatcactcccctactgcatagctttggcagatcgcttagccccattcattttcaacgcacaaataaaagaaggatgtatatatgagatattgtggaacatgatttgattatgcaagtggttcagtataaacgaagaaatttcgaacaaaaggatcagaactcactgataggaaaaggaggataaaaacaatgcttctctttttcatttcatgccggatgtaacaaaatatcattaagttttcctcaaaccacaggagcacctagcgcccagaagggcaaagcttttggttcggtgtacttgtcatttttttaacctcatatgttcggtgtacttgtcattttttaatcccatatttagtacaccctctgtttaaaaagaattatcttctgaagattttcagaagttagttttctttggtacgaagagagtacacggtaataatctctaaaatatcaccgcggcataatctctaaaatatcaccgcggcataagactaaacaaaataaaccaccaataaataaattgttagaatttatcgatcaaagctcttatggctgagtttagttttaaattttttttcttcaaacttttaacttttccatcacatcaaaactgttctacacacataaactttcaacttttccgtcacatggttctaatttcaaccaaacttttaattttagcgtgaactaaacacaccctatatctaggtaggcaaggggaagcacgtaacaatacgatttacttgcacttttgctaaaaataatattacgccgctggacacgtactactatatgatcaagccacgagagacaatattccatccaagtttcatttatgaggatctatgtcgctacaaaactcaacttcttgtcttgtccgaggaagcaaaacagttcatgagcagcaggaatttttttttttgatagagcataacttcggatatgcacatgcatggacattggatatacacgcacgaatttccaggccctcgtcagctcaccgataggccatctcttcagcaactgtgtgaacctttttatgggattagagaatttcgttcaaatgtttatatgagtaaattaatggtcgtcttaattaatttctttatattctaaacgtacagaatatgttcatattaattccgtctcaaaattgcaactcaaaaaatcagaaggggtctaaattttttaccccatatttaaaaaccaaactttaaatttagaatgaattttaattaaattgatgaatttttaatgggtgatttagggtttagggtgctgataccgcctcatcggaacccatcgcaagtcctctcaccttcccccaccctctccatactccttcactgaccactctagtggtcgccaaaattcacagcgtaattcacaagaagccaccaaaaataaagctagaggttattggcacaataatcgtggaataaattggaaggttagaaattcacatggttttattaattcgtaaatttctatcgaatgtaatgtgaagatgaaaatgaaattgtcatttgttaaatcatgcacacatactctgcttccaggaggctcatgcagatactccttctaagaagtagtactgtctgtactgatgaggatttgtgtgacccaactaatccattgttcatgtggttggcaacaggccaggtgctacaagttccacgaaaaagaccagctttaggcaccacagatcatcaaaatatggtaaaaaaaagaaaggcattttcaagaaagaaatagatgaaaatgagagggacataaccccatgatagccgtgatttgcacggtgcctatggcacctcgttactcagttagcgtcagtccgttaaacggtggttttcacaacagagacgttaatcgtcggctccaaaagcgaaatctttgctggcttttaggtagaaaaacgaagcctctgcaataatcagactaattaacgtcccaattgcatctttttctttgattgattgttggctacttaacacacgttgaaaacggaacgtacgtgtattaaaatctcaactcctccctaaaaaaaaataatctatgtttcacttttcaaattcaaagctacgtatgacactcaaccactaaatttataatcatacattatgaaaacttacaagcgtgtgatattatgaaattttttagccatgccatatctgaatatagtttggcagactatatatatttttaatcaatacaacttgactacatgtagtggcaagcttaaccatcatgaggaaaaaagttagataccacgaagaagccaaatatcaatactattgagagaaatatgaacttacttacaaatttaacgcagatagataggggattcgatggcggccctgacaactgggttagcccaactctataactaagttaagaattgagcttttaactgggtgtactaagtggttggagatgtatttttcatctttcatcatccttgaagataatcttgagctgaacaactataaagataaaaaaaatgactattaacatttaaaacaacagatgttacttgctagggtgataaaaactactaacctctgaactactatatttataaataaattaatggcaagacagaaggagccgccactcatctgtacttatacctacttcagaacggcatttttctttttgattttgccgcccctttacgggaagtaatactattgcaaatccgacatactatatagaagagattgattgaggtcagggatataagacatttctatcatcaaatatatatacaagagagattaactactcgtgtgcttgtccttggcctgctttggtaatggtacataatacattcctgttccaaatagataggcaccatgtcaatgccgttcagctagctgcttctgcaggcaaagccaaagacacaagatagccctgtgtagttggatacagccaacatgtttcagtgcggatcagctgcagaagaagttggatttggccggagcccttggagcaccgatctagctaacgaacgaacaacaccggtttgctcacctccatagccgctcgcagacaagcaaagcatccgcccaatgtgttcgtgtgatccaacgtactacgcccctgtccctccttttcctagtaccacacacacgttttcaggtttcagtacgagctagctagccaacacccgtttgcagcagtggcgttttgccagaaaccaaaatggaaggtgattttgttatttgtgtaataacggtggagtttaatttccttagatatatattcagagactggctaatgactgggtaattataactgcaaaacacttgggctgattattatctcccacttggccctagtcgatttcagtgtttgttagcttgcaggctaccatgactgaatgattgattattccgtaatctgtagctaatcagatcggatacgctaatacggcgcagtaggtatagggaggacaaagtccacaggcccagtagcactctttctgtcactcactcactcactcactcactcactagagttatagagcagacgactctctcactgtcagtcctcatgaaactgaaagctatgaaaatcccatcaaaagaacttgaccgtgaaaaataccccaattaaattacataaccatctaattttatgatgatagtttggttcgttaaaaacctaaaccaattaggccccgttctttcacgattaagatataagtagattttagcacggtttttaaactgttgaacgatatgttttatctgaaaactttctatatttatatatttccttcgtttcatactataaattgtttgatttttttcccagtcaaactctattaaatttgactaagttttttgcaacatataaaatattaaattggttttactaaatctaatattgaatataatttgataatatgtatgttttgtgttgaaaataatactatatattttttatatatttggtcaaacttaaaaatatttgattgaaaaataggtaaacaatttataatatgaaacggacggagcatcagcatattttaagtttgcaataatcaaggctcaattatgcactaatgttttttttcttgttttgtgtaagtaatctgagccgttcgatcacgcctcttctctcccggatcacacgacacccaccgtttgcctactttttatctccgtcctcttggattggatgcgtccgacactcgagccacaccgaatcccaaccaccattgccgcgccgagctcttcttcttcaccatcagcgaagcagagcagagcagaagcagagcgcggagatatgctcggaggtcgacggcgaggtcagcagcaagaagcgaggtagcgggcggcggccgcagagagacatgtggacgccgtcgcgggggtcggcgagcgggcggcgggcgacgggtcaccgccgcatcgcggactacctcgccgacgaccggacggaggcgtcgacggagaacgggtcgttcaacacggcctacagcgacgagctgttcgcgccgacgtcgtcgtccgccggcggcgatggcgtcggtggaatgctgccggcgttcctcgccgaccagagcgacctcgtggaggtcatgctggagctcgacgaggagtccatggtggtgcggagcgtgacgcccaccacgggcgcgctgtacgggcccacgtcgttggccgggggcggcgccgcgcacacgccgccggggagcgggcggagcctgagccggtgctcgtcgacgtcgtcgcggatacgcaagaagttcgcgtggctacggtcgccgtcgcccgcgccggcgcctagcgcccccacgcagtcggagccgccgccgccgcgggaggcggcgatggccgcacgcgagcggcggcgcatccaggcgcggctgaaccggtcccgctccggcgccaggcgcgccctcaagggcctccgcttcatcagccgcaccaccggctccgccgaggccgccgagctctggacccgcgtcgagcaccgcttcaacgccctctcccgcgacggcctcctctcccgcgacaacttcggcgactgcatcggtaagcaagcaaagccatcctccatgtccatggcgcgccgcgcgcgggcgcgatcacgcgatgacacggcgtacggcgccggcattggtgcagggatggaggactcgaaggagttcgccgtgggcatcttcgacgcgctggcgcggcggcggcggcaggagctcgagcggatcagcaaggaggagctctacgacttctgggtccaaatctccgaccagagcttcgacgcgcgcctccaaatcttcttcgacatgtacctaagccagccataaatccaaccaaatttccttcgaattttgagttcgtgcgtgtttcgatgaatttgtaaaaaaataaacgagtttctttcagggtggataccaacgtggacgggaggatcactagggaggaagtgcaggaggcaagtagacttaattacacttacttattactccatgattaacttgtaaaatcactggacagtaacattttagaagcttccgttgttgcatggctaacgacattactactaccgtaactgtcactctcactctcacagcatttccagtgtcaaactaggctacacgaatgattaacttcactgttagttaaggtaattaaataatttttactgcatgtggttatttttttttttacagctgatcgtgctgagcgcgtcggcgaacaagctgtcgaagctgaaggagcaggcggaggagtacgcgtcgctgatcatggaggagctcgacccggaggacctcggctacatcgaggtgaggatttcgctttcgccatttctgtgctctgtgtccgttgctgcttgagcttgactcgtcttctccggcgacggcgtggtgcagctgtggcagctgga

SEQ ID NO: 62315 - DNA, 1784 bp, Oryza sativa
  unsure (1)..(1784): unsure at all n locations
tcgtgcagtaccgccgcacgccggcgttccgggtgatggggtactgcctcccgacggcgaagggcgccgccgagacgctcaagctcaacatggcgctcgtcctcctccccgtctgccgcaacacgctgacgtggctccgctcctcctgggcccgcttcttcgtccccttcgacgacagcatcaccttccacaaggtaggtactcctcctcctctcgagctcaccgccggtggttgggaggtcgccgtcgccggagttcggggagacgactcgtcgcccaatgattggcggccggtgcgtctctgccttgtgggcccgggtgggccggctcgggatcttctgcggctcggcccatgtggggcggtgcgacttttgggccgtgtaggtggagagtagctcgggctttaagtgggccccaccggggcggtccaatcagtgtagcgtggccggggaacccgcgggtacagaagatccccggcccggtcggctcagggtcaaagcgccggtcattcaaaagtctccccgaccgacagggctcccactgtcatgtggggccactgtaagctactccaaccggcagggccacgtgttcattaagctaagctccaggcataaaacgtttgtaaatgtacttataggatcaaggtggtcaagatcgcaataatcgtttcttctgacattagcaattataaatttaccaccctcttaactcgttatcataaaactagaatatgaatagtgtaaagcattttattgtaacatataaaaaccattgataaatttacaaatacccctgcttatacctatgtaggatcagtcgtcatacgtcaaatttaaattttaaaagttaatttttatttttttaatattttgtttttaacattttctttggaatttaaaacacgtatataaaaattttacttacgctccgttcgttttttctcttaaatggcaagaaaaccggagcaaagaaattaacaaataattaattaattattactccattacaaacttaaaaaatagattcatttgaatttttaaataaaattttatataaaaacattttataaaaaatacaccgtttaatagtttgggaaacgtataaaaaacaacaaagttgaagtttagactttttttaggtaacttttttttagggaacgaagtttagagttggagtttagaacgggcctttataaattaattttgattgtttcatctactttttcacaactaattagttgtagagcaaagagagcgaggctaaaattagcacattgttgaggttgctagtaattgcaaaagctaaaaaactttggctacacctgcagatcatcgcgacggcaatcgcgctgggcatctgcacgcacgcggggacgcacctggcgtgcgacttcccgcggctgatcgggtcgagccgggaggagtacgagctgctgctgtccggcttcttcggcgcgtcgcggccgacgtaccggggcctcctcgccggcgtcgagggggtcaccgggatcgtcatggtggtgctcatggtggtctccttcacgctggcgacgcggccgctgcggaagcgggaggcgccgcgcctcccgttcccgctcggccacctcgccggcttcaacgccttctggtactcgcaccacctcctcatcgtcgtctacctccttctgctcgttcatggctggttcatgttcctcgtcaccaagtggcaccagaggacggtaagtannnnnnnnnnnnnnnnnnnnnnnnnnnnnnnnnnnnnnnnnnnnnnnnnnnnnnnnnnnn

SEQ ID NO: 62316 - DNA, 11351 bp, Oryza sativa
  unsure (1)..(11351): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttccttcactccgaaggtggtgaactccaaaccactcacaaacggtgccgggcctcctccacaatctcctcggagaggtcaccgggcaacacctccacaagccgtctaggaggcggcaacctccaagagtaacaagtctaggatgcttgccgaggatgatcaagtgccacactagctataacaatgaagcaatgcacttggattggcttaactcactctctaacacctcactagataaactaagtgcacaagggtgtgagagctcttgcaaggggggttcaagataatgcaatggagtgccaaaaccttacccttgctgctggggagtgggtatatatacccccaaccaccaaaactagccgttggaaccgaaatccccaactttgtgctctgccggtcagaccgccgttgtgaggccggtcagaccggactactttgtaacggctagaaaactagccgttacagggcaatcattgagcccactcaacctggccggtctgaccgcagtgtagtggccggtcagaccgtccacggctcggtcagaccgccgtcggctcggtctgaccggttgcggctctggcagctctgtatcgccaccaaaaaccagaccagtgcaacaaaccagtggggccggtcagaccggccttaccacgccggtcagaccggctaacagacccggtcagaccggcctaatgcccacggtcagaccgcaggtcacttttcagctcaaccgaccgttagtaaaacggcgatatctcttgactcgggtctcggaatttggcgttcttggactctatggaaagcttattcaaagggccatccaacccatgaaaaatccatccaagaaacacaacttaagtcaaggataaagggctcacactccaaaggatatccaccggacatacccacaagatgtcactcactcctattggacatgcccacttctctcttggtttaggacttgagaaaactcatcacacttggttagacaagcccacaaaatgcacctacatgcatatgaactaatatggcacaagatcatccacaagctcgcttcatagacccctcttgatagtacgacgtctatctagcaaatccggtctacaccaaacaccaagaccgggaaaagactaagaaaacattcttagctacattatacctttgccttgcgccatccatcttggggtcaagcttgagccgagatcaacacttgtgaccatccggttgaaccatgtttatgctgaggtcttgtccatcctttgtcaagactttattctcatcacaagcttgacttcattcttgttaacatgacgatgtccttggcttgatgaccactaacccatggtgtcattcattagcctcatcatagtgggacctattccttttcacacctcaaaggagaacattagtctcaacaaatcggttgtcatccttcacttgaagaccaaccggttgcatatgaaagatatggatatgtttgttgagtattcattaacttcacaagtgtcatatactcgtatgcaagctcaagtgcaaagatccgatataaataataggtgaacaacatggatctagaacatgcacaataaatgtataggatttgctccccctaaatatatgcatacaaataaatatacaagagatgcaagtgtatgcataattagagaatgaccaatgggggtttatcctatacatatagagaaggcatatgtagtaatgatgtagaccaacataaaacttataccttcatgatctccatgttctcaatgtaaatgagactaaataagataacattcgagtaaacattagtctcacacttatatatcaataacatggaaatcatatatatgaacctatcaaaaagtaggagataagaagtggtacatatcgttttatctccatgcatttcatccttgtcatgattaaggtccatcacaaaagaatgcatgtcttccacatctcattatcgggaaataacctagtagacaacttatgcaaaagagaggttaatcccataaacatcggtttatcatctatcaccaaagtaacaattacacaaattgtttaatccaagatctttcaatcttttctctctttggtgatggataataacccgatataaacaatacagagagatgagatgaaaaatgatttcaaatcaagatagaaatcttataataaacaaaatatagaataagctccccctcaagatgtgcatacatatggatatgaaggaacacatatgcacataatcaataaagatcaaataggaagctcacactatattttggatccacaagagagaccaagttagaatatgtgaagtttaatacatacctctcatcatttttacttccatatccaaatgagactagtcaaagaaaggctcataaaaacgttagtctcatataattagatttgtcattaatcaccgaaaccaaattaaggcacttgaacttatagccggtttaggcatagttggttcttaaccagtagtatctccaggtagagctgggacttgggccctgctttctcgggccggtccaaggcacaatggcctagcacgagggaaagcacggcccagcacgacacggcaatgggccgggctagcacggcccgtagttgggccatgcttgggctagcccagcacgaaaaaggctcgtaggcccgaaggccggcccagcacgaaaaaggcccaaaggctggcccgagctctagcctagccgagcgcgcgaggagttaggagtgcgtgcaattcgggccggccgggaggagatcaggaggcaggagcgccgagccgccgagcgcgtgcgtgcgtggtgagacttcagtgatgcgttcagtaactgatgaggtcagccggcggctgcgctgaatactgatcagtaacttatgagcagtgctttcagtctttcagaattcagagagccgtgcatgcatggaaagcatgatttttttggctaattaattctgggatcacttaccattggcgattagtatcgtgtatatccactgtctagtcaattaaatttttgtttgtgttttttcaactttttaaatggctaattacctgtgtccttgtttactgcaatggtgcatgcatggaattatggaaagcatgttcatttgcgtggaagttcagagttcagacgcatcgaacggtcgaggtgtcgactgatgactgatcattggtcgatcagtattcagcacggaggagtcgtttagtcacgtgtcatgggctcatggcacggcatggccattggtcgatctgtcatcagtcaaggcgtcgagccgccgaggagtcgttcagagttcagacgcatcgccggctgataaccgaggaggcaagggagaggtgaagagcctggcgcccagccctagcataccctatataaaccatacccattttttttgatttcaacacacttcttcttctttcaacacatctccccaccgtatctatttttcatagaaaatatgcggaggtccaaaaagcgtcaacacgagtcaacaaccggtccatcccagaggtcggtcgatgcccgacagctatccctgggcatcgatgactacgggatgcatgatcgccacatggatggtctggagggcgacgacgatgatcagccatctcctagcgaggccaacttctccttcgacaccaacgccatgacgttgcccacaccaaattccaataaccagccatctgccagaagagcggagtgttggcagcacttcgaagtattcaccgagatggttgacggtaaaagtatacctcgtgctcaatgcaaatattgcgacaaaattttgtctgcagctacttcttcagggacaggccatctcaaccggcattacttggcgcatctcaagaacaaggcaccggcaggagcaagacagacacaattgtccttcggctctgacggttctgtaagtacatggatctatgatccaaaaatagctagagaagagattgctaagtttattattgctgaggatctaccaattagaatgggggaaagcaaacattttgagagaatgatccaaaaagctttttgcccacagtacaaaaaggtttctaggaaaaccaccaagaacgatattacagctatatatcattctaagttgagtgtgttgaagcaaactttcagtactactagtttttcatttgctgtgacatcggatatctggacatcccaacaccaaagaacatcttaccttagtgttgttcttcattatcttgacaacaatcggtcattaaataagagagtcatagggttccaactcatgacgtcacacacgggagatgccatagccacgacaatcctagaggtattgagagaattcaatttacaatctagggttgtttctattactcttgacaatgcatcagcaaacacaacggccatatcgattttggagtcggatctgcgaagttatgttggaggcttcgttattcatcagagattcatttgtcacatcatcaatctcatcgttcaaccaggtagtaatgttattaataatttattgattttagtgtatgcggcatattgcttatttattttaatgtatgcgacctatttgttttgcaggcataattgttccggataaattgttaaacaaaattcgtcattctgttcgtatcataggaggtaacacagtggtcaaagcgaggttccaggactactgtaaagcgaagaagaaacctggacggatgtttggcattgatgtcaaacataggtggaacaaaacatacctattgctgcgacagttaaaagggtaggaggagttaatttctgttttcatcaattagatgcatgtcagaatgaaggatacaactagacaattatccgagagtctgtccccctccccctcccccccccccgcatcgcccacgcgcaggcgacacggggggcaaaccctaccgccgccaccgccgctcccctctccccctccctctacctcaccaccgccggagctcaccgccggcaaagccgactggcaagctaggatggcggcggcagggcctcttccgcggcggcgccccctctctacgtgggggagttggcgttcgctggtgtcaaggagtgcagtcagggaggcctcccggttaggcagcggcagatccggcaccgctgtcatcggatctgggaaagctctggtggcagcatcgtggggtggcgcgatgcagcggtggccgctgcggcccgtggcggctcacggggcagcacgatgggtggtgaggcggcggtgttcacgcgtgtggtcagttgccggcgctcgcggtgccgttgcagcggctgccagctccggtggtcggcggcgcgtcggggtgaggcggcgtggctattgcagcgtgagggcttgtgcggcggcggtgttgcttgcatgtgggtggtggccggcatgtgggcggcagaggccgtctcttgtggggctgcggcggcagctggctcttgcggtcgcggcacatcgggtcatactggggggtgtgctagcgtctccggccacccccattcccctgaaaccaccctcttctctccttccttccctcctatctctcttcctctcgctgctgtctctcggcactagcagttgggggaggcatgcgtctccctttccttcctccttctttctctcttctctatttgccgcctcttggcacaagctattggggaggccgcccccctcctcttagttgtctaggagccttgctgatcaccccagtgcccctctctctgtgctggtggtgaagttggaggtggttgctgcagtcgaaaggttcatcccgcgaagcctggagctcctcaccggttacatggttgacaccgatgcccatttgccctgcttccagctctcagttcttccccaggcctgcctgcctcctttcctccttgttgctcctcccttcttttggtagtctgcttccagatccggccgtggagtctctcagtggttgaggagtttgtttgtccgtggggttggtccagtctgactgtaatcagggcttttgggcctcgccggtgcttcttgtgccctgtgaccgtgtgaacctgctgtatttccgagtttggaccggagtgcttacctctagggtgcgagagttcttgtgttaaggcggagtcggagctgctgcatcgggtcagctgatgagctgggcaacgataacactcaacactcttactttggcttcttggaggtcctgcaccttttgtgagagtgttgggtgtaagccttgcctggtctttcaggatcagcaacatcgactcctacgggtgccattccctccttggaggtgtttccttgtggactctctcccacctttgggtgaaaacccagtccaacttttgggcgggcgtcaacaatggctttggtcgttgttcacctccttggaggcttcgccttaaaggtcatgctcttccctcggtctctttagtggttcgtagttttgttacaggcttttttgtgtcttctgtgtaagggtttgccagtttccccttagcaaaccatgcagttgtaaggcccggttttccttataaacagggtcaactctcttcttctaatatatccggtagatctcctaccgtctactgtttcaaaaatatgaatgaaggataccgatgacaacggcgatggtgagattgtgattctcaccaatcatgagtgggagatcgctacacgtgtgcataaatttctgaagcccttttataatgctatagctcaattatcaggaatttactatcctacatcttgtttggtgcttgagtggatttggaagctggcacttgtttttgatgaaaaccgttctgatcgtattgtcttccattgttaaacccatggaagaaaaatttctcaaatacttcaccgctatacctcacctttattgctttgctttgatacttgatcctcgcaaaagttggaaaccgccaaggttgccatgaactcaataggtgatgcagtggggcttgattattctgaagcttttcaacatgtcaatgatgagctctatagggttttccgtctataccgaaccaagcttggtggtactccccgagttcctgagcagacctcacaaaagaaagcaagcaagtcaagtgcagtaaatttgtggatgcagtatataggcaacgaccaagcctctccatcctcagagaacaaatcaacatggaacccggattcagagcttaaccactacctcgccaccaatcatactgagcatgatccgacgcttgatggccacgatgtcgatctccttgggtggtggaaagagaaagagcgaactcttcctgtgttagctcactttgctcgagatattcttctggttccagcctcctccgtctcttccgagcaagcattcaacgttactggaagaattattgaagaacaatggtcatgcctgacacccgagacggttaagtcaatattttgtcttaaagactggatggaagcagacgaactaacgcaacactgtctacatgatcaagagtttgccgatgcaatggaagacgcattggcggaaatttgccttaccaaagatgatggtggtgttgatctggagtaattgatggtataatgtaaaatagttgttgtactcttttttccttacggggaaccctactttagggcgtaaggtttttaacgaggcaacaactatatattcaaattattaacatatatattttcccccaattttattgtctcaagttatttacgatattatgtcaattctaattgtgttcattaagccatgtacattattatctcattgttttttcatttcccctctcttattttttccctcccttatttcagtttcctctctcatttaccctgatttttcccctgttattatttcatttatcaatcagcatcgggcaaagcacatggtcagaggcaaaaaccctaggcacccggggcgtcgggagtcggtcctcggcggcagcggctctcagcgtcggcagccctcggtgcgggccgcacggcgtggcgacagcggctatgcgcggctgcgcgatgtcggtcctcggcggcggcggcggctctcggcgtaggaagccctcggcgcgggccgcgcggcgcgacgacagcggctatgtgcggccgcacgacgtcggtcctttgcggcggctctcggcgtcggcggctggcacgggcagcgccgcagggagcaggcggcggcggcggcgggtcggcgcggccgcgcgggccccggcgaaaaccctaggcacgacacgactcctcaggtaattctgggccgtgcttgggccggcacggctcgaagaggcccgacatgtctttgggccgtgcttgggccttgtcttctccacctcggcctagcatggcccggcacgattagcaggccgtgctgggccagcacggcccattctagcacgaagcacgatgggtcgggccgggccgtgctagcccggcacggcccaagtcccagctctatctcaaggtcagcaaatggtgttgtcaagcacagcagggagttctgctcaaagcacgaagacgaagacagtcaccctgtgtacaacaagtacaacccaacaatccatggcccaaaaaaaaaccaagaacaaggtatgtgcaaatctttctcccttgcaaagtttacttgtaatcactacaagttcaacatatgcaaatatatttgactgcaggcaccaatggagacccaggagctggtcagggttaaatgccaaggctaaagtttctatagaacatggtggttcagctagagttgatatgcaagccatagttccccattcctagagctctacaacttcatatgtgagactcacatttggcaaagcatctgtttgtgtctcaactcaagaacctacacaaaccaagaaaaagaagaaatctggtggggcacttcttcttctgcccccatgggaaactaacaagctctgaatatggcacgtttactactgttagagtaatggaagtacttgttttatgatgtaatggcaagcaaattagcccagtatttcagctttcttcgtagtgaggccagactatttgggttaatattccaactatgtgtgatgtaatgtcagacctattagcctagaacttctgctatgtttgttgtgatgccagacaatttggctaactatgccacctatctgagatgtaatgtcagacaatttcagttgcttttgtatgaatgatggagaaaaatatttcagttccattatgcaatatcatccaatctttctgcttgtttgcaaataccaaaagtgccttgtttgcaactagctgaaacatatgccattgtcatgttcaaaaattgaacatttggtgtattatttaggtttgctgcacaaattgcacatataaaccattcattcacaacattcattccaaatggttaccacaactcaggatacatatagttcatgaaaaacatgttgtttccaatgcataccaaacacacgatcttgttcacaaattatagaccacacatcaaataatctcagttcttcccaaacaacaacacaaacaccacaaacagacatgacaaaacacaaattacaagcacatttctctcattatctagcttttggttcctggccttcaaacttctaatttcttctttgttcagagcaaccacactccttacatcatctaccgctttcctctgttcttccccctatgccctactctgttgaacctccttccacagcacttcgttttccctcctcaacgaagtcacagcgtctcgcaagtcacccgaacctagaaatcaccccccccccccccaaagcaacaagaaaccctacattcaaccccgaagaacaccgactgcgtatatgcaacttcatctcaaaatcagccaaaatccatcatttactcgaccgttttgacacttataataccaccgcgcagggttgtcgatgctctacaagatccaccctcaccgccttggctgggcaacgacatcgacacattaccgcaggttggtaatccagaggaccaacccgacaaggcacgggagaggccttcgactgacagggaagaggctacccaatctcacatcatcaacacggtacaactgcagctaatccgtgggagaggtaagaaacatgttccttgatatggtcaatagcacaatagcttagccaagctgtaatcctaatgacaaagcttataggaattcttcaacaagacgaaacctgcacttaagatgccattctggtaaacaagtgcaaacacaattaaatatcagaaattgcaccgtggcacagagggtgaaatagggtcctaggccccaaatcaaagctacaatggcatacaagtaatcatgtaaccaacaatgtagtaacacttcaattaagcaatgcaaggtaggttgtccaatcaatcctaaacccataattaagtaacaaaatcaatgccaaaaatatatggaaactcactgtattgttatggtgaatctcctcagggagtgaagtctgaagagatgggcagcagtcatgtaagtatagtgaaaccaataaatgatcattgtcagaacagtggcacaaaaaatactactatgtgcaagtaacagtgaagtatgtgagagagaactgaacgcactccagcatatatgtatacaattgtgaagctagcagatatacaaaaccaggctccaaacagggagattcttgttagaatgtccatttgagagaaaattagcaggattaagaaaacatagcttgtgaagagcattgatgccattggcagctttctagaaattatatccacaatcatggccgacaaaaatgatcctggcctctgtacttgaagaaagcagggcagcatttgttataaaaatgagaatcaaatgcagttatgcatcagaataattagtaacaaatggcaaaaaccgacctgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62317 - DNA, 6977 bp, Oryza sativa
ctgggttagtagcttgctttaagctcaaggaaagcatgcatgaacaacagatcgatgcagtggtgtggcgacgatcgatgctgtgtcgtgttgtagcatctgcatgctgagatggaaggtcgattaggataacatgagatgcgagctaattaagctagcttagctctgtgaaaagttggtgatggcaacgtgtgtgatcgatcatgccaggggtcagggtggttttcttgtttactgattggcttatcagagacgtagggttcatctgagcttaggttgaccaatgttttggatggatggcttggccacctttgccttttcgtttgtgcattttaatgagacacttgccgtggggtttcaggcttgatcagtattccaatcccctacagtctacagacgctttctgagttttttttttttgagggttgggggggggggatgataagcttaggcattcgtgatcatcctgtgtctgctggttaatttgtcaatagcaattgtaaatcaatcacctgttaaaggcgtacagtttgattaagatgtacctaataggctactgaggaggaaagatcaaccgctgtcagaactacaagcatgtccttacataaaaaaaactccagtttgattaagatgtacctagtagcaaaataaattcttttttgctactagctgctatattatcgcaaacacgtttctcaaggtgtgtgttttttttaaaaaaatagtttgcacacacaagtttttttaagaaaaatcaaacaaatttattttttaagtttataatagttaaaaattaattaattgtgatataattgagcattttgtcgggtagggaaacaagaaacgttctccatgggctgtcgccggagtcccgcttcagtgcaaaaggccgtgcagaacgccgcctgcggcctgctgtgacaacccacaccggccgcgtctacttgggccggcgccatcgccatgcgtccgtacaaaacggccgcggatttcgctcgggacgccactaaatcggcccaaaggccgttgattatgctcgggaccccggtaatccacggcccgtgtgggtcgcgtttcaccgaccggtttttgtgtgcgcgcttgctttgcagtgcagtggctgctgttacatcagcgagcggagataactgaactgaacagtaattgcactgcacggaggctgcctgcctgtctggctactgtagacggaaaaaaatatgtagccaaaatttttactcatgagtaatagacttgctagtaaaaattttactcgtgataatatgaacaaatttcagacgtctatttcttaacccaacgttttcaaatttcgaatacatacgtagttttgaccgtatattttgctaggggcatctcgatcgagtggccatccgtcgcatcgggactactactactactagaaaacagatttttacaaatgaccaaaacagatttttctttttttcagacgcccatccatcacgcctgcactttttgttccgatccatcgccggtcttcgctgactaattaacttacgcgctagctatcacaccttaattggtacaggcatatgttaattaatatgcacgctacacgtacaccacgtacagacaacagccgttcgatactttggataagaccatatcgtttcatgcatgaacagtgtccatgtacgtatggctgcttggtgcctgggcaatgcactggcggagttagccatgggacatgggtacgtaagtagagtgggctgaccccatagcttaattttatacattcaccttagaggtctttaaaatttctatatgaatctattcagattcaccttagaagtctttagtgtactaaaatataaagtaagaataatccaccttatgccaagttagttggtatttaacttctgagaatatagaggaactaggtttgtcagcttctagagtttctagtttatttcttaaaatcaaattcaaaatctgaattgctcggggaagatgaagtttttgggagaaactacagctgtacaagatctaatatataggaggcggcagccacaggaggcatacgttacgttgcatgtctcgatcgatcggccggtttaattcgtcagcgaccaaacattcttggcgacgatattatggactattgggccataaagcgcatacgcatgcacgtcgtttccttgctagccaggaggatgaaagccgcaagcgcgcgtaccagtttatcatgcatggactgatcgcttgcaacttgatcaacggatgaccgtttggtatatctatctaatcatcaatagcatattatttgtatgtagaagttatatatgtcgcatatgcatgcatttcatgtcatgtatcttgcgtttttaatatatgatagtaccgttgactttttaatcaatatttaaccattcattttatttaaaattttaaataagacgaatgaccaaattaacgtataaaaagataatagcgtcatatattaaaaaataggggagtaattattgaaaagattagcataaatatgtaaaattataataaaattatatgttaagattatagtttatttgataataaaacaagtcacaataaaataaataatatttatatatttttttaataagatgaatgatcaaaacatcatgtgatgtcaaaagttgacagcatcacacattaaaaaataatagaggtagtgtagtactccctctgtcccataatagaagggatattatggattttgtagggatgtaacacatatcctagtactatgaatttggataaagagtctatcaaaattcatagcactagaatatgtcacgttccttcaaaatctcttatacttcgggacggacggagtattagttttgctccagcgtttgccgctgctcacagccaaacacactcgtgcgatcaggtaaaaggaagaaaagagctttgctctttttgactataagactcaagggaacctgttttttacccctcgaggggatgttccctcgttatttgcatgtcactcaaatgattataaaaaaatttaaaaattctgagaagatgtattaacatgcatgtgatatatcactccacaaacatgcaagttcaatgcgatatggagctggtgctgtggtgcatatactcacatgcatgggcggtgtaagtgtaacgctccgcttctcgtgagacgttaaaaaactattttggcaaaatcctattcgcgaaaattttcgttctttgtgtgtgagtctaagttgtgccaaggatctcaattcaatcccattgttccctctcatcgaaatcaaaatcctctgcctcaaatttcctcttccaattcaagtctccaaaatctaattccgaaagtcaatcccttcctttgaatcctcgccaaatacatttccgaatcccaaaatatccaaactcccgttttgtttccttccttgactccttgaacccttgtgtacaaagtatcaaatttagattcaaaacccaaactccaaatctctccaaatcaaaatctttcagcaaaagtctattttgcctcccttgtcgatgggctgattcctctctctcacggcccatcccctcctctcggcccagctctctcgagcgtgcgtcgcacgtgttcgggagcgagagacagcgccgtctcctttctctctctctcggcgtcgcttcccgccgacgccgccccaaaattccggccgcgtcaccgtttcccgcgtgctcgcgcatggtcgaccggcaaggacgccgctcccaccgccttcgcccttcccgcgcgggttcgcgtgtggccaacgccccggtcgccgctgcgacaaaccctggcgccgccagcgtcgtgccctgccgcgctgccgctccgccgctccacgccgctagcttccaaggccgagagaggcagcccctgtctcactcccctctccctcctccttttcccgtttcggcaagggtcaaaccctcctttccctcttcctttcccctttttcccgaccaccgccgatgtcatccatggtcctagccgctcgctccggttcgccgccgctcgccggaacgcctcgcgcgtcgtcggccgtccgatcccgggcgcctcctcctcctcctcctcctcccctttcgcccctgcccacatggccgaccacgtggcagccacctcagccccgggcccgcttgaccgggtcaagtcgcgcccagtcagcatcctccctccgtcttccctcccgtgcacgcggtccacggcaagccgtgcggctgcacgtgggcccgccgccatccgtccacccggcgcgccgcgcccgaaccacgcgcacctgaaaccctagcacccgcccccgcgtgcgccctccccaccgtgaacccgaccaccgccatgtgggtcccgcgcggtggaccgcgtccacccgcgtcggcctctctctccccgcgccccctctcctgggccgcccctcccgcgcccgcgccggcccattaggtccggcccagccgcataaacccctcgggctgcgcctaagccgccctaggaagtctatatggcatccctcccttctttttcaagggatttaataaaccctttttcccctattccataaatcaattccttattcccaaaattccataaatcatttccttggtcccgcacgtcagtgacggtcaataatatttttgagaatattatttctataaatttcataaatcaatttctccttgttccacaaatatcttcctttgcccagaaattccaattaaacttccaaaattcatatctctcaatccgtagctctgattgactccgttcaacttccagtatttccataaaattgagatctatttaatggcactactaattagtctaaataggatctttcttttggtcttttgtttaggttttcgattgtttgcgtatagttgcggttaccggattttcgtcgatcgcgggttttctcgaagattcgtgaagcttcgtgcagaccttgagcaaggcaagtcaccctctgaccaattgctcctataattggaaaatcattattattttgtttgcaacttgcattattagaatcacacactcaacttgcttggcctcggtatgcgtgccaaaccgacggacctacccagtagtcgcactaattcatgtaggttgtgctaccctgatttccttgtcgctccacctttgtggtacctcagtatccgtgctatctgagcgcgtataccaaatatcccacatacaccgttgtttgtcgaaaacttgggaaatgggttcgagaagccttgaaaacccgacatgtggtgtcggcgtgtttgaaaataaaatggattgtgaaaactcgcgatgcgggggttgtgcctgtgtggcactgtcccgtattcgcatataaggaccgattcctgtggaaaattcatccgagcatataacaagtgcgaccacacgggtgcaatgggacgcccctggctgagtaattagctaatcgggggagccatgatgccaagagacatgtagattcaacggggtggtgttggggagaaccctcgggcttcctggcacagtatggtctgggacctaatctggtgttagtctgggacccctctcgttggcatatggtgaacctgtgtcggctttcgaaatgccttgtcatgaaagccttaaggtctcccgacgtggctgatctcacgggctgggtgatccgggttagtaatgtcgtgtgggtaaagtgtaccccctctgcagaggttaactaattgttcgaacagccgtgcccgcggtcatgggcggatgtgaggtgtttcctgtagcgtagatttgttttcctgtgctttgtgaaaagttgttgtggtgtgggaatcgttaccagaatcagcctatgtggcagatggatgacctgagtggtcaagaaacgaatctgtgtgattcgggatgtctacgggcatcatagaataggcttcccgagtggaagcggattgttgtgctgctgggcagctggactctgggagtccgagaaaatgaaaaaggctctgggagccgattaatcaagtggaatggctctgggagccgagaagtaatgatctgacccgggaggtcggtacattaccaattgagctgttgaaaaacatctcttaaagtcgaatcgagacgcaagtctcttttcggcccaaacttagaaagaaataaatcacttagtgatttcaaaatgatttcaaaacaaaagatttgcaaaaacaaccttgccgctcttccaagcttgcattaaacacctaagttcccgtgacttgctgagtacgaaagtactcatccttgctctatataaatatatataaatatatatatatatatatatatatatatatatatatatatatatagttcctccgccctgaagctgaagtgaagtgaagattagggtttcgtcctggttcccagctgtcgcctatggtgatgggtgttagttcgttggttccgctgctgctgctgctggtgtttcttcgtccgtgtcgtcggttgcattctcaggctgttctgagctgcaacctaagttaaggtaaataagtcctctatttattataaggattgcaatgattcatatttgtcaccgtgggtaccagcgctatgtcctaggactggtactgagatcgcggtttcgtaggaagcggttcgcgccgtttttcctacgacacactcctgtcaggtgccgttgtacggcggtgccagattggggtgtgacagtaagtgggtcagccgcgaacccacttataggtcaaaataaataggttcgctgcttattttaacctataagtgggtttcgcgggctagccacttacacccctacgaatggccgccgagatgagactttttggttgaatttcagcagcaacgccgactcgatcgatgccagccacaatctatcttcgccacggcgatcgacgtgacacgccaagctctagctagctccatcagtgacggcctctcgccaccatcgatcgatcggtggcctataaat

SEQ ID NO: 62318 - DNA, 11647 bp, Oryza sativa
  unsure (1)..(11647): unsure at all n locations
ctgcggcaagtacgtgccctccgacttccagtgcccatccactgatccaccgtacatataaatcatctcaaataattaatcacacacaccatctctgcatgcatgcgtgcatggatggattaattaattaattaagctattaatacctgcatgagtatagtttatcgcctggctatactatatacatgcataaattatataaaatacatatagtaacgtatgtagcatatatacatgagctctgatcgacttgtgtcatggagacatggaggcatgcatatggagccttggattgtgcattaattgatgtataataatatttgtgtgacatatatatatatatatatatatatatatatatatatatatatatatatatatatatatatatatacatgtggagtttgtggtatttgcaggtttgttgtggtttgggagatttataatgaaataaagagtgtgtgatatgtatgctatgaaatacaaagtttgatgtgtatgtaccatgtatatgtgtatggttgacaaagcctgtcaactttcctatatataaaacgtacttaaaagaatatgtttcctatttccatgtgttttttcatccattgttcaaaaggagtgcataatattaaaaagcagatctggtttctttcaagttcaaggctacgatggaatggaagaattttacgacaatttcatgaaaattaaactaattcaagtgaatttcctgtaaacttcacgggttccagcttccaaattaaaggagcatgcactaagttgtatatgtacaaagtggatatttccttcgcaaaagaaaggtggatatttcaatcttgatcgaagggatcagactaattaacagagatactctgcaactcaattttgatagttgccacatgcagagttaataaagaaaaaaaatacaagaggccgcacaactcaaggcctgagatggtctttaacatccccattatttcgcttatgtttaagcttataatcaaattttaaattttaaaactaaattttggagttaattttgtggatttttcattcagatcatgtgtgttcagccggtcaggtaagctatgaacaatttttagcttttcttttttaaaaaaagagagagttataagtgggtttgttataatatccttgcaaaaatgaaaagtcaaaattaaatctactcaatggtaaaataacatgtagaatccacatgtgtaccacgttgactaattaagttatcatcttagctaaaaccaagagcaatattgacttgggtaccagtcaatgtatgtagtatgatagcttggcacttaccggcggagcctaggtaataaggtgtagggtcgactgattcataacttttttacattcatattgattcaccttagaagtctttaaattttctatataaatccctttgaatttatagaggaagcaatagtcgtgtagtggtggagtcgtgggtgtataatgtggaaaatctaatatgttgtattctaatgttttctaatatattggatcgaccctctcatggggtatatatatgagtacataggggatagagacttggagtacaatacaagtaagagtaaatttatctctaggattctatctataggactctatcttatctctaggattctatctctaggatatatcttatctctatatttgtatttgactcttatctctaactaacatattatacttctaacattccccctcagtcgtaacgggagcgaagctaacgattgcaactggatttaaaatcttctatttcttcatcttctttaactcaccatcatcaattgcatctctgatggacggtcctccacctggtgcctgcgtccccttctgtgtcgtcccttgactctcctctattccctcccgcagtcatagcgggagtgtcatagacgatagcgatgacacggacgctttgactagagtttccgtcaatgatttttgttgtagacgttcgtcgatgtagctgatcatgtagtagttgtagtcatggtggtcatggtagttgatgtagccgcaaatagccgaaggcgaaaaaaaatatttacgccatggtgtgaagacgaaactgtaattgttagcatcttgcaccttgtagatgtcagatgatgccattggagacgtcttgcatatgtcagaggacgccgttggcgatgaggccaccacttcggttggtccttccgcaccatgtagcggtcatcacaatggtgatgccggattgatgcagtctttgtcgtcatagatgacgtgatcgatgccgtcgtcggtgtcgcggtcgttgccgtcgtagaggacgcggtcgatgtcgtcgataaagcgtcttgcagattaatctgtcagaggacgcgagatgtccatcttcgtggacgagtcggcggcggcatgttaccatgttgatgaagaccataggagtcgatgtagtcgtacaactgatgatgagtattgtccgttgtagatccgaagacatgtgttgttgccgcggagggagtcgatctcggcggccaccggtcgccggccgccacaaattcatgcatgtgaattctcctcgggctcggtgcaccgtactgctgcttgcctgctactgatgtgtgcacgcactagatgcctctctgattcttgctgctcgatatgacgcttgaattggctatacagcttgatggacaatggttgcttccgctcaggaggatcgcttttatgtggctaatgaagaaactaatctaatctaatgctaattaatggaattggcggctgattaggcacttgcttcttcggctaatgattgaagaggctagctaatggcgttgccccagggagataccatttgaaaaatctaatatgttgtattctaatgttttctgatatattggatcgaccctctcatagggtatatataggagtacatagaggatagagacttggagtacaatacaagtaagagtagatttatctctaggattctatctctaggactctatcttatctctaagattctatctctaggatatattttatctctatatttgtatttgactcttatcgctaactaacatctaactaacatcttggcgacgatatcatggactattgggctataagcgcatacgcatgcacgtcgttcccttgctagccaggccaggggatcggatgcattgcgcgcgtaccagttcatcagtaattaatcatgcatgtactgatcgatcgcttgcaagttgactaacggatggtttggtatatccatctgtctaatcatcggaagcatattatttgtatatatgtcgcatgatgtagagctagcctaggaatacttttattagtatatttcgtaaaactatatataatttgattaaactaatacgaaactacatatatatatttaaaggtctatatattataaaattatagatttatcattaaatttatcacgaaacggtagacttaaagcatagtagcacaaaactatagatttattattataattctcaacatagctactccctttgtcccaaaatacttgttattaattctaattaaatgatgtatgatgtatggttagaagtaaaatggttgtttgagggtacaaaatttgaatgggagaagctagatggatagaaaaccaactattttgggatggaggtggtaggacttgttttcgtgtttagttccttgcactaatattcttccggaattactaaacttatatttttatggtaactagtgctagagctgaaattttgtgatattgtaccttctctatatattttcatgataattgtgatgcatgctacatatgtagatatattctattaaatatatagttttgtgatagtttagtcaaagtatctattttgttttgttgtaaaatttactctattaaggcccggcgaaaaatttactctattaagagtgcaaaggctaggatttttttatacggttattaagaaaaaaaatataaaaagcaccatggtgtggaattgatatgataataccgtactagctgtgagaatatatactccctgtgcatacgtctcctgtacggggttctccagtaaattaccaaaatttggatgttctgtagtaaaattcatcttaattaaaaaaagatgattaaaggtaagatagaaaaaattaatatgaattgatcaatgggataaatagtactttaaaaatacttatattagttataaatatttagtgtgctctagctgactactccctctatctacttttgatcggtatatttttaaatctgaaaaatttatttttgataggcatatttcaatccaaccacctatcattttaatgattttttcggatttaatgagcgactctctattcttcaacacaagattgactacatgggcatcaagaaatgtaaatattaatgaatcgtttgtttacgaggaataactagtagcatgtttaaatggatgataagtaaaattatttattcttgatctgtgtgacaagatgaaatatgactagtatcaaaagtagatgtagggagtaattagtaattaacttcttctccaatcaatcaaattaagaccggtacgtacgtacatgcattgatcggaaagtagattcccatgcattatacagtatgtgtacttgtacaggtgctcgtacatgcatgatgaactgatcatgtactacttatgccccacacgtacgtacgtacaggagaatccctcccggcaatacaaacctgcatggtccacacattttggaatgcacgactaataatatggttcttttcctattaattccgcgtgtacgcggaagacttttgcgccaatctattaaagagtacttcttcagtttttaaaaaaatcaatctagaaggagctcataagataacgaatataaaaaatgtagtacatattcattgtcttagaaggggatgcttctaggttgagtttttgtttttatggagaggaagtagaagataattaaacgtacaatattatttttaatgaggaagcacggggtcacgccacaataaaattatgggtgcacacgtcttcatatatacatgactcacctatccatcaagcaattaaattttggtgtccataaacattacacatatatacggatgtgttttcagtagctaggattttggtgaaataatcgagttaccactggcatccgtgtctctcttctcttttcaaggggcaccctagctcgcggcgtgcaaaaaaatatcgttcataactgcacgaatatgtatcgtgctatatatagtaccgttcgtaggtataaatatatctggtttaattcttcgttcgcccatgcgaataatcgcctctatttctttcacgctactatatgtacaattggtacatgacatggaaattcatggggccggggcaagctatctctatttgttccagaattccaggaattccaggtcaaatgtctcagggctgaaactatagtggtgtgtttataagtggttaattaatctactactctcttcgtttcagcttataagacgttttgagttgtcaaagtcaaactgctttaagtttagccaagtttatagaaaaaagtattaacattttcaacccaatagaaatttattatgaaaatatatttaattattgatttgatgaaactaatttagtattataaatattactatatttatctataaatttaattaaacttaaaaccatttgagtttaaccaaagtcaaaacgtcttataacctgaaacagaccgagtattatgggcctgtttggttatttacttcaacttaccaagccacaagtatggccatgccacaagtgtggcggacgatttgagcgccacacattcaacaaagaaatatgcggcagagtagttcacattcaacaaagaaatatgcggcagagtagttcactgctgttgaattttgtgcggcagcctcaggtgcggtaagcaaacaaacagtgaactaactatgtgtggtacgcctaacttgaagtgcggcaaaaggaggcaaccatccaaacaggtgtctgtacgactgatggtcaatgggctcgcatatatgcatctgagctccaaaacttggacagagctagattccaccgtatctatgttttagaaaacatgcatgcatgttaattcctgccaatttcggtacttgtttcaccggccgatcgattgctggcatgatttgtttgatcaatcatggaaaaacaacagcttaacggtgctctctctcatatacgtgttgcaaaaataaactgtcttggaaaaattaaaatggctagatctgtagtttgtagctagtattcgataactaaacgatattttaatttagataattttaccatctttaaaaaagtaataccacgaagtatcacattttttatgtaaaatttgatatctctagatgctactagataactgaggtatcaaagtttctagtgtaaaattataatgccccaccttttaccagatgttgaaaactaaattaataaaagcctatatgtgaaaatttcattctttgagtgagagtttaaatcgtgtcatggatcccgatttaaatatacccttgttccctctcctagaatcaaccatcaacacctcgaaaatccccgttccaaatcgagtccgcaaaaatcaagttcgaaatttgaccttttgaacccttgccaaaaacttctcccggtttcaaaaatatcaaattcccttccttgactgctccttgaacccttgagttcaaatatccaattttaattcaaatcaatctcccaattccctcaaatcagttcctgcaaaaagatcaagtcgtttccttctctatttgggccatctcccttcctctcctcccggcccagtccttcttctctccatcccacctggcctgtccctcccttccccctcctaccagcccatcttcgctagtgggcctcgcgctacggcccagtggcgaaagccaccaggctgctggcctgctgcaggacacgcacgcgctccgcacgtgctgcgctttacctcgctgggccgcgccgctcctccggcccagtggaccaaataccatttattcctcaatttcttttccagaaattcccgcaaatacattccctttgtatagcattgacgcattgtatatacactaaatatatgtgtatgcttactgaccattggtcaaagtctgtaaagtttgaccttttttcaatataaaaatattccttataaaaagttcgaaatcaaaataccccttataaaagtgaacggaggaaatactaaatttcacaaaactaccacatacttcaacaaaacaacaaatttaattagtcatcgtactatatctccgccccagaaaaactacagttttacattgtttgtgaccaatgtttgactgtccgtcttatttgaaaaaaaattatgaatagtattcttattgttattagatgataaaacatgaatagtattttatgtgtgactatttttttaattttttcataaatttttaaataaaacgaacaattaaaatacagaaacccataactatacttaaaattgggacggatgtagtaatttgtagtggttctagctttctaggcttagctagggcaacaggactacctagtttactttctactagcagtaaattactagagatgtatagccatacataaagatatatgtcaatgttgaaagcaacaactacagctaaagaacgtaaccgatgaatgcaacccggatcatcaatcaaaagtacttcaactcttcaagacagtaaaaggaaaagaccaatggcctgtgtcacacgactggtacccaacaaaatcaactcaacaagacaccacatgagcagtagttttaattttcttgtggcatccaacgtagacacgctggaagcaggaaaagcacgcagggcaagaaacaaaaccctaattaagagagagatggatgatgaatgaattaagaggtagcaatgcaaggcaaggatagatagatgcaagttgagctggggatggatggatgcgtggatgtcggcacgggaaggcgccaaacaggggacgcgccttactcgccatttgcttccaaaatctccttaattttttctatcgcttgatgtgcccattccttggaggagactgagaccgtcgctctctcgtcctagctcggctcatccgtcagcgtaaacgcgcgtacttagcagaaaatatgtctacatgagactacgtagatatattttctgcttagtagcccgaccgcacgggattaaagattatcccgtgcggttggaccacccgcacatgaaagtgttgattttcgcagacacctgaatgcagacggacgggatctctgcatgaaaaaatccattttgaccgcacggaaaaatccaatctgtagtagtgtacaagttatatatgcccgtacacgaatcaaaacaaagctttatcgtagtccaaacaactgatctagctaggatccagttgtgtagatgtgtgtgcacacccctggtcacacgccacagctagctcagctctgatcgatctcctttttctgttttgttgtgttgtgtctggaggaggaagaagaagaagaagattggattgatctcagcctctagattttggtagtgaaaataaaatgtgattatattgaataattgaaaggagttgaagctcactggccacctatcctagctctagctaggcctctaaatatctggggacagtgccaatggagtaagggcccataggcatgcatatatgccatgcaatgtatgctgagtaatgatggtttcatactttcatttgccttcatgcatggcaagatcagagatgatttaacagctaacccgctgtcagtactcggtgacacgttcattagctagcaaaggtaagactgttctggattccaacaataagggcatgtacaatggttgtcaatagtggtctcttagcgttactaattaggaatacttattgacatggaagaaagagaaagagaagagacaaaacgtcgttgttatacatgacaacggcttaacaacgactcttaatcactataatatgaaaatatggttgcacgagggtaaaaaaagggaaagaatattaacaaatggaatattttttgagttaatgattagagtctttgtcgtctcaactattgtaaagacagggtctctaaataatcttgtattgtttaagagatcatactcgtctctaccattgaacgtgccctaatagtgaattattttgcatgcggaccatgctgtgtcgatcgattaactcacctaccatgcagtaatttggaggttgcatgggcaccatggaatatccgaataaatagaatagacataaattaaaggtcctctttcaaaagaaatttagtgatatcaagaatttatcattaatttctactatatctttcgacgtaaaagttacgattctttcttgggtgtgatatgcacggaaaatattttctacatctagtacttgaatagggaacctttttaagataacagaagaattttatcaatctgagtcaattatattaaaatgatacaactgcattaagaatagtctcgacctgttgactgttttaaggttaaaaaaaaaaaagctttgctcttttgactgttgactccccaatcagtcggttttgttttaaccgcgacatgcaatatgcaggggccccgcatttgctcacaggctcacatgcctgcgcgagtaatccaaagcacgagtcatccaaattaagtccaaaccgagatgacttggttgaatttcagcagcagcaaccaccgactcgatgcatgccagccacaatcctcgccaccgcgcgcgacgtgacacgccaagctctacctagctagcgtgctccatgtccatcactagctagcttcagtgacggcctctcgcctccaccaatggcctataaatccaggctcccagctcgtcttcttccctcgcacaccagctagctatagctaagccccccaagagacatcgagagcgagatcgccatggccgccgccgccgccaagaacggccgcattgccgtcgccgcgctcctcctggcggcgctggccctgtccgcgcagctcgcgccggccgcggcgtgctcctactgcccgacgccgaagccgcctccgccgccgccgccggcgccgtccggcgtcccgtgcccgccgccgccgtacacccccaccccggcgacgccgacggggaagtgcccggtgaacacgctgaagctgctggcgtgcgtggacgcgctgaacgggctggtgcacgcggtggtcggcgccaaggccagcgacacctgctgcccgctgctgtccggcgtcgccgacctcgacgccgcgctctgcctctgcaccgccatcaagccaaggcgctcggcgtcagcctcgtcctccccgttgccatctccgtgctcgtcaacgagtgcggcaagcacgtcccctccagcttccagtgcccatcataaatcacctcaattatgtatgatcactaattaattaataatcacctactgcatctgatctctgcatgcatgcatggattaattaattaagctatcaaattacatattacctgcataattaataagtatagtttatcacctggctatgctatatacatataaatatatatagtgacatatgtagcatatatacatgagctctgacttgtgtcatggagatgtggaggcatgcatggagccttggattgtgcatttaattgatgtataataatatttgtgtaacatatattttgctgtgtcatgcatatatgcatgtggagttgtggtatttggtttgtagtggtttgggagatttattatgaaataaagagtgtgtgatatgtatgctatgaaatacaaagtttgatgtgtatgtatcatatgtatatgtgtggctgataaagcctgtcattctgtcaactttcatatatagtataaaacgtgctatgttgtgcttaaatgaatatgttttcctatttctcatgtgtttgtttcatccattcttcaaaatgcgttcataattgaaagcagctctggtttctttcaagttcaaagcctctcttatggaacgaaagaattttacagagaaatttatttttaaaaaattaaactaattcatgtgaatttcctgcaaaaactcctgcgttacagcttccgaaggagtactaagttgtatatgtacacccctccccacaaaacaagttgtatatgtacaagtggatatttcaatcttgatcggagggcatcttacattggctcatttctctggtcaaaatattgatcccttctagtccagaaaaacggaatgctttgaattttggcgcaagcagtttcctttaagggagatattactgtaaacagggccggccctgactttttggtggcccggtgcgaaaaaaaatgtaggcccccattcaccataaaaatataagataatatttaaaaactcattgtcattaacgaatttcacgctaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62319 - DNA, 11861 bp, Oryza sativa
  unsure (1)..(11861): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactttcactaaagttccagcgtattcaagaacacgagcagcaagctcacatgcagctttcatgtgaataatgctcactttgtcatgcatttgtatctcacttgctatctctgaagcatcctttttaccaacgtaaggaggttgagttatgtgacctggtactggtagaggtggactcactgtcccacggatcagtggtgctcttttcttcacttgttccaaactttgctttcctcgtgacctttgagtttttgcaagtgttagaactgtatgaagaagatcatgaaggtgcagtggcactaatatgttctaggttatcagccactgaaccacatttcttatagaaggtaaagactcgacttatataggtggattttataccttgggtttgccttctccaatccctctaatctctttgcttggacaaggaaaggcttttgaaggcagctttttccttaaaaattagaagacatcaaacataactttgtttgtcgtttcccaaaaaacaaactttgtttgagtaatagaaagaaataatgtattactgaacatacttccataatatcgttgcagatgcagatatgcaaatgctacctataagaagaatcattgattttgagttacgagatgttctttctgtcacttaactgcattattagtttgatcatattattgattatgcacactgaaccactcagtctcctatacccattccattagcactaccaattgctcatagcattgttcagagttcagactctagtaacggaaaacataactttctttatctactcctcggattattcctgattcgtagcatcgtttctgcctttcagcagtaagagagagagagagaaaaaaaaaccttctccatccttcacagcattgttccagcaacactagtgactgattaaagcccctgactaaaccaaaatctagcacttagaatatcctgatattaaacccaaagttgtcagtttgtcacctcgcacagcgagacgctcgccgcaacaacagcagcctaaaatcacacgcggctgagcgagataaagtttatagaagtttcatgaaccccccacccatccagccaaccttcggcgatgccaaaatccgacgatatcgccatcatattgggagtgatgaatcatgaatagatacctcggacaccggatacggacggcggggggcggtgcagctccatggaagggactctcaccgccatcggagcgccactttggtggccggagcagccgcgcggcgcgaggagtgagagggccagaggttgaagaggataacacgggaaggctgcagatttttttcccccttcccttttcgccttctcgtttcggagaactttaatcatttgggccgtatcatgtttcccacgcacgtgaggcccatagtgtgcgagatggaacgggcttgcgacgtacgggtggcccattgtacatgggctgcagcccatataggttggcccactatatagtttccatggagtttgccccagaatctaccgcgctggtcagtggtcagggtcgccgtcgccgacgtgaggccggccacggccagcttcacggccacgacgctgagcgtggcgcccaggggcggatccagcataggctggcgggatctcaagcctctactactaacatgaacgtgaaaactatgagagccccacgaaaattgcactgaattttttaccttatatagatgagagggggactgtaactctatataatttgctcagacacctattcctttctatatccgtgatcgtctccgacaacgattgcaggcggtcgccctcgaacatgcgttccatcgtctggcacgcctcctagctcgttctcctcctccgtcgttctcaggtcggcggcggccggcggcggcattgttagcttcgccggaacgtctcttagctctccttttaaatttcccgcgctttctgttggtagcttcggtttgcttgcgttgagttgggtgcgtagtgtgaggcgcggggcgggagggattttatacgaggcgtggggatgcgaattggtttggttgctgcgtcatgttgtgacagtttggtagttgattaacgaactgttgctaacgatgttcctataaaaagtggggaaatgaactgtggctaaagatagctattgctgtcgtaccctgattatgtattttgatttgtttgttctcccagcgagagaacttccggtggctacttaaccttgacatgctatcatagtttcattttgtactggatcatgtctttaaggggatagtgtatatgctgttagtataaataagtgtgctttaagattttaccatgtataatttaaagaccaagcattcaacgggttaaatagaataccatcgtacaagtgactttgtcctataaatacattaaaatgtgttgttcatcccgtagcactaatagggggctgttaaaggaaccctaagcaatgacatttcttaggccctctttgtttaggcttaggcttattggactagacttttaagttagcttattgacttatatgatttataagccggtggatttaatgtcctaagtttagtggttgagtcatacatctacctcacataagccaaaaaagcttctccaacctagcttttggcttaatagtgttagagtgacttatggctttaaaaaagccaaacggaaaagctacttatttgtttaggcttagacttttcgacttataagttagcttataagcctaaacaaagagggccttagtcagggccacttgtacgatgatatttcataaaagttgcacttatcaatggcattttatggaattaagcgcttgttaattatatttcttgaattttataaaatatagtatagatataagaaaaaaaactattatgatccctcgatgggatatcctgtcatgtattacatgttattcaaataatcacgaatctttttttaaaaaatataaaaaatatttaacaagacaaaataatgtatgagatatcacttcacaaattttaagacgaagttgatagcgcaaaataggattagaccaaattaggcctataaaattcattccctagtccctataacttcctactcctatcttattatatctcttggatatagttggccaaataggctgcccagcatggcactggtcgtgcctgggccatggttagtcgggctggcacagcccgaccgacacgcaaggccgtgctgtgtcagcccacgtgcttcgtccaggtcaaaatagcgtaccttggatcgggccgcgggcctcgggtctcgggcctcggcccatataaccatctatactcctggaggaaaaaaaaataacaggcacgtcagcaggatgagttgagttcgtccagaacgttcaagccgatcacaccgatcacagcgcgagctcgatccaacggcctctgtctcgacagcaaggcagcgcacacaccatcgctccacgcgtcacctccttccacctcccgccgcgacgtgtcttcggacgtgtcgccccgctcgccttcctcgcccaccgcccgcctcctcctttacaaaaacccccgcctcccacacgcacgacacgacgcttgcacttacagctgcagctagctttgcccagttttgcttagcttttctctgcttccttcgatcccatccatgtccaggttgatggccgccatgctgctcggtggcgcccgcgtcgccggtaacaccaccaccgccgtgatggcgcttcatcatccgaggccgtcgtacttcctccctccccggccgcggctggcggcggcgagctggagccgcctccgcctgcagaccgcgccgagatcatcccaggtgcgtaccgttcgtccgtcgtcgatcgccgtcgccggtgagtgatgggtgttgttgggttggctggctgacatcaatggccgtcgtttttgttcggggtaggcgtacgacaactcgccggcggacgaccgaagggacgtcggggacaggtacagggacgccgcggaggaggcgaaggaggccaccggcgacgccaaggagcgggtgaaagggatggccggggaggccaagggcagggcggcggacattgccggcagggccaaggacgagaccaaggacacggcgtcgcgcgcggccgacgcggcgtcgcgggcgacggaccgggcgaagcacgaggccgccgacaaggcggcggacgtgaaggaccgcgccaaggacgcggcggacatggcgcagggcacggcgagggcggtgagggacaagacggcggagacggcggagggcgccatggacagggccggcgaggccaaggacaggacagtggaagggacgaagcacgccggcgagaaggtggcggagatgaccaaggaaggggcgagcaaggtggtggagacggcgcaggccatcggcgagaaggcgaagcaggcggcgcagggcgcgtggggcgccaccaaggaggcggcgcagggcgtcaaggacacggtcgccggcggcgacgtcgacgccgacgccgcgatgaaggagcaggacaggatcgcgcaggaggagaagaagaggcaggccagggagaagggcgctggcttgccttaggctaaaactgcatacttgttgcatgcttatttgtactaaaagcttttttttttagctgaattttagtcggttcagttcttttggttgaataatgttggcaaacttgagcctcctaatgtctgtaagactgtaactgtaatggaaaggaacttattgaagttattagccatgcaatgtaccaatgtacactagtagactgtaggagttctaatacgcctttcatacaccacatatttacttgtagactagtaattataatgcgcctttaatacgccacatatttaacagtttaaggtgactctaaactgaaaagcagtaaacacatgaagcggataaaatcagtggaaaaacagtgagctgagctgtgaagacaatttttctgacctgaatcaatctaattgataactttctggaaccttaacgacatataaggtactggaagagagacaattccagttgagaaagaaatgaactgaagccctgacaacactggactgctcgagtcagaccagagctaaaaatatttacacagaacgaaatgatcatcttttttttgttgttgttaacacttgtagatatcaaaatttttactcaaaaactcaaaacgagtaccttgtctagtacatggcaaaagaatctcttcctcacacaggaatacacatgttagctcaccacactctgatgtgtttgctacacaacatttgcttgcagatacatttcgcaattgtacaaaaattacaggagacgtggattcctaaaacagatgttatcccttcctgaataatgctagaggtgcaactatactcttcttctctttgcaatgccattcttctctagttagtgttatctctacttgatagcaacgaacaaaacaaaagggtgtcggaaagggtaccattcggcaatcaaacataagaggtcaagcgcacctgcatcacatttgtgtgtggaatgctcatcgacatcatcgccctgcggcagttgttcctcaagaatgcgaagaagtagtttatgatcagcttcttgaagaaccaggaattcttcctggctttgacgatggggttgtcaatgagatagacggctccagattgcttggcctgcctgatgaatgcgagctccagctcaaggttctgtgtgtaatccaccacaggatcgtgctgaggcgttgagcaactggcctcaggaataacttctgccgaaggcacaaagtctgccaggagagggacgtcaagcgagtagaggctaccatttggcgctacgattgtcctagatggggttggaggctcctcgtcagagtcgatgtcgtctccactttgtagggatagctctactgcctcccgctgtatgaacttctcgaggccttcaatcagaaggcgctcaaatgtgctttggctctcctggttcttatctttgtagccgtacctacactcatccaagttaacaccatcataagctttttgtgacgactacacatacttggagacaaattaactccaggagaaactacatcagtaactatttcgcatgacaaaactgcaaaatgcttataaggacggagctaaacttcaagtaagatatagcataccttgcaatacagcggaacatgtgataaccccttgtacaaacacgttggaaaagaaacctttcagtctggggaaccacgggcactggtacattcctgatgcatacaaaaacgattatcgagtggattgcaggaagggcaatcagaaaatgaccaaaaattgccggaactcctttcactatctcactgtagaccaagcctaatccaggagctctaatagtaccaaggttgggccccaattttctcatcaaatcctttgaaagcttctttttaacttcactgtcatacttcagtttgcttccataattccagatgaacataaccattagaataccagatgcaaaaattatcagagcccaacctccatctccaacactacttagagacgatgagaagaaaaccaactctaaggagaggaatgtgatgacaaatgacaacactttcacaatactggtttcccaaattagaagcattatgattgtaacatagactgtggccattatcatcaccccaagctcagctatggctgttcaatatggaacagggtaagcgcatgtagaacactgagcattacaacttattaaaaagcagataaatagacagatttgcactaaaaagtataaccatataattaagttattactagatgaataccctgccacattgctgagggaaattaagttgcataatatgcacaaataagattaaatacgaatattaaaactaaaacaaattgatacttatgaattttgaggcctaaaaaattgagattacttggtgttatgagagaagaaagaagagacaatttgaaccatagatctatcatccaatggctagaaataattaaggtgatgtggcttaatgatagaagagagataacattaactacacttagtggggatgaactatacaagtatataggattaccatatgcattgccaacatcatatatgcttctgaacagcagaataaagcccaagcaggaaaacaataaaaaccagttcacgacaggaatgtatatcttagccataaatttccgagacgtatgaatgatcttgagtcgaggaaagcaaccaagagctattgactgctttaggcattggaatatagctgtcgtcattgttctactagcaatcaatgcggctaaattggctattaagaaaacaggccagaaaactccacctgcaacgaaaacaacgcgtagtaagccaaagtatctaagtgctatggaatacttggtatcggctaaaattattgaagaaaaaacagtcaatgtaatcactaatatatattttttttcaaaatataaggattatacgtcgattgagattattcaattaaaaaagaatgggtaaatgttcagcaatatctgccttacttgggatggatgagaagaagatctgctcagatgaattttggtttgcaataagaaaagcgccttgtcctaaataggccaagacaaggcaaggaagaacaagaagcgcaaacattgactgcaaaggaggaataagatggatttaaatataatcacagagagtggttacattgagtatatctaggtgacaagaaaagaaatattagcaagacgatacctgaacatatcttacaggaaagtaggaaagatttgcaaagattgcctcggaccctgcaatatgttttggataagtgtatcaagtttcttttagcaaaagaaagagttgaatattccttcttaaaatagcatactgctgatggaaatcaattgtaactgatgatgggccgactagttatgatctttacctgttgcacataaaagacagccagcaagggacagccaagcctgaaagggattcctcccaaaataataaataatgtagagaggattaaatgctttaaaagctgctgggccatatgtactgagattgtatataccaattcctccgagacagcaaaaccatataagtaaagaagggccaagtgcaaaccccattttgctagtggcatacctctgtacactatacaagattacaagaagtacaactgaaatcatcaccacaaggcctgcaaataacatttagtggagttaaataaatagtttgcttaggtgctatcagatacagggatctaaaggatcaccttgtgaggcatttggtatcccaactttcaagccactgacagcagacagcactgcattcaagaataaagagttaaatattaactaatagcactcctaggagaggagattttaatataaacacaagtgtaaagtatccatttgatgtcttgtgtattctttatgatctacccagtaacaaatacttgaacatgaagaacataaaaaggaaaaggagaaaggaaataacctgacatagctggtgtgataactccatttgatatgaacattgcagtcccaaatagcactagacctagaagcaacttcttcaatagcaatgaagattcaagcttctcctttacttttatggatctctcaagctctggcgttggaagcttgagtcggaaactcgacatcctcttctcagagtgtacttggtttggaatgagactcacttttgcatttctgcaaatcaaagagtacaacgcaaatataccacctgtagagtcatggaatcactgaaagatgttaatgttctaacttagtcattatacaagactgaacatgacaaactaaattcacaacctcagatataccttcaccatcatcattagcccaaaggacgactaagacatacttcactagtggcatcgaaattagagtataaaggacaagtgacagtgctccaagaacatcctcctctccaagaatgggatacttgctgaacatgacatcaaatgtatacaatggacttattccaatatctccaaacaccacagcaagagtctgaagggcaagaaacattgtcctgccaaaatcaaactcctgcacatgtaaataaaccatatggaagataattaaggaaacatcatcaataatgctagctggtttttcaaagtagcgtgtacatttcaggatctaggtacaattatttcgatgtaccataagaatatcccatcgttcgggtgtttgcaatttttttttttgaaaggatgtttgcaaatattattcagctgatgagtcttcaaaatgttcccttccctgaaaaatcgcagttacttggatgaatcttcaaaatgtttttttttctagatgagtatgttcaaacaattagtgtagttttttatttaaaagaaaaggcaggtgatttgtcagacaatcggtgtagttgatcgcacaagatcatgaacatcacatctcccttaggcatctgatcaattgcaaaccattctcattgtcgtccaacacaaggttaaaccaaaagtaactagtacacatgcctaatcgttgccatttttcctcatgattctaatcgcatgggcaaatcaactttaatcataccgtgacagccatatcattctccaaatctctcgcaccaaatgacgcacaagcacacgcacgaaagaaaaagaaaaagaaaaaaaaagcaaaccgaagtaaatcaaaccgcaagccagaggcccctcacctcgctgtcctcgatgtgctgcgcgacggagacctcgtagccctcgacgtcgaaccagtcgacggacggcacggtgcggatcagcttctgcttctccccatcctcgccctccccctccccctcgccgccgccgccgccgtcctcctcgtcctcctcctcctcggacccgaagctcccgcccctgcccacggccccgacggccgcggccgccgcctccaccgtgtccccgtcctcctccccctcgtcgtcctcctccgtggatacccaccgccactccatcgacggcgccttccgcatccccccgccgcccatcgccgacgccgacgccgacgacgacgacgacgcggccatagtatcccgatcggatcgagaggcgaggcgaggcgaggcgagaagggaccaggagaaaaattcgtctccgtgtgttgcgtgtggagatgtggaggcgcggatggaggaggaggaggaggagagatcaggagagagagagagagagagagagagagagagagagagagcgacaaaaccgcgagccggagagagagaggcgagtgggttgaactgagcggtttcgttcgcggggggcgatgctgaggtggcacacgtgctgaccacgtgagagcgggctagcggttcttttttttaaaaaaaaaacctcgttgaaatgtggatgcttttttgtaaaatttattcaaacgattcaaaatttagtccctttttatctagaattagagtgaattgcatattggaccgctaatatttgccttggttgcttattggactaaaggtaaatatatctttttcacattgggcctgctaactctacaatagttgcacattgaaccggtgttcttctccaactcccttctccattaagttgtattgtacccgatttgtagaagtctctgcacctgccatctagctcaagctcgctaccacagatgagcaaggcttcgggagaccaagaccttgagtgagctgccgccggccggtgatcaagcccctgccctacgctgcaccgccctacgctgcaccgagctcgaccttcactgacaccaccttgcactggatctgcattgagcattgccccgcgctcgagctcaccatcggcggtgagcagaccatcaagatcacgccaccaatctagctttaccacctccaatccctgcctgtgcactggagctcaagtttgagctcgaccttcgtcagctcaggccactcggtcgatctcgcccgcacccgcccctgcatcaagctcaccctcctggccctgcaatctctcaaactaaacctccatccaacaagctgctgctgcaggggagaagttgatggtaagcagctacgattaggttgagtaagcgttggctgagctccttcgtggatatctgttaactgttggccaccagtgttcgagagagataagagataccgacactgactgacatgtgggccactagtgttaagtgaacttttggtaataatacctagcccaaagtgaaaagttgtgctaccacctagtccatcatgtaacaaaggtaataaaaactggtccattatgaaatttactcttaggattataatctagcttacaaataaaaaagtctaagcctaaataaataagcagccttttcatttgggtttttaaagacctacttatttggtagaactccaactcctaaatttagctccaggagttgagtgtggagtagagttgtggagtagtctaaacctaaatccacctctctaatgtattctgtgagagtgctccacccattacccaactactccctccgttccgatatgtagcaacct

SEQ ID NO: 62320 - DNA, 2472 bp, Oryza sativa
tatcgggacggagggagtaggctcttattttaggttgagctgaaactgtttggctgggctctagctccaaaagagattgagctagagctggagctgcgtcaaacatgctctaaagccataaccaaaaactaggttgaagattttctttttgtttctgatgtgaggtagatgtatgactccactcttaaatttagaactttaaatccacgggcttgtaaatcgtataagccagaaactaacttaaaagtctaaactaataagagtataagagtaaacgcccttagcatctaaagttaaattgcctattggctattgttatccaagttcgtgtggacataaattctgtttctgtttgatttcagacagtgtagcattttgggtttagctaaggctgtgtttagtttacgtcaaaattggaagtttggttgaaattgaaacgatatgatggaaaaattagaagtttatgtgtataggaaagttttgatgtgatagaaaatttggaagtttgaagaaatattttggaactacggcgcaagttctgttcactgccatctcccactgggtggaaattcagagatctctggaattttttcatggtcgcatctattccggaattgatacttgagagggacacgcaatgcaaaacatggtcaaaagtgctaataaaagtgataggaaaatcccctcctttcactttcaaaaaggcttcttttgagttctctgaacttctcaggaaaccgaatgattgacacagtagtcccccccttttgtttatgtatcagaaaaaaaaaatcatcttgacctcgcatgaacaactgaaggtactgaacaggtcattgacatgccatagcacgattgcttctgcctattggataatacactactgcaccagcaaagcagcaagtgtaaaatctttttctgaaagtggcagctctgaaaactctgaaactgtgtgccgtaattcttgcatgcacacggagattgaccatctttataaatcctagttaaaaaagtattccagttccagcttgaattagagatggcaacgggtgcataccatcgggttctcttgccccatacccacacccacgatgtctaaatactcccacttaaatacccacacccgtcgcgggtacaaaattgtccccatacccacacccatgcggataacgggtatccaacgggtacccataatcatataattgacttgtaatatttatagttttgtactataattagctatattagagttgtaaaccatcaatattttctctagcaacaatgctattaatatcagtgttcaaaggcgagtaaaaaaattatacaaccacattacataatcaagaaatcaaataataatttcatataactagactaagcgatgctttaagatgtgaaaaatgttttatgctatgatttagtagtcattgagagttataatgctcatagttttagactcaatcaacgggttttttctacccacgggttggtgggtacgggtgggtaaagaacagacccatacccatgtacccaatgggtaagagttttcgtccgttaatagacctatgggtataagagttagaacacgattgtcttctaatagagtaaaaacccgtcgggtctcgggttatgggtaccattgccatctctaagcttgatgcagtttatgcaactgcagcgtagactgtggagcaagcccttgtaattaatttgccatctcaacgtgtttagcacatctttggcatcgaccaccgtttcattccatcgcccaaaaccatgacctggtggtgattagcagaaaatgagttgactagttcgttctgagatttctgatagaccttcctgctggcacaagcccagagcaaaactcaatatttagtcaccatgaaatctgaaaatatcttccaaaggaaatatctgaaaactagaaatcatcatcaaatggttagtatatatattttggattgaattatgacagggatgtgcctggtaaaacatattactcctgataaggaagaacatgcaaacaaacgagaaagcctcacactgtccaattcagacttgagactgtccgacaatttcttactcccctcgtctcaaaatataagtattttttaatttcgacatagtcttcgatatgctattttgaccaataatatttataaaagtaatatattttaaataaaaaagttgtatattacgatagtttatttaatgataaatccagtagcatcaaatttacattgattgattttttttatatatatttgctattaatagtcaaaatttaaaaagtttgacttgacattattctaaaaatgcttatatgttgggatggagggaatagctatttacttttttttttcttaaacagaacattcaaattaaatactctatccgtcccataatatagcaacatagtacaggatgatgtttagatccgttatattatgaaatgtcaatattatagga

SEQ ID NO: 62321 - DNA, 2038 bp, Oryza sativa
cgagaaggagacgcccgagagcgagccgccgccgacgttcctgcgggaggacgggtccggggcggggtccgggtcggtgcgggagcggttcgaggccatgatccgccgcgtgcagggggaggtgtgcgcggcgctggaggaggccgacgggagcggcgcccggttcgtggaggacgtgtggtcgcgccccggcggcggcgggggcatcagccgggtgctccaggacggccgcgtgttcgagaaggccggggtcaacgtctccgtcgtgtacggcgtcatgccccccgacgcgtaccgcgccgccaagggggaggccggcaagaacggcgcggcggcagatggccccaaggctgggcccgtgcccttctttgccgctggcattagctcggtaaggcacaattactggttcattttgagtgagaattttaggtgattttgcagttctagtcattgcattgccgtcagagatttggatttcttagcatcaggggtagtacactacactacgattccattcttcagctttgttggcatccgagattccgagtgcaagtgaactgtttaggtggtcagtaaaatttgggagtctttacatcgcagttgtgtgaatgatttggctattgtgggtgtttactgttcacaatgtccatttttaaacttccatgtgctgtttgacaataacaaacagttgttgagaaggaagtgtttgctagattagtgtttgcttttctgtttgaaatgtagtgatgtcattgctatcttattgtgagaacttgaaatgcataactttgaatttggatatgtagttaagcatttgaatgatgaatttagatgagcccgatattctatcgtcttcctgtatattctcataagagactaggaattctcatatatcggaaaattatgtttttaagaaatttggaacatgctgcattttgttagatgcttcagcttcagccatcatttgaagaactgcggtgaccatgtttgccatgcctgtgcaatatttcctactgtctcttgtatcccaagcactggtgactggtccactgtcttgtgctactgtttatgtgctactaattggaccagtagagttataaagagctagatctttagccaaactttgtatttttgttccacgattaaacacactcactcttgtttcaacatatcatacctttccagtaatggaattattccttttatctgcaggttcttcaccccaagaacccatttgctccaacattgcattttaactaccgctattttgagacagatgcaccgaaaggtatttgtgcgaacaatatacactgcataattttagtttcatcaagtgtaggtcaatcttagcaatttttatgattactttctttttccgcctgcagttgatatgttctctgttctatcctctttaaatcttttgtttagatatacatgtgaatgaagctagattttttttttgaaaaaaaaactggatatctgtatgagacatagagcaattctatttacagtaatgagtaaatataaaactcttaacattctcctatatattacgattaatttacatttggttggccatttaaaccacctttattatcaggaactgcgaatctcatcatgcagattattaattcataatgctctactgcagatgctcctggtgcaccaaggcaatggtggtttggaggtggtactgatttgactccttcatatatcattgaagaggatgtgaagcatttccattctgtatgtaacagttcctgcacatttcaaagccatatgtcctagactcctaggatcaagagttttatttccctcacgtagccaaaacactgttatttgctacttcgtatacatggaactcatttaatttttatgccttttcaggttcaaaaacaagcgtgtgataagtttgacccaagtttttacccgagattcaaaaaatggtgtgatgattatttctatattaaggtacattcagtttcttattgcgtgctatagcaattaagaaaggttctttaatctctgcatatgctgc

SEQ ID NO: 62322 - DNA, 17340 bp, Oryza sativa
ccggaaggacactccatttactgaggaacacaaggcatggcaacaactgaggagaggtcgctatgtggagttcaaccttgtaagtgatcttagatgaacacagctagagtctcactgcagtatctgtttctgattccagtgttgcttcttgtgaaggtatatgatcgcggtaccacatttggcctcaagactggggggaggattgagagtattctggtttctcttccactgactgcacgatggcagtatgatcatgtaagctaaaatgctcctttgccttgccaattcaataaacatcaaagtatttcatgctttcagctttaaaacaatacaaaatttaatatcaaatagtgagcatatactgttgaatatgatatattctcggcaaagatcatgttacatgacacattttcatcctcggggagtcagtcaggcaggcaggtttcctaatgtgccatttacttgcagacacctgaagagggaactgaagaacggaaacttcttgacgcgtgcataaacccaaaggaatggctcgatctctgaacagcttgatttcgttcgttcgtccaatcgtttgttagctttcctcgcactctgtagccttacgatctccaaacatgtgtagttcttttacttgtagaatcctgaataagtgtatgatgcaatgcgggtgttttgtttcatctgtcgatgctgttgagctttgtaactgtggtatcagtttctctctttttttcgagtgaatgaaatatagccggtgagccttttcccaaagagtggcaaaaatttgctgtctatttatctcatggttcccaatatttgtgtctaatgtcattgattcaaatccaaaaaatataaacatagcttgaaacctttcaaatatgacccatccattccaagctataattggtgagaattgacctggtgtttcaggccaggtgcagctgattggctttaactagtttttgcacagcgttgactgaaattcgtcggtttttactagttttcggtcagttttttttggcaaaccggtgaggagcggtttttaatttcaaaatgaaaaggtaaattctggtggccgctcaccggttacctgcttgggccatgacaacggagtgatggatgggccaacccgatttgcttgggccatgtctagcatgactgcatgaatacattattattactagtagaaatgacttgcaatcatgaggtgaaaggttaactgaggaataagagaattttatcagcttcatctacacagccagtttgctgctgaccactcctaaaactggaaagggtcgccaagaaaggaaaaaaagaactagtggaaagggtcgctaaaattcctctccagttgacatttgaatgacctataaaaggagaggagaggtgctagtggacaccaccatttttgtacatgattatcatgcagcatttgcaataagtacgatcagttttgtgctgggaagaaaaaggcacaaagcactacgcagctgaatggttattattatcattgtactcatatgctttacaacttgattgttttatttctgatcaggcacttatcctctcatcacaatgtctcactggttggagacaaatatccaatttcagtgattgcaaatggccccatccctccttaagatatttgggcctcaaggtttgagctcactaatgcctaagtggactagaggcatagatcatattagaccaataacatattgctagatctctccaaatctttgctcattagtaggactaattctttaatagcatagggctgcttaacctaattgctcttcccttttgtgattcgccaagagcacaaggttttggtgagaccatttcggtttagagcagaaagtgaaggggcaaaccggatcctgttgtttagtaactgttcaagcttactaaacaactcctctgcacatgaaggaatagtaaggttgattgttcagagccaaagctgatgcaaaaaagcaaacgatctgattggggccctgcatggcttgcatgcatgaaatggcatcattggaaagattactcattttgccttttgcatatcaagtgctagctgaacaagtgaacatgggtgcatcaaaatattcagaactaataccacatcatcaagatgcaccagctagtatagtggcagggatgaaaacaatggcggaaattctgatcagctgagtattgttttttttaaaaaaaaagtggtaccatttttgtttctagccatacaaaatttgattttttttctaatttctatcagcgtcatattgaagtcacaactaaacagctaaattaataaatatgaaaaattcccaactaacctagaaccatttccgtagaaatgatatcgttttccaaccccgtggttctgtgtttgattctcaacacgcttacactcctctatatgtctgaaatgttttgatttatgtacaaattaagagaattatgagtttgagtgtaccgatcaggaatgagttttggcaaggccagacatgccctgaaaaaggaacctttttcccgttcctacttctgtctgactgcccttgttggctgttgccatattgagaaggctctcatcctgcctttccttttgcagagctggatcccagtttatgtgtttagtttgtgcgagcctactgaaaaggacccctccattgttgcgagttgcgtgccacaggcaggttgccatcatgggggaagcatggcatgatcaacaattctgcaactacactgcatgacattctttggtccaattcacactgggaaaccaaaaccaaagagaagagcaggttttgtttctcatcacactgaaaagaaaaaaaggtaaaaaaaaaacacattcaggcctacccgctgctgccatcttgttcttcttttctgacgagcaagaaggagctcagctgacggagcgtggccgacatcgggtgtagaacgatcatgcagctgttttcttcgcacaagtctctgaactttcgagattctcacggctcgatgtgcttttgctatctgaaacttcatccattgcaggttgaaaatgggggcaactcaactgaagtatgggaggatgaggcttcgaagaatgggtcctccttgaccgaattaaggccctattttgatatatctaatctaactatctaaggatcacagatccacgttggattgaagttaaattataatagttcaaaatattatattatctaaaataaataaaataaaataatttgttcaattattatcaatataattacatatccaagtctattgatttctggagttatgaatagtcagctccaagaaatctcgaatatgcagttgtgaagtttaaggctagtttttaagtgtactttttgcatggatggtaatacatgaatgcttgacaaacaaaacctttgtaaattgatttgcctcagttctgaactggagctgatgttgctgcttgacgtcagttatgacaggctagccaataatatgagctgggtacgaacaaatcaacttggttttagttttagataatctgaataaaaatggcctaaagcttatatattgttattattatttgaagggcatgtcaggagtgttgtgttaactgcaattcatcaagacctagatgctactatccgaacaggaggagtagaagtaaaaattggcaagtacaattcttaaaacaaatccagaggagcttttggtggtgcagaatagaacacaggaatattatgttttaaaaattgtataccgtactactgagcaagaaagtgggtgaaccaaactttacaaatcagtattagttggattaacaatcaataaatggttgctcccaactttacaagaagtttgatgccacttcccaatattaaaattgctctagcctatggataattagttagctgaatggaggatacaaagcatatgtctctgaccttattatatcaagaattcatacacacatttttggggagattccctggaatctattgaatttatatcagttaaaagttgacttatgtttctagagacgtccattgccgttcacctgaaagaaaatttgaaaaattcgatatataactcatggagtcgtggtcacggatggtagctcctggaagcaagcataaaatttgttagaagtgtatatgtcatcaaaccagaatactaaacagaaaggagatatatatcctcataaacttagtgcaacttgtagcattgcaaaatgatgggtcattactcacgacacacaaacatcttatctttatatataatgattactgagatatgattttacaacaaaagtgaaaagtttgaagtccccatatgcagcctttgcttgtcttcccaactagaactaggatgaaccccatcaagcatctatcctggttgctggcttccaagcaaagcaaaccgtgcatgcttgcctatgtaataacctactgatcatgctaaaacaccaagctaaaatgttctcaagaaagtggtcaaacagtttcattcatttgttgatgagatagatgtgattgtgttcttttgagctgaatggaatggaataccaaatagatgaatgattctagggtacaaaaatggattttgaaataatatttcccttttctctctctttttgtgtaagactctgtcttgtttctctttcggctttctcccaaagccagaaatttacctgccataaaaaaaattaagaaatttatatgaggatttttttttcaaaaatagcgacttttaggagctcaggaagcgtgcgcgttcatatattccattccattcagcatttaggttaaaatgaggtcagtaatataatatctattcaatcgttccaaatttcataactattcgaatcatatgcaacacacatagaggtatgcatgtgctctcgagggtttaagtaaaacacactccctttcttgacttgctatttttgtgtccactccccaaccccaaccacctttcacatgtctgaagttccattcttgatggcctccattagctgcagcattaacaataattacaggagttaggagggggataattgcggccaatggcagctatcgctgtgatggtattaaaaattaatgcgtgctttgtggtgtcaccagaaacaaaccttgatggcttgtgattggtgatcagatcatgtacaaataggctgtgagatcattgcccatttctttttgagaaaatggttgttaacatcacttaggtcatggcaagtttgttgcttccagaaattatatatgcacgtccttttcaagcaagtcccaggtgacaatctcattcttgaccccataaaattaattattagcttattagcacttgatgaatgccatattttctgaacacaccatccctgtgaattccatctctttaatagataacagaaaataaaaaaaaagattcaggatcaaactatcacgggaaaaccgaaactgaaaaaaacctttattgcaaaaaggtatctgaagttcaaaacacaaccatttaagcatctttacaagagttttccctttcttcttctaaaaagaaaaggctcacgagcctctcctagctgagcatgcatttttcatattattaaacaaaacaactactctctccgttttaaaatgtaataacttttagcaatgtttatggacatgttcatattcaaatacataactcaaaaatattatatttagacaggtggtattttttttcttttggcaaaactgttttaggccccctttgattcaaaggaaatttataggaattttagaggatttcatttctataggaatttttcctatataaccctttgaatcaaaggaatgaatcctatgaaatcctatgaaattcctatggaatgcctaaacacatgcaagttttggaggaaattcatggaaactttcctatgagttttcatctctcctctaattcctgtgtttttctgcggtccaatcaaacggccattcctgtgtttttcctgagttttgtaatcctctattttacacttgcactcgtattaaaatcctacattttttctatttctacgttttttcaatcctgtgattcaaagggcccttaatagcggaggaaaaaaagggattcctccacgttgagcgacagtagagctggcacgtttctcgaggcacatgcatcaaaatctagtgagaactgatggtcctgggttaattactatacttgctagccttttaatttgcacagtggcgatcttaacaattactgtacttggtcacaagctagacgtgcttatgcctaaagaaaggaagatagtatggtacggcgtcagttggttatgataaaattctctaaagtgtggtttagctttgcttaaatcagaagctgttagggcaaagataacatattttacttagagctttgaagagtaaggctgtacttgaatctagcgtttgatcaatatcattttggaatcataagccttaagccctcttttggaacaccaaaatcttttattacgacatgcaaagaaaagattttttttttccggaagacctagaaacagtagacagtgagttacactgtctaatttaaacctcagaaaactcttataaatatttgttaagtttttaattgtttattaaattcatattaagtccagtacgtagtttagaaaacgtgatttgtaaattccttatattttaagacgagaattattccaagtaattaacctgattgactgatcggtcgactttgcgttcgaactcaagtgtccagaactcttccctccaagaacacagaacagaacggtggatcagtgtatgattagttaattaatagcttaaatttttttaaaaataattaatacgacgttttaaaataactttgttattgatagaatatttatagcgaatgcaatcgtttagtatttttagaaaacgtgtggtataaaagaagagagtgtaagttgggaactcatcggaaattttacatgcaaaacagctgggagtgctccctgacttcttcggttgaaattatcaactcaacacatcatgtgcacactttttaaactacttaatagtgtatttttaacaaaaatatataaaatattgctttaaacatttatatttttttaaataataaaataattaatacttaattaattttatggtaatgagtcatcccattttattagagtctgtttggctcagctcagccaaacaactttagctccatctaaaatgagagcgagagttcttgtttgattcagcttaggattattataatctgaattattaggagtaagccgaaacaaacaagtagattattacgttagattattataatctataagccagattactataatccaataatcttctttataggagcttttttcagattattgagtggctaaagacctactacccttagatgcctctaataatctagagaaacaaacaactcgtagcttattttatgttagcttattataatccagcttagagtaatctgatttaataatctagattataataattttaagctaaaataaacaggaccctagataaaactctaataaattaaagagatgaaattgggtttatacttcttcccaactttactcctaacactaaattttagaattagagctcgagaaaaaaaatgtccaacaccgagcagtcgccgacctgcccacccagccgaggcctcggtttccgtttgcggtggatgtagcatcagctcgatttggtattttcccttctcgtccgcagtccatccgctgctccgatatatatccagcgccgcacccaccaccggccgtggacgaatcacgggacgagaaacccatcgcgcggcgggagggagtccgcgggcgacgggtgtcccctctccgcgacacgcgccgccttgccacgctgctttccggcgcgccggggtggcgtggcgtggcgtggcgtggcgtgggaggccggcccggcctttttcggtcgcgtgccctcgtggagttgccgattcggactcaggggcccgtcgtcctttgcgatgtctggccatacaattgtgtttcgtgtcaattcggtaaaaaaaaaagcagaaacaaaaatactatacatgttaagggcccatttgattggtaggaaaaatataggaattttgaaggattttaatcctatgaaaaaaaatcctatgaagacatttgaaaaaaaggattgaatcatatctaatcctttaaaattcctatggaataggtaatcctatgcacattttggaggaaagttagcgagaggtctaatctcttggaacatttcctttgagtctatctctctcatctgattcttgcgtttttcctgtaatccaatcaaacggtcattcctatgtttttcctgtgttttgcaatcctctgtttcacaattgtattcctgtcagaatcctgtgtttttcctattcctatgttttttttattcctacgattcaaagggaccctaaggctgatccgctaatttcttctagcttttcaactcggctctcctgatgaaagaggagggaaataaagtacacgaaaaacaaatagcatatttgcattgcatagtataggaagttaatttggattttctcgaataggcaatactccatctgttctagaatataagcatttttagagttgacataattattaaaaatgttggtagaattaaatagggagtgttgtgattggagaagtgaaggtaggtggaaaaatagaatggtggaggattatgattggttgagaagagaatgttggtagagaaattgttatattttggaacaaattctaaaggctagaagttgttatattttgggacggtgggagtatgttaaataaatagttattaaataattaataatatagactaatataaaatatatcactccataaatatgtaagacataattaattcgacttctataaactaaaaagaaattaattaattaaaaataattaacatacattcgcatttatatttattgtttttttacagtctatagaagtaaaatttaacttgtatgtttgtcgagtgatatatttcatattaatctatcttatcaattttcttaaattatttatcactatttagataacatgtaataaatgagtaaatatccccttgataaatgaaaaatactttcacctaacagatgatcaacagctcaccacatatgtatgttccaaactttaacattggacctgtttggtcactcacagcctcatcatcatctatctccacaagaacataacacaaacacatatcctgtctaatctacactacgcataaacaacaaaatcccaacaaaaaaacaaaacaacaacgatagtactatggttccatgcagacatacacacacacacaataatataaaaatcaccagaatataaaaaatgcagggggtaaaccatgaccaaagacatgcacaagatcaaataaaattggagatagcaaccaaaaaataatttaaaataaactaggagtacaccccaagggccaccctgcaagttgaattaaaccactcttcatctcatctctctccctctcatcgccatggccgcctcctcctccatttccatttgcatcaccacctcctcctcctcttctccgaaccctaattccgacgagcggtggtggtgctagcgagcgagcttgatctccatgcgtcggcgctagctccaccggcggccatgcctcaccgacgacgcctgcttaacccggcgccgtcactgccgccgccgccggctgctgctccggccggcttccaccaccacctcctcgccgtcgacgacacgcggctgccgctgctcgccgactacgcgctgctgcagggcgacgccgcggcggcgccggcgtccgcggagtggagcgccgggagcgggttcaccggcatctccaccgacccggccaccgccaccaccgccacgacggcgtccaccgccacggcgccgggatcggcgtcgaacctgacggcggcgaccgccggaggaggagggagggagacgtgggtccgccgcgccagggagggctactacctccagctctccctcgccatccgcctaacctccgaggccttcctcgccggcgtcccgcccgagctcctcatcggctgcggcggcggcggcgaagccgagaaccacgccgacgtcgcggccgatgccgccgctgtctcctaccggctctgggtgggtagtgtacacagctcgcctttggtcttaccgacctgacacgacatgccatgccatagcttagctcgagaaagagagacacaaatccattttgaactttctcttttttatgcaaatttcaaatttcaaacttctttctctccctgccaaagaaaacagtttttttcagcttcaagttttgctggagatttcgtctaaattctttttagtcttcaattcattttgcagttagtttgtagcctctagattgatgttttttttactagtgggttgcttaattaatcaaagatttcgcactaattgcgaactgtgtagtatgttgactctaatctattcccattgaagtctccattctgatgcatgctcagtggctgcacattgtacatatattatacaattcaataagggcttgtatattgcaagttgcagggagtcgtgtaaccttctagcacctccctaatcatgccccctaaccacactagtagtatttctgtttaattaatcaatctcttacttagctttaaccaatccatcctgcagcaattaactaccactctctgtagctaactgcactgcactgatagctataaacagcttgctaattaaactgttgctgaattgataggtgatccaatgatcttgttgatcttgtgttgttgtgtgtgtatgttcaggtgaacgggtgcttgtcgtggggggacaagatcgcgcacgggttctacaacatcctgggggtggacccgcacgtgtgggcgatgtgcaacgctgcggcggaggacggccggcggctgccgacgctggtggcgctccgggcggtggacagcggcgagtcgtcggtgctggaggtggtgctcgtcgacaagtgcggcgacccagcgctcgccgacctcgagcgccgggccctcgacctctaccgcgccgccggcgtctccctcgacctcgtccgccacctcgccgtcctcgtctccgaccacatggggtaatcacacactaaccaatgcaatgtaccccttactgttgtcttggtttattttctccgtcctaaaagaaacctggattattttctccgtcctaaaagaaacccaccgacctataagcgagtttgttttgggatggagggagcattttacaagaaatgttgaccggattatcgacgagagttcgttagtttgcgttttagcttatcagccgtagctaaaatttaattttagagttgattttgattttttttgttgtgttatttttcattattggtttttaaattaaaaacatactgtatataaaaattttcctcacaaattatcttttaagttgtgttgttcacctgtacaacaaacgatgagtctgttcgttgataaaaattagcggcgtactagccgccgtgctgtggatgcaactgcgaatgtgattcacaggactgggcaagtcaacaagctcgatcgtccccgtgaacatgagcaccgacgaacacgtgaacacagcttcatttttcagaaaaataagtgagctagataatctaggtactgtacggctgtataaacggagtagtacgcccaggcttaattcgctgcacgtacctctgtacttgtctgtacctgtgcaagttgcatctactatctgtttctttgcttaattggtctttgaaatgtacagtgtcaccatgcatctgtactctatggaccacaagaactattaaggactatacttaacagtcaagtctagttgctcttagattttgtagacatatgctttctccgtttcatattgtagcaagtagttttaggtttgttccaagtcaaaccttgtcttgagttttactgagtttattgaaaaaatactccaacaactgaaacatcaaattagttttattaaacccaccgtgaaatgtcttggtagtgtatttatttgttaccgggtgtatttttctataaactcagtcaaaattagagaagtttaacttaagataaaactaaaatgtcttacaatatgaaagagaaaaactaagttgtgctttgctcgtcagaacttgcagacatgtagactcagatttcagttgcaggttcactttcaggcatagttgcaccgaacattcagcattggtctctgacgactttcaatggagtttgtgtttgtgcaggggcgcgttgcggtcggaggacggggacctgttcatgcggtggaaggcggtgagcaagcagctgaggaagcggcacaggtgcgtcgtcgtccccatcggcagcctctccatcggcttctgccgccaccgcgccatcctcttcaagagcctcgccgacttcatcggccttccctgccggatcgcgcagggctgcaagtactgctccgcgccgcaccgctcgtcctgcctcgtcaagatcgacaacgagagaaggtttgtaaggtcagtctgtcgatctccctctgaaatgtagcagatgtgctgttgcatatgacttgactgaactttgctggttggttggttcagggagtacgtcgtcgacctcgtcgttgagccgggaagactcagcagtccagactcgtctatcaatggccagttgctctcctccgtgccttcacctttcaagacctcatgtacaatgagttctgcaaactatgcaacaccggctgcttcgtggaatcgcgcgatatctggagatcgtcgcaactcgatactgtcaaatcctcagtattcaggtacagatataccattctttctccacagcaaatatgttattggagtattctgattagccatttacaatctttcttgtgctgcgtacagttgctaagtactgtgttgccgaggagaagagctctgttcaggtagccaccaaagaagccatgctgccaaaatgcggtcagatcacgcagaacggcaactgcaacaagaacagtatggcagtgttcgaagtgtcgaagcagatgaaggcgatggagatcagttctgagagtggcgataaggacaacatctccagtgctacgcctctgaaacggctgagcatcgagccgtctttctgcgccgattggctcgagatttcatgggacgagatcgagctaaaggaacgcgtaggcgccggtacttctttaccttcatgtttgttactgatttacctgtatgatgtgaaatctgatcgctgctgaaatgcaatgcaggttcgtttggaactgtgtatcgtgctgactggcacggctctgtaagtatattgaacttttggctcattgtgtaagcttgattccctttggagatcataaacttgaggttgtagatttgaaatgtaggatgttgcagtgaaggtgcttactgaccaggatgtcggcgaagctcaactgaaagaattccttagagaggtctctgccccattatgctttgattctttataacttgaactaactgttcctttggatcacaaaccagttccatctttctaacttggaaattgtttttaaccactacagattgcaatcatgaagcgtgttcgccatccgaatgtggtgttattcatgggtgcagtgacaaaatgcccacatttgtcgatagtaacagagtatctgcccaggtgaacctctccctcagtttcagttgacaaaacctatcaatgatagtttgtccttcaccaaataatctttctgatgatgcaaatagagggagcctcttccgtctcatcaacaaggcatctgctggagaaatgctcgatttaaggcgtcgtttgcgcatggcgttagatgttgtatgtatcacagcttttttcttctcttctgcatactgtatgcatctgaaccgttactggtttctctgaacaatgtatcacccatgctttgtttgtaatgcaggcgaaaggcatcaactatctccattgcctgaatcctccaattgtacattgggatttgaaaacgccaaacatgctggtggacaagaactggtccgtgaaggttggttcaaaattcaactcccaaatagtaacagcgagatcgaaaacttgttctacctttttatttctttactgtcgttgatacgaacttcaggtaggtgactttggcttgtccagatttaaggcgaataccttcatatcctccaaatcagttgctggaacagtaagtttcatattaccgtccaagctcaagtagcaatctgcccagctcaagtagcaatctgccattgaaattattggctctgatcatccattgttcctgaaaactgcagccagaatggatggcaccagaatttcttcgtggcgagccatcaaacgaaaagtgcgacgtgtacagctttggagtgatcttatgggagctcatgacaatgcagcaaccatggaatggcctaagccctgcacaagtatttatctcaatcttctctttattctgatcctgcatttgtgtacacgggactgtggtttgtgattcagcagagcaacctgtgcaggtagtaggagcagttgcattccagaacagaaggctcccaattccacaagagacagtccctgagctagctgctcttgttgaatcctgctgggatgagtaagcactgtttgttttgaagaaatttttccatgatttagacaaatttttgcttgatttcatgctatgttcagaacaccaacttgtcagcgagtgattttgctctccttttttcagtgatccaaggcagcgaccgtcgttttcgagcatcgtggacacgctgaagaagttgctcaaatcgatgcttggtggctcatgacgaatactgaagactgttggtcgccttcttatttttgttctccctgttaatgttaatctacagcaaacaataagttggtaagtcagttgccttaaaggcatctgagttctctacagaaaggagaggatagttgaagcagcacaagtccaatgctgcatcgagttcgttaggtcaccttttttttttcctccgttttccgcatgagaaactaatatctaaaaaatattgttttttgctcctctttttctctggattgaattttgtacagtgcatacaaatttgaaattaatgtgcagaattcagatggtcatgattcgctcggtttactacaaaacacgataacacgtccttttgcaattagcccacatgaggaaaggaaatcattttgaaatcaagcaagataagccattaaattctacaggagtccggatagacgccctgaacatcatatacttgagctgaaactctctcaggtttatggttttgatatcggcataccaaatgccctgaaaatctgccgttgttttcagtatattatcaagctccatctcgaattaaaaagcaaaaaaaaaattaataaaacttagtgacatctaacttaagctgatggttgcatttgggcttacctagtacgtacaactacatgcagaagtccagcttgtgttaggaatctaaactatatgttccagcagtcacaggaaacagggtcggtggcagcgtttcttgacccgggaacacgggatcatttttgtccccaccttgtaaaaacctctagcaagtagcgtaccacgtctcttaaccccgttcctcgatcccatcgacccggggactttgtggctagtccagctccttcacgtagctaatacttctcttgttttgctgaagcgagggtatggcaggaggtttggattttgccatgtcaaaaaggactaaacaattttggacatcccattcatgttgaacttgttatcaacgtgaatattcagatacaaagaattaatggtagtacgatcagtgcagaagtggatagaattttggccttcactcatgcatcatataacacaatccattgattatcctaaagtccattctgtatggttcaattagtacagtagctgtataataattttgtttagtctatgcccatgcccgcatctagtatacgtttcttatcttcagatcgttcaattattcaccattgcatcgaacaattaggatgggataaaaggagcgtaagaaaataatacttgcctctgatatgaacttaagaagctgttggtcacaagaaaacaatagcattttctttgcataagatattgacaagtagtcatatgcctgagcactgcaatcagctatttcatctctacaaaagaacacaaagaacatggtaaggaacttcaaaacagaaaccaaacatgaaaaacctggaacgtgaatgtgcaatgtgctcacctgatagtttcagcaagaagatctataaagaagtcataagcctcatgtggaacagtttgacgagcattgaataattggctgtaagcaccttccatgaaggaaaactcaaggttcagggcataacttgatgcaaggatagtcaagcttttagggacagaagttccagctccacgtggaattcagcaattttgttctgagccaaaagtctcagaagattaaggccctgtttgtttcagcttaagattattgtaatctagattattaaatcagattactgtaagttggattataataagctgacataaaataagctacgagtcatttgtttctctggattattagaggcatctaagggtagtgggtctttagccactcaataatctgaaaaaagctcctctagaggagattattggattatagtaatctgacttataggttataataatctagcataataatctacttgtttgtttcagcttactcctaataatctaaattataataatcctaagctgaatcaaacagggcctaagccccaaaatagggtactcatcaggggagggtggtattatgccactggatgaacaattacaaataaacacagaataatatagcatttaataaaaataagttctggaatgcagagctccgaaaaaacagaaaattaatgtacgtaatgcacacttttcagaaaattatgggatctatgacacacttatgcagaaaatcttgcgacacacttttcatgctggtctgctggctcgtttggaacgaacatgatgcacgggttttcaatcagagatcacacattaggccagttgtttggagacatcaaggatgagatttccatttggaaagagactggactgttaaaagattgtaatgagttagggcttgtttctcttggtgtttgggcttgttcaggacccgacacctccatcttcgacagcatactgttgatgctacttgtaacttgtatctttcccaaatcttaatg

SEQ ID NO: 62323 - DNA, 1724 bp, Oryza sativa
gtcggtcttcttcaacccaggccaaaaagaagagcagaaaatgtccaatgccaacgtgattgttcttataaaactacagggattcacaatgtcacagagattaggatacatgaattcctcttcccacaaaattcaacactaacaatggcaatatttactttaacggcgtttttctgtcacctatcaatgccatcctgaaatttcaagaacatgatacaacgctagaacctaaggctgatggttactggttcagaagaaaagcaagaggcgacacagtataaatgcttgacactccacatccagagtacatatgaaggattgaatcttgagttcttgacattgcacagtaccagaaagtattcaagaagaaacaaaccgtgtatccatgtaaaaggctttgagttgatagaagttcctctcgaaagcatcttggtcttttgacattaattctcaagataacacttgctcatatatagcccctgaaagatttaaaagtagtcaccacaacaaaattacatacaaattgatggctaggccctactgaacacctgcaaaagacataaaaaatagttggatcataacaaagatctgacaagaagtcccaaaattgatggaagaacagcaatgagcaacaaaatcttatcaaaagagtaaaaagggaagcctgacatttgctatcaagggtagaaattaggcaaaattggttctgaagcactagaagttttagttttttttgttttaaaatccaagttcatgcttttaattttctagcgatgaaacataagctttgagtggtatgatccagttttgcctaaaaattaccgtgttaattggataaaaagaagttatccacattgttgattgtgctgggtccaaattaaagcgttataatttggaacagagcatcttcagcatatgtaatagacttgttacagttatacaagggttgtacttgtctatttcgaaatacaaaatggaagtatgttgctatataagtatttcattacatttcctgttggttgagactgtgtatgcaatgtattggattgcatgtgcaaggagcagtttattaactagtcgagtttcgaccttcacagctactttctccgtttcacaatgtaagtcattctagccatatatgtctagattaattaacatcaatatgaatgtgggaaatactaaaatgacttacattgtgaaacggagggagtataaacaattgtcgaaccaaaaaaaaaagctataagcctataaacaatggtccaaaatgaacatttcagatgatcattcactggtgtgatactaaataagtgcaagggtataatttctccaaaacaaaagcgcggcaaaacttacgtgtggttttcagctccgcgactgcattagatgtcttctcaaatgatggtgtagtctaggaaacattggcaggagtacctgaaaccaagaaaagaaaataggagtatcaacatagtatgatatacagcgaatttactgagcagagaaggaaaatccagcattttctatgaacacccccccccccaaaaaaaaaaaaggacctaatacaacggcagcctaacattgtgacattgggtattgtaaatgtgaacagtttgtagcaatcacagtacactttaggcctcaaccctgagttccctaaacccctaaaacagtggcacaatccagcaaattagacatatagaaagcgcatttgacacaattaatcc

SEQ ID NO: 62324 - DNA, 3398 bp, Oryza sativa
cgcaagctttgtggctcacctcctccatctccacctccacctccacctccatcgttggcaatggcagcggatgctctcctccgagctcccacccccccgattttttgactgctctgctttctttcttgggggaggagaggagcatatgctgcggagtcgtctggaccgcccgatgcgggatcaacggcgcgataaaagtgagggagttgcgaaacgacgtatttagagggaatacgttttcagaatcgtatggcggattttcctgagaaagcagttgacggcgttttcacagtctgaaggcggagtttttgggacgatgagcaaacagaaaatgaacaaaagaaaacgttttatattggaggtgcggggaatcgaaccccgtgcctctcgcatgcgaagcgagcgctctaccatatgagctacacccccgttttgatttgaatcataattaaacccttaagtagtaatacaaaaggtcctgggaaattctgactattacttcggcgctaattgaatgagtttgattttgagaagcaacttgtgagaatctgaagaaaacccaacttttaaattctataacttcttaaaatctaactgaaaatttgaactgtttagaagagtttatggcaatcggagattttaggagaaactatatctaccagaaccttgatagacccttacgcagctgccttagcgttagagctattatgtggtcatgaccaataaatccacacagatagatatgttcacatactactctgtagagatatgcagccagcttttatcagctagattgagctgtgttctcaattaagttttcagttttgggacaggttggggagcagctagcttgaacagttgggcgccgaaattaattcaaccggaatacgtacacatcagaaaaggcaccagtatgtacgccgaaattaattcaatgggaatactagaacatgcacgcggagtacagagttactgtaatactgtcaggctaggtagcagctaaattttcacccaaaaaccgcgtgatgaaggttgtatttagatacaaagtttagatccaaacttcagtcatttttcatcacgtcaacccatcatacatacataacttttcagtcacatcatctctaattttaactaaaatacaaactttacgctgaactaaacacagccgaaattaagtagatgtactcgtgtcgtcgtacgcagtagtactagcagggtatactaggacatacatgcaaaagtacagagttctatagtttgcaacgcctaacgactagtatttagctagcatctgtaacaacgacgattttttttttaaaaaaaagctttgcctcatatatatcttctattatatacttaaagtccattaaacttcctacaaacgctctcaagccgtcacgtggtgttcctataaatgctcttaagccgccacgtggctctattaaatctaaccgtctattttcacttaaattggtaggcctgatattttagaccattagattaaatttaaatcccaccccacccctaccccaccacctcctacgtaagtacgtacgtccgtcaatctgtccatctaccccataccctcctctcctattctctattcctattttacaacaaataatttcagataaaaggaatcaacagttagataagttcaagttaattgctataatttttaatccatatatctacttgattccatggttttgattggtttgagtttagaatttatttgctccaaaggtctttacgacacaaatatatacaatcaacttaaaaaaaagtcctaaataaaacttttaagagaaaggtcaaaatcataaaaaaaattatcctaaatattacgtatttatgtatatatgggaaaaacttacgtatgtacaactgaagaaacgaatgaagcttacctactattcgcgtaagaagaaagaaaaaactacccacagaattaccataaaatcaataagcaaaaaaaacatacgtacttagtaccattgtaaaaaaatgatgatatttaaaatatatttactattatttaatgataaaatatattactctataaatttacataaatatcaccgtcgattttcatttaaattggtagacccgattaatattttagaacattagattagatgtctaaaagcccattaaacatctaaaaaatgctcctaattagccatagccatgtgatgctataataaattagtgaaattcttaaaaattctaaaataacaaaacatatttttattaaatttggtggacccattatttacaaccattagattaattttcaagaaaaaattcctctcctaaacctgggcccacctaagactgtatgtataagttactttttttttttacaaaaacgaacgtacgtatgtacgcctcctcttccttcaattcatttctccacttttcacctattccttctcctattttcatgccttattagttagataagcaataagtttgtgttaaacaattaagcttctaaatcacacaactaatttctgatccgcgtaaatctttagattatttataactaaatttacagttgaagaccatatttcactactatttacctttgaaaaaaaatgccattttggtttagatttcctgacttttgcgtgcccttcaagcaattataaaaacatataaaataataataataataatatagattttatcatcatacataacttcataataattaaattaggtctacaatcataaaagtaaaatgaatattctatgagtaatgtttcaaaaatatgtttgttagaaagcaaaacctatgcaaaacataagcaactataacatctaactcacacaactaatatttcataaacttatgtctttagattatttgattattttacatttaaagacataggaatgctttaaaaagctactcccccattataacattagaataagttaaaataacattactagattgtagtgttcgtatttttaatatctactgtgaatatactggaaaagacaagtaaaaaggatatattttaatcaatcaataaattgtttttcaatttttagttaaaaaactaattgcaactaaaacactacaacccggtaaaaataattattaaaattatatccacgcgcaatctcttcccttcaactctctcttcctcttaaatcataatgttaacttatttgaatttttgctttatttataattaaatagataatttaagatccatgatacccatatttcactatataaaaatgaaaatacgtgatttaaacatagacaccgttcctttgcatggtaaccaaatagaaaaaagacagaccataatacaaaatgaaaataagtattatattatcgtaaatcattgtacatcctctgagcgcacttaaggcgt

SEQ ID NO: 62325 - DNA, 4637 bp, Oryza sativa
cactaaaattagaccaaccattgcatattccattttcataacaattttaaaatgcttagacattaatggccttacatctatccatatcatagcattatgactttctccacatattattacatatataaaccgcactaaggttcacagtatatagttctttgaaaagttatatttgttactattaaatttaaaattttggattcatgttaactaggtatattcttttgaaaaagatagtttagatcacacaaatcagaaggaagcgaggtatatgacatgtctttattaatttatatgtaagtatgtaacaacttacatcaacttaaacctactagaaggagaactacttgatggtacaaataaaacatatttattaacaatatagttctttagaatttgtaaaaaaaagcatgtaaacattctattaaaaaaatggccaaacaccttagttctaatttacacttgatttgttagacatgttttccaaacaaactgaatcgaacttccttctatataatcaagagatcatagataattattaatacagatgtattaaatatgatatatttttaaacctaacaaatatcttagaaaaattatcaaagcaaaataccaaagaacagcggaggcttcacctgatgtgtcttattcaaataaaaaaagtacttttaaacataataggtgtcagccgattgatattatatttatatagatatttcaaatgcaatgtacaatcagggttggaaattttggccatttcagacccctccgatactatattatttcggccaaatttttgtattttttcatgaattttggtaatatttgttcaaattcaactaacttttgttcgaaatttcggaccgaaattttggtgatgccctatgaaatcggctaaaccgaaaagtttaatcatgtgtacaatacatgcccgcgcgaatgcgcgggctactttcctagttgatagagcaggagaataacaacgacaatttgaggatatctgaacatctactactctctttatttcaaaataagttaatttgtaatccgtgatgtttgttaaaaattagttgtgcagtttggcggtttgatgcccctctctgcattaaagaacttataattgctgattgtaatctccctggttgagaaataaattcaccctttccccgcaaaaaaaaataacttgtaatttataatacaaatgtagagagtagataaaaagaggagtagttatattgagatttaataaattaaaggtattagtcctttttatctttttacatgtacgtacacgcaaaatgggtaaaacaaaatttgttccgagacgtagggattatacctatctcagtcgcagtgcacggaaaagatgcggaagcacgtcacacacatcacttgtagctgcagtagtacatgtcatgcttttaatttgcatgtactggatcgatcaggattcagaagagagagagctagcgacaagttgtgcgtgtaaccaactcgatctgtcccaacccaaccaccagcgaggcagcgacggccgggacacgaccgattgaccaaatgttaattagtgcagattttaaagccggctggttaaccgtttatgtcatgtcatggcgcgaatgcgtcctcatcgaaatttaattaatagcgacggttcgttcgttcgcttgcctttttcccaactcctaactccgatcccccccacaggcacagttcgtcatcagttcgtggttgattgcttccgtacgtccctgatgatcgatggtcgaaccagcctccatcagtagtccaaccgtctcggcgatgtgcatatgctgtaactgtggagacgtgttgattgaacgatgcagatttagagcctatttaggccctgtttagatggaactaaaacattttattccctattagatcggatgtttgaatactaattataaatattaaacgtagactattgataaaacccattctataaccttggactaattcgtgagacgaatctattgagcctaattaatccatgattagcctatgtgatgctactgtaatatatgctaattatggattaattagtcttaaaaaatttgtcatgcgaattagctcttatttatataattagctttataagtagtctatgtttaatactccaaattcatccgatatgatagaaactaaattttagtccctagatccaaacacccccgtcgtgaaaagaaaatttttgggtgtcacatcggatatttgaccggaagtcggaagaggttttcggacacgaatggaaaaaaatttcataattcgcctggaaaccgcgagacgaatcttttgagcctaattaatctgtcattagcacatgtggttactgtagcactatgactaatcatggattagttaggctcaaaagattcgtctcacaatttccatgcaaactgtgtaattaattttttattttatctatatttaatactccatatatatttataaagattcgatgtgatgttttggagaaaagaaaattaaaaactaaacaaggcctaatccaaggaaaccaagttaccaagttggaccactaagggcttgttcactttgctaccattttcaactttaccaaattttggcattgctaaattttgttaaggttatcaaaattttagcaaggttaccaaattttagcaagatttcatatgtatttactaaaatttagcagcaaattaaacgtagctaaaattttggtaactttatcataaaataatataattgaaaatagcatcaatgtgaaccgaccctaatattatccgcggctactacacccgaaaacgaatgtagcggcaacagctgaaaacggccacagccacgcggctccagcggccagcgtttccgatcagcccccaaaacgagtcgtggagttggaaagggtaagaaatacatcacgcacccatattttcgtcccaattaagagggcgccattcctcgatcgatagatccggcccccttattcctcacgtacgcgatcctaattagctacacacgattcctggcgcttttatacacggaccagagtgtactaagatcatcacattttggaccatcaaatctgggatcgtacgcacgcagctagtggcgatgatctatctatctgagaaaacggtgccatccctgcatatatgcaaccccattgtggaataagcaaacggatgaaaaataatttctgaataaaaattttatatacgtgtttttaacgttctaaaagcaaatgttgaaaaataaactacgatgaaaaacctcaaaattaacttctaatttaaagttaaaatttttagatttagctaatgtgtataagcatgtgaaaaaaaatgtgacaaattggcaccgcccggcaacgccaccatggttggctcgcacggtcgccggccgggccacttgtgtgtaggcccccggccgggctataactttcctacctggctacctgcctagtggcccgtccgtccgtctaatatagtagctggattatattggttttgagatctcgatcaatcagcttccagttccagctcgttttatggacttgcacactgtgcaatgccttgagatattgattgggttggttgatcgcaaatcgttcgtttacttcgtttctgtagcttcttcatcagggcgcattcagcatgtctaatcacataagtatctttcttttgaaggagattttgttaagaaactcaattaattcaagtcacgaactgtatatgctcactagtagtacgaaaaatatttgttgttacggtcaaaacaggttttttttctggtctactgttccgctagagtcaaaggtcacggccaatagacttcaacagaggtagtggccaaacaactattttctgccaactctgcttcagaaatctcgagacggcccatcacctcttctacgaattcccgatcacgagaacaatttgggacactatagcgacaaggctaggcattcctcagttgcgaccgatgaactggccccacacatcatcccttgagaactggtggatccagaccatccacaccatggctaaggaaaaaagaaaatggtgttaaatcactcctcattatactcacttgggaaatatggaaagaaaataatagcatggctttccgcaacatcgaagcactaccacaagtaaccattaatcggacgattgacgaagtatagctatggcgcgcaagtggagcaagggccatccaatccctgcttctggacacctgtgaaactacaaatagcaatatgtaaatcatgacatgtacccctaacccctttcccctagcgatcccccatccctctaaaaaaagaggcgaacattagggaatgatctaatattaaataattataaggggttatacttcgaacccagattgtctagctcaccatcttgtgaagttagatggaagacccctaggcatttctcaccctcctcgttttccttttgttttcttttataatctcctggctttagagctattatacagtgtttccccctccttaattaatataaatacaccttgtgggtttaaaaaaaggtcactaaaaatgcaccacgtttctctgactccatggtactctcttttttcatattataaggtgtttggtttttttatcaagt

SEQ ID NO: 62326 - DNA, 2849 bp, Oryza sativa
tttgatgataaatcaaatcacaataaaataaattataattacatatattttttaataagacgaaaggtcaaacgtttgtcaaaaaaaatcaacggcgtcgtacattaggagggagtactgtataagtgtatatccgctgtggccggcacattgacgctgccgccacaaaaccgctcgatcgatcgatcggtcgcagttcggttcgtgcgtgagctgatgatgcgctggctgtcttcactcgtcgaagcataactgcgttggcgcgcatcgatagggggccgattatctagatgcttattctttctacagctagcgtccatcattttacgtgatactccatatagtgcttcctccgtaaaaaaaaataaccctatccaaaatcgttatatcagattatgtctcacctaaattttaggttggttttttttaaaagagagagggagtatatcaagaggtgagcgtgatctgaagagagagacgactgttattagagtagcctacccaacagcgtgatccgagcacgtgtggttcacctcaccggcgcgcggtgccggtgggcgcggagaaagccgcactcgccgcaccgcgcagcacgacgacctaacggcaatttcggcgcgcgccgagccgacgaacgcccaagatttcctggatgtgacgcggtattgggatttcctggatctcgacccggataaccgaaaatgatcagatcagcacgtacagtgtcagtatgaattttgataaatataaaaacgagtagctgcccgacattaagtccgtgtttaaatccaggggtgaaaagttttggtactccctccgtttcgaaatgtttgacaccgttgattttttaggacatgtttgaacattcgtcttattcaagaacttttgtgaaatatgtaaaattatatgcctacataaaaatatatttaataataaatcaaatgatagaaaagaattaataattacttaaattttttgaataagacaaacggtcaaacatgtttaaaaaaatcaacggcgtcagaacatttcgaaacggagggagtatatcacatcggagtattaaacgtagactaataacaaaataaattacataattcacgagacgaatttattaagcctaattaatctatcattagcaaatgtttattgtagcaccacattgttagtcatagagcaattaggcttaaaagattcatctcgcaatttacacgcaatctgtgtaatttttttcctaaatttaaacatggcaaaaagttttactaggagatccaaacaggccataaagtaacttcaaatcatctgaatatattgatgcttcccggttgatatatacaataacatatacagcaaactgagagatgtaggcttctttaaaatcagagtatttttacgcgcattatttacttcgttataaatactaaattaatttttttatggaaaaacttagcaagtatagtttgagttttataacaagtgtgcaatatagcaggaaaacaatttttttaagaaatcgtatttttaagagtcttggagtagagattccataacaataattcaataaagtacctataaaagagtaaattttacccaaaaaatatacaattatttaaacaaaattaccactttgctacaactttagctttgtagtatttcacacaactacaacaataacaaatgatttatcaaaaatctgcaacttatccactatatggatataacatatgagctcaacttaaaacaatagtactacaaatgtacaggacaagtgggacggcacaattttacaatatagacaaaagatacagttttacaatatcatatattattgttgtacaagttaaacttgtataacaaattgaaaatttttcacgaacacgtcaaatgattgtgcgtcagtatattagacgaaagagtttttattacacaacgcaactggccagactttagcgggtcattgccggttataggaagaggattctgagatgaagaaagagataaactaagaaattaaaaaaaaatgcaactcctatctagcaggagggggtggcagccgcctaatctcccaatagatccccccaagtacgcggcaccagcgagggacagagatgaccctcaaactagtttatcaaaccgatatttttgataaactagttatagcttttttaaatttactcaacataaattgagaatcaatatgcaatactaaaggttcaagccacaacagtgaataggagtaccacgccacacacatgcgaccgacgacagaataataacatcaacatttctccccaaaaaagaaaaagaaaacatcagcaaacaatgcacacagacattgacatatccatggtccagggagctcacccgtccagcgtttcgccccttcacctcccaaccaactcgtatttaaacccccccaacctgtactcttcttgctcgcgttcgcgtatatatccctctcctcacacacacaggtgttcgtccaaaattccgaacacaaccaagcgccattcttgcaagcgcgattcccttgccatggtgctcgaggggcaggagacaccggcggcggcggcggtgcacgggcaccggctgtctacggtggtgccgagctcggtgacgggggaggccaactacgacctcgccgacgccgacctggcctacaagctgcactacctccgcggcgcgtactactaccccgcgggcgacgccgtgcgcgggatcaccatcaagtcgctcaaggaccccatgttcccctggctcgacgcctacttccccgtcgccggccgcatccgccgcgccgagggcgacgacgccgacgccgccgcggcgcgccgcccctacatcaagtg

SEQ ID NO: 62327 - DNA, 26825 bp, Oryza sativa
ctaatagtatagattagttgcagagtttatggggattctttgattaattgttcaaaagttcagtgcaaatctgagtaattagcttagctagcttggatttgttggttggttatgactggttcttgaattggcgggagtagctttcagtatggttcgcagctgttgctgcagcagttaacatttactacttctactccagtactcaccgtatttaagctagctgaactggcaacctaatcagtggctgaccaacttggcagacattgccagcaagctgcgactactgtcaaaactacttcctctgtcccaaaataaatcaaaacaaatcaatctagaacgggtaatatatcataatactatgaatctttggtttattttggggccgagagagtataactactagcactagtgtaaccgttgatttgagaaaccatcacaagattcatggcacctactagaaggattagcggacacttgctgtccggatcaggtagctagtgtgagggtggttaggcaattatcctgcagtgaaacacctcagttcagtacgcacagggctgggcatggaggtttttcacgcggtggccgtgtattgtgccgtgagccggtgggactgttcttgaattcttagcggtacaggttcacacaaagctagtgatgcggttttgagggttaaccgtttctcctttttttcttttgcctttggaaatggccaggtgtttattcagatatcctgggaaatgaccatgttttttattgataactgaagagttgagatgatcaaatcaatcttatgaaatgagtaacagtagagatgatgataccgaccggtgctagaacatgtagaaatcaattggggcttgtaaaagtaacaaaagtaacaattttactccactgcagagaggctatacagtctggtaaaatcattcattgctccaccttcaccagatctctgaatctagagtgatggtatgaaaaaagtgctctctgaatctgccaacatgtctctacagactacagtatttgtgtaccatggcttctctgctagattaattgaccattgacagacccagccctttttctggagtaacacaaccccaccaacatttacaaagattcagcacagtagtagtactgtactgtagtagtacttgtagtatcatacagtatcaaatgaaagaaagaaaaagatacagcagacaactgaattgattctataccagttttaatgtagacaatttttcgtgtgatggctggtaataggatgccatgtcctcgtcctaggtgaaacaaccacgtcatctcgcgggtaaatccattcatcggtagtgtgattttgtaaaatacacaaccaaaatatatgtacttaagtgttaaatgtcaaaatgtgtgtgattttctgcaacttagaccacaaaatgtgtagttttatgaaatttactctttattaatactatgtctttttgacttttcgcctatattttcttgtcagttaaaagactgaaaatgttttacagtatgagccatcactcccacgagagttcaatgaaattattgaaatggacattatgtaagtggcacttcagtcttaaggagcgaagaatgataattgaagagttgatctaaaagaatactatgatttactactaaagaggtgtttacaaacagaattaggtttaagagcaagtataataatgagctataagcctactataaacttatgtggaggagagaaataacaaaaaatcaagaattttggctctcatgcaagagctagcttaacacaaactcctaggcaaatacattaaatgcataggtgagagatagagagagaagatagttgtagccaaccttatagctaatccattatatatattggctttaagataggctaatagtaggctataagtgagctatatacttatgtggaagagagagataaggaaaagtgggtagtgttggctctcatgcaagagctagctccacacaacctccaagaaatatgcattaaattcatggagtgagaaagagagagaatggaaaaaataaagttaaccttatagctaacttattatacaagttaactctaacattgacttatagtaagcagtgagctttactattaaacttgctctaatatatagatcaccgtagaggccgttgcttcattattatgatgttgaggtctcgtggtccactgtcgatttgcagcacagctcacaagtcacagttctgacctgatcgtctaattttgatcccaaatagctgcaccccaattcttcaatttctgaacaaagacaaactttttttatgaaaagaaaacaaacttaagtgttcttgctgtaatcttgtattgatgcaaaagtggtaacaattaatgattttcttgggtttggaccggctcgcgccatgcattgcaggtcacgagcttcaaatgcggtggcatggcgctcggcttcagctgggcgcacctcatcggcgacgtggcgtcggcgaccgcctgcttcaacacgtgggcgcagatactgagcggcaagaagcccgcgggcaccgtcctcgagccggcgaacaagccgctggaccgcgcgcccgccgcagccgccgccgcgccgccgcgctccgtcaagccggtcggccccatcgaggaccactggctcgtccccgccggccgcgccatggcgtggtactccttccgcgtcaccgagccggcgctcaagaagctgcaatccgcggcgggacgccatgcggcgggcacgttcgagctcgtctcggcgctcctatggcaggccgtggcgaagatcagggcggcggcgtccaaggaggtgaccacggtgaccgtggtgaggacggacatggccgccaggagcggcaagtcgctggcgaacgagcagagggtcgggtacgtggaggcggcctcgtcgccggcgaagaccgacgtcgccgagctggcggcgatgctggccggggacaaggtcgtcgacgagaccggcgcggtcgccgcgttcccgggcgacgtcgtcgtctacggcggcgccaacctgacgttcgtcgacatggagcaggtggcgccctacgagctggagctgaaggggcagcggcccgtccacgtggagtacggcctcgacggcgtcggcgaggagggcgccgtgctggtgcagccggacgccggcggccgcggccgcgtcgtcacggtggtgatccccagggacgaggtcgacagcctccgcgccgcgctcgggagcacgctcctgctgctgcaagacgcctgagcccggagcgccgccgtgccgcgcgtcgtcttaacacgcggcgccggcgaccggcgatccggctggtatgaaatttcgacgagcgtaggacaatcttggcgcctcttttttctctggaatttacgaagtctgtactgtatcatgatgtaccgtaataagttgttcgagtgccagaatggaaatgcagtgttatataccacagtatacttgtcagaaattcagaatacattattgtaagtacttttgggcgtacggtaattcagatcaagcattattattttttagactgggtaattcactgggatcaagcattgttactacggttgaattcagatgagatttataccggtagaattcagatcaagcatttgctactgctagtagtattgcatacggtaatttaatactctggtgaattgcacacagtattttatctggcagaaacagtttttgcacatgcatgtcctccgtctgatgacgttattcctgagtactcattcaattatggctgtgggtcgataaatcgaaatcaatgtagactaccagtacgtgattaatattgcctgcagaaaacacgtactcctaataactgacctgccatggaggcaatgcaaagttgcaaaccatgtactaacgcctgccaactggtcggacatggacgcctgtgacagtgtgccgtcgtgaccaagtgccctagcttttgggctccacaaatatgcttgaattttacacatttttcggaaaattattagacaccttttattatttgcaaaaggccccgtttagatgggtcacaatcttggcccatccaggtagatgggccgagatttaggcccatcaaaacaaggctcaaagagtagtcttcctattgggctggcccaatttggaaccagcaatactaaagcccggcccaagttagcaacgcggcggccgctacaaaaccaatttgcgagggtggctaggtctcctcctctttcgcttcgctgaccccccaaaaccctagctcgagcgctcccttcttccccccacctctgcggcggcggcgggcggcgagatggcgaagtcgctgcggtcgaagcgggagaagcggctgcgcacgctgcggcgggagatcgcgcagcccttctacgacaagaaggaggcggccaaactcgccgcgcaggccgccgcgctcgaggcgcccgcgctgccggtccgcgcgcctccgccgccgtccaaggattccggcggctcccgcgccgcctccagctcggcatcggccatgggtgagccttctctcgtctcagtggttcgtggttgtgggggtaactgtggccctagttttcatgtaggaggcggacagaatcgctctgcgccttatctgttatgtttgggatgcttgtttgagtatcaatccttcaggtagagaatactgcagatttcatctcacgatggtcctggtgcacacaaggttatagctgtagctgcgatcggtggattgagctgaccttccactttattgctttgctcagttagtacatgactatcatgatagttcttgaagtgtatcagcggtggaatttgctccgattgacaatgcgttggtgctatgttgatgtctcgtctggaaacctggaaaaaagcatgttgttggatgccaatttgagtaaatttagctgcaaggagcatgagccgataactgttctgttgtgcgtctttgaaaactattggtgaaacaaatgaaagcttcctttctgaatcgcttgcctatatgtgtgttatgtttggactgaagatgctgttaagttcttttattattaggttgctgtacatctgtttggagtcacttcctcttggtttgcaatttgagtacttgtatcagggaagtgaccaatagtaacatttgtgtgatgtcctgttatgaaattattaataggtaatggaagggtataagtttcaatcaaatttaggtaatggaacatacaaatcagacactgttttgcttcacatgaaatttgcacctgttagtaaacacaaaacctaaccggtagatgcaattttggactcattctcatatatctaacagaaacgactttttcatcaatttgtttctattgctgccttgttgatcaagtatgttgtacttactaaataagcttggtttgttagtatggatccttctgattttccaccatcaaaacacctgattcagagacagatatattagagtcggtttttacattttcacttcaccttgtttcttgactgatggcatgctctctttgtatcaacaaaacagacgttgagatggcggatgaaggaaataacaagtccaagtccttcttgaagccaattggtagcattagcaagaagaaggtacaacttcacttgaagatcaagaaagataaaagaaaagctaggaagaaggggaggtttagtaaaaagtaggtgtcaaagcttactctgttatgagaaccatcaattttggttagtttgaacaatgcatgtaatggtaatctcttgtgttgttgtgcacctaagtgttaaccatccattctgggtggataccgtattgaaatcagcgaaagcagtgagccagtgacaccctattcaggagcttcatccgtattactgatatgatctttttttaagcatctgtgatgagctatatatattcatttcctggtgagtctttgcatctgctctttccgaactattcttagtgataacaaaagggcatgatgttaatttcaccttgcatcttgttgatttcttaatgattcatcatttcataatttggatcattttgccccaatgttggtgggcgcttggagatgggggatgttcttggtttactacatctcatgtacagaacttgtacctatctgttgtattgaagtgcaaatttctttgatccagtactccggtgccagccttattccccgttcctacgatatcttcattaaagaatgccaagtctccaagaacgcatgttccgttctttgacagtttgatagcagtggcatgttgagccgttaggtagcatatgaactgtcagatgctgttgtgcatatgaggttttgtaacatgatcaagtcaacacataattcctggcaatttccatgcactcatgtgcactaaataacagtagttgacttaacatgaaatccgatcagaattcagaaaataacctccaaactgaagaacatgaactgaattttttttggtatcgtatttcagtagctaatttttcatgatactgtatcgattcttaaattcgttgaacccggcacgaacaagctgccttggctgctaaaaatgtcatttgataattatgaatttggtacctgttaaattattgcacgactcgtatcatggtacacgaagaactctggcgttgaatcgatccttgcacgtcttagtccccaacccacacgctcagttgccatcattatccccacccgctgactgacccagggctgcatgtttgttacacctccccaacatttgcacaactcgcacatcaccgaagaaatgttcagacataaaaaaagaagaagaagaaaagaagttgcatcagcaagccagacatactactctctctcggtcccttttcaagtgcagttatagttttttttaatccaactttaaccgttcgttttatttaaaattattaaaaaaaaattaaaaaataaatacacataaatcactattcatgttttatcatttaataacaagaaaaatactaatcataaaaaaaatttaattaagacggactgttaaacgttggacatagaaaaccacaactgcacttaatataggatagaggaagtagtgctttttttttgcaggggcataattatcatatcatggtgtgcaaaggaagcgatgggacaatctcgttatgtttaaattattagggcatttgcaaatttgccaccggttttttcaatattgcaaggatgccactcgaatgatagttctagtggcatttttgtaattttctaatggcagttttgcaataatgattcaaagtagtggtaaatttacaattgcctctaaattaattaggatggacattttccaaaaagacttggagatcggtcagggcttaggacaaaccagtgcacaatgtaacagcgacatatcgcgtagaagaacaattcaaacttgagttatttatttatcttttacgatgtttatgacctcgatttcaagtctacgcccccattttgtcaaaaatattactccttcccccctctgaatgggatggttaaaatgcaaatttaatatttaggtcttttttttctccaataagagttggatgaagtttaagatttttgtgacacgattttcaaactgctaaacgtgcgttttgtgcgaaaactttttatatgaaagttgctctaaaatattatattaatttatttttcaagtttgtaataataaaaactcaatcaattatacgttaataccacattgttttgcgtaaaaaaacttaatcctaatcttcatcttcatcttcagataaaagaacgccacctcaataccactgttcatcgtaagataaattcgttttcgttttcgtggacttgaatttcaagtctcctctccgatggcctctctaccatccatgtcttctccactacgtctcccgcgctaacaacctacaaagatcagagatcgcgagcgcgagagctcgaggtcgcagaggaggagagagagagaaggagatcaagaagcacggcaatggcgaggaggttcgccgccgcgctgtgtctcgcggtggccgcggtgagcgtggccgtggcgacggcgaggttcgtggtggagaagaacagcgtgaaggtgctgtcgccgcggtcgctgcgggggcggcacgaggcggcgatcgccaactacggcgtgccggactacggcggcacgctcaccggcgtggtggtgtacccggcggacgcgaggctggccgacgggtgcaggccgttcggcgaggcggcggcgaaggcgctcaggtcgcggtcgcgccgccccgtcgtgctcctcgtcgaccgcggcggctgctacttcgcgctcaagacgtggcacgcgcagctcgccggcgcggcggccgtgctggtggcggacggcgtcgacgagccgctgctcacgatggacagccccgaggaggagacccccgacatggcgttcctcgccaacatcaccgtcccgtcggcgctcgtcaccaagcagttcggcgacgccctccgcgccgccgcctccgccgccgacgacgaggtggtggtgcggctggactggcgcgagtcgatgccgcacccgacgagcgcgtcgagtacgagctctggacgaacagcaacgacgagtgcgggccgcggtgcgacgagcaggcggcgttcgtcggcgcgttccgcggccacgcgcagctgctggagaagcgcggctacgcgctgttcacgccgcactacatcacctggttctgccccgacgcgttcctggagacgacgcagtgcaaggcgcagtgcgtcaaccgcggccgctactgcgcccccgaccccgacggcgacctcgccgccggctactccggccgcgacgtcgtgctcgagaacctcaggcagctctgcgtccaccgcgtcgccaacgcgcgcaacgcctcctggctctggtgggactacgtcgccgactaccacctccgctgctccatgaagggcgaccactacacccgccgctgcgccgacgacgtcgccaagtcgctcggtgagttagccgccgccgcctcgccggcttacccttcttctcgccgccgccgccgccgctgacacagtggagttcatggcgatggacaggtttgccgatggatttgatcgacgagtgcatgggggatcccgacgccgacgtcgagaacgacgtgctcaagacggagcagattgttcaggttcggtgaccaactgaccagcttgatgctgaaaaatgtagtaggattttgaaattttcggtgtactgacgaacaccttcgccattgctgttcttgatgcaggttggacatggcaccagaggggatgtgacgatcttgccgacgctggtgatcaacaatgtgcagtaccggggtaagaacgatcaagatcacactgaattgtggctaagatcattgttcgatcgaagatttggtgtttgtttctctctgaaacagattgtttgctgttgattttacaggcaaattggagagcacttcggttctcaaggcgatttgtgctggattcaaggagtccactgagcctgatgtctgcctgacaccaggtttgcaatcctcaccagctgaaatcacacttgatcaatcacttgatccaagtactaatcattgatcatgaattcatgatatccactaatcatggcagaaatggagactgacgagtgcctgaacaacaatggcggctgctggcgagacgagaagaccaacatcactgcctgcaaggtaccccattcccaaaattctttgaagatcacaagaaattactgtgatacaaatcaattcaagtagataaaacttttattgactcacttgattatttggcaggacactttcaggggaagaatttgccagtgccctgtagttgatggtgttcagtaccaaggagacggctacacccactgcaaaggttgtactagactactgctaatgtttcaccttcaattcagtgttcttcagaggatcatttcatttcagctcatcttgcacctgaacatggctgaatttcctactgatgtttctgctccactgcaatcttttcagcggtcggaccagggcggtgcgcgatgaacaacggtggctgctggaaggggacgagagacggcaagacgttctctgcttgctcggtactatgataaaaacatgccacctctgtgatgatcttctaaaccacattaggtgtgaccaaaaaatgcttgttggcctatccgccgcaaccgaattttgaattctgaaacttaattttatagttggttttggggtttttatcatcgtagtatgcttttaagcatttggcttttaaatcgtgaacaacacaaatatataagttttactcaggaactatttttggttggttcattcatttctaagccgtagctcaaccgatcagacacgggccatggtgtctgtcactgtcacctgctagcttcagactcatctgatgttttgagctgtttgcaaatgcaggattcagacttgagtgggtgcaagtgcccacctgggttcaagggcgacgggctccattgcgaaggtgatgaaatcacttgtcactctcctgcaaatttcttggtcagaattgcatcaggttgtcgtcgtcagatcttgttcttgatccgttcttcgccattgcagacgtcgacgagtgcagcgagaagctggcgtgctcctgccctcactgctctgcaagaacacatggggttcgttcgactgcagctgccatggcaacaacctgatgtacatcaaagctgaagatacctgcattggtaattcttcgtcaatggagatcaatccagcctcgacatcgtcatcttcctcatctcgtcgctcgagattttgagaatgggtttgtgtttttttggttgcattgcagcgaagaacatgtcggcgtttgggtggctggtgacgacgctggtgctgtcctgcctcgccggcgccggcgtcgccggatacgtgttctacaagtacaggctcagggtacgctggatatgatcagacagcgtcatctgaacatttttgtcagaaaatgttcttcttccaaagatcatatccattgctggcgttgttactgattttgctcttgttcttgttcgtgtgcagaggtacatggattcagaggtgatggcgatcatgtcgcagtacatgcctctcgagggccagaacggcgagaggctgccgctgagagaggaggcccaggttgagcatgcttagctaggcaggtactaacaacttcctgtctgaactctgaacagaaattgtggccaagtagttactgaactcatatgtttcagcattatttgtctgtgattatagttccttctctgattctttccatacttgcagttgcagaggttgaacattttggcaatgtccattcgttttgagacgccaagacacatgacagcgacgaatgccgcgatgtacatggcgaagttcagacatcatacttgatgacaggggttcttgcagtttctgcttggtgcttttgtagagaactgaaccagataggttcagagtttctggtagaagaacgggataagtctatgtcaagccggtgcaccgcaaagtgcagactagacaagtatagctgctgtaatgcagatttgttagaatatattgtgaataatagatcaacaatcttcctaataactttgaatcttgaacgcctgatttgtggcatcacttcattaacaactgaatcagttgaacttctaagtggtatctaggacgcacttgcattgcattaccttatacgaatgattatcattctacaataatactactacaacacgatcaaaattttgttacctcgcgatccacacacaacactattctactatccttgaaaacttaacagagccttcgtccacaaggctggtttgctttctcttcttggatagcctctggaaaccactctgttcatcaacaaactgagcagcggtcctcgctcgtagttcttcaagagtctctccttccttagctcgctcgatcacctgaatgcaaccgcaggaaggtcaaaatacaaatttcatcgcattgcactgcagtatatggtaggttagttcgaagaggaaatgtttgatccgttaccaaatgtcgcccgtagagatgagtgctcgcaagtgcttggagagcgttctgcgcctcttgctttgtgacgaattcaacaaatgcgaaacccctgtgactcccaaacttcataggcagtctgaggcttttgatctgaaattatgttccatcgatacacgtaagcacaaacaagagaaaattccttgtgttctcaacctgaaaacataagcattgatcaacctgaaagcagctaactcctttttgtctatcgaagagaacagaaagcatgaacatgataggtgttttactattttcatgatatattgttgcgtgatattaaattttattccacagactactatcctggacacaaaaggacaattacctggccaaatgggctaaataattgccgcaagtccttttcagttgcttcaaatgctacattccgcacgaggagttttgttgaactcttatccttttcatttttcttagtctgaccatcttttctcccatgacacagttgcaagatcaaagcatgtccatccaaaaccgttccctattaacacacacaacatacagcaggctgaacatcaacagagatcatggtgcggaaaagagagaagagaggaaaacgaagggtgggaggggtacctgtagatccttgcagacactggttgcagtttcaactgagtcgaactcaacaaagccaaatcccatcgaaacattcttgccattcttaatgtgcttcttaacctgtagagatatccaacaaagatgtttgagaatgagatctggaaaactccattcaatgcccataagcattgcaaccataccgttgcacttttaagacttccactcttcaattttgtgctgaaatgctgcttcaaggattcatccgatgtcttgaaattcaaattcttgacaaatacagatcgcgactgcaatggacagttgtgtgttactaagatttgtaattatttgggcctaaagcaaatagatgatatttaaaggcttgcacatgcagccacaaaaactcgcaggcaggtgcaaccacaagaaaacacgaaacagcctctagcatcatacagtaaaagcggtccaagtatataaggaacaccgagtgttattcagacatgaacagttgaacacaaatgccaaaatccaacttggacatggccacacgggagtcagtgacagttaagagatggttataataaagatttaagtcaagagaaagttccaaacctccaccctgtcaggatcaatctcttcagcactcactccttccacagtttgctctacaattgctttagtaacaatcctgtcaccaacaacatccttctcatcatcttccacaggtgctgaggtgggagataaaatattttcaggtgcccactccaaatacagtggagtatccctgcagtaaatagtaacaccaacttaggaaatatacatgtgcagatttcacaatcacactaatagctagaattatataacattcacaaaaagtcagaataataaaacataaaaaaaataaaccataaggatgacagggtataattccatagagagcatatcgatctataactagaaagcattacaacacccttagatcaaatagactaaaatacaagcatcaagtatgaatatgcgtctctcatgctactaaaatacaagtatcagatatgaatatgcatctctctctcttgcgacatgcatgccagtgcaaataggatctagctgtatcaacgtcgataatgggttttttctttcagttcctaggcaaactttaacttagattaccaggcacatgcatatgaaaagtcgattaagaatggagaaaacaaactaaagaaaacccctcattcttgaagtaaatatcgatggctgcctaatttatttaaagaaaatatgttaactatcatgcattattctatcttaacagaaaatttactacattgatttatcctaaaagctcaataaaactgtattcaaactagtcattaagagtattagatgtggactagcactattgcagatacttacttgtatcttgtgtacagtaactttttgaaagcatgccgagcttctgtcgcttcaacaaaaactacctgacatacaaactcaaggggtgaaattattcgcaatacaggtaataatgttcacttggtaatttgtagagcaaaagaaatacaaaagtgaaacattccagacagtaatgtaggacactcaaacactcaaaagtgtcatgatataatgaccaatgaccaatgaacaattgaacaaaataagcagaaatagttacataccaaggcaaacactctggttggagggaggatgattttatccaggcttccatgtttgcgaaacattgtggcaagatcttcctcacaagaactatatggcaagttctttaccaatatcacatggttgcttcttttaaacttctcatttcttttggaagcaagctcttccagtgcagcaacattaactccagaccttgataaatatttcttggtctctgcaatgacatgtgtctcaccaagagcaatacgaacagcaaggtcatctgcttctctatcaagtaattcacttttactgattccattcttccttgctatgttttcagcaacctaaatgtgaatgagtttgatcggttagcatgatacacgagagtttgattgttttttttttttcaaaattcagcaaaactatcctaaccctaaaaaggatacaaggaaatatttgaatgcagtatagggtaaaattagtagctaagtacaaaccatgtcaatgaaaaaacgttgaacacaagcaaaatgcagtaaatccacatcaaggtatcaaacattaacatacagtatcttggcgcatataaaagctgttccaagctctcgtatccccactgatttcagaagctttcctctgatccaacttttgttgtttgagactcattttcttctcttcgtaactagatctgaaaattttaaaacaaattttaattattgaataattaattgaagagaagaatggccacaagggaaacttcttttcttactcaatctttttattatttagtggcttagcagccttaacacgcaaaagtcgcccctgaaaacttgagttgtccaattcaagtgccctacaaggcaaaaaaatattagccaagccaaacacataagaatcaaggatagtctcaatattttgtgatacttttttgttctattcaatcatttaaattatgttctgattcctgaagtttgcagaagtgtatttttttttgtgagctaaatcagtgttacactgttccagatttagtccatcacaattaagcattggattataaatgccaacggtttgaggcaaatacaagacattgttaacctcttttttccttctaatttcattccttcctaataattctgtacaaccaagtacatagagggctagcagaatacagggtgtgagtataaactgctactgaacaatatgcgtctcatttataagagtggccaacagtaatggattaaattatcagcagtaagctaaacaacaataagttcatctacatttgaaatcataaacttgctgaccaaatttacctgactgctgagtctggaaggctaaagagcacataacctcttccagttgatagctttgtggttttatcaacgacaatacgtgcttgatcaacatcaccatattggctacacagctccactaaatcaccttcactgaaatcatacacaaaaatactcttttaagaataatcaggcagccatagcttcgattattccatatgacacacaaacactgatctcagaaaggacaagcaataacatacgtagttgcatatggaagattgcagaaaaataaacggccagtctccagtgccaacttcttctcgtcagtaattaaagcagcttcttcatcttccttttcttgattgtcatcttcttttagttggctgtcaagattttcaacctctttgttgtcagagtttcccgcctcttgcacagtagagccttccagagtcatttccttatctacattttttttcaagttcagactatccttctgatgagctatttcatccttttcatctgcatcgtgtgattcatcagatgagtcttcatcatcagtgctgtggtccgattgatcaccagaatcttcgctatcagattctgaatctgaccaatttttcttgattttactcttaaagaagtccatatctgtcatatctttgccttgtttactttctatttttagctcttctgaagcctcttctgaggaggaatcatcagattctgactgatcattcgccatttcctcatcagaagaatctccagaagatgagtcattctcagaaactggaacattcttctgaggtttctcaggcttttcactaactaccatgctatccttggcagaagcatcaagggtacccatcgtatcattagcccacatctttgcttttgagcggggctgcataacctcaagaaactcttggaacttgggatcactagcggcactgcctttagaacctcccacatcatcagatactttttggcccttggaacttttgagtggtgcactaacatctccagtcttagtcttgtctttgctattatattcaggcttctttaaagaatgacggctccaagggcgaggagcttcaggatcaccaatcttacgagcaacctgacacacaccggaggaactgttaagtctgtaaggtaaggaaatgcttatttccttacattaacccaccatagtcatattcaatcttctataggcaattcatcaagtggatagcagtccaatgagggaaaaaactaaaaatagttgaggaatacgggaagtacctcgcaggtgatcttacaagtgtcgatgtatgtgttgttgaaatacttgagtgcttcctctgcctcctcgttagttctgaaaccaacgaatgcaaattgcctgctctttccatccctacccaaaagaaagacatcaaactttatgccttgctcgcactacatctataaccactgaaaatattttattcaagcagcagcacatgttgcatgtgttaatggtgtaaatcaggtacatcctatcttcgaaagcctagcatcatagccagaggtgacaaccaaactcgaggtttcctgacctaaagggccaaactttttcgagatcaaggtccaattttgaaatccaacccacaactgaacagaacaatgcaggatagtgagactttgattctcttgcccatcatcgcaaaaaaaaaaaaaaaaaaaaaagagcacaatcttttgtataaactagcaaatgctcatcctatcgttatgtaggaatatatacatccagcaaaaagaacaaaaagaagcatttattttgctggtcctctgcagttacacgaaccactaagacagccaccaagctgccatggaagcagtagcagcaacgacctaagcctctaaacgagcagcttcctctcgattattacttacttggtgcggatgaccttggcgtcggtgacctcccccttccgcgagaacacctcccgcagccgcccctcgtcggcgcccttgggcaggttcttcacgcacagccgcgacgacctgcaccaccacaaccacaaccacaaccgccgccaaatcagccaccgagaaaacaaaaacagcaagacacgcagcagtggactcaatagagaggattcccccacatgccgatgccggcgaagtcccccccccccccggcttctgcggcggcggcgaggtcggaggaagaagaagtgcagaggcggcggcgctcgaagcctcccaaactccgcaaacaagggttgctcttgcgcttgcgcgacgatgaggatactgggctcccgacagtaaatgggacgtacatgggctggatcagccagccaatgggcctcgtcgcggccggcgagaggagaaattttctcatttttagttttatttaatttcaaaaattgtttttattttgaagtattacatatctcttctttgtataaaggtaatgtccactaaatgcctaaagctcgacatgcaagcatgtcacatcaacacattaagcatacaaagctcaacatacgagcatatagtaattatatctacaatttattttattctaaaactaaacatgcacatgctaaatcatcagtctcaaataatttttataatatttcaatctaaatcatttcagcatttctccattatctaacatatatcctgcagcaaagcgcgaggcatatttgagcactctttgcgagagatattttaaaaaacacccttcaaagaattttttttaatggcgtggcacacagcaattagtgtatgctaactatctcacggagcatcccacattctacaagcgatcccttgcaactttctaaaatctctaggagtgtgataagggggtcacatgtaaaatagcattacatgttagaaaattgattcactggtgccattagtgtcataatacagtaatattgcttaactcctagtgttatgtttgttgcctaaacaatataaccatggatttcacatgaggttgtcggggttggggcttttaactatttgccactcttacgagtggtgcttaacgatttgccactaggcccacatgtcatagacacgtaaaggcccacatgtcattaatagggtgtagtaaatcgttaattgccatgtcagaagagtggcaaatagttaaatatcccgtcggggttagctgacctagcgattgtgttgtagctccaccactacaagcggtccctttggaagccctctacggcaaggggccattttgcaggcaccttcttacactcttatgtaaggacataaagggggccacctgcagtagccggtccttcttcgttaagctgttaggggtatagattttgtcggtgatatgggaccggggatacgcacagtagagggaagtcaccttcccatctggccacgtggccgcacggcctggccttcccccgccccctcggggggtgatcaggtaacactgaggtggccagggggcctcggggtgccatgtcacgcccctcgggccctcagcgcgtgctgccctgaggcccccagccggccatcacgtggcggggagagtgggcggagcaagagcgccgctcaccgctttcaatgcgcggcgccccaaccgtcccatgctgcatttaatgcggtgtgggcgggcgtgcagcaccacccgattgacccatgtcaatcgggcttgaccggtctgtgaccggtcacaggcgattggactggtggcaatgcccccacgtcccgcccagtgtcaggcggagtgggggcaagtatgccccgtcccatcggcacattgccgagagcgccccccctccccggcgcatggtgagcccgccaaagactccatacatttaaaagagaatgacaggagtgtcccccgtgtcaggcggaggacggcgttgagccccacctagagacgcacaaccaccttgcttccggttgaaggcacggatggcggtctgatccaggttaggtgggtccccctcccatggaggggtacgcatagacggtgcatgtggtatcccttgaactataaaaggaggacctcgcccaccgagaaatgggacgactctcaatagcttgagccctaaaggaagaacagttaggtttccccaggagctcaagacctcttgcaagaactcatcataatcccacgcataggagtagggtgttccgcttcccagcggcccgtacctgtatgatcccttgtcttccacacagactcgtgagcgatctagtagttagaccacaagcggaagtgcgctcttgaacatcgcgccatatcccctggccgaactcacaaaggggggtctcacgaccacccgctagagaggataactcctcgacagatttgtaatactttaaaaataaaaattatttgtgaaaatattttaataaatgaaattaaaaataaaaaactagatgaaaacgaagcggatatggacggataatgctcataccatattcgttttcatattctttaccggatacaaaaacgaatacgaaaaataatacggattatctcgaatatgaataacaatcgaatatgatcagacacggatatggaaacaaatttttctcggaacatgaaaaccaagtcaagttctaatagaaacaaatatcaacatatatattagctcattttatataaaatgaattataatttataaatatctttttaaaatttaaataatagtatggactagtgataagagataaactactattaaaatctataaaggtatattgaaggtcatagagttagaaagaaatgagctatgtctcatggcttctgcagatatccaagggacatttaacttcttgccacttttaagatgtgtcaattaattatttgccactcgttgtctatgacatgtgggtccagtggcaaataatttagcaccactcgtaagagtggcaaatagttaattattcctatcccgaatagaactgatcaccggatatccgaattattgtccatattcgacgaaaaccccgataccatatccatatttgtatccgaatccgagctatccgatccaaaatgtatccgtatccgtttttgttcggagcggacggaaactatccgctccatttttatccctaccccatgcgttgctgcagaagttttgtacgatattagtagaaacaatatgtatgatagttgcactttgtatagttttcatttctgatcgactattgagaaaaagctaaaaacaataagataatgtggtatataataatttaaatcatatatggattgatcgttaaaagataaaattaaggtgatcttgctctatcagaaaagaaaaggaaataataaccatccaaacacgaaacggaagtgatatgattttataacagaatagaaagataaagatgataaatataattaagatgatgtgatctataaccagattagagagaaatagcattaagaagaaggaggggaggtggggtaacgacgccgcccggcaccgcgctcacgggcgccgtcgccgtcctcgacagcggcggggggcgagcacgaggtactcgaggcgagaccacgcgagaagccccactcggtgccccgggaaatggctgcaagcaagcaagcaaaagcatcaccaacccaggcgacgaccggcggcgagccggagaccacaagcgcccccgcgctaagcacgccaaactcgtgcggggaattctgatgagcagtcacaaattctgataagaacgtggagagcgcgaacaggtgactgctcaggatttgttctgatatgtcaaaaggagatgctcttatcatcaaacagtgccttgaggtataatgaactcctataataattgttcccttctaaaaaaaacactcctataattgtatgtagatcattttgtttttgacatgtgacaggttatattggataaaagagttaacggtggttcaaagtaccacataccctccgtactcgtaaaggaagtcgtttaggacaatgtttaagtcaaaccttggaaatataaatcatgaataacttttaagttgttgagtttgaaaatgtaaaaattatatgaatagatttgtcttaaaaaatacttttataaaagtatacatatatcacttttcaataaatatttttatagaaacaagaagtcaaagttgtgttttggagaccgtgtcgctatcctaaacgacttcctttatgagtatggagggagtaggtaagatcatctggtctaaaatgaaaagattggttaaaagatgttagattaatgggctaagcctaattaaatcctaataaatttcattgcccacattaagtgttatgggtaataataccaccttgaaaatataagtgaagaggtctcaatttaaaaacggagctagtagagagtctctgttgattggttgactctctctcccgttttgtaacggatggtagaattgattctgtattgacgagcgcgtcaaaattaaacactgagaattgcttccgtattaacgagcgcgtcaaaatttaataccttcagatattaggtatctcgaggtgtcaaaattttttagtataaaatttatgtccctcaagatattttcttaagtaccataaaatttcttgatatatgcatttttacagaactacaaattaatgctagaaaatgtaatatctttcagtatcttttttataacagtagaaactctgattttctttcatcctttaggctaaaaagacgattgaaaaaattattaagccagagaagtagtaactgtacgatgatttttctatgtgagataccatactgatgtcttcgcggtagtaatacagcatgacatctcctagcatctaaaaaaagtatgtgaaatggacattcttctagtagcccccagatcttgtagacaaccccgtactgtacgaaacagaggtttttctcctgtacatgtgtcccatgccaacaacaggaaacttgtcgaatcctaggctttcctctgttgcttggttgcattgcatgcttctataaataaactgcatcaccacctttgtccatcacacacagcttcggctgaatcactaacgaggccattatcatcatccatggcgttggaagccagggccgtgcagatatctatcccaaccgatgcttgctgcttctccggcggcaagtcctcccacagaatgtcaccggcgacccagttggtcagagccccgcagcatgccgtcgctacaggtacagatgattgtttacagagataaattcagtctaacatattacaaagttgttaaaagatgtagtagcttaaaacaagttatatttaagtaatgctgatgtagaaagtttctgaaaaaaaatcgtacttatggaagagtgccacaaataatccgtacataatccttcagccgtatagcaactcgtttcactattattggtgaacgatgacacctatcttgttcttattatactccctccgtttcaaaatgtttgacatcgttgactttttaacacatgtttcactgttcgttttattaaaaaaaattgtgaaatatataaaactatatgtgtacataaaagtatatttaacaatgaatcaaatgatatgaaaagaataaataattacttaaattttttaaataagatgaatggtcaaacacgtatttaaaaagtcaacggtgtcaaacattttaaaagggagggagtaattcctctttatttatttttctttctaccaacagcatacgctgagaagagtttggaggcaggaggaaatgcagcaagcttgccaaacaacatggtatgagtttccctggtgatcttttgatctcttattttcttcccctgttatgtctgaaactctgaatatgacaagatcaggctcatgtttcagttagaattagtgaacgtcgtcatgcaccagaggaaagcaatagaggatacaatgaggaagaagaagaagcagcagcttcacaaattcgagatgttgccgtctccctacgacacggcatgggtggccatggtgcctctgcccggatcatcatctcagcttccatgcttcccacaatgcgttgagtggatactacagaaccagcagagcaatggttcttgggacctcaaccagctggactcaatcaccaaggatgctctcttgtccacactggcttgtgttcttgcactcaggagaggtaacaaccatatatatgcaattttttatatatcttttttttaagataatggaaatcatcttggtctttccttcaaagaagctatagccgactactgcaaagtttgcagattgaacgactgcgagtgacaattctttttatgcgcgtaccttttttttaagataaagttgtgtatttttacctgcaagttcttttgtttagtactccctccatcctaaaatataaacatttttagcatagtgccaagttaactatttttaactttaaccattaatagcaaaaaaaaatcaatcatgtaaaattgatgttattaaatttatcattaatcaaaatattataatatgtaactctttttatttaaaacattttatttttatagatattgttagtcaaagtagtatctcgaagactgtgtcgaagtccaaaaaatgtttatattttgggatggagagagtatcttaatttggttgttatgatcaagttttggaaatgtttgacaaaaggtggtgatgataacaggactgctttttattggaaggaatttctccattgctatggatgagcagctggctgctcctattggattcaatataacttttcctggtatgcttagctctgtaattgagatgggtttggaggttcctattggacaaaccgacgtcgaaagagtacttcatctccaggaaacggaattgaaaaggtccacaaaattatattttattttgtcattttggattttggtgcacatattgtagcacttttcttgttgtaggctgtttccttttccagtaatcataatatttagggaagtgggccatattaccattattgtctatttgtgactatgatgagtttggaatttcttatatctgacaaaacgatatccacgggatacttcatctccgagaaataaatgccacaacaatttgtgttttattttggcatttctttctttttcctgaatgagattggcaatttttatcctcatgatctaaactaaatacagtagtcttcttcttgtaaatagtcccctttcataaccataattgttagtaaaatgggccaccttatttcaccaaactagtctagaaattccaaactttgaaatttttaatagcatctctaagtaactgactgaaattcctattttgatttaaagagaatatgaggagaactatcgtgggagaaacacatatatggcatatgtgtcagaaggattagggaatgcccaagactggaatgaagttatgaatttccagaggaagaacggatcattgttcaactccctttccataacagctgcggtgttagtccataattatgatgctaaagctcaccgatacttaaatttgcttctgaacaaatttggcactgcaggttggttttaacacttctccattccaagttgccaagaatttcttcctaaagtgcatactattagtaactaatgccattttttttattttttcatttatgtttgaaaccgagtgcagtgtatacgaaaaatatacatcgccaactttccatgcttgatgcgcttgaaaatatgggaatatctcggcattttgatggtgagatcaagagtatactggacatgacatacaggtatcagcccaagtaaccttgagtaaggatcagttgtctgcttttttttttcttagctcatgcaattgacaacagccagtttgcagttgttggttacagagagatgaggaagttatgctggacatcacaacatgtgcaatggcatttcgtattcttcggatgaatggatatgatgtttcttctggtatttttctaattctggatttttttcctcgttaaccgtgtttaatcttaggttatcttcgatcgttttgacacaattattttactctattttaattattattattattttactctagttgacacaatgatccatatgaaaattttggtgcagatgacctgtgtcatatcgctgaagtttctgatttccatagttcgcatcaaggatatttgagtgacacaagaacattactagaactatacaaggcttcagaagtcagtgttgcagataatgagtttattctagatagaataggctcttggtcaggtcggttactgaaggaacagcttagctctggtgcgttgcaaagaacttcatcaatatttgaagaggtagtttcaagaacataaatactcctttgatattgtgtgattgtgtctacaagagctaagttcttcttacatgtttttgataccatgattttgtatttgaaggtggaacatgctcttgactgtccgttctacgcaacattggatcgtctagtccataaaaggaacatcgaacattttgccgcgatgagctatatatcatatgctcaaaacaacatacctgtaagcttcctgtttcacaaaaaggtaatctagtgtactttagtacaacattcttaaatgtattgctgaaacaggccttgtcaaaccgctcaagatcttgtagctttgggtgccagaaatttcagtactactcaatctatttaccaggatgaacttgagcgtatagacaggtaaatatgacagttactctctcttttcatgtacaattgtacaaaccagtaacattcagcttatttctgcaaatttcaaattttgatgcaacagttgggtgaaagagaacagacttcatgagctgaagtttgcacggcagaaatctgcttatttctatctctctgctgctggaacggtttttgatccagaaatgtctgatgctcgcatttggtgggctataaacggggtgcttacaactgtcgtcgacgatttctttgacgttggaggatcaagagaagaattggaaaacctcatttcactagtagagatgtacaatcctttacatccatgattttagcttactttttaaataccattttcttaggcttaattcaatttttgcccattttgccaatggttgtcacaggtgggatgagcatcacaaagaggagctctactctgaacaagtagagattgtattttttgccatcttcaattcagttaatcagcttggagcaaaggtttctgctgt

SEQ ID NO: 62328 - DNA, 1228 bp, Oryza sativa
aactgcttcaagtttaactaagtttatagacaaatatagtaatatttatattaccaaattagttttattaaattaataattatatatatatatatatatatatatatatatatatatatatatatatatatatatatatatatatataaaataaatttatcttggtaaaaaatatacctattttttataaacttagtcaaacttaaaatagtttaactttagccaaagtcaaaacatcttataaatgtttatcagaatcttaagctcctacaaacataaagcttactaattggtactcacaattgatcttgttctaattggcactcacaattgatcttgttctttcgctgctgatgcagagggaggatggcgagggcaaggtgaacagtgtgtcgctgcttgtcattcagagcggcggttcagtgtccatcgaagaggctagaagagagatcatgaagccgatcgagagatgcaggagagagctgctggggctggtgctcaggagaggcagcgccgtccccgggccgtgcaaggagctgttctggaaatgtgcaaggtctgctattcttctactcccgtggcgacggcttcagctcgccgacggcgaagtccgccgccgtggacgcggtgatccgcgacccactcgatctcgccgccgtcgtcgcaagccaagaacccatatatatcattcctgcttcgtgactcgtgaggaaattgaactagagatgtgatcgtggatgaagaaactgtgaacgtgttggagattgaacacgggaccttagggttgaaaccacgtacccctttctactgcactatcaagtgcatctcctgctctttcttttatgagataacggaaatattttaagtctccgtacgcatgtagtcattagttagttaattctgtttggacgcctagtgcccgcagcgtgaggataagctcgcagcgtgcggatcgtggggatggaagcggatcaaaccgcggcgtgggtgatcaaaccggggaaacgctttctatcttgcgtgttccagcatgttccacttcgcacaactataaatggagaggagaaaaccccgaaaggtttgcatcacaaatcctctcgtgttctcattgttcttcctcttgagttgagtgtccgtgttctagctcaggttctcaccgatcattgtccagggaaacctgacaaatggtacccaagtgggattcaaggcttggactcgataacatgta

SEQ ID NO: 62329 - DNA, 752 bp, Oryza sativa
ccgccgaccttttctcccgcccccccccccccccccctgtgcctttgagatcatggccaatccacacttgttgttgttctttcccttcgtcgtcgtcgtcgcggcctctgctataacaacctcctcttcctcctcctcctcctgcatcagtggctactggccccagtgcagctgcagctagctagacatggctcgcaagaacagagatgggagagtagcagtgtggttgatgatggtgttcttgctactgtccggatcatatcagtgtggtaggttcatagctaggttgtaatgtcagtgattagtttggtttttgatgtgcatttgattgtgtggttgttgttgttgttgatggagcagaggcgagagctctgatgaggcgaagcaggaggaacacgctgctgaacgcgctgtacaagctcaacttcatcaggacggtggagccgatgcagctgccttcttcgtctccttctccggcgaagccggacggcgacgcggcgagcctcgccgacgccaccggcgacggctcgagctcgccgtactgcgtcaaccctccgaacgcgcccccgtcgtcctccaccccgacaacgacaccgacgccgacacctcccttcgcctcgacgccgttcgccccggacgaccagcccccgccgctgccccccatcggcggcttcacgccaccgtcgttcgagccgagcccgcctgcgtcgtccacgcctggctttaccccgagcacgcctgggtctgcccca

SEQ ID NO: 62330 - DNA, 2923 bp, Oryza sativa
cagccgagcggggcgtgctacacgcccgacaccgtgctcgcccacgcctcctacgccttcaacagctactggcagatgaccaaggccgccggtggcacctgcgacttcggcggcaccgccaccatcgtcacccgtgacccaagtaaataataacaacaccatttttttattatttaccctctccttctccttctccttctccttcttctcggcccaaaatataacaatctaggattagaataagataaaacatattttactccatccaacactacgctgcatattttgggatgaagtgagtagtacgtgctgatgattatttttgcaaaaaaaataaaaaagatttttggggatttaccctctcttcctcatttttcttcttctcatcgcattccacgaaacatataggaatctagtataagatgaaatatattctaatactttatccgatactatgttgtatattttgggatgaaaggagtagtatgggctgatgaatctttttgcaaaacgaaaaaaaagagatttttggggactaataacatttattattaccatctccttctcaacgtattctttcttcacaacccaaaatattagggtatatttttttatgacgggaaattgatgtagttggatttgtgttatttaggaatgttatgtgttgatgatttttttttgcaaaaacaaaatgtttttttattaaatcttttgtatagtactttatagtgtttactgctttagttagtgcaatctgctagctagaacagagaagaaaaggacacttgccactgaacatattgcactgaatcaggtgctctgcattcagatgctctgtccactgtcctggctaaatttcagtttttgaaactacctacttgctgagtttttgttgcaactaagaagtcattttctctctcttatgctgtttttgatgaactctgcaggctatgaaaagtgccaattcgacctactatgaaggagttgcactgcagagatgcagcagaacaggctgcattgcatgtgcatgcagatcgatgtgcaaacattctttgcaagtttgttgggcagtcattccatttgcctctaggccacatagcactgcagattttgtaactagctgtttagcatgattttgatcattattacacgactaatacttgtgcaaaaaggtgattccttcacatgtggagtattatactagcactagtcactcctctctcgcctttttcctctttagctttttcaagctctctttgcccaattatttgagacataatatgctaacttgatattcacgccaacacaacgaatctctacataatatatgctaacttgacattatctttgatgtcaagatcaattctttccttttaggattacagaagtttgactgcatttccagcctctgtcgttagttagtcacacagaacaagacagattcagcggctcgtggatcaccgcgtccaacgcgccggccttcgccgtcggcgagctgaacccgtcgccgccggagtagaagaagtggcagaccttgcacatgctccagaacagctccctgcatggccttggaacggcgcctcctctgctgacgaccagcttcagcaactctctcctgcatttctcgatgggtctctgaatctgcttcacagcctcttccatggagacagagcctccactgtggagggcaagcagagagacgctgttcagcttgccctggctgccctctctctgcagcatgagacagtgtgaaacactcaaattcatcgtgggaacttcagaattcagaaagatcgaattgacgcacaagttcagaagttctagtacaaacttcagaaagtgcacaactcttcagaaagacactgttttcattgtttaaaaatcaatgctgaaaaaacaagcttcggagaaaaacctttaaaataaactacaaagttaaaatttaaaatttaaaatttggcagtggcttagaaactcgacagaacagctagtagttctgtagtctgtacctcgtaggattggacatcattcaggagacggccacatttgctcattagccggaacaactcgctgcattcttggcttcttatgacagaatcagggatctttggtccaacaagatacaatgctgggagcacaacgggtcccagtgcaaatgtcacaactgcattttccatgtattcctctgctgttggcacataccggctctgcctccactctacctctgtcatcatagacctcagcaattcttgccactatacacagattaacagaggccactatatttagcttgtcagttctcacttctgaaaaaaaataattccaaagtatgtcagagatgatgcttactatttctacaaggtgtttggtgacatcacggccttgtactacagaggccattgatccaagctggttagttgaagtataaattgcagagaacacaatctctacttgttcagagtagtactcagttttgtcattcttgtcccacctagatatgaatatcacaagcgttatcagggctgaaatttttgttagcctgaggaactagaattggttaagacattaatttgttttaaggattagttttacttctcaactaatgcgacgaggttttccagttcttcttttgatcctccaacgtcgaagaagtcgtcgacgaccgttgtcagcacgccatttttggcccacaaaatgcgaacatctgacagttcaggagtgaaaatggtagcagcagcagagaaatagaagtagtccaacttctgccgtgcgaatgcagctgatccaacctgctctctttcacccagctgcagcaaaaaattgtaacgaaattatctgcaagtttgttggtttacataggaaataaaaaagagcaataaatgtcagatgtacatacctgttgagttgctgcagctcttcttgg

SEQ ID NO: 62331 - DNA, 11076 bp, Oryza sativa
gatactgacttttgaagccttatgtaattctaataaagatcttgtatcattcagatatccttgaagtgaattgtggaaacttgaaggttcagaaaaatgagatagctcatctgcaccacattttttaaaatgcaatacattagcttggtacaaggaactgaaactaaagatcaaagggctacctcccgttatcttctcaagaatcataaaatcgagctagcaattgattttttttatgattcttaagtaggtaaaagaaagtaccgagttatccttttaggttctagcagaataaagtacctgaagaaacatcatatccattcatacgcaacatacgaaatgccatcccacatgtttgcatgtcaagcacaatttcctcatccctctgtttccagcaactgcaaccaaatttagtcatttacctgaactgctaattaaccacggtctccaaacaactaatcttattatcttaaggtagtacttagtacctgtaggtcatgtccagtatgctctttatctcaccaacaaaatgcctagatattcccatcttttcaagcacatccaccatgtagagctgagactgaatatttgcaggataggccgctggcactgcaaattttaactgacattaattaggcattcagcaaatgtttatatttcgtatcctattaaaccattgacaaagtgcagttacctgcacttccaaatttgtccagaagcatgtctaagtactggagagctttggcatcatagttgtggactaatgcagctgcagttgtgtaaggggagttgaacagtgagccattctttctttggaatttcatcacttcattccagttctgaatattgcctaatccttctgagacataagccgtatattctgttcttccaccgtggcagatcaccccagcatctctgaattaatttacacagcaagattgttattgtaatgatcaagttgatatagttttgatactcctcccccctttcatattataagaagtttcgattttttttctaagccaaattttcttaagtttaatttaatcatatttatagaaaacataacaacatctataacactaaatcaaattagtttcattaaatctaacatttaatatatatattttgatactatacttattttgtactgtacttttttatagatttaatcaaaatttaaaatactccctcgttctattttaagtgtagttgtgggtttctgtgtccaacgtttcatcgtctatcttatttaaaaaaactatgaaaaaactaaaaaaaaagtcgcgcataaagtactaattatattttatcatctaataacaataaaaatattaatcataaaaacatttcaaataagacagatgatcaaatgttgaacacagaaatacacgactgcacttaaaatagaacggatggagtaatgatttagaaaaaaaaaatcaaagcaatataaagtggaaggagtacttatagtagttttctttttctgtagatgattttgacctcttaattaatttcgaagatgcgacttgacggctgcgttctttcaaaggagattgggaagattgtgactcgttttccgcgcgcacgcttcccaaactaataaacggtgtgtttttttcaaaaaaaattataggaaagttgctttaaaaaatcatattagtccatttttaaaatttaaaatagttaatactcaattaatcatacgctaatggctcaccttgttttgcgtatcttcccaatcttctttatctcccctttctcaaactactgcgttttccttttctctatatggtttttgacctcttaattaatttgggaaatgtgactttgacggctactttttttaatcttgatattaataaatagtctaccatgtcgtcaatgtattttttcccccagagcatgcatgagctggtggatgtcactgtcacagaacatatatagcatacacacctatattatcatagtttattatagcctttttactgcatttggaaaataaaagtgtttaaaaggacgtcttctcgaagtattagagcccatctttggaaggtagctagcaagctccatacatcgtaccagaaaattaaaaaaatggggaccgaaatgtagttctctcacgtgtaaattaatctgttgagatccttgtcctgactcatgaagttgaaggagataaataagtattccctcccatcataaaaaaataacatttataataagacttactagtagtttaaaaaatttaaaaactttaactaaaacaatttctcaaataatgtttgctttgaaaagtagtaacacacaagtttattagattccataaacttaatttaatatagaattagttcgatggtatctcgccctaaacaccaaatattggtagttagagagagtaataaaaaaaataaataacacggtttcttcttcaagaacatctagagccagaccagcccaacgaaaaatgcaggagcttgccagtgtaccgaaagtgttttttcttcactagtgaggatattcctcacaactcacaatatgcatggatcactaaaatacaaattcaagttgatttaattattctaacgggtcatatgtgtatgtcgtgcttaattatattataaaatttttaacctttaaattgattttttttctcaaaatacaaagtacaaatattgtaagcgctcgtatacaacgcagtttaactttttaaattgatatttttttctcgaaacacaaaatataaacgcaggcgccttgcgtatactcaccctcacatcaccaaacacttactcacccccacataacgatgaacttagcttaggagctgattagagagagatgctcaattcgctttttaaattgaatttgaaaacagtaaaaacgtgtaatatgtgtgacaccctctccaatcaagaatcagaatccatcttcgataggtagcaaattaaacaatttaatcaacttgtttctgaagctcgaccgtaccgtacgttaccctgaaaaatacaaacagtaacgcgggaacgaaatgctgttctttcacatgcaaatcaattaacctgtcgcggacgtcagcttggctgacggcaggaacctccaaacccatctccatcgccatccggagcatcgctgcgaaactgacgacggaaccagacgccggagcagccgtctgatcgtccatggcgaccgacatgttcctcccgataaactgcagccctgcatttaccagcaaactatgtatgttatctaaatttgataagatatagctaggttaatatgcttgcggagtgatatatcacacatattaatctatcctataaaaaaattatacatatttagatgatgtgaaaaaaaaacaaagataggacataggagacatccgctcatgaattatgggtctgtttggtagagtttccaacttctaaaatttacctttaggagttaggtctagagtgtggttgtggagtagcctagctaaaatcagcattttatgagagtgctctacctagcttcgctcctattttaggtgaagctgaaactgtttggttgagcttcagcttcaaacaggctctaagaatccattctccattttaaccgagcatcaatacatgtgtactccctccgtcccataaaaaaacaacctagtatcagatgcgacacatcctaatactacgaatcggtcttagatttattttttatgggatgaagggagtatatgcgatcccagcagcagctcaatcagtcactgatcatttgcgatcatcgatagatctgatcagagattggtcgatcagatgactgagaattcaacgagctactactatacctctcctgacgtgctcactgccggcgtcccatcgcgcgagcgcgaggacgcaggcgagggtggacgagaggtcgcgctcggtgacgatctccggcgaggagccgagctgctggtgcgccgccgccgcgtggcgccatgacccgtcgccccgctggttccgctggatccacgcgacgcactgcgggaaccgcgggccgccgccgccacggcggagggccggcaccatggccacccacgccgtgtcgtacggcgacggcgacggcgacggcggcgctaattggaggcgctcccgtactgctgatctggccgccgtcgtcgccgccgctcctccttcctcgctgctgctgctgctgctgcagtgccgcatggcctcgatcgccatgaatgctgtaatttggaagatatgtgatataaatcgttgaaatatttatgtggaacatggttcaaacaatgcaattatatatgcaacttatatatattaggtatttattagcggcattgtcctcgtatcgatccgaaagaaaatcccaaatgcaaccagtccttctacggatgttaatatttacacaaattttctttcgaaattttatctcgatcggtagaattaacatggatttgtattgctcttaaatgaaaatgaagtacagtaagttatcttttgggcccacgtctttctttggtaggcagtcctgaccattcgtaaagtttatagaaaatatatatggaattaaaaaaaactaccttattgtactaataaataaataaatatgtatcttttatattacataatgaaattaatatatggccggccttacacatctgtatatttacagtaagcataaaatgatgaacataatgtacctttagtaaccttaggacgacgaataagagtcctattagtttgtttgggctgggacaacaatccaaaaggcgaccgatcgatcgcggaaggtttgcaggctacgacgctaccatacgccgggaacaagcacggcagcatcgtatatatcactccttgccacgttaattaaacgaaaagagggtttaaaatgaagaagtaataaatgggcgatcaagagtaattgatctgtgatcagaatttggaaaaagatagctagggagagtgtagtgtatgtgtgtgttcgtgtgtcaaatggatcataacaaacctaggagggaattgaattgtattgtggaggggaagaggggtatatatagcatgatttatagtacttcaatatatattgaaaacctgtttcttttggtgatgtgattgaacaattaaatatatgatcgtatggatctgctctccatgatacccaactcaacagtatcaaaagcgcgcacatgttttgacggaaggtagaataacgaatgctagctatttgatattgcataatattttcttttgacttttcctgtcttgaaaacatattaagctatgtaaatgattttaaatgaaaaggttatcaactaagaagttgcgaatctcgtgaagatctaaaattttcatatggagtttgtctccatgcatttgaagttgtttgaaaaactaaaaaaaaaatcgaagtagattagagaacttaagttctataacgtgtatttatcatcgccaaactctataatttcgatataaagtttgtttaaaaaacaagatttggagggagatatgtccctccaaacatttttaagaagaaatcatgagcgtgttgcgagggagagacgaccctccaaacttttttaagaagaaattataagcgtgttgaggattaaacatgggacctttgagttgaaaccacacaccccttgccactgcactattaagtgcatctctgtaaagtttgttttcatcagacttcatatgaaaaattttattatttttcttgaaaaactataatttgagtaccaatacctgccggctcgatattctctggacagtagttcgcacctagtctaggcgacgtacccgtcgacagtgagacgcctgtggtgacttcgtcaatctctaggatttgccggcccagtcttcgaatatgctcataggggtagagtttacatgcgtgcgttcgtaggggtgagtgtgcgtacattgtaagtgtctgcgttgtactgtgtaattctcaaaaataatctaacccgttgagtatgaatacacgtttttcttatgaaccaggaatgatgtatctctacctgttctaggcctcaaccgaaccgatggttgtgtttagttcagcgcaaagtttgcattttggttgaaattggagatgatgtgattgaaaagttgtgtgtgtatgacagattgatgtgatggaaaatgactgaagtttagatccaaattttgaatctaaacacagccgatattgtttactctggtttaaacagtaaattaaagtgaaccaacaatgatatatagagtatcgttgccgattcacaccgaaccaacagtgatgtgatgtgcaggcagggatgtttttttttgggtagctagtgagatacatcctcctctctatagttactactggcaaacacaaaatgtatgttgttctgtgagttatgtccgttgtccgttgtctctagttgaccgttacaagaggacatctcattatgttcttttttttcccctcaaatctgatcaacttttttactcattttgttacaagcactaaagtttaatccctagatccaaacaccacctaacacttgcacttacttagcttgttgcacatcaaagatccaaacaccacctaacacttgcacttaattagcttgttgcacatcaaagatccaaacaccacctaacacttgcacttaattagcttgttgcacatcaaagtgcttttttttcctttcctaataataatataataagtactatattcttcccactaagggaatgcattcatatgttacttttatatggagtattttccaaaacacatcaagtcttatccacgtcggtgagattcagtccattgtgcatgtggactactcgtttatagcgtgatcatatatactaaactactaaaaatagcatgtcactcatcaggcgcacataagacgtcgtttgttcagcattcgcgctgccatttcgttttatttattacaaaaagggacatagtggagtagacaaggatgttttgtttcagctcacttcagtttttcttctattaactaatgctatagtgatatatccgtgtgttgcagcgggatataaagaaacatagataaatgaatttatggggtttagtttaacgtgggtatacctattgggtaaggtggtttttcaagactgtttttttgtgtgtgggaaagtacgatggtggcggacttcgcatttaaagcaatagagaaatatatactctctccgtactcataaaagaagtcgtttagtacaatgtttaagtcaaaccttggaaatataaatcatgaataactctcaagttgttgaaagttgttgagtttgaaaatataaaaattatatgaatagatttatcttgaaaaatactttcataaaaatatacatatatcacttttcaataaatatttttatagaaaaaagaagtcaaagttgtgttttggagaccgtgtcgctgtcataaacgacttcctttacgactacggagggagtactcggttttgcatgtgccaatgcattataaaactatagtctataggttgcaataaggctgtctacagtctagagtccaaactactgccaaattaatgtacttttaaaaaaaacaatgaaaaaagtcatgccaaccatcacatacatcattatctcgtgcaagattggtattagcacgtagatggggctgaatgtagcaagcaatcttttcaattgtaaaataccgtagaagaaaatttgtgaaatagcatgcacgccacgtgatcacaaaattatcagaaagagtaattttatttttttaaaaaaatgtatttgacggtagttaagaattattggatgagacattttctagtactacaaatctagacgatttttatattctgggacaaaaggagtgtataatttggtgcttctgattatgtcaggtaccaatatataccaacatttacattaaaaaaaaatggtaagagtgtaaaatttattatacttaaagcacacagcagctataatcgtgggtactaggatttaaacccttatcgtaaagaaaaagaaaagaaatatcaacctgtataaagctcgttgctgatatccctgataaaacagaacggagaagcactcaattgcccgacaaaatagagccatatggatcactcactttgagtttaagtggctccttgacgactgcattcactgcactaaccatttccttcggcgagctaaacccatcagtccgagagtagaacatgtgaacaatcttgcacatcttccagaacagctgcttgcatggcctaggaacagcaccctgttctccaaggaccaatcttaacaagttcctcctggaagtgtctatggatttctgggctttcattttagcctcgtctatggagatagaaccaccactgtgatgaacaagcagtgagacactgttcagctttccctccaggctctccctctgcagcaatagagaaattatttgttagaataagtttgcaagctttgggtagttgggtcgaactgtagccacgtcctaatccttcaacagaaaaataaaagtgttcataattagtatcacatttatacagattagtcaacaaatttgtgggcagagaatgagatagctgcaatcatataacatcaagtaaaaccgaaaattttatttacatgctaaatcttgtagaaatatgagaatacaaggaggtttgtcacagaaagggatccgggtacctcaaagccttggctgtcattcaggagacgcccacaagtgctcatcagtctaaataattcattgtactcatgatccctgacgacatcctcttggagcttcggtcctacgaaatacagagtcgggagcacaataggtcccagtgcaaatgagacaacagcatttgccatatattcttccattgtcggcacatattttgtcctctgccattcagcttcggtcatcatagacctcatcagacataaccactgcagatgagtttgagcttatcactaaacactatgcaacagagcaatattcaccacagaatcaatagatcaaccatgagatgggactcactatttctgttaggtgttttgtaacatcacggccttgtaatgcagaagcctttgctccaagctggttcactgtagtataaatagcagaaaaaactattcttacttgttctgagtagaactcctcttgatgtccatcccacctagacagccatttgcaaatcagagaagatgaattagctgtgcataaccagcgccacttacaaaagaccagacaaatagatcgaatagaatgaattaggattgtacgtacttctcaactaaagcaatgaggttttctagttcttcttttgatcccccaagatcaaagaagtcatcaacaacagttgtcagtacaccatttttagcccatgcaatgcgggcttcagacaattcacgggggaatatggtagcagcagcagaaaggtagcaatatgtcaacttctggcgtgcaaatggcagctgatcgagcttttcatctttcacccaactgtcgcaaacaaaattttgcaatttatccaaggtagtacaataaaggagcataacatgacagattgacagcaggctggattacctaccactcaagataattaagttcatcctggtatatagattgagaactactgaaatcttcaacagccaaagctagaatatcttgattggcatgaggaagcctgagtaaacaacatagtggaattggtgcctaacatatatattactcagattggcagaccttttcaatgaaaaccttacaagtattccgtctttaacatctgggaatcctttgcatcaaaacgttcaatgttcctcttgtgatctagacggtccagtgtggtgtagaagggaaacttaagagcatacttcatctgaaatcacaaaaggcatatacttaaacacaaaatgaacttccgaatgaaatggaaattcaaaacttcatgcaagcacctcttcaaagattggagcttttttcaccccattagagcacacactttccttcaataagctacctgaccaagagcctatgctatctaagattgattcattttctgatttactgacttttgaagccttgtataattcgattagagatttcttatcatttaaatatccttgaagtgattcacggaaactggaagcttcagcaacaggagataactcgactgcaccgcatttaaattagcatgttaaataaaaaataattcagcatgttaaatgaaaaccaaaggtagaatatagttcgaaaccaacaaaaaaaatattcctttcaagccttagaacacacctgaggaaacatgatacccattcatccttaacaggcgaaaagccattgcacatgttgttatgtccagcataatttcctcatctctttctaaccatgaactgcaaactagctaaaattaagtttgaactattaaagatagataaaatacttactcaaagtcattacacgtatgttgtgtctaggatgctctttatctcactgacaaaatactgagaaattcccatcttttcaagtgcatccacccatgaaagctgacaatatatgtttagtggatacactgttggtactgcaatggaccaaatgtattactatgtatttaggagcagtctacactgtagaaagttcttgacaagaaaatgcgtgcagactcacctgcactgccaaatttactaaccagacaatttaagtactggagggctttatcgttatagtggttgactaatgtggcagcagttgtggaaggacagttgaaaaatgatccattcttcctctggaacatcataatctcatcccactccaacaggtttcctaatccttctgtgacataagccatatatgcctttcttccataagaatggtctccagcctctctgcatttaatcatatcagattttcagtgcgttactcataggcactattaaaaccgagattgatcatttcctccaaatataggatcttggaaaaaaagagaggagaaggtcattatattccttccttcaaaaagaatgcagggggaactagggaataaaactaagctgacagttatttttagaacgcctgatggtaaaacttcatccacac

SEQ ID NO: 62332 - DNA, 1164 bp, Oryza sativa
cggtctgtatttatggatatttttgtttctgtactaatatggttcagctcttcaaatttttcgtattacatctattttaccgatataaatataaacagagttttataaattttatgattttttccgccattggatttgacgacttatttgatgttccattttgaaaagcataaccaaccagaatgttctgtgacacacaaaacaagaaaaaatattagcacatgtttaattgagtattaactattacaaacttgaataatctattgagtaaagtctatcacaggtccctaaacttatatcgttgtgtcattccggtccctacactcgtaaatcgaccgttcaggtcctcaaacttgtttgactgtgtcatcccggtccctaaacttgcagatcactcgtttaggtcctccaacttgttcagctatgtcaccccggtctctaaaattggatttgaatatcatctgggtcaaataggacggtctaaatactttatatttaaaaatagttcataactttttcatgtgaactctaatgaagataaactttatatcaaacttgtagccgcgacgcgatctacaactttatagttgaatttttttttattttaagtcattttttgtcccaaaatgtaattttaaaataaaattacaaaatctataaacatgcaacaatattttgcgaccctaaacagttttagttaaaaaacttttcaactacaaagttgtaggtcgcgaagggctacaattttaatataaagtttgtcttcattagagttaacatgaaaaagttatgaattattttttgatataaagtttttagaccgtcctgtttagggaccggggtggcacaactgaacaagttggaggacctaaacgagtgaactgcatgtttagggaccgggatgatacagtcgaacaagtttgaggacatgaacggtcgatttgcgagtttagggaccgggatgacacagcggtccaagtttagggaccggtgatggactttactctattttatatatatacaaagagtatactatttggcagtttgaattgagtgatagcaacaatcgagttgtatgcactttagaactcacagaacgataggcaactagggtcaatactagctacatcgatgctgtatgggtattaaatgcgacattttcat

SEQ ID NO: 62333 - DNA, 2201 bp, Oryza sativa
ccgaccaaacgaacaaaagaattattatagaaattatttttttacaattttcgatagtctagaaacatatatcttccagttgaaaacattcttcttttgtccgtgaagtcatggacaaccattaaaactgtttttctctggcagaatactaagtatatatcgccttgcttacacgcacaaggtgttttcctctctacaggcttgataagaagccgatccatgcatttcttttatgcatatatggacattttagtggcggcacaatcagccaaattagcataatatttccctcaaggatccagagcaacatggtgggcttgcataagatccaaaccatccaaaaaatagtaaatcaaacaatccagaaataaatgtctttttggcaagatagaaatgtccagctcttatttttttaaaactaatcgcacaagatagtgcgagttttatgtattgataaagtaggataaaaatacaagtctagtcctggaagactatagtcaagaaaaaaaacaaccacgtcacgcgtctacgacaacacctgccatgagagcgaaaacaagaacgaaagatctttgaagtgatgcatccaataagggaaggacaccgaaagcgccgctgccttttgctctagggagtcaggacatgattttcacttgaagaaagtaaccgggagaaacgagaagaaagtaactgggagaaacgagattatgcagcaacgctagaggaaaacggcacccataggcatcatcgttgctgccccgaaggcaaagctttcgcccataattatttcacccctcccaagaaagtttcctgtcacactcctgctgcaaccacctttcgaaaaccttcaacgcgtggccaccacgggcgacgcctctctgttggtcggccgtcaagaaggggcatgacctcccccccccccccgatgcgctccagctccatccatgcagttgggttggatggggagaggatgagagaggacaatggatctcctctctccccacactagcctgctcgacgtggccatctttgtcggcaaaggcgctatcgcaagaggacaatgtccagaatagggcccatcgaagaaccacagcactccccttagcagtgcaaccgccgaaaccgtcattgtctaattgcccacatcctcgccatcaaaccgtcccgtcatcgccttgccaccctccacgccacgccgatgccccctccatcaccgtgctctcgccatcgttacagataccaccatgcccgcagcaccgtcaaaccaccggtggcctccccgccgacgctgactctgccgcaccacacgatgctggatagctgagttacctcaccgtgcacctcgccggctgtaacaccccgattttcgttcgggattaaaaatcaattaataatgcatttctagaaattatattaaaagttaaatcaatttaatcaagtgaaattatagacgaaattaaaatttcctttaaaaaaaatctttggccgggaatattttgtaatattctttgtgccctaatgtactctccggaattttccatgaattttcagagctcgagaaatagttttaatagcacaaaaatcattgcatcaattaaaataaaaagaaaaaaaaatcctccttcctctctttgggccccttttcggcccaatccctcctttctctcccgcggcccgcgtgccccttatctctccctctcgggccggcctcctccctcggcccgcacggctctctctctctctcaagtctgctttacctccctcgcccgttttcccctctctctccccgacaggtgggacccgaggccccacctgtcatcttcttctcctacctccagctccatccccaaccgccgccatggccgccaaatcctcccacgtcgccgcctctcccgcgcgactccctctcccgcgcgtgcgtggacgcggtcgtcgcccacgtccgcgccgtttccccccactcttcccccgcaaaatccggccacgtcgccgcctcccgcatctctctctcctcccacgttgccggccggtttctacctctctcgggctcgatcccgcctcccctcccctataaaaacattccccacacctccctctccattttcccctctctcccgagccctcccgtgcacgaaaaccaccccgccaccgtcgcacctcccgccgccgctcgccgacgaccctccagccggtcaccacag

SEQ ID NO: 62334 - DNA, 3839 bp, Oryza sativa
actatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccactgcagcgcaccttcctggatcataatcacccccttataaacaaggcatggactccccagcgacccctgtgggcttatctccgtcacttctcagtctggtgccccgcaatgaaccatgctatacaaaggataaagccgttgcccacgctggcttgtggttggcacggttaatgtttcacaaccgaaactcgtgaaccggttcttaattgtcacgcgcacgaccatcaaaaccatgtgctcacaacccaccattatctggttttagttggcacattaattaattaatcaatcacgattgaccatcgtgaactatcattaagccatcattaaataatagtgagtcataagttatcccgatgatgtgctaatgtttctaagcagggctaagcaattatacctaatatctagctgaaccaatatataaagcccaactagtcaagttataataacccaaggtatcaaggaataaagtaatcaagaacaaaagggctataacaatgaataggttaattccacccaatgacattcgaaaataaatgcaatagttgaatagaaacaatagctttaaacgggatcaacattctcaaagggttgtttgggatctgtgtgacttgccttgctggccttggaactcttcaaactcttctccggcgaaaacggactctccggaaacgacgaaatctaagcagaaaagagcaaaatcaccaaaacagcacataaacaagcatgaacggtacatgtggatatttttaatatgtagatctcaattttagaaaaatttacagacttgaaccaactaaatccgagctaagatgaattagttatgaatttttgaagatttaatcggattaaaacacttatattgattttaattgaattatgacgcaataatgaattatttttgaaaaggaaaaagggatttattgcgtcagcgggctagggtttcggtggaccgggcgcacggcggcggttcacgcgaacggacggccgagatcgacttgatccaaaacggacggccgagatcgatcggtccacgaccggctcacgggagagggcgacgatgacgtcggcgatgacatcaccaccggtggcggcggctcggcggctcggacggctcggacggcgcaagctcaccggcgaacggcggcgctttggcacgaacggagggcaccaacgggtagcggacggcacggcgaactcaccggcgaccaaagcgacggcggaagaggaacggacggcgacggcgacgaggaggaagcggcggcaaacttcgggttgacggcggcgacggtgctccggcggtcttcggcggcggcgaaggagcggacgagaatggcggcgacttggcgatcacgacggtggccttcccgagcgatgacgacgaccgagacggcggcggcgcacggctggagcgacggcggcgacggcggcgctaggttgcccggcgctagaactcttccggcgacgagaggcgaaggcgagagtggcggcggatagaggagacaccggggaaccttttaaaggggctcggaggcgacggcgaaggcccacggcggctggcgacgagaaggaaggtttagggttcggaggaaagagacgaatccgattcgaactcgaatccaacaatttccaaaaagaattagccgatgattccaaaagagaaaaggtagaggagatcccggagattgtttccctctatcaattcggccggagaaggaaaggatcgaccgaatttggaaaggaacggcggcggcgcgaaactagggtttcgggcggcggcggctggaggtagacgacgaccctgacaggtgggccccacctgtcagcgggcggacgcgcgcgcgcgcggcggactgggccgacttgggccgaggagagagagagcggttttgggccgactttcggcccaaagccaaaagaagacttttaaaacctttttcaatttaaattatttcttaaatgtaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccaattaaacaacaatttatatatttaggatttttagggtgtgacaccgtgccccagccgcgccgcctcgtggccgttcgatcggctttgggccgatccgggccgtcggttcccgtggaccggcggtgggccgcctcggtggtcccggtccacggtggaccgacgcccttgtgccgctgaccggtggggcccgcttgccggcgccgcccctcccctttgatgacgtcaacaaccctcttttcctttggaaaaataaataataattgcgcaataaatcgagtttaattctaagaattcatttaaatggctcaaaacttctaaaattcatatctaattcatacgaactccaaattgggccattcaacttgcaaaattcatctaaaattgagctctacatgtttgtttactttttatatactatttccttggtttttattagagtttttcctcgttttgcgtgccagcgtgtagaatccgtcgtttcggaagatcgcggtcgcaaggataagagttcggaagatcaaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaaccatgggtaataaatcgcctagcttgtgttactttgatgacctagctagaactatatgcttagccatgcttaattaccactagctcagttgataggacaattacagtattagaccttttaatatcagaatgagctgcgtgctcgagacatctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccaacgcatccaggcaagggtgggcgtgatggagtttggatgggccctgcgacggcctatgcggcttccggattcacctaggcacgagaagggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgggaggctgtgtcttgtgggtacagttgtacacctctgatcagagtaaaactattcgaatagccgtgcccgcggttatgggcggtcgaccagattcaccgtgattagtcccatcttaataaatcgacccaatgcactgtagttcaggtgggttggttgggcctgttcaacgtggtgtagcgttgatcagtggagatttaatattactttaattactcaaccgttttactgttt

SEQ ID NO: 62335 - DNA, 1574 bp, Oryza sativa
tgtgaggactaagtgcctcttctgtaagtattttacgctttatttacgtttggaactgtttattacttgtcgttttgtgtaccctggctggtcctggacagggatttaatacacgaaatagtctggaaacttgggctaaatttctgggcgtgacaccggcctcccactgctggcgtcgcccatgcgccacggctcctcccaccggccgccgtcgcccgatccacggtctccaccaccgccgcctctctgcggtcgccatccccgccgtcatcggcctccgcagcccggcgcagctcgcccttaccgtcgccgtcgccatccccaccaccatcgccgtccccgtcgccagctgactcctcgccagatcaggcaggagcagcgcggatctagcaatcaccgtcgccaccgccctgagcggctccccagctgtctgagcacgaggtcagcgagaagcgagaagccccgccgccgctgtccttgcggccgcacggctttgccggcggccactcggggtggtggcgatgtggaggatgaaggtgggggagagggagcggtcgggtcgtcgcctcgcgagccacccctgggggagggcgacgtgagaggaaaatgtaggctcaagtgcgtaaaaagattttgtccagctctcaattaaccaggtaataaagagaacttgctccctgagcaattgtgtggcgtgatacatttctccagtctgatgacacccggattattaccctatctgcctatcaacccatagatcgaggcatgttaaaacattcgtggtatgttaataaataattgacaaaaaaggttatattttgttctaaggtttatcaagttaaaagaacttgttactattttctttatctttgatgagaatgtaaagtgagggtgtggtcatggtgcatgagtgacgaggggccgatcttggtttcaacgttgtagtaaagcattgcacattatggtaaagcattacacaaatataaagatttacaaatattcaagctaaaagttatagtaaagctttacacattagtaaaattggagtgaaaaaaataacatggtattaattttccatggcactatatgttcttaatttaattatttttagtaactataaaatataaaattgtgaaatatcgaggtcaagaacaatcaaaattgacaaactcaaaataaatggtagttgcaatggcatggatccaataaacccaaaaatatagggtcgatgcatcggctcaaatcgagccgatgcttcaagttgctccccggtgcacaaaaaatcatttgacaagaacaaaatcatccaaatcaaataccgatatcatttgattatgctatttaccataattttgaaacacaaaaatccaataaggacatcgactagaagaaatccccaaatcaactgctcactggaaaatccaatactcatctaggtcgttgccgtcgaggccaccaccggacccggtagccaaacactggcaggttgcccggaggaatatgtaggactgtggagggaatgtgttagcgaggcacagcttcgggcctccctgctttcaccgactggccgagga

SEQ ID NO: 62336 - DNA, 1704 bp, Oryza sativa
agcaaactggaaaataattgatcatctattcaggactgatgatatataataccaccagagaaggccacacattatccttgaactgatcagacagagaaaggcggtaggaaagaacattgataacaccatatcttgacgctgcagtagtggtgagacgccacaatattatttccatcaattcttttcatggcagacgagtagcatttgcgaccgatgctgtaccacgagcctgaacataatgacataaaatgaattactgttatacatgccattacatgcacagtttcattttcttcatataacaagtaaagtaagatgcttattatgacataataagatgaataacagttattcaagctgtagtccactaaaatatcatggtgactacaacgaaaatttgtttagattaacaaaaactagctaggctatataaataggtagaccctatataggaacaatgaaaaaaaataaaatattaaaattcctgctatcattaagatcgtaaccccttcattaataccgtgtcgggggtaggtattcctaacctctgcattaagagcttgatgaaaaatttcatttatatttattgacacatggttgaaaacattggacagaataaaaagctacttacagcttgtggattatctgcagtatagattgcacgaatattaagttctcgaacagcatcctcgctggtagagcttgggtccgttgtgaactttatactgccatgggccattgaaaattctccagttccaccaataacagaccactcaccactgcttgcagcaataatccccatcacctgaagtgtggatcccttaaacctgttttgataaaaaatataaagcttcatatatatcagagaagattatagaagtgacaatgcatacaattgaacaattaattaagtcaataaggtactcaacactatagcagggaaatttaaattatacatctagttatgctagcataaatttcaacctgtcatcctggaacacaatgttgtgggaagtgtaccacatgttagcattgctttggccagcctggacatgcatgccttgtacacgtgcaacgatattatcattgggattggttgtagctgttaaataccagtcatcaacgagtgttgtaccgaatccattaggatagctcgaggctatcacaaattcttcattgcggtttgggtgatttgctccagcaacaaactggtgcaggtacaagtgcatggtaacctcattttggtcagggcaaccacactccacaggacatatatcatagtaggtgctggcagccatgctcaggaatgttggaagcaagaagaggatgaaaagtgcagagctactgtaagtagccatgggaagtatagcaaattgttgatgagcagctagcaaggagagggagagagagcttgaatgccaactggagctagtttctctgctctgtgatggagattaggaatagacaatggtgtatttatagggtgctataattgttataatgtagacccgtgaatgtttatagggtgctatgactgttccccatcgtcctttacaccgaagggatcagaacgattggctcactgtgtacggggccataatgacttgatggaatgctgagaatgcccttttaattttgtgaaactactaaaatgccaggctgtgtttggaatcagcccctctccatcgtattccacgcgcacgt

SEQ ID NO: 62337 - DNA, 1586 bp, Oryza sativa
tgcatggatctgtcggtggcagcgatgggtggtgggacaccggggagggcgtcggccatggtgacaatgaacctagagcacgggaatgacagtagctgtgacggccgacatgcatgggagctaattagctgccgctttagccatcgtctccattcaccgttgccgccgtcaggatcgcaaggaggagcaaagcatgtcagccccatcgccaccgccgctcaccaccagaatgttgccgccgcccccgacccgaactgagccgccactccaaccttgccagcatctactattgcaccacccaccggtgagtcccctgcgccaatccgaacccaccatgccctagatcgccggccaccatctggtcccgtgccactcgcaaccagccatgaacccaacaccgccacatccgcgctgcttcagcctctgtctgccacgtcagccgcacatgtggtgaacccgatttagttcagccgttagatctaggatagatcggtcccttttaatctgagccgtcagatccatagactggctctgcgcacccggtctactgtggagccgatccatgtggatgcagtaatccgttttccaattcataaataattcattattgcgtcataaatgataaatattatctgacagtggtttaaatcctattgaacttaggaaatccataactaattaaccgtaactcggatttaggtggttcaagtctcgaaattcatctaaaatcgagatatatccaacaaaagtatccacatgtcatgtttatgctcgtttttgtactgttttgttgattgtattcatttgctttggctttcgacgttcccaaagaggctgtttatgctgaaggttcgaaagtcttcgcaggcctgcaaggtaagtcacacagatcctaaagctcccctttgggagggttgacctatatcctttgttatgaccctgttgacattccttacctttcctttgcaaatgggttaacaaattgattagctagaactctatgtggtttagctaaagctattaggatgcagtcctgcttagaaacattagcacactaatgggataacttatgttacactatcacttattcatgttcatttgacggtagctcacgatggtcagttgtgattggttaaaaactgaattttccaactaaaacctaataatggtgggttgtgagcacttggttttgatagtcatgctcatgacaattaaggaccggttcacaaggtactattgtgaatgtttaatcatactaaccacaagccagcgtgggaaacggctggacatgttgtatagcatggttcatcgtggagtgccagttagagaagtggccgagataagcccacgagggtcactggggaatccatacctgactaagggggtggctatgatccgggtatacggtgcaccactttgaattgtgttatgctagttttgttgtcaaagctcctttcaaggtactgtggtggtattgaggtgcatggcaacatgttgtgtggttctgtcttgtgtgtgcattggtacacctctgggcagagtaaaactattcgaatagccattcccgcggttatgggtgaacctaa

SEQ ID NO: 62338 - DNA, 3613 bp, Oryza sativa
ccggccgcctctcttcccctctccgcgccgcccgctcctgcctcctctcccctctcccgcttcttccccgtgcgccgctgcgcccgcatctgcccgcctgctggggagaagcaatgagagccgacctcctccccctacttctttccggcgcgccgccatgcccactctgccctagccgccacacccgcatctgcctgcctgctccacgccgcccgcctgccgcgctcgcttgccgcctgccgccagcctccactcaccgaagaagataagagagaagagagaaaaaagaggagaagaaaataggagagggcaactgatatttgggtcccacgtcagcaaaaccacccatatatactgccataggactctgagtgtacgttttgtgtgggtttaggtgtgcaaatttctgattttgtatttaagggactcaaaaaaatctcgctattaagttgagggatctctggtgaacttattccttttgtttttgggttcccttggcccatcttgttcttttctgcaaagcccatggcccatctctttgcgcagcccagccagcacaggcctgcgctgcgtgtcattccagcagccatacacgcgcctatgcacagtttcgaaaaagaaactgaaaattagcatggtgattggcgcgccgccctgtgtgtattaccatgtgtattgcataagttattgatttctaccaagcaattgctttcagtttattaaaaatatcaacatggtaatggtacttaactgtatttgtctttatatttttcaacatcgtatgaaaatttcagtcaaaaaaaaaacatcgtatgaaaattgtcggtcttacttgtgtaatttcgcttattttatcttaattttcaattaaacctatagtagattacatctatttgaagatttttaataatgagattcttgctactactaatttggtgcttttaattttgctattttagacatataggatgttactatcattgtgttacttgcctcgattttgatttaacatgaagtaactgcatctccgaaaaaacttaccatgggctacaaattctaatatcgctcccttccttttatatttaccagtaatctatccgtgctaacactacagtgatttttgatagtgcaaatcaaaataaccaaatgaagaaacatacgtctaaaaatacaaatatacaagcaatcatatccatgtttttatgcaaatgctaaaggatctacgcatattagcattaaaataataattttatattcccaaatttatagtattttataaaattgtagaaatataaaattgtggtcaaactcacaccaccaagacaaaataattcaaaaattatataatttttaatttttgtcaatgggagtagtaaatttagatggagcaattaattgcatcttatgtatatgcacaacggtaaattacttgaatatttgcacaagaggtatggaccaatattataaccttataacatgaactgtctcatttcttctccaaaagggaatacatgacaattctttatccacaatttgcatataaatacatatggacaatctcaaatttattagtatcagaactttgcgtctaacgatctacaaatctgtccacatatctccatgtacgaggaccccgtataacccatcaacacattttcctggaggttatggacaattccaacagctcatcacccaagtgtatctccgttttttaatagatcaagccgttgattttttatcacacgtttgaccattctacttattaaaaaaatttacgtaattataatttattttgttgtgagttgttttatcactcaaagtactttaagcatgatttatatatatacatttacataatttttttaataagacgaatggtcaaacatatgttcaaaaatcaacggcatcatctattataaaaaacggagggagtattagaattatcgcagcaacagatttcatcgtagcacgataaatttcaatgcatctttgaaatctcatttaacacgctgaacttttaaaataaaaattaatcaatacttaaaagtacattactactgacgtgttcatacactccatttgtaaaataatttttttgcggggcatttgtaaaataaatttaaaagcatcgtaaaatacaaacatggatttcatcactgcacacaatatcttaatcaaaaaattgcaccagaagattagcaacgtaccatgaccaagcacaaaaaggcatatcatatattcattattggaccatttgctcaggtgaacaatttggtgccatacagacgaactcctggaatattgtaagatcaacatgtgttttgattcttcttctatgatgaataattggcatctgtgattattggttttgatatttggagattagtgtcgaagtggttttggagataattaattttcaggtgatgaacagggtttgctgttttgtcaggaccggtcagaaaaggcggtggttgccggtcagaccggcttgtgttgagcggtcagaacggccagcccgcggtctgaccggccgacgctgtgtcggtttcggtttcgggttgtttctttggatatccatgattgtttcacggttatggcttctggatggatactatacgtatgtaatactgttgtttgctaacaatgagtcaagttggtgatagcttggtctcggaatatggtttctttgtttgtttcatgtgtaggtgactcgatgccacgggagagtatttgcggtgatggaccgggagtcggcttggtggtaagacgatgtccgtggtggacagatatcatgcgggatacttaggctagagttgatgcacgtggttggtgattggttatgtaaagtttgtttcttgtactagagggttttctatggtgattaggacttttaggatgagtttggttcgtggctttaggctgcctacctcatgtataaatagagggggagcgtgaggcttcccgatatcgcttttgagagcaattgagttgctagtttagttagggtttcgagtttagtcgagatttttgtaaggagtgttgttggtacactttgtaaacacagagagaagcaataaaattgtcatatactttaagaattcttcgatttgtgtttcaccgggtttcggcggtctaaccggcgacacaccggcggttagaccggcggcggcagcgggcgcaggaaggcgacttcggtggtcggaccggttgatctatactggtcagaccggcggcatccgaacagtcagaccgacagatctatctcggtcggaccaacttccgtcaaatttgagggtaacttttatttccgctaaaagttttcggtttttgggtataccaaccattcacctcccccttctggttggcttagtttttgtgattcgatcctacaaatgtaagaaagtttggtgccatttaattaaagcattataacattttgcagagaacggaagaaaacccaaacaagcctcatgtaatactgcctattcctctttcgtccagtgacgcagttcctaattgctcaattgaaccatcatccccaaaagagtactgatggcctcagcaaacaatcggagaatgcaagcaaatcaagaagatagagtacaattagtcg

SEQ ID NO: 62339 - DNA, 765 bp, Oryza sativa
atataattgagtaacattcaaataaattaattaactagcttaactagtatacctgtcatccacaaactctatattgagagaactgtaccatccaggggttgattgatcggcctagatcgtcacacctcttgcatgtgcaactatagtacttgatttagggtcggggccatcatatatgggccaatcgtggacgacgatcagtccgaatgaagctggatgggttgatggtaccatattttcttggttgtggttctgtccagagtacacttggtccaagtacaactgcatggtaatctcgttttcacggagcacatgctttactaggttaacactgaaagaaaagctggccatattgttgggtgtaatggcaaggtgtaactaagaattgtgactctttcgattgtttgggctgtgtggagagatttgggggagggtcgggtatatttatagtgtggtagggctataatttattcattaattattaggggaggctaacaaagagcttcatcatttctcttacaagtatttaattcagaagaaaccactacgccagatcctcacacctctgacgggatacctgtgacgggcaaacgatttggtcactagtgaccattacctctgacgggtcagacgggataacgtcaccggtgagccatccggccgcggaccgtcacaggtatcccctcacctgtgacgggccgaaaggaaaacccgtcacaggtatactagtgacgagtttttcttccaacccgtcactggtatccc

SEQ ID NO: 62340 - DNA, 1244 bp, Oryza sativa
cggtattgcctctgaatattcacatgattggcatggaaggtggacaaagttttgtctatcatgtcagcatcagtgattttctctccacatagcttaagacaagtgacaatgcggtgaagaactaagttatattgctccacagaattgtaatcctggaaacgtaagtgaagccactcacgttttgcttttgggagcaaagcctttacttgatggccatagcgatccttcagtgagtcccaaaggaccttcggatcttcctcagtcatatactcattcttgagagtaatattcaaatggtgcctcaggaaatgcagtgcctgattttttcagctgaagttggtaaattattaactcctccaattgatgttgtaatagttgggtcctgaatgaatgcagttcaggagtttcttagcaccaagcatgattttggcatccagtgcccatgtcaggtaattcttgccgctgactgctagttcagcaaaatctctcttagcaatatcagtcattttcctacattagtcatgcaaaattcaataagtactgcaagtaagagcatgacaagtgtgcaaatagtaaattgcctagttatctaaatttagtactatgtcaatatattcccataattctcccaacatttctcagaattactgtactatttatttaggtaccaaagatgaattactaacccattaaatagtatcctgaaaatataaaacaggtaggaaaataaaccataaatatgatgctctctggtgtgtactaaatttcaaattatgacagctcatttcctaaaacccatgtctctaggattctatggttgattcaaaaattaactaataaacagttaatatacagaaaattgaaagtacggaataactaaaaaatgtgatattctctgtaatttctataatcccgagggactattccgctaaaattccaaatccgcataaaatcagaaaatattcggaattttgccgtttttgggccaaatttcgattcgagcccgactccttttataggccgaattcatattcggcccacctctatatactggccatccaagggttaactggcccatcgggaccgtcggcctgctaatggtctcagcctatagtgtggcccaacaaggggtgccacaccttatccgattgagtggcatgggttgaaaccctagcccccaattccaccgatgcagtggcggcacggtttcccggaggctcatgcgggcaaggcagcggggttaa

SEQ ID NO: 62341 - DNA, 1098 bp, Oryza sativa
ccgcttctcgttcgatagatcggttgtacttgggataccccatacgcctgtcgcgcatggggtggagagccgcaaactctcttgctacgtgcgccataagggacaaatccacgtagtacaacccatcgatcgaacgattagcggagaaataaaaataacagaaaaagatctagcaagtttatcgttatccctatagaacgagattagatcagatcgatgttgacaatataccttggctgaagagcacctcatgctgataacttgttagaattcatgttgtcaacaatcgaacaagcacacacgaacacacggacacgaaagtggagggcaatcaactttattgatgtttttctctctgttacaagtcttactttgccctcaacctcactattgtatttatacccataataggatgtcctatatggatacatacatatatatatttggtataagcccacttcattaataaggaaacagaaggaagaggaggaggtaccgtgatcctcctataaatccgactcctttgggagatcggttttataacagttcattgcctctagcaatggaatgatggaaaaacagacaatggctcgccgaccagagcaaacgcactccatatttaaatacgcacgagtttatacgtactatcaactacctctatacctcatcagatctactagcaataacagcgcgttacgccgcacgtgattttatcaagctttggtgaaggaacctatatgatttatgagtttaagtagcatgtttcagttcatatataaaaaagtttgtcatatggttctcgtaataatttttttccgcaagattaataagaatgatgcaaacaggaggccaccagcccaccaattattcagcggtggataagatggcaatgaacataacatgcataaacattttttatagtagtataaaagagaacagaacaatattttacatggagtcgacgcgtatgtgtacaggatatgatatttatacggaggacattaggtacgatgcgtactgcagaacgcgatatctctacaacattagcattaaaacggtggtgataacatatagggatatggtgttttgctcatcagc

SEQ ID NO: 62342 - DNA, 2151 bp, Oryza sativa
tgacacaaactatgatctatcttagtacaaggaagaatagctaatttgtggagagtctgaatagcagctgaactgggatgaccaagacgacgatgccacagggtagaggattgggccaagaagctgtgggcagcaatagcaggtgcagcaataggtagagtgtagaggtcaccacgactattgcagcgaagaatcacgcgccgggtacggaggcccttaacagaaaaaccaaactcatcaaactcaatggaacagttattgtcacgagtgaattgacgaatggaaagtagattgcgaaccaaagagggggcgacaaggatgtttttaagatcaaatttagtggttcctataggtagaaaagaagtgccatgacaaataacaggaatagtatgaccattgccaacggtaatgaaggtataggaattgggaagacgagtatcgagaataccgtcggtagaggacatgtgtgaagtggctcctgtgtcaagcacccaaggacttggactttgcacggacaactgattgagggcagcaatcagacctgcctgatcccaattgggctgagattgctgcattggtggcaagcccggcattggtggagagacatatgggcctgcaaatgtcgtgtgtgcttgaggatatgggccaagcagaccggcactgttgctgggacgccagggagactgctgctgctgcacagcccatggattgaaacagacccatgggccggtagttcgtggcccagcctggtgctgctgctgctggaaattgttcccgaagttgccatagccgccgccgttgctgttgttctgtcgtccgccattgccgccaccactgctgttgttccggccaccgttgtagcgtcactggttgcggcgaccactgttgttggagacatcgccatgagactgtgatgaagaagaggacgcacaggtgccggaagtgcaggcattggcagaggaggcagccaccaccatggttgtctcagcctggaccttgtgtgcattggcaattcgcagctctttgagcaacaaggtgttgtgcgctgaggcaaaggagggcagaacaggggcgctagcgatgttgtcggcggtgctcgaaaaacgagagttgaggccgctcagcaagttgaggacaagctgagattcggtgacggggtggccgacgtcgcggagggcatcggcagcagtcttcaccttctgacaataatcggcaatgggcatgtcaccttgcgtcattgagtggaactcgtgactgagatagatggtgcggggttccttgtttgcttgaaagagatcgtcgatggcgagccataggtcacgggcggtctggtcggtttccatgacgacgtcgaggatagcatcggaaacggagccgaacagccagccctgaacacaacaatcggcttgtgcccaagtcgagtcgtcgggacgagggggtgcagtgccatcaatgtgaggaaggagcccaaacttgccacacatagaagtgaagaaggtcttccacttgttgaaattggggtgcttgagctccagggtaattggtatgtgagtcttgacgttgacggtggcatacgggttgacgaagatcgagccggtagaatccccggtgctggcagcagaagatggagtagagccggatgatgtagatgccattgttcccgaggttgtggaagaggaggtggactcggtagacatggcagagaggcagaataatcacgacgtggcgaagacagaaagcggcgcagcgtgagcagagcagggcagggcgcggcgcgggcagggcacggcgtggcgcgatgggggcagagcgcggcgcggcgcgatgtagcagggcgcggcacggaacgagcgaggatgcggcgcggtgcgtcgtggcgcggtggggacatggaaggcgcagtggggctggggcgtggcgagatcgtgaggggaaatcgctggggcgcggcgcggtggtggggacgtggaagtcgcgtgggcagcggaagagaagcgaacgcggaaaaagcgaaggccataggaagcggtgaattagggtagaaggaaactggtatctgataccatgtagagaattatgagacgcctcacaacgcctcacaacccaacgtgggagggtgattgtatttatatatccaatacaatagagatt

SEQ ID NO: 62343 - DNA, 1168 bp, Oryza sativa
tgacattcatgcattctatagtactccacaaacacaagctgtaagtggaaaactctaaaggtttacattaaatctatgtgtgctattaattgtgtttcagttacacatacatattaaaatacaataccttgttacaagcatgttaactgtttattttaatttgttttaagtatcccaacaaataagagttgcagatacatctgagtttatgctgattttcattacctatgcatagtattgtttttctctcagacaacttgaactgtcggacgtacaatgttgaaatgcaccaaatgatttgattgtttataagcctataataatggcatgaacaaaatttgtgatattataatgattcaggatgtaatgactacaacgaatacaatagaccagcaggccgaataatgcatcatgcagcagtccaagtacaagaaatggtggaactactcggaaaataaataatggtgtggtttgatgtctattgtgtacattcacgtcaaaagaaaatgtctattgtgtatattgctggcaatcgtcatcagaacgaagggcatgtgatgttaccgtgctatagcacatttgtttgtttttgtaaaacaatatgttttaattgctctttgttatatatgtactgtttgattgtgaactatggatcataacttatatgtctgatccttggaataaagaaatttgtttcagaaaaagaggatagttatgtaccgtaaataatattttattttctggtgaaatgcactatgggatgagtcactcaattgactagcaacttgtccatgctaacgctacgatagtatttaactaaataataaaaagaatgtgtatgttttggcaatcaagcataaaataacatcataccatttccatatttcgaaattatgtaattcttaatgtacaacttcacaataagtgcatagacaaaaaaaaaaaagtccaaaccattcatgaccatccaatatttgatctacatcccttttacaagataattcatattatttttccttatatgcctgccaccaaaaagaattttccgtctattctatcctattcacatgacccagtcaccattaggagcaacactgttttttttttcttttttgcaaaaaagagcaaatccatatttctctctcccatatatatggagttaccgatc

SEQ ID NO: 62344 - DNA, 3439 bp, Oryza sativa
tgccaaaatgatcgtcatctcacatcatgtggttcgattgtgccataaatgaaatacaaaaggttctcccattagtcgaaagagaagagcaaatacatagagcccttaggagagaaaaaaaaaaggttcatctacattatattgtaggagaaaataaataaaatacaataaatagcacataaaaagtaaggtggtaagattctttcaagtcagtcgtagtacaatcaatggctacagagaatcaatcgataagtcagtggttcatgagacaaacttttcataagtatcatatggaggcagttgcatacttcaataaaaaaaaataagaatgagtaaatttcacaaaaccacacattctttagccaaattatcacaaaattaaactacagatttaaggtgatgtatcacaaactacatatttaacactaaatttatcacagaactacagatttaaggtagagtactgcaaaactataatttagtaataaagttatcataaaaatatatattttggagtacatagcactagtgttatgtttgagttataaacgtctaagtttcgtgattaagttgacactaaatctgtagttttgtggttactttgttactaaatctatatagttttacgataccccacctatttgtagttctctgtgaaatttagtgttaaatatgtagttttataatacatcaccataaatctgtagttttgtgataatttgctcaaagtatctgtagttttgtgaaatttactctataagaattgatgatcgtagcaatcttatcttgcaaagttattattttggagatagcagagtaaattatttggaaggcagacgctagccgtgaaagcatcagttgcatcccatgtctctcttaacttgttggtcaacacatgaatgtacaaattaggatgagctctgaccttatccacatggggttgtgaagctaatggagaaccagcttcacggtccagatcaataaattatcttcagcactcctagaggtagtccgatttctcccaccaagctctaaacatgtctcagagctgggatttggtccgtgctttatcaggccggcccaagacatgatagcctagcacgctagaaattaaagcacggcccgtatatgggccgtgcctgggcctagacaacgggcatggcgggcagcacaaacgaaaaagctaatcggcgaacaatcgcacgcgccctccgccgcgcgactggacacgtgtcgcgcacggagggggtggctgacggcgcccgcgcgggattccttttttttttcatttctctttccttttttcggttatctttctgttttggttttcttcggttttgttcggtttctcttcctttttgttcggttctcgttctgtttggtttttttcccttttttttgtttctcttcctttttttggtttttttaagatatacgtatgcaaattttatattcatatgtataccaagttttgttttttttattcgtgttttttctctcggtttttaatatgtacatatacaaagtttgtatatatgcaaacttggtatacgcgtatacaaactttacatacgtgtataaaaagtttatatatatgtacgtacgggatgcaaggtttgtatacgcgtatacaaagtttgtatttgtacgtacgtataaaaacctaaaaaaaatacacgtatataaattttataaatgtgtatataaactttgtatacatgtataaaaaattggtatatgtacgtataaaaactaaaaaatacacgtatacaaagtttgtatttgtacgtatataaagtttgcatacatacatattaaaaacagaaaaagatatggaaagaaagaaaacagaaaaaaaacgaaacggaaggtacggaagaaaaacagaaaaaaccaaaaaaaaaaagagaaaccgaaaaaaaacaaaaaaaaaagggaaaagcgggcactcccaagaaaagagaaacaaaacgcaggcgctccaagcgacgcaccatccaccgccctagtagtagagaggagagactagacgggttataactgaccgcgcgccgtgcagagggcgcgactgatcgcccattagtgctccccggcacaacacgaccagtgggctatgggccggcacagcacatgaacaacccataggcacgacgaaggcccaatgggcttcgcaatagccatcaggcctggccgggcgcatcaaggagcgacgcatgcttctacatactcatcgtgtgaaacgcgcctccaccaccacgcacgctcggcctgcatcctgcacccgcgcacattgcatatctttccgtgccccggcaacaagctcggcactgcaagtctgcagcgcatcaaagcatctctgtctgcccgtcccacgcgtatacgagtctacgtctctacaagacgctcagagcatctcctgcaaagctgcgacggtgtcccgcgattcccttccgcattggcgcaatgaatcaaagcgtccgtcaactgcgctaccactagtccactgctgtcactgcaaggtcgactggtcgagtaccgaggacagggacggccgaacggatgcagacgcgcggcgctgggcaccacttgtgatttaccgctggaaaaacgaagagctcggactagtactaggactaggtagtaggtagtatgaaggactgggaaggctgggtacctgtgattcccttgcttggttgatcctgtcctgccccgctgctgtccgtctgcatcctgccatcgccattcgccgcctcgccacgaccgcacgaccgcacgacgccgcggatgtgtgaagaaaggctggcgcctgcctcggattgagatggagatgggacgacttgagtttagaccatgccacaccggcgcgaaggacatatacgccgggtcgcctggtgtagcagtgcaggcgtagacgagtagagggccagacctccagttgccagaggcagagtggcagagaagctgcatgggcatggtgaggcgattggctgcgccatgtgcctctgtggagcccgtaggcagcaaatgtgttgtgtgttgtgtgcaagagcaacgagaaacaactagctcatgagggcaatttgttttataaattcctcctcctcttcttcttcctatcataaaagaaaaatgcaccacaaataaacagagcaacatagttatttcctttccacagcaaaaatgtggggcgatactcgtcggaggtcaacctcgtcgagaccctcgcaaaggcgccgccaatgctcgcctggtccttcccgtaggtcggtcgatgcccgccaactatctcctggtatggatgactatgggatggataaccgccatatggatggtctggagggagatggggatgatcctacggaacagtccatcatcgaggccaatgacgacacggtcttgtctttgccgggaggcaaggccgagccatccacaccatctg

SEQ ID NO: 62345 - DNA, 951 bp, Oryza sativa
gatgggcaaaagcaaaaaatttcagaggatgatccgaaatgctttttgtccacagtacacccaagtttcaaggaaaactaccaagaacaatattgttgtgttatatcgttctaggttggatgagttgaaatgctcattcagtactgttagctttcctttttctgtgacatatgacatttggatatccaagcaccaaagaacctcttatcttagtgttgtacttgatgtactacaagaattcaatttagaatctagggtggtttctattactcttgacaatgcatcagcaaatacaacggccatgacgattttggagacaaatttgtaaagctacattggaggttatgttatccatcatagatgcatctgccacatcatcaacctgactgtgcaagcatgtattaggagtcgttgagaatttattgatttttttagtgtaaataatttatcaattttaatgcatctatgacaaggaatttattgtctatgcaggattactgttgttactaatttactcaacaagatccattaagctgtttttattgttggggatcagctagtgatgaaggagatgttccaagactattgccgagcaaagaataaacttgtgaggatgtttggcattgatgtgaaacataggtggaacacaacatacctcatgctacatcaactgaaagggtatgagaaaataatttctgttttcatcgattcattgcactttagaagtaatgatactgatgaggatggtgatggtgagattttgtttcttactaagggagaatgggacatagcaacacgtctgcatatatttctaaagcctttttataaaactacagtcctactatctagaatttactatcctacttctttgtaaggtgcttgaatgtatttggaaattgtcctttgtgtttcaagaaaaccgacatgacagagttttagcttatgttgttc

SEQ ID NO: 62346 - DNA, 1571 bp, Oryza sativa
caaggatgcaacaccggctagaggatccagagattgccgatgcaccggcttgatagaagtttgtccagcaccataaactttaaaatcggagatttagcctcctaaaccgttcaaattacctctgagttactttgatagtggttttgttttttttttttttgagagggtacaaatcagaacgcacacgaacacacacaacactcacaccacaacgcacgcacacacgcgtgcgcgtccctaacacacgttaggaaagagattcgaggacctatgcctcactgtacgggaaacatacagtaccaccgaacacgcacgtatatgtaccctattacctaactaggaccaaccgaagttgactcaggaaacgggaaaaacccctgtgaggtccgtgagtcgatgagtggtcctcaaatcttaaacaagcagttttggaacataccaacagagctacgctcaggttttggataactggtatggcatgttcacatactgtcaatcatcggttatcaatttatattctatagtgatgtcatatcagtattatattaatcatccatttgtaagggggaaatttgatcgaacccgacccgtattcacccctttatcacataatcatactcatccaacgattatgtaaattaaataaaaactactatgcaaaaccattttaagtgtaatataacatctcataggataggattagagttcagggtgctgcatccacgttttcaaatcatagggggcatttggacttaaaaaaaaatgaaaacgcgaatataccagccgaaagtaaagctgcggcggatggggtgaatggctccctcctctccccgccgagacctcgacggctaggggaccgacggcggtagctccgcagctagggacaaggagcggccgatggccttcgacgagaagacccggacggcgtgctggcggaaggcggcggtggtgatgggccggcactcggagcggtggcgggaggacgccaccggctacatcgtgtgccgccgcttatggagctgccacggctgcctttgctacgagtacgaccacatcgtccccttctccaaaggtgcgtcccccccttcttgcccactcgatttagggagaatcctcaagttttccgtttcttgcttggagaggtggtggtcgatccgtcaagttcgtatctgtaggattctgatgcgtttgcttgccgcggtgtagttgcaatgttggatactcggactatttttgctcgatcaagtattggaggagttgtcgctgagttgagttcatccgcagatgagcactaattttgttttattcagaggaacatttagattaaggttgggatgtttaaaatcggatatgagtacacaggtgagttcagatggagaaattttagcctaatctcctgtgggtcagtagatgataattggaatctgtaatgccgtatgtttttgtttttttactaagtaaatcatttatgtttagttaaattagggggagatgccttctccaatcaataaagatggctgtgcaacaatatcatgtaacatttagcaatccatgttaagcaagaaacatgt

SEQ ID NO: 62347 - DNA, 1829 bp, Oryza sativa
gcatattttgtacccacgaacattaccaacacattgcagcttacattttttttcatgctttctgaagtaacacgcatttttcactttttacagtcgtagtgaatctgctaatgagttctttgcttacacataagaagacccgaaaataattgaaggatcagtgtatggcgtcaaaacagaaagtaataatacagattgatcctaggtgggctcaggccctcccagtttgtggaagtgattccctgcattatggacggagcagcaagacagaagggtcaaggaaggaggaacagcacgcttggcagaagtgattccctgcattacgtcaactgccgcagcagctctacccgtggcagagcagctggcaaccatagcgagcgaggccagagcagcaaacgccatggtcggtcgctcgccggtctgttctcgtgccgcaacgcgtcctcgtctactgtgttctatggcgccgagcagacagtcttcactgctctcttaggactcggtggatcggctaggtggagacaagggggtgttttaactaggcttaagacagcaactgcatcgtgtcgttgtaatctttgttttcttttcgagaaatgataaatggaatggatattaatgtctatttctgttgtttattttgtctgatagaaatgataatttgtgaaacaatgcatttaaaatgaaatcattatcataaaataggcgctacatgagcaaggtgtcgttgtctgactttcggcctctaatctgtacattttatatagttacaacccactaagcctaaaacttaacatacaaacataccacctcatcatctattagtaataattacatatcaaagctaatgcaagcatgcacatcatctatattgtatcaaattctacgaatcaatatgcaagcaaatccaatcaacaccccctcgtatcatttccacaatattttaacatagatatctattatttttataatacttaacatatttccatccatatatctcccatcaaagtgaggtatatcatttattttgtttcgtgattagtactaataattaaacacaaacttttcatcaattttcctacctcttgcttcttacgatgcaaatcttacgcaacaatttaatatttcatctacaatctgctacatgatctattaaatttatttttcttgagatatggtttgacaaaccagttgttaataactaatatcctttttctcctaactcgattgttaacaaaaaaaaaacatattcaaaactaattagtaatcccacaagcaaaacgtgggaaatcaactaattaaattaatactcgctacatattctttcagcaaaattttagttttaccaaacccgcaattactccacgatgtcaagagagcactaataaaacaatgcgaacattgcaaataaagtagttattcggttctttgtgattttagatgaattgtggcatttcaatgtgtcactctagttaacggcctcgaatgaccccttaccagtagggatgaaaacggtcggaaacggtcggaaaaaccctctaccatttccattttcattttattttctcgaaaatggaatcggaacggtatactcggaaacggtaacgatatcggttatatcggtatctcggaaacggaaccgtcggaacgggaatataccgatatcggacggaagtcgaaaattcatgtcggaaacagcgaactggggtatcatcccgcatttaactatgtatgaagatgaccttataatttcacccttgcatcattacgctgccacacaacaccgttatatgatgattaataagttgacaataagattgataaataat

SEQ ID NO: 62348 - DNA, 1634 bp, Oryza sativa
cgagagaggcagtatgtgagtcctcggggccaggcccgtccctcatcagtgatggggttttgttgcggtctgtccaagataattgataataggccacaacgaaaatccatcaccgatgagggtcatggtcatcggtgacgggccaggtataacagcctgacaaaaataactgtgaagcccatcatcgatgaaggttgatctttgatggggtttgcttgtggcccattactgataacccacagtataaataatgcaagaccttcaaggaattgttatcccaacctagtatgttgttcacacttcaggacagatggctagaggggatattttttttccttttaatttaaggaaagaaacaagatgcttccaaggtaataataaataaattacaactcaattttcgtataatacatagctatagatattatacctgttttttcacaatttgaacatggtgttggtatttgaaacggttacagataatccgcaagcgcacggatataccgatgtagcacttcccctcagagtattccaagggtatcgaatccaagggaacgtgtgtggtcagatcttcctccggttcatccaaggacaccaagcaattgataggctaggatagagatgattcactagtgagaaacagtgtctagggaaagcttaattttaatcctaacgcaatacttcaggcactggcaacccgctgttcccagatatcgctctactatgtacccggacagggaggacttaagtgatctcgagggctgtcaccacctctacacccacctcaaacgtaatgtgggatacgcaacaattactggataataattacctaaacaccatgtctaagcaattaatatctactttagtgtttataactcaccaaagcaatcactatattttagttgattatagtgaacaataatcccgtatgctatttaggaactaaccaagagataattctcacaagataaatctaaattactcaagaagaatatattgaattcagagtaataaacagaataaaagaaataggagaagattaccgacaactccggaattcttccgactccttctactctactctcttcctattctagtatacaatatagtacaatagagcctcttataattcagctcgagcttggaagtgaggtccttttatagggcagttatgacggttatgagaaggggaaatgtccgaactgcccccaaaccgtcattgggagaacatcaggagcgtccacgctaaaccccaggatcaacgatgatcccctggttcggccgaacctgggctgggccctcctggcctggccttcggtcggtgaactccctgtaccttcttctatccatttcgcggatttttgggttgatccactggtgtttcgatgaagttcgcaacccctccttgtatggatacataattttcctcactttagtctaaatttcctcccaacttcagggtttatcatctgcatacaactatacaccaacacttgtggaacatgtgagattaagcacctatactatgttgaatgttttattatctaaactttatgcagatgttggcggtatagaatcggcatttaacagccgccaacaaaaccccccacacttagctctttgctcgtccctga

SEQ ID NO: 62349 - DNA, 2831 bp, Oryza sativa
attcctgcagcccagcggcgagcttgtggatcgagggctccggcgatttcacctcatcctcttggaattggctgggaacccttacgattggagggggcgtcaaatgacgcttcaccttcataggtggagggctacgggactccgctgccccctccttctccgatgccatcaaaagccggagtaaacccttaccatacccaccgccggtagttcgcactccctgaatacggaatcgctcctccttcggagtggatggagtagcggtgggtgtggtgtacttgtggagcacctcatcccttgccttggtgaacagggtgcccacatagcactcggcgggagacggcgcggccttcccatcatcttgaaaaaggcgtcgtgccttcaagagaccgagctctcccgttgtcggccgtcacgcaggcgaatccccctggatttttattcttgtaacatggcgaggggagagggatcgcactgccgaacggggggccaattggggccgagaagggttctgccgaacccctggttcggtcgaaccagggagctcgccgacgggctccagattcacaggggaacccggcactgttgcgaggggctgcgcccatagtgtgttcaccccttccatcgtgtaatgctccaccgggatcaattgatttgccagtgtcggctctccatcaaaattgtaggtggaattggaggaggagccaatgaatgggattagggatttgccagccattagtgggtatgagtggaaattcgaggaattgggttgaattggagaggggagtgtgcaaatgtggaggaaaggaggaagaagaagtgttctggtgtgatccgaacgttctacctccacacgcgcatctaaacagactagggacgagcgggggagactagcattcaaattcggggccgatcgggcactgccctggttccctggtgagtccggcaggcccccaattttcttcctaggcccactaaaacctattctaagcacaataatgacaactatacagggttttaagcatgcaatagatgagatcattgttggtatttcttacgaccacagataaatccgcaagcgcacggaataccgctgtagcacttcaccttcgggtgacccctaaaggatatcgaactcagggaacatgtgtaatctacctaaggctaaggcatccaaggacaacaactgatgataggtaggctaggctagagaggactttctatatgttttaattatgcacgctaagcaaaggtaaattcctatctgttgcttcgggcaccgatccctgctagtctgctagcgtggttccggctatagctctatgatatatccgaacgtggaggattactgggacggaattcagggctgtcaccacctgccgcttacctctgacaaatccgtgggatacacaacaaacaaaggtaatctctaacctagacaccatgtctaagttattaattactactctaatacttgcgcgggaacttccttctctatccggagtcctagtaatagagcactttgtatgaatactaaacaatgaacccgcaaatatggaaatataacttactcagactaaataattaaataacaaaagaaaggaacacgagtgcttacttaatagaagaagttctccgtacctggagcagagtataccgacagctccggtactcctctcgaattcctcctatgaagctatactcgtcgaggtagaagtcggatgagcgccaaacttccaggcactcctccagagcttcccctcactctctaccttattctagtgtacaaaagatacaatagagcctcttgtaattcagctcaaagttgtgtgtcttggaatgagagtgagctcctccttttataggcaggtatgacggttacagcctatgcgaaatgtccaaaatgccccggaaccgccattgggacgtgatcaggagcgtacacatggaagatagcgatgaacggccacagaacaggttcggccgaactggttggttcagccgaacccaaaaagtgtcctcccgacctctccttcggccgggaggttgcttagtgggcccccaataacctgggctatgttttggcctaattctaaatggtttttattgacttattgcacgtctaatccgtgtaaacgcgtcctgaatacgtggaggtgcattttgtcacatgacgatgtgttttcttctcaaaataactgcatacacatatttcaccaacactagtggaaatgattagtaataatccctaccactaagttggaaaccatgttttaattcattatatgcaggtattgacggtcaaatattatgatttaaggaccgtcaacaacaccaccacacttaacctttgctcgtcccgagtgaaggctatggactctacaacagaattatgacttccttacttccttactaatagtcacgcaaacaaattattcaaagtcatacttgtatttgtggatgtttgtagtgtctaccatgcaatcctgagcaattgagaaatggaacaatcttcactaagtcaccctaacttttcatgaagaacaacatggggtttttcatataacacaaaattataactttgctttactcctccattgattctctcgatcactcaaagtgtatgattcctcacaaaggcatatgattgtgccttttcttttcctaccatctaataaggcttatgtggagctcagggtatggaaaagagtagaacattacttgcatcacatatatttcaaagtcaaataatggatccacagaaatacaagtcatactttctggtcaagaatgtgtatgtgtatgtgtatggttaatttgtgggtggaaaa

SEQ ID NO: 62350 - DNA, 2240 bp, Oryza sativa
  unsure (1)..(2240): unsure at all n locations
aatgagtagccaagaacagaacgatgcttttctaacacggtgagaagacgttgagtctcgtcttcagagagcttgtcactgattatgacaggagcctctctgtcattgtgtaggaaggcatatcgtaggcctggaggtagaggtttaagctcaagcggaggtcgagatggtggttccatgattggcaggtcgagagtctcgccgggatccgcttcctctttgatgaaatcggggggacctcatcttccagaagggcctcgggagactcatgaggaggaactgcggtaacctcttccactgactcaatttctgggagagggtcggtcaaggtgatccttgcccgcgagaatggaattgagaattcattctctcctagtattattttgaggctaccaaatcggggtgtgttgatgataagttgctcaatgggcagcccgattaggatatcaaagtcttggatttcaaagacgtggaaatctaagatcgcctccctgttttcaaagcagacaggcacatcttgcacaatcccaaatccttcgatgatatttccgtttggatgcttgaagaatttgtttgtcggggtcactgccttgtcgattaaataagcgaatgcaaaagactcagagacgaggttggccccgacagttggactcagagacgaggtcgttcccttccaggtgacaaggaatgattcagggagcggtatttatccgaattacttcggatgaaagctctgcctcccttagccattcatcgctcattatggatgtcaactcccggacagtttctcgtaggaacccgagttccataggatcgggaggtgacaagggaacgggtggtttcctcttactaaaatagtttatggtattgccgtattcttcgtcaaaaccgtccctaaacagaattgcggcactatccagagtctgaatttcttcattctcgacggacggctgctcaggaaccttctcatcaaccgagctagcaaaagtggatggttcagcaagtggctcgatcgttagaggttcctctatcttggacacggatgcctccgactggggttcattggactgcgtcatgaaggaagtgttttctagaatgcgatccaaaatcgtttttccttgtgacggcattttgtgtatgaatgatcctccagcggttatgtccaaatagaatgcagactccttatccaaactcgtatggaaatgtgggagaagcacatactcgggtaaggacagggttggtccggactggactaaattagtgaatctggaccaagctgcaccgattgattcgtttttgatcaatgcagactccttatttctactcgaagggcagtaatacgggtaactgggaagaaggcaagatagaatctgtctcgcagcttttcccagctaccgtttacacatccaacggtagaggtgtaccattgctttgctctctcttgaagagaaaatgagaacaatttccaccgcacagtttcttgtctcatgccacgagtcttaaggcatgagcagacttgttcaaagtctcacagatgatggtagggattttctagatcaaagccaaaaaaggattttccctaaccatactaattagttcgggacgaatttcatagccagttgtataaatgggctccgatgaaggaggtggctcatagaattcgccccgaggagcagacagctcaaaaagaggttgctccatggtcgagaagagtttgacaggaatacttctctgggatagcaggggtgaaggtagaataacaaaaatgaaaaaggatacgaggatgaactaggttcggaaatgatcaacaaccgttcctcggcaacgacgccagaaatgcttgttggtatttgatacagttacggataaaatccgcaagcgcacggatataccgatgtagcacttcccctacggagtattccaagggtatcgaatccaagggaatgtgtgtggtcagatcttcctccggttcatccaaggacaccaagcaattgataggctaggatagagatgattcactagtgagaaacagtgtctagggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62351 - DNA, 1003 bp, Oryza sativa
cccaatccggcagaaaagctttgtcaagttcaaatttttctagacaatcttcagtccagatgtatttcggtccagatagtgcagcggcctttttcgcatcatcccctcttagtagtgctctttccttgccccctctgaagacgcttaccatgtatttctccttgtgttcatcctttttcttggggtcgtggcttctgagcaccctaggcacttcggacttatctttgtccgtggcttcaacagtggtctcctcaacagggtcccttgtaggatttgggtcctcatggatggtcggttctgattcatcccattgcaatgttggtacgtcttctagctatacaccgatggatgaaagaacttgcacatctggtagagccacatctggttcttcgacatccggtacactttgcacctcatgttctttatgtggcaagtcaggtgtgtcaggccctttagttggcagaggtatcttagcctcttccgccttgtccttcaacgatcgatgcttaggaggtctcggtggttttccaggaccagcggcgacattgctaaatatgatattctttttgtgccatagaatgacaaggtcgaccacatccccaagtactgtgattccatcatgtgttgggatgtctaggtcgtacgactcgaaccctggattcacctcttgcggctgcactttcgcatatgcagattcaataaatccgccatggtagtttctgccaggaatagcaattcccttcgccgcctcaagtgtcctcctagcgcgtccaattgggatgtgcaaccggcaaggtttagtctcttgtaaatcctcgaacggatattctggctccggttctttgggatcctgtagtggaatagaatatttcatgcagaaatctatcatttcttgttcaaaccgcttacccccctcgtccctcaacttttccttgtaggcgtcatgtttcttttacgaggaggcgtcctgtttgaagccttctttccaactcagcttagagga

SEQ ID NO: 62352 - DNA, 1363 bp, Oryza sativa
agacccatcggccggtggcctggtcggttgcgaagcaaccacaatagccgttgacgcctccacgttcggttgcgaagcaaccacaatagcctgtgatgccggaggagaggccttatcctcatctcgtttcgcactatctgccatcgttctatattataggaatgacaataaaaattatttaatgtgcgtacatataaaagaatttgaatttattactaactcaaagtcatataaaaaaattaaaaatatctaccactcggacaatgtcatataaccgaaatctcatatcaaagcaccatcatttagcattaacagaaatgtcatataaaagcactatctaaatgtcatatcaaagcaccatcgtttagcattaacgaaaatgtcatataaaagcactatctaaatgtcatatcaaccgaaatggcccgaaaatgtcatataaaagcactatctactcggacaatgtcatatgaaagcatataacgaaaatgtcatatacaagcatttactgaaagtcatataaaaaaattgaaaatatcttcccaacatgttatttaattaaaattgaacgaaacgaaaccgacatttcctacattcaacacattcatcctgcatacaaaattcacccttatatatcacaaacaaaacccacatttccccattcacatgtatgagcacatagcacatagccacatctcatccaaaaaaaaaacaaacccggccccacatgtcagccactatcatcacacacacatatatatgccacacacacatgcacagagtcgtggatgaggagtcggggatgacgacgatcggccgagttgcgcggagagatggtggcggccggccggaggagaggaggcgcgccggccggagattgatggaggcggcggccggaggagaggcggcatgaggttggagtggacggcggccgcgagcttcgagtggacacggcggcggccggcccgggcgtagctaggaggccgcgccggccggaggagaggcggcgctagccgcgggtggcggcgctggaggacgaggcggcgctggccggggaggaggccgcgccggcccggccggatggagaggtcgcggcgtgcggcccggctcgaggagatgggcggcgccggcggccaaacggttacgaggcggcgcccagcggtggtggcctagcaggcggtcggcgccggcaagggaggcggcggtcggaggagaggcggcggtcggatgagagccggcggtcggaagcaccaaaaatttcggtagcctaacggcgccaaattttctagggttcccgcctggactttgagaatttggcgccggggtggtcgcgcttttataggcctcctatcttcgcaggcgg

SEQ ID NO: 62353 - DNA, 3188 bp, Oryza sativa
tagtcgatttcccatatttcttcaataaacctaaagtatgtctgtttttcccctagtgaatctattgcttcaactcgaactccgctgttctgtgtaactgtcttagtatctcgggctcttgtactaaaggtgtatccattaatatcatatccctgctaggaatttacagtacttgattgaccacatgagaaccgcttcattgtaatttcctcggtggtatctccatcaggtaaatttagttcttgcaaccaatctacgaagcggcgcttgtgttcttttatcatccaatcatccgtgcgtcccttattttcagatctgagaagttcgaggtgttgatcgatgtaaggctcaacgatagcaagctgatgaagaacactgaagtgagcttctgaaacaaatttgtattcaaggtcgacgaatcttttcttccctaccgtccccctaccagtcaaccttccctcgtgtcgaggtacaggtattccgattgtctttccatcttttaggtaatcaatacaacactcgaccacctcttctgtattgtacccctcaaccattgatccctccggatgggcgcgattccatacatagcccttcaatacagccatgtaacgctcataggaccacatttgatgtagatacaacgggccgagggcaacaatttggggcacgatgtgaaccatgaggtgctccatcatattaaagaatgatggagggaaatacatttcaagttggcattggatctcatgtgggaatgtacgaagaagtgctaactcttcaggatcgatgactttctgggagatagcattgaaaaagtagcacatctttgtgatagcaatctttaaatgttcccgttgaatggcccgaatagcaactgcgagaaacacggtgagcaagacatgacagtcgtgtgaattataaccagataccgacaaatctttcattgacactagtcgtctgatgtttgatgagaaacctatgggcactttcacatcacagagagatttgaaaaatgccttcttctcatctggagttagtgtgaaataggctggaggaagataaactttgccagtcttttctccttcttgcgggtgtagctcctccctaattcccatttcgactaggtcggaccgtgattgcaaaccatccttagtttagttttgtgtggtatgtccaacaatgtaccaattacgttgtcgaatatattcttctcttgatgcataacatctttggcatgacgaatctccagatctttccagtacggcaggtacttaaagaatatagaatgcttcttgaatggggaagggggcttgcgatcttctttcttctgctttgccccctttgatgttttcttacgctttgtcccctttgattttttcttagtcccttttccaaacacgcattctattttctctgttgcctcacatactttatccccgggtgtaactttcggtgcagaatcattctcttcagtaccatcaaactctgctttcatcttgcgaaacttatgacccttgggtagaaactgccggtgcctcaagtaaacaagcttgttggaacctgggaggtacctatagtacgttccattcaagcatattcacacatccagttttacctttgatctgccttgaaactgaaaacatggcggggtaatcataaatggtaacgaaaatgatggccttcactgtgaagtgttgtcgtaagtactcatcccacactttcaacccctcatgccataaatctgccatatcttccaacagtggttcgagaaatacatcaatgtcaataccaggctgtcggggtccttgtatcaggatacatagaagtatatactttctcttctggccaagccaagttggaagattgtacatggtaagaagaactggccaagtactatgggaactgctcatgtctccaaaaggattaagtccatcagtacttagtgcaaatctaatattacgtgggtctttagcaaattctttgtactttgcatcgaaatttaaccactgatgagcatccgctgggtgtcggagcatcccgtccttcttgcgcccttcttgatgccatcgcattagttccgcatctcgagggtttgagtacaaccgcttgatgcggtctttcacaggaaggtaccacatcacaagctgcgggatttttctcttagtctctccgattgtgtcatcctcttctaggcaggtattgctgtttgatttgtaccggctagcaccgcaagttgggcatttaaccaacgaggcgtactcttttctgtacagtatgcagtggtttacacatgcatgaatcttctccacaccaagggataagggacatatgatttcttcgcttgatatgtgttcgatggcaacaagttaggcctcggaagcatgatctacaaaagttgtagaagactgtcgaagctactatcagaccatccaaatctcgccttcaacctcataagttcaagaactgaccgtaaaattgagaagtcactgtgacagccctttgactcatcatatagaatatcctttgttgtcttcttcaaagcttcgaaattatctaaacctctagccgacccaacaagcaactcaggttctacatggcataacaattcctccagatcaatattgtcttcagcacaaccatccgtgcaatccatgtcttcaacaaccggttcatattcttcttcaacgagtctaacttcatcattttcgccatgatgtgtccatataacgtaattctccataaatccacgagtgactaagtgctcatttaccttcgtcagattttcccacactttttcattcttacatttagcacatggacaataaatacccctcctattctccttctcaacgtactccttggcaatatcaataaatttagacacttgttccatatatggcgataaaaacatcggccaatgatacatccattcgagcctgtccatgtctctgcaaaatttatttaatcaaaaaaattaacaaatatatttgtaacaaatatctctgcaaaatttatattaataaaaaaatttaacaaacatgtaacacttttgaagttaacatattatatttaaccaactagaggatgggacgaccacatgatatcaaagattacacataaatccaacaagatcataatatacgaaattaaacataataattagtttcttcatgtcatgaagttttctctct

SEQ ID NO: 62354 - DNA, 1325 bp, Oryza sativa
gagaaaatataaatgacgcatataagttttgtttaattttaaatcacacatataataaatgacgaaccaaataatgtgtattaaaacaatattgcattattacaatttccttaagaatatatattaatgaatgttaatttgttgtttgccacaagtgactggctgtttatgatttcccatgaatttacaggaacaattaataaccaccttaatttttgacagaagttaataatatgtcaggcatgtaccatgtaagaatcaaatcacgcaaaaaaacaccttcaaaccaaaaatttgagatgtcttttgaagttattctgatgttcatgttgctaatgtataattttggaccaagagttgaggaaccgcaaaatcagattttcccagggtatcttacttgaatgatgaactgcttcttcttttcactgataataacttcgtaaaacttagagaaaaaaaaacactgatagaattagctctatgcataatgcatggctgtctctagatgcattatcaatccttttaaataagcacctcaaaagaaatgatggataattagctccaaaaaaacaaaaatgtttactctcccatatacaaaccgtcatctttcgtgcacatttggactggactatttttttttcgcggcaaatccatatcactgccggttggtggactaaacctggaatgacaaacctccagggatatttttgtgtcaactccaactccatcactgcgccacatgcagcctgccgtttcgaaaactggcagggatctcttgttgtgtaccagtgaaaataaaggggaaaaaaatgttggatggctaatgcaagtgggggcaaaagaattagacatctgaccttgtttggttgtgacattattccatacttcttctaaatgctatagccagggaatgcaaacgagaaaatcgatgaagctctgagttggcctcatgaactagagtgctaccactacgctataaatacagctagccatacaccatctctgatcatcgacaccaagcaaagaatcaaacaattcctagttccactttgccagtcctaccaaagcacattttagccatggctagtccatttttcaaagttattccagtacggcctgtgctccgcgatcagtgtgagattaccatgagattgtacttgcaccaagttgttacagggccaaaccacaaccaagaaacaatggtgccctcatcacatcccgcttcgtttggtatgattgttatcaacgattggcctatctatgatggacctgacttcaacacaagtactattgttgcacatgcaagaggaatgcatgtccaggtt

SEQ ID NO: 62355 - DNA, 2005 bp, Oryza sativa
  unsure (1)..(2005): unsure at all n locations
gtgtctcacactctgccctcattgtgaagaagaccatccaccagggaagtgtcccacccgcaaggtcacatgttttctgtgcgaaggtacaaaccatgtgtccaaggattgccaactcagtgtgttgttgaccaagaccgcagaaatccaacgaacaaccctacgattgtctcatcagctagtcagctccaacagcaacattgacgatatcatccacagcaccaatgctcttcctgctccacctgactctgcaataaatcatagcaataataccttcagcaccaaccattctctgcaccgacagcctcaacaaagaattgtcgtcgatggaagaagttgtgtctctccccgacctactccaggccgagcaacgggcaatcaacctcaggagggcgataccaagcagaagaccgtcatccgcttcaaccagcaatcagaagtaagtttctcccgtgaatgatagcaatatgcagtcctatcacatcatcaaagacccaatcaaggatgatgcagtcactagaacaatgccagctatatctctccagaatcaaaatgagcagtcacgtttgtggttttcagttcgctacttatcattgtgtaattgaaagtttgcagcaatcatgtaataaataaatatattcatgtccataaacagtgagtttgctatgtttatggatgattcatgttgaggatacaatgtaccgatgttaagcaccttccctttttatttaaggcagtgccttctattcatgtaataagggagaaatgtgtaatacatacaagttctatgaggattcttttggaagatgcggatatgtgatcatgtgtataattgtttactgataaagaagacctagggtctcatttcagaggaatcatattctaacctcgagttaataaccaacctattgatggaaaagaaaaccaattaaactgtgttggattaaaaagccaaaagggacttttgtttggactaagagtttcagatgtgtcttcttcggatcaaaggcaacaaccgttagtccaatttttgacaaaccacttcaggtttcaccgaaaggcagcaggccaaaggacctcgtcatccctagaagcgtccgcaacccacattaaagagtaccacctgttagagataggccgaaagatgattgataaaagagattggcaaagaggttctctagcaggaaagaagtaggccgaaaggtgattgataaaggataaacagaaacatgctctgcattgctcaaggaagacccctgatagtaattgccccgcaacagtcaccttgtcattgaggtaaaaaaaaatcatgagtaagcaagatgacctangtaaaagtgtttccatgataggcaaggagtgaaatcttcaactcggtatcagatgctatacggagtgaaaagtgcaggcaccggttaccaggcaatgttatgtcttgggagatgattcaatgggaaggaactcatcaaggtcgaaggtgtaaaggaatacatggaatgctaaatgatgacaagcatgatattcttatgatgacaagcatggtattctagtaatgacaaagctgatatcgacgcataatgtgaagtgggtaacttgtatgaggttgacgccaaagatatgaattatgagaatttttcgaactgaaaccccatcttcaagtgccgcaacccagtcaaagtcagctagaggtgcaaccagggacaagtcaggtgaagtgaagattccatctgccaatgggagctcatgccaagtagttcagcgcggagaagtccggttagaaatgtccgttcaagaagaggttgcagaagaagctgaactaagaagagaagacagcccaacctatcttcttgctagcctcctcgaatctcgaggacgagattcctgtaaggggggtggatttgtcacgttctgataaattcatcccgaaataaaaatcattccctaaaaggaataatagaattaattaaaattcgaaaagaaattgccaaacactaaaatacctaca

SEQ ID NO: 62356 - DNA, 3959 bp, Oryza sativa
cctgcagccctctcgtcgttcccggtcgtcgtggcgttcgtccctccgtcaagccgttctcgtccgtcgtccgcgtccgtcaagtgtgccgctgcagccccgtcgtcgtcttcgtcctcgtctccgcgtcgtcaagccttgtgccggccgcgtctcgccttcgtccaacgatcaccgccgaagtcgtcccctcgccgttcatctccgtcgttcctggccgcctccgccgcgcccgttcgtcgttgttgttcccacgcctcatcgcgtggtggtaaggatctctcctctcgctgccccgtcctcgtcctttcggtgtcgccccgtacccgttgtgcggttgtcgaccccggtacccgtgtaccggtgtcggtagtcgttcacgtgtgcgggtggtgaccgtgtagtgtccgtgttagtgtgcccgctcggtagccgcgttgtttccacgtgtgcagcccgcgtggtgtctagtggagtccgtttgtcggccactcgcctcggttgacacacggggtccgcttccgtcaacccgtggaccgtctctgtgtactcggtctactgcggtcctttaggttgacatgtggggtccgcatgtcaacggcgcagccttcctgtcttttctaggctagcgcttacacatgttttatagttgcaaaacctaattataataatccgcaaatctccatataacagcattaaacttcggatgaccatgtcttggtcatacgaactctgaatcgacccgttcaagtctcctaatgtttgttataacctaaagaaccctgtgctttctttttatgtattgttatttcttctttataggcttgtagctttgcttgtgtgcttcgcgtagcttctgtcgttccggaggttctcgaggcgtgggtcgcggtcgtcgccgaaggttcggaaggccgttgtctgcgagcaaggcaagtcacatcatccttgagcatattgaatcccagtttataaaattattttgatttaaattaatgcattgttgctttatttaaattctcgcgttatcactgttttatttagccatgcctatttacctttattatgaccttattattattgctattgttattattaccttgttcaccctaggataaacaaacccccaactagtgggtactctattcatggttccactagtatgaatttaggtagatgcttcgctgattaattaggcaacattaggtggttttataactttagactttgggaattctcatatcacttggacactatggaattgttggcttatggtggaattggacatacacctctcttcctctttcaaaaccccgaaaacctattttccggtggggtttgggtgcatgccagttgtgggaagtagcaccccggccaatataaggattaagctcgggcctctgttgcgaagcactaccgtacttccacatgtctagtgggtaaggcttagtttgtggctcagtctggttataaacaaaggtacacggatggagatggacgaagtcggggctcgatggacatctctaggacaaatgatggctacacgagctgcggcctggtagtcgagatgtcatggcacagggctggtgttctgttgctaggggctcaatcctgcctgcctatcccagaggttccggctgtaggtggagttgggtcggtactcttgtttatgtctaggatgggttgggaactatgtcatgtatttcgtccgtatgccatggtggtatgtggcacgtggttacacgtgaggaagatgtgtcttgtgggtaaagatgtacacctctgatcagagtaaatctattcgaatagccgcgcccccggttatgggcaagcctagcaatgtacccaagttagtggtttacttcttaaaatttgcttaacaactaaaatgtggaatggttggcctgggttggcttgggacgagctgggacccagggtcgggttgccagttcggtctgaatcatcgtaggccttgggttaaggcaggttcgtgtgggtttacggccttgtttaataatattgtgtagctctaggatcgtgtttacaaagtagctttgagcaactaagtgtcttttaaatgctgtttactgcaaaatttaacccctatattattaccccttgtacccccttgcattaatcatgcatctgccggtgtggcttgctgagtactatggttgtactcattcttgctctatcttcccccccttgagtaagagaagctttggagaagaagtcttaggtggagtcctgacttataccccagttgagcgcctgtgaagatggagccataggcccgctagtctgttgctgtttatttttgtctgtcaagcctgaagtgcctttgtaataatgtaaatattatcgatataataaagatgtgccttttgtatcatgtttgtatggtgtaccccggcttttcctgggacggggattaatacactagcgttcgggaaaatgcaaattttctcgctcgcgacacaatgcgaacatctattgtgactagacacttactatagcttcgtagactagttgatcttgtggatttggcatgcatattgtcccatcatcattcttacgataccaggccctggcccagttccttttccgagggtgtgggatatcgccaaacacccgcggcgtgttcgattcctctgcctcttcatcctcctgcctccattcctcatccttgccggcatatccggcggtgccaagtcggtgcgggtgctggttcaacgtttggagtaaccgatatgcctcgcttctagctctggactcgggggtcgacttcttcgcgtggaatgactcccagacctgatccgtgatccaaggaaatttcactgttggatcgggattcatcgggttgaagacgaactcatcgaccttaaccttaaaagcagcctgcttgataaggtcctcgtgctctgcaggataatcgaagctctccttgaactttagccaagcacttttcttctctgctatcggcacttgcttgatgtcatcttgcagaatactgaatttctccctccctatgaccccgcagatagacctaaatcggctcaatactttccggggacctgtcggcaagcctacttggttcacctctgttatgcagtaccgttccttagggattttgttccctgtcctaggagtaggtgcccttaaggacccaccagttgtcgtcgatattgatttgccttgctgagacgtcgtttaattttttacaaaataacgaaaatacacaattaagtgcttaaatggctaattatccaaagttctaaaatcacttagtcacataaataaactaaattgcacatctcacagtaataaaatgaattgaatatcacatataaataaattaaacatttcatcaagtcctaaaatcatacattcacctcatatcatctatttatccacatatcatctatcactaaaatcattcatgcaccacatttcatttattcatccacatgtcatcgatcacaaaaatcattcatgcaccacatttcatcaatcactaaaatcatctatcactaaaatcattcatgtaccacatttcatctattcatccacatctcatcaatcacaaaaatcattcatgcaccacatttcatcaatcacacaaataatgacaggaaccacagttcatccattcaccacagggagcagagggcgatgcgatggaggactaacttgagcacggctggtgggggtcggtggtgagctcggtggcagcggcgctgggatcggtggagggcgtcgccggtcggtggaggggccgggctcggcttgaggcgtcggcggtcctcaaggaggtcggaggaggccaagaggcgggcggcgtcggcgtcggagaggagggggcgacgacgacgaggaaggacgtcgccggtcggtggatgggccgggctcggcttggggcggcgtcgtgcatcggtgaggaggtggcggcagcctgaatg

SEQ ID NO: 62357 - DNA, 995 bp, Oryza sativa
tgatggtgctggaggggatgaaaagggtagcgctggcatcgatggcgtgatcagagcaggtggagctgacgacgtgggtggcggtgtgctcaggagtgttggagcagcgacagagagcagtggctgactagccgggggctagcagtcaagccggcggatgcaatggtgatgaagcgggtgagaaggtgatagaggcggtggcggtagcgcgttttgaggatgatggcagtgcaaagatggccggtgtgctttttgtcggcatagcagttgccagttggcatcagtgtcgcacatgtagaacaagttaggcgtcagccccatagaaatggtccaatgaggacactttgggtatttaaaagaattggataaggctaacggagttggatggacggaactccaacggtaatggacagatagaatatttcctagctgtgtgattaatttgtttgtttggtaaacatggatcgaatttcaaagtataaacttaataataaatgactaacttcttcagggctgaccaaacataatagatgaagaaattccaaattagtcagaatactatataggaatacattctttgcacgcaagaagatgcttattcctttgtagttaagttacatgcatgatatattttggtgaccatgtgttaggctaagatttagatgttgtgagtttggaaactcacaggccaatgtacagccagccggaccgctgtcaagctaggaaatgcccaaattccaacttgtttgtttggtttagtgatgaattatttgtacaagtaacatataactgaatgacgtcgtacgtagtacgccaaataacatattcagtaggtatgttaattggttagatgggtacagaataaaattttaagtgcaaattatggttgagctttcagtttttctattggtcaatttggctataccaaatgagatactcgtattatcaggcaaatataaaactttccaatcctacgtagtgtattatatcaacag

SEQ ID NO: 62358 - DNA, 2585 bp, Oryza sativa
tccttcctcccgcacctttttttttttccttccgcacttttttcgtgattggcccattagtaacaagattactgtggctttccgcctaagagtaaataagttacgaccacttccgtacttccaaattgatttagtaacaagattactgtgtctttcagcctaagagtaaatgagttactaacacttccacacttccaaattgatttcttctcttagtaaatgaattactcctaggttattttctgccctttccaatttggttcctcctttcagtaaataaattactctcttagtaaatgaattactcctaggttattttctgccctttccaatttggttcctcctttcagtaaataaattactctcagatcgttatcagctcttctcttagtaaataaattacttaggatattagtactcccaattggtttgcaaatcttctcttagtaaaataagttactcctgatactggagtaaatatattgcagattgcacaaggccgctggagtatttagtgacaaaacaaatgaaggtaaaaaattatgattcatattatcaacctaaccacaatttaataatttctttacaaacatcaattgtttgatccagtgtcggtgttacatcaacaatctgataatgcactcaatgatacattggcagaaaaacacaaaactaataaacaaaatcaaatcaacaccacccgctaatacatatgtcgataccgatcgatgccagcactaatatagcaatgtagatcagggccgacgacgctgattattaactgcaaaaggcagtaaatcctgagttcagctcacaagtagtaaatttctgatttcatctccatccccactagccagctgaagcctcatcccatcttgctggccttgccatggcaggcaaaagcaccacaagagaaagctccacccaatgaactgtacaaaatcaagagcagtatcaaaaagaattcgatggatcgacagattctacacaattgtagaacaaaatcaagaccctgatcaacatgaccatatgcagtgagcgcttcagaaaaatgaatccatatgctctgttgaaccacaaaattgcagaaaattcaatggattgacaggttgtatgcatttttacaagaaaatcaagaacctaatcaacgggaccatatgcattgagcagttgaggaaaacatgtatcgatctgctttgttgaaccacaaagataattgcttgagaaaaataaaaggagctaaaaaaatgcatagctcagctgcaacccaacgaaccttgcagctagcagacccatcatgctatccacagcttcctctgcccatgtgtgatctatgctgtcgtcgaggcgtggccatccacctggacaacatccttctgcctcgctggggttgcagcctcccccatgatcgtcagctgaggtgcagaaaactccacaaattcagagcattcctgaagtctatagatgaaaaatcaagtagaccaaaattgagaaatctgttcatcaacaaaaaaaaatcagaacatgaactacatctacagcagaaaaaagctcataggggactacaactggtttgttcaaccaaaatattcagcgaaaaactatgatcgaaaggatcatatgtagagagcagttcagagaaaatcaattgatatgctctgttgaaccacaaaatttcagtgaactgctattgaatcaagcttctagagttttcatttataaaaaatatcagagaacctgatgatgatgctattggcagttttccaaattttgcacacacaaatatatcactgaacaaatgaaattcagatgggagcacttttctgaatatattgcacaaacaattcatggttgaacaaatgaaaattaaaatgagagcatatggttcttcatgcgttgcaaaaaaaaaaaaaaaaaaacctggctatcaggactattcactcatgatgcttgatccagcaaaagcagccatcaccaaaaaataaataaattagaaaagcttgttaacctatcaattacagaaacctgtagatgcatagaagcctgaaaatttcagaatatcaatggatgttagtgttacacaaaccaaatccagatcacatagaactaacgaaccagccagaagtttggtaggattatagatggaagtctcatgaattctctgagagctaaatgcttccctgaagtgtttcaacagaaattaagatgctctccaagcttaggcagtcacaatagagaactgaaggaagaattcccgtggggacgagtcgagcggctgcggcgtacctggtcctcgaggtctatctgggtgggcttgcccttggcggccgggtcagagtagacgtccatcggcagacggcagcggccaagcagcgagctggtggaggacaaccacgatgacggcagcgcgcaggaagaagcgggaggaggaagaggaggagaggactgcaaggtggcctgccgcccgtgctctcctcccaccgccgccggtggatccgtgcgaggtcaggcgagggacgcccgccgccactggatccggacagaggacgaccgtcgtcaccgggttcgagcgggggacagccccg

SEQ ID NO: 62359 - DNA, 4001 bp, Oryza sativa
aggaggcacaaggtagtagtcagagacagcgtatcaagccactccaaattggtgaacctttttctgctggtcaaggacagtcgcaacagttgaatatcggtggtgagatcaaaacagagactaatgaaagcaatgaagttaatatcgagcaagctaatcagccggtgccaattcagcaggatcagtctcaagagaataacagtagtggaagggagcagcaggtatgtttcaactgttacaagccaggccactttgcaagagagtgtccgaagccgaagcatcagcagccgcaaggtcaggtcaacaatattgtcgtcacaggagccaatgcagtgccagttgcgtcttcaagagttgcgtcttcaagtgttacaactcagccaccagtttcaaagaagcagtagttttctttaaagccttagaataattatcggagttatggaataagatagactgcagtttacctattccctttttctttctagccgttccgattctcgggacgagattctttgtaaggggggtagtttgtcacatcctgatttttgtttcaggatttataaattatttaataaattaataatataatttatattaagtgttctttaatttacaagtgaagttaaatgtgggaaataaaatttcctaaatataaagcatggatggatttaatttttattaaattctccatggttaattcaactctctgaaattttctcggatttttcagagctcaattcctaaatgatacaaagaacagttcagtaattatttgatcattaatgatctaattataattgttaagagcttttcttgtttaaaaatccttaaattataaattgttgtttaaaaggaattattagaaatgattttaaaagcctagaagagaagatctaattttaatttgctaaatctcaacataaaattgggctagataaaattttgttaaatactttgcttaattctataattcctagatttttctgggatttatttgagctaaggaagtatttttaataaatggaattgcatttcatgaataatttaaattgaaaaaggtttttaaaagtcttcttttggctttgggccgaaagccggcccaaaacctctctctttccttttcttcctccccggccagtcggcccaagtcggcccagtccgccgagccgccgctctcctctctctctcagccgctgacaggtgggtcccacttgtctgggtcgtcgtcctcctcgcgccgccgccgccgcccgaaaccctagcgcaagccgccgccgtctccttccaaattcggccgatcctttccttctccggtgaaatcttttgaggggaaataatcttctcgatctcctcttccttttctcttatagaaactccggtcaattttctttggaaaccggtggattcgagtttgattcggattcgtttttccccaacctttccttctcgtcgccggcagccgtgggccttcgccgccgcctcctagcccctttaaaaggacccccgagctctcctctacccgccgccaccctcgccttcgcctctcgtcgccggaagagccctagcgtcgtgcacccttgcgccgccgtcgctccagccgtgagccgccgtcgctctagccgtcgccgtcgctcgggaagaccgccgttgtgctcgccaagtcgtcgccgtcctcgtccgccgcttcgccaccgccgaagaccgccggagcatcgccgtcgccgtcgacccgaaggttgccgccgcttcctcctcgtcgccgtcgtcgtccgttgttcttccgccgccgttttggtcaccgatgagttcgccgtgtcgtccgcttcatcccggtgctttccgtttgtgccgtagagccgccgttcgccggcgagcgtgcgccgtccgagccgtccgagccgccgagccgccgctgccggaggtgacgtcatcgctgacgtcatcggagtcgtccgccgtgagccggtcgtggaccgtttgatctcagccgtccgttttggatagggttgatctcggccattcgttcccgtgaaccgttgccgtgcacccggtccaccgcaaaccctagccgctgacgcaataatctttcttttccttttcaaaaataattcattattgcgtcataattcaattaaaatccatataagtgttttaatccgatttaatctttaaaaattcataactaattcatttgaacttagtttaatgtggttcaagttgcaaaagttgtgtaaaataaagatctacatattaaaattgtccataaattgaattaaatttatttaattctttttaaatgggctttaaatagatttaatcttgtaaaattcatttgaagtcagaatgaggccgttcaagactcataattcatctaaaattatgatctacatgtttgtttactttttatgtattgtttatttggtttttattagtctttttcttcgttttgtgtgttagcttgtcgtttccgtcgttgcgaaggttcgcgagtgcgccggaagtattcaagaagattaattgaataccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgatcttgattactttattccttgataccttgggttattataatttgactagttgagctttatatattggttcagctagatattagatgtgattgcttagccatgcttagaaacattagcacactattgggataacttatgattcattattatttaatgatggtttaatgatagttcacgatggttaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtataacatgattcattgcggagcaccagactgagaagtggcggagataagcccacgggggtcgctggggagtccatgccttgttttataagggggtgattatgatccaggaatggtgcactgtggtgagttgtgttatgcaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcataataattatagatgttatacctggtaataattagcttagctcctggtttggagattagatctgttcagccgggtatggttgttcagaatggttgggcctgggcagcacgggtgtgctgttcagtgttgattaaaatttctgattaattactccaatgttttacttctcttaaatgttttgctaaatgctgcttttacaaatgagccaatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcgtgacagacatgatcgaagatatcatggatgacttctcagtttatggaaagaatttcggtcattgt

SEQ ID NO: 62360 - DNA, 960 bp, Oryza sativa
gtagccacgttgtttccacgtgtccagcccgcgtggaatctagtggagtcggttgtcggccactcgcctcggttgacacacggggtccgcttccgtcgacccgtggaccgtctctgtgtactcggtctaccgcggtcctttagattcacatgtggggtgtgcatgtcaacggcgcagccttcctgtctttttctggctagcgcttacacatgttttatagttgcaaaacctaattataataatccgcaaatctccatataacagcattaaacttcggatgaccatgtcttggtcatacgaactctgaatcgacccgttcaagtctcctaatgtttgttataacctaaagaaccctgtgctttctttttatgtattgttattgcttctttatatgcttgtagctttgcttgtgtgcttcgagtagcttctgtcgttccggaggttctcgaggcgtgggtcgtggtcgtcgccgaaggtttggaaggccgttgtctctgagcaaggcaagtcacatcatccttgagcatattgaatcccagtttataaaattattttgatttaaattaatgcactgtcgatttatttaaattcccgcgttatcactgttttatttagccatgcctatttacctttgttatgaccttattattattgctattgttattattaccttgtttaccctaggataaaaaaaaccccaactagtgggtactctattcatggttccactagtatgaatttaggtagatgcttcgctgattaattaggaaccattaggtggttttataactttagactttgggaattctcatatcacttggacactatggaatggttggcttatggtggaattggacatactcctctcttcctctttcaaaacccctaaaacctattttccggtggggtttgggtgcatgccagttgtgggaagtagcaccccggccaatataaggatta

SEQ ID NO: 62361 - DNA, 723 bp, Oryza sativa
cgccgatgaaccattcgaacttgcgaaacaattcgagcagatattctacataaacgatccttcaaacaagaagatgcacatcgtaagggatggcaagcgccgaattgtcggagttgacaacgtcgttgatgaagaagaatacaaccagaatcttcttgtaagacctcatatcgaccttaacgaagatccccaagaggctgtggaatatgctcgttcagatcaaacgtaaggcataaccttgtgaccgatgcctttgtacttatctattgtaatgaatggagtattttgttttattagaaagacttgatatgtgtaatcatttatatggccaatttagttgattattttgactaatatgatgaattattatactgtagtgaattattttgctacaggtgaagtaacaaatataaacatctcatatgaaaaatggaaaaatagtcaagcgggacgggctttggttaagctccgatagagacaaagtcatcacaaacgggcattcgtaaatcccgtaagtcatgagtcatctcaatcgggcattagcatagagcccgtcacgacatttacgtccgtcactgatgactcatctatgacgggcgttaaactaatgcccgattgagataaattaatctctatcgggctataactaacgccagtcacagatgacatttttttccatttttcgaatgaagtctttatattagttagtgccaaatgattagc

SEQ ID NO: 62362 - DNA, 779 bp, Oryza sativa
ccggaagttgaacactggtcttataaaatgctactccttgtaagtgcataccttctatacttgtgatatgattggactatatctcctaattaaattagttctaatacataaatgttttatggttgtgttggatcgagagtcgtcgccttggtaatcaggttgggttccttgatccatccatggtgaacgaggttaatttacgacagagcttcactgaggtggttgactatgtcaaccggtgtttatgggcccatcaagacaaggaatacatcatatgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcccatatgtggaaaagggtggtagcacaaggagggcaaggacgaactttatcatgacaccaagtttacatgcgcacaacagatcggagaccaatgtggtttccatgtgtgccacaacatgtcaacacttctaagagaggtgaaagatttcgaccctgaggttgttgctaatggcgaataaactcatttcaatacctacattgctattaaaacgttctaattaccctcttatttattaaacagaaaggtagagctggcttcagatctcacccatcaaccccccgctatc

SEQ ID NO: 62363 - DNA, 1365 bp, Oryza sativa
ctgtgacggagtagcaaataaaggcccgtcagaggtgacctacatgtgacgggcctttacttttggggccatcacaggtagatcacctgtgacagcttctaactacggagacctcaacctctgacggcctttatttaaagggccgtcagagatgagttacctgtgacgggtcctaactcgccctaggctagcggagaccaacacctctgacggccttctagtaacttgctcgtcagaggtgggtgtcacctgtgacggccggccacccgtcaaaggtgactggactcaccagtgaccactgatcactcaccatgcgcgaagccgtcaaagatgagggtttgggctcgtcacaggtgaccttggccagtgtagtgaacgtagtgcatgttctgtcaggaagagttcagtatttttaagaaatacaattgtgtaccacttgggaggaatcaccatggtgatgttatataaggaaaaaatgatggcgtatatattaattgatttttcattatttaaatgtaccgaagcacaaactagatcaaatttgtaaaacttcaaaagtaattattaataaatcaaaatgttgaaatggacactcgctaggtgttaatatgcaatttatttgattttggactttttccccctcttttccgcacagtccatgcactcatttatactgaaattttcaaaacataaaaatatgctctagcaagtcacgatgacatttaaaaaccaaggatgtttttcttataaatatatatagtggctgtcgacgggttgtacccatctatgggatttgtatagggtgggaaacactcgtactaatatatatgagagacaacgattaagtaggtggaagacaagtgatttatatatatatatatatatatatatatatatatatatatatatatatagccctaggaaatctagttgatgaaactattgtctagtttggtgccaaaattcaatcagcgaaaatgataaaatttgagtttaatttctagaactttttgcagccaaataatctgcagcaaaaataattgcagtgtttttagtataccaaggtcatgacgtcctctaggcacaacaaaattaacgccacaattggaacaccgtacgtagaacatcaaataaattgatcctcgctctgtgtgatgctctatctgcactgttccgatgccttgtcaacgtaacgctgcatccgtgcacgcacctatacttggctgcgttcgattctgtccgtcgggaactcattccctccgcatagaaaaaggatcggtttattaacacatgattaattaagtataagctatttttttaaaaaatagataaatatgtttttaagcaaattcatatataaatttt

SEQ ID NO: 62364 - DNA, 733 bp, Oryza sativa
aaccaaatgccaatcaataaaaagatgttgtatcgtttcattagaattatagaagcaacacttagtgctacctttccaccttctttttgcaagattatcttttgttagagtaacctcaatggaattctaagctcccaaaggaaatatttccttggaattactccgttaaacatgagagttctgtacatggagttgatggtaaatgtttcctttttattggctttccacacaaagacatcattttgttccgtaagttgagttgatataacttttgagaccaagttataccacgctgctaggttatcccctacaatagctcttctgaaagagacgtttaggggcaccttttccaacacttcggccaccattacattttttttcctaacttgattatacaacgaaggatacatcttatcaaaagaggaatcaccactccaacaatcctcccaaattctcaattgtgtgccattacctacttgaaaagcgccacaagaaagaaaagagttttattaacctccatcagccctgcccaaaaatgagaatcccctggttgttttcctacaagtgtaattgttttcttagccaagtatgttttttctaagtagcttttgccaaaccccatcctcattgataagcttatacaaccatttactcagcaaacgtttgttctgcacatttagattatgtattccaagacccccacaatccttaggtgtacaaatcacagggctgc

SEQ ID NO: 62365 - DNA, 980 bp, Oryza sativa
gtcaaacatgtgagaaaaagtcaacggcgtcatttattaaaaaatggagggagtataatgtaggaggatggataatacttgcctatgtgggaagaaaggatgattgatcacgcttgtcttaaaaaatatagtagccaagtccttcaccttctttttgagaacaaaatagcagtcataattagtgatactggcgaaagggtctgtaacctattggttacaagagcctcagtagtacctgagatcctccccatggaagcgaattttctaggatttaacggcattgtgctttcagtggtaggcgacgtacccgtcgacagcgaggcgcctatggtgactttgtcaatctctccaggatttaccggcccagtattcgaagatactcataggggtagggtttgcatgtgtgtgttcataggggtgagtgcgcgtgcgttgtaagtgtgtgcgttgtactgtgtaattctaaaaaaaataattagtgatactgaatatagaatatgttctacatctttttttggctgtaaaagtgacaaattctccaattagtagttttttcatgcctactaagctatgctaatttgtcgcaattccattttaaatcactattacataaatcgattttgatagacaagaccctctccaggctgaagatggctgtaactgcatctgcatgcaaaaatggctctgttggatcggttcaaggctgcatgtgaaaatacattatcccaaacagccacttaagaggtctgcctccaagtcctaccgttctctcgtccttctcagcatgcatcttcaaaattttccaagtcctaattattatctcctcaccttctctctcaccccaatcctctcctcatctttatctctctcatctcccctctctcatttctcacctcctctctctcccttgtctacacctcccaagttgcagcctgctagcgggcgggtgcgggcagcggtgggctctagtgggagcgcgc

SEQ ID NO: 62366 - DNA, 2256 bp, Oryza sativa
atcggccgccgggcagccccgtgacggggaagggtgaatccgctagggtttcaggttttgggtttcaagttttagttttttttttcatgatttttcttttagcagtgcagtgacataatttaccgcttgtgaaaagtggaatttcatggacgggtgtgccatctgcttgtaaaaatagctacttttactgacacctccgagcaggcagacggcccaattgcatgcgaaaatttgttttgacggtatgggaacatgcatttttgtagttttgaattaccttatatttaatcaatatacatattcaagttggcatgaatacattttcatattctgaattgtccgggctgatcaatttgtgatagcgaacagaatatgtatttagttcacatgtacatagtatcttcctctacatgggcatattccatgtactatctgatctaaatatttaatgcatatacagccattattgatgggtggaaataaaaccaaattagcacatcgatgtccagatatgcaattcaattggtttgccagatccaagtcctcgtgaaacaaattatatacttaaagaacaaaagtttgcgtatggccaatcatctcctgccatttaatcttgcattctgcaagtatatatgctatttgtacgtactcatgctcccaaacaatctttcttcaagtttgagcttgaatagttgttaagggaaaggctttcatgagttagtagcggaagtttggagaaaagagaacaagggttctatgatgatggaaagatagcaaaataagatccatagattaagacagttcttgagaggttgggcaaaaagcacaagtgaaacatatagaaaagagaaggctgaactaagtgcaaaagcaaatcagttagattaaaaagccgaggtgcaaatattgactaggcaggagttagatctcaagaactacttgaaaaatagactagctcatctgttaagggaggaggaaattagatggcaccaaagataaaaaacaaaacatttaattgaaggggaccggaatacaaaatactatcatatgattgcaaatggcaagcataggaagactaaaatttttcagttagaacaagaggagggtttaattaaaggtgatgaagatttaaaaaagtacattactaaatactacgagaatctttttggaccaccggaggaaaataatttttccatggtggaatcacagaaagaggacattgcacaggtatcagatttagagaatgaaatgctaattaaaatatttaccgaagaggaagtaaaacaagctattatccaaatggaacaaaataaagccccgggacctaatggtttccctgtagagttttatcaagtgttctgggaggtaattaaagaagatctcatggctatttttacagaatttcatgaaggaatattgccgctccacagcttgaattttgttatcatcactttgttaccaaaacagaaggaacctcgacaaattaagcaatacatacctatatgtctgttgaatgttagcttcaaaatctttccaaaggtaatgactaatcgaatagctctagtagctcagaaagtcattagatcttcacagacggccttccttccagggaggaatataatgtaaggggtggtaattttacatgaaacaatccatgagatgcatagaaaaaagaggagtggagttattctaaaattggactttgagaaagcatatgataaagtagattggacttttttacaacaaaccttgaggatgaaaggattttcgcaaacttggtgtaactggatttaacaaattgttagaggaggaagtgttgctgttaaggtcaatgatcacattgggaactttttccaaacaaaaaaaggcttgagacaaggagatctcctatcactaattctatttaatttagtggcagatatgctatctatcttaatacaaagggctaaggatcagaggagatttcagggagtcatacctcatctagttgacaacggcttctcaattttgcaatatggtgatgacacaattctcttgatggaacatgatcttgatgaagcaaaaaatctcaaacttgtacttagtacatttgagaaacttgcgggtttaaagatcaattttcataaaagtgaattgtttttttatggcaaggcaaaagatgtagagaatgagtatgtcatgctttttgggtgtagatctgggacttacccatttagatacctaggaattcctatgcaccacaagggctgcaggaat

SEQ ID NO: 62367 - DNA, 982 bp, Oryza sativa
attcctgcagcccgactggaggagtcgtcgacgaggacgaacggagacgacgataacgaacaccggcggggttcggatggaggggaggcgaggccgagggcaaccttgatgctgcgatgccagaggaggagatggcgacgtcggccggcgcacgggcacggcggaaggggttgcgaaggaattccggcgaggcggagggcgagaccggcgcgggcgatggcgttccggcgaaaccgagggcaggccggggtggaggtcgacgcggcgacgccgagggaggagacggcgcggccggcccgcacctgagcggcgcggcaggggcggctggaggcagtgggtggcggcaatgccaccggttgccggcggggacgcgcctccggtggtttccccgcgaaacggagggctaaccgggggagaggaggctgctacgaggccgagggtggcgacggcgcagccggacggcgcacaggcgaggcgggaggtgcggctggaggtcggccggtgccggagagagagaaggagaaggcggggagaggcggggcggccacgggagagcgcgggagggggctaaaactggagaacggaaggagggggttcctttttataggcgcggggagggagccggcaacgagagaggccggaacggaggcgggaatggcggccggtggccttggaaagcggcgggggttggcgcgtccgttcccggcaatcggggacacgattcaagggggaaaacgggggaaatcaaagaggaatcaatggggattaattccccctatttaatttggaaagagccggcttgaatggggtggatttggaggaggaacaacgctagggttcacgggagagagaggaaggaggccggcggctagaggtcggggatgcgcctgacaggcgggacccacgcgggaggcgcgcggtcaacgcgcggcaacggcgcgcacgcgcgcgcacgtgcgcggcacgggtgggaggcacggct

SEQ ID NO: 62368 - DNA, 2173 bp, Oryza sativa
tatggatttctagacaagcggacttccaacaaggcggagaaagatgcacgccttgaagccaagatccgggcgtcgatcagagtggagctgacctctgaattcgacgagaagctcgagtcgatgagggccaagattaggcaagagatccgagaagagcaacataacccgcaggccgccgctgctgctgcgcaagaagagttaggaagtcccaaccaaaagcgcagcagttgcgcatcaactgagttggcggaaaatccaacatcggtcgacagcgccatcaaccacataacggtaaaagtttcatccacaatgcatgaaaggcttaacgaatccatatgttatataatattctaaaaaaattgatgaatctatcgcaagaaccaacgagctgcaccctcacagttagggtgatgccgaccttcatggttccagcagccgagggacttgcgtacaagccgaccccagagacaagagtgcatggaccgcaacttagggccgactgtgcaaaagttcaagttgactcagtgaagcccgaatacgagctgttcctactgaagtatccgccgaacgacgaggtcctatcactaggaaatgcccgtggtaccttcatccaatggcccaaggacctcattgagataaggattacagcgagaccaaccactgcaccaagcggtcgtccgccaaggagacccacctttgctccttcagcccctatagctcaagatcgtcatgcacaatcttatgatgtgcagttgcagtatgacacggattttagggaggaccgtacagaggccgactgcaaggcgattcatgaacccctaccgatgaagaagagcaggaaggcacactcttccccttagagaattactctcgataaacccgatgcaaaggagagaggaagaggtggaaaggtgaaggcctcacttctggctccaaggaagctagatctgggcaaggggcatgaagagacttaggggaaagaggtcaagaagaaatatgtcgctccataggagttccaactaggcatgccattggttagagacgacgtgctagccacaatgggcaccacttgcaaggaccttcacgtatactacatggagaaatctaacgccaggaggtaaaatagagctaccgatatccttggagagcatgatggaaagccattccttggtccaacaaattatatcgtggtggactttaaggatctattcgacctctataggctccgagcggtggatacaagccttcttaagtgctactccttgtaagtattgtcacccaactcaatttggtaataacaatccgtttaactcgcttacaagatcgtttatcttgcgtgtaggttaagttggcagtggtgtcagaagaatgcaccagaagttgccttccttgatccacaagtggtcactttcacaaatctcgagaatgatcgtcaaggaatggtcaactacatctacgacaccttgtggtcccaccgagaaaaggagtacattatgtacgtctataatcaatagtaagtgtgttccctaaatatacacaacagcatgacacatatagctctagtatttaactttcactatattaatgccgcagtgcccattggatccttctggtcataacacctaagtggagtacatgccactacttgaactccagaattgataagcaggcatttgattggacccctattcaactagcgatagatgaagcgtggggccaatacgtgcaaagaggaggccttaggaagacaggacatgacaccctcatccaaaaaaaagacttctcgatgaagcaacaaataggtgaccagtgcggattctatgtgtgccacaacatgcgccttctgtacagagaaaaggtgaagaatttggctgaatttgaggtcgatgtcttaattgtgatatactaactacatcaaagtacatatatatgatcgatcaactaatctcaaattatgacaatgtagggcaaattgccaagtctctgcctaccagctttgaggaggttcgcgaagagatagccggcttcatcctctgcgaaataattaaccccaaaggaatgtttaggcttaaactaaaatgatgaacattgttgaacttttatatttaggcaatgatgaacattgattaagaccttgattatgtaactatgatatttatatttatgtatataa

SEQ ID NO: 62369 - DNA, 2681 bp, Oryza sativa
tcatgagtacatgcttgttgggaaggttgcaacgatgtaatccattgcagtaggctgagtggagataaatgcacgcatatatcaggacagattgacataaacagtatcgatctataaggtgtaaactattttgcagggaagtaattagtaagtgtttgagatacagtataagtgaatggcctgactaatgggagaatagttacctggtttagagggatgttgtcatgtcttcttcagcgagcaaggtcgttgcggtagggttggcgagatgcggcggagaagacattgccggcgccgccgacgggagataggaggtcagcaacacatgcgatacgtggactgagacggaggcggggtttagaggcgactgctggttggggaagacgggaggaaatcgtggcctcgtgggcgagcgatccacgcggcgagactctcggagaggatgaggcgttagtcttgtgggtgagcgatccatgcggcgagactgttggcgcggcttgcgagaggaaaggggattagtgcgaggggagagaagtgtgggtgaggtgtggcagtgcagggagcgatccgaaggcgaaggtgcggttgccagtgcggaggaaggaagcggagtaaaaggggagacgactgatttgcttggaaggaaactaccgatgacccggtgcgcgatcgatctccccccgcgtgaccccgcgtgcgcctcgggtgtgcctgctgttgttggatgtgatacgctggatgatttccatccgttagatttaatgaatgaagtatgaaggaaatatttgatcaaacatctgtaacttgtccactataataacttctcgtagcttatatagcttagtttaccaaacatgggaaagtaatacataaaatattattataaacttactgtcataatcttataaattcaaactgatgattaaagttcattaaattgactgaaaaatcttattttaaatataaaatatttttctatagttggagttcttatttttcttttctataattttctatagttttgtgtttgctaggcatgcacacgcctaagataggaaggaagagagactttcttaatgagagtttgataagcgtcaggcccatgcgtgtatacaaggcccagccgaatgccaggccctcctatgagcgcaacgtagcgcttttttctcttttttttcttgatctctctcgatgcaagtatgctcgtctgttattttgcgtggaaaccgattttgtgaatagggacgtgccacgtggtttatctctccagcgattaatatgcatagaatttgttttaaaagattctgtactaaatatccaagtagataattaccattctggtgttctatttagtttttacggacgacagattagtctgaagatatacatttacatgactcgctcactcactcgagcagttacatttacatgaccatccgcggcagtagtaaggccctgtttgtttcaacttataattattatattctagattattaagccagattgctataagctggattataataaactgatatagaataagctgtgagttgtttgtttgtctgaattattggaggcatggattattgggtttgaaaggctaaagtctataatgcccttagatatttgttcggttcatggcataggtgggtaatttttcttaactatgtaggggtagtgagtctttagccacttgataatctgaaaaaaaaagctcctttagagcagcttattagattataataatctggcttatagattataataatctacttgtttgtttcagcttactcataataagctagattataataatcctaagctgaatcaaacaaggcctaagattctttatggcacaccggcacagcgctctgatgaatcttcactcttcaatgcagatgaatccatgttactactgcgtttgaggcctttttttctgactgttatggatggctgcattgcaaatatggattaacacgtgcgatattagcagtaaattaacatcagaatcgacaggagtattcctattcctatcgtgttaatctgccagattttagtactctactcggatgctttaatttcactacgtagcactatcagattttgtctgaacatcaactcctcatccattgccatggcggcatggcgccgatgctgctggcctgctgcccccaggctctgatgatccatggtccacctgaacaagaacaaaaccacacgatttttgaagtttcagatctggccatcattttttcagcccccgcatctgcatatgcagtcgcaaaagatttaagcctctgcatctgttcaaatgcaaacaaaccaaaggccttcatgaagtcaactagtaatcccctttctgcctattttcatcatataacttctctagttgccgattcatgaagtgaaggagttactgattgtgtcaatgggcttttctgaatttttgtgaataacttttttgcaagatgtgaatatgttgatctccacctaataattttgtgttcccttgtaaactaacaaagctaccgcgaaatcttataggagttttcataaaactagaataaaaatatttttgtacatgcacacccaatacttttcctaatacaattctgaagtcatgatatgtatccttattttctaaaataaaacaagttaagtgggcatataccattagcaag

SEQ ID NO: 62370 - DNA, 1376 bp, Oryza sativa
tcggcaacgaagccgaccggagagggcccgcaatagagttggggcgccggcggagggcgcaccggccggccacgcggatggagccggaggtgggcgttaacggcggcgccgtggatggcggacggcagtgctggagctccaggtggcaatccgacgaccacgtcgctggcggccgcgtcctccaccgtcgctccccatgccgggctcgtcgccgcggccacgtcctccgccgtccgtgcctcacaccacgctgaagctcgtcgcctgagtccgcaatgccgggggcttgtcgggggtggccgcatcggagctcgtcgccggcgaccgcgacctccgtcatccacacccatgcaacaccggagctcgtcgttgacttagttgcagcagcacacgtgagagagatgttgtagaaagaatagctaggtagaagaagagtggattggttggtgtctatcctatcccgtcgagacggtataccagtgtttagcatttcccttaaaatattgctaagaacacatcaactaagccctcctctgtcctaggtgtgatcatttcttggctacgcctatgtggaaaatgatgtatgtttctgtgtacggctgtcaaaaaaagctcgagctccagacgagccgagcccgagcctctccctaagctcgcgagctttgtcaagccgaggtcaagcttccaacgagcctagtaatatatgatttttgttgttatttaataaattaggatatcaaatatgttatttgtatgccttatattgacatcatatatttattttattattttttgccttttctattaatatgatgaactagaaattaattatttttttaagataatctttcaaatatatactgtattacgtaaaaaaaatcaagctcggtagtcgagctcgagcttggtcaagctcgagccgagcctgtcagaaagcttgaacattttataggctcggctcgagcttgtatcgagctcgagcctaggcagacgagctcgctcgagctcggctcgttgacagccctatttctaggcatgataccatttttttcatttccgttgtttaacctgtttgtcaaaaatgtaatccattttactataaagttataaccctctaattctaaagctcaacatgcaaacattccacatcatcatctactagcaataattacatataaaacttatgcaagcatgcaacttcatctataattcattgaattctacaaatcaatatctaatcatcttccttcacattatttttgacaatatttttaacatttttactctatgtgtgtgtgtatatatatatatatggacacgctaaactgcacccagggtgcgttataactaaaacgctcccctcacaacacccctcc

SEQ ID NO: 62371 - DNA, 1661 bp, Oryza sativa
tcgtcgcctcggggagggcagaagcgggagctccccttgtcctcgccctcggcctcggcgtcaccgtcgtccccgcttttgcacctccaggatggacgccggcagcctgcgtcgacctgcaacaggtatggccgtcaacctcctcctcggctcctcctcaagacttctcaaactctctggctcgggcctcgaccctcacctcgtcgtgcctcctcgacgtcatcctccgcagttgcggccctccctccctgacgtctcctcctctttttgacagtaccctctgataccccataagtaccaggctttataccttggtaccaaggtttgatacctaggtatcacctggtaccttaggtactgggcatcaggtatcggtcgatacctagtcggtaccaaaggtaccaggtaccaggtacgaaccggtacctaaggtaccaggtactaggggagcacacgtccctcaccttgccgtgcctcctcgacgccatcctccgccgttgcggcgctccctcccccacgtctcctcctcttttttgatggtaccctttgataccccacaagtatcaggcttgataccttggtaccaaggtctgatacctaggtaccacctggtaccttgggtaccgggcatcaggtatcggtcgatacctagtcgataccaaaggtactagttaccagataccgaccggtacctaaggtaccaggtatcaggtaccaggtactaggggagcacacgtggacagaggaaacgaaaagggagagtcagttaaaatatcccgttgcaacggtatcccgttgtgtagctgccctcatatttacctataaacatatactacactagtaatacttgatcccaactgtcatacatacattttgtcttatggtctgtgctgtagcttgctacaaatctgtagaccgctgctcttttctatcatcatttatcttcttgatatgtatttatagctggcttatagcctgctattgtacttgtcttatataagtttaagcaccaaaaccaaagacaatttaaatcacatcaatcaagacaacatgcacacattctcccacaatgcatgcattgattaaaaccccataccaattacaccctagcattgtcgcgcccagggattcgacaacccgaatcaccggctatctgtggatttaacctctgtctaggcatcaaccagagtacatagatgacaatttgacacagatccacgtcttacaaaaataacacaataaaacccatatgcagcggaaaaactagagaactaaacttaatcttcacagcaacgcgaagcttcctccataactccataggcaaactcttgatggctggcacaagcctaatcttcatagaactcaccatctgaaccaacttctgcttctgggagattgggaaaaagaagcaagactgagtacaaccaccataatcaacaagtcataccaaggggaaggtatgatgcaagggtaatcaaaggattggctcaaaggatattttgcagtaaaaacagcatttgtaaattataagttgaaagcaataaaacagtatataattaagtagtattaaccatcatcgcagtacaacgctaaatccacgttgaaataggcccaacccaaaaccacccgaactacaccagttcattaagacaaattattaa

SEQ ID NO: 62372 - DNA, 1057 bp, Oryza sativa
aatcccaaagtgagctagttgatctaagcatgactaagcaatcctagaccaatcatctagtcaaattattaacctaggctatcaatgaatcaggataaacaaaggctgagtatgggtagaaaccatcccacatgacattataaaagtaatgcaattttgagagaaaagcaggggttttgcaaataggctcaatatgatgaatgatatatgtatgacttgccttgctcttcagctgacgggacctcggcgaccacttcaaaataaactggagcgtcggaactgccggagtctaaacgacaaacaaggcacacaataaatacaagctaaaaagctactgaaacatcaaaagaaaccaattttaatggattcttgacattttaacgaatttactgcaatttgaatgggttaaaacaaagctctgattattaagttatgaattttacaagatgctctgtgttatttactattgacagaaacttaatcaattgataggaattagagcccaaaaggaacataggatcaaaggataggttgactagcaagcaaacctcacgagataccgactcaacgagtcaatttaacgtgacacgggatcaccgaaatgatcgaccgaaactggcgaacggaaccggccgctctaaacgactctaacctaaagaacgaatcgggttggacaaacgaacaaaccatgggggaacacctcgttcgaacgaacgagcggacgactcaacaacggctgtggctaaaccggtgggctagacatgattcacggtaaagccccggtacagcaaacgataggcccagtaggaacctagggttgcacctatggctagacaactcgactaccaagctatgggacaaaaacaacggctaggattaagcggcacacggctgcgacacagcggcgcaaagcggcggctcggctcggcagtgcggcggcatggcatagcacggctcggcggcggcgggacgacccgacggtggcggtgcaaggtggcggcacggcaacgacacggcgacgacttgactaaactacgacacatgaaaagaaaaccct

SEQ ID NO: 62373 - DNA, 21371 bp, Oryza sativa
ccagggcatcatatcatggcgggctatagtacgtggacggccgtgcatatgggtcagaggccggactgtgttgggagagcatgcatgactaatttgctctgattagctagctaggtatagcagctctgacccctgcaagtctgacacctcaacctaatcaataattattcagtgatcaatatgagctcgatcgatcaagcagcgcggtgggggtgcactggtctaggatattgttgttcttgttcgaccgaacctccccctttttcttcgctcggagatgattgatgctgcgaaacacagacagaaatcttcgggcagttaacacggttgctttcgcgttaagaatgggattagttataagggtctatttaaaaatatggtgacaaatataattatagcataaatgtaatataattacagatgtgattagtgtaattacatatataatttaggaacttaaatatgtaattttcaaacttagacttacattgtaaatacagtaaaattacgtatgtaatttagagatttacaatgaaaatacattttttcatgaaaaatatggtgtcacatttatagcaaatccgtagttataattgattgagtgatactatggttcctgagaaggcatatttttgtaacgtaaaatttaataatatctcggtatacctcttaaatcacaatttttttaattgatttggtcatttttcattgtcgctagcttggacaaatgtactttaggccgggttaaattaaatattttccccagaggtctctgtagttcaattcactgttcttgtgctacagtgtactactatatatgcttcaattaattccgagtcatggggaaaaaggccaaaaaagaagaaaaatattacttgagcagaattgaatttactcggttattgattatttacacgcacacggatgcgtgcgcatgaatggtgacaaattttagtacgtaaaattataacagtatacaatcatgcagcgtgcatgcatgcaggcgtatgtatataccactgtagaaccctagctacatcgatgttgccaaatcattgctggcccatgcccgcttggcttggtcctagttgccctgtcactatatgctgagactgttgctgtcgacgactacgacgaatatgtactctctacatactccctccatactttaatttatgacgccgtagacattttaatcaatgtttaaccattcatcttattcaaaaaaaattatgtaattatcatctattttattgtcacttgatttatcatcaaatattctttaagtatggcatgaatatttttatatttgcacaaaaattttaaataaaacgaatagtcaaacgttgttcaaaaagtcaacagcgtcatacattaaaatacggaggaagtacgttacagagacatggatgcatatatgcatgacatgccttgtacgcattcatacacgtagtaatacgtacatggtgcagtacacgtatgcatgcatacactggcgacaggtaggagtgaacagtgccttgaacggcgatcgatcgagggactttcgatcgtacgtttggaaagaatccggccctgcagctttttaaattttatttaaaacttaattacattatttttaatgtggattttcacccgctcagaatatatgtataaaaattttatctataaattatttttttattgctaataaaccgtgttagcttatattagctctcggtaatcaatggaatgtaatgactggttcggcgtagagatgaaaaagtgatccacgccttgctagctcgaacctaccactacagaaacgatttttatctccgatcaaaattgactttgttaggcgggtggatgtcccgtctgcacctaggtgtatgtggaaattgatattttttatgcgggtagagcaaccgcatgcgatgtgggtgtttaagccgtccgaagataaaaagaaaagttagtaaaaaaattccaaaaaagtccgaaaccctagcaggtcccgcgtccagtggtcgtcaccaccattcttgtgcccgggcttcgtcctcgccgtcgccaaagcactccttgctgtcagagtcaagcgttgtatccatgcgcgtaggaagccgaggcggtgggatccgcgtgggagagggacagcccgccgggtccaccgttgccgagctcaccgccgaatccaccgtcgcgtcctccacaccactggatccaccgccgtcgtcccttccctccactgacctccccaccaccagatccagcgccgctgccctccccaccgtccgctagttccccgccactcccgctctcgcccaccgccgatggagagatgaggaggaaagaagaggtggagaggaagcagtggaggagatggaggaagtggagggtgaggatgaggagagagaggggtgacttgatattttaagggtgagctcgatctggtagactggtagcaggcgggcctattaacatgttactttcactattaacatgttactttcacaagtgaacttttaacaaacacacttgcaaaaattgtcttttgcatgcaatttttgaaccattctcaagggaacaatttttgtaggaggtagtagttatggcatatggatggttattgatttttttaagtagaaatattgatctatatgtgatatttcgtttttgcaagtttcagatctcatctaaaaaatcgcacgtactgccgagtagatcatcgaccggcgccggtcggcaagattattatacgatcgaataatgtttcgatcatgcgtgcatgtgatctgtgtacgagctactggctacgcatgcaataatctggtacgtaccaataagcaagtaagctagaggctggccgactgtgtgtggccagactggttagatttgtggctatgtggcctactgtagatgacgtacatgcatactacattacgtgtacaatactattaaacacatgggattgtctggttttttaggcacataaaaacactcacaaattgtagtcacgcctaaatcataccaatatttttggataaagaataattttatatcatgcaattctttctccccacaacgtgccatgttagtgtgaactcgcctcacacacctcaccccatagcgctgtcaccaagcttgccagggccggaagctctccagcggctcttccccacctcctaataacctctcctgatttgacgctctctgccgtcgaccctgcccatctcccccctctagccccatagacccaactacgtacactactgtcacctcgctacatgctcttgtttgccatccaccatgaatccacccgtctccttgcccatccctttaagcctatgggagtggaaccactctcttccaccagccaaaatccccacccccaaaaccttaagtctaatccgtgggtcctctatcatagttaggtgtcactcatgatgcggaagatgaaaagatcgtaaagaagtttgatgttgtcatcgttgttaagccatggctaccatctccctttatctcacctcttttcttgcctccccttattctagatgctgcaggtgactgaaatttctcataaatttgaccacctgaaacaagcaattcactaagtaaatttaccatttctacggacacgttttttaacatgttagagttcagtctcacattggtggtgaaagtacaatatatcttgtttaaaagttatcccctcaactcgtaagctagctattaaaaatgtgtaaggtattttaagtccttcaattagtatcagaatatggctagttcaatgcatttaacccaatgaacattattagtatgagtgcaagcggtgccctgatggtacaggtgcatataaaatacaatcgtttctatataaacaaggtttatgagatgtatatcaaatatagttctagtgcttgtggtgcctaacagtatatatagttatatataaaaggaaaaaaaagaattacccctaaactatcgaggtcaattgaattaacccactgaactcaaacaccagacattttacaccattagctatgcaaaccggataaataaccccctttttcaaaccggagtatagttttggtcctatgtggcaatccagttagcaattttatttttaaaatccatgggccccgcatgtcatactctccccttctctatctctttaatccccatcctctctctcttctcccttccctcacctccatctctctctctctctctccccaaactgagcagggaggactaggccgacgacgctgcttagcggccggtggcaggaggggctcgagcccgtgtgggcatagccgtggccagtgatagaggcagcaggcgacgcatgaaccggcgggtcagcggcgggcgacacttggcagtgtgataggtcgcgatggcgcgcggcttgggcgacaccgtaggtgttgcccctctctgcgtcaccttgttcccatcggaaaaatcggtgctagcggtggagaaattaaggatgtggttgcggcgttggcatggttgccgagcttacacctgaggatggtgccgccaccactagctgaagcgctccaccttgaagcaaatccggtctccgccctcatgccgagcccgcctccctcacgccaagcccgcctccttcacaccattcccatccatggagagagcagagagggaggggagagagggagagagcagagatgaaatgacaggtggaccctacaaatctattactattatttttctgactggattgccacgttgacaccacgtgtgtaagctcttggtcaaaaccgcccaaaacagtcctggagggtaattcgtacggtttagaaagtccagggttaaaaatatatggtatttgagttctaattcgatcatcctcgatagttagagggttattcgtagtttttctatataaaatacaatcatatttttataaataaagttatgagatgtatatcaaatatagttttacttttacaatctgatatacacaaattacaattatatttttgaactagtttcatataagggagatcacctatcaatttgtaataagataataagatgaaattgacagactgaccacaataaactagtactcctatgtcttattggttttttttaagtggtacactggtacaaatacaaaaaaaaaaaaggactgtgcaggaatagtccggtgcctctccaagctagggattggggatacgatcgtcgttgtcgtttccctgtacgcccacaggaataatacagtacagtactgtataatttatattgctttctcgtttgtttttcaccgtggaccggacaagcaacaaagggacgacgtgacacacggtcgtccgtcccggcctccacctctctctgtccctccctcctcctctcctgttcatcggtccattccgacgtgtcacgcttacacttggcgatggcgacacccactacttagctcgagagcttagctccagaccggacgattcttcccttagctttcatttgtcccattcaaacgcacacgcgtcgtacgttcgataatataatctagttaatctgtcattattgagtaattgatctgaaacacactcagatacattcgatctcgtgctgattgagctctagctaatccagagagaatctctcctgccacacctgcaagttaaagtaacactgtgtatcccactcatatatgcatgcatctgtcgtgtaagccacagctagcaaaactgaaaatgccatacttatgaagtttttgacggtgtcagtttcccctaaatcttcagcgcgccagacaaagatttgtacttaaaatctaagattcgatatgtaggtacaatttttttttaaaaaaaatctcatatagttcaaatcttaagaaccctagaattatcatgttctttcttctcagaaatccagtttttctgtattcttatcagctgcacgctttaatttctcagaattagcaactccaaacaagcaggatctcggaaggaactaacgaccccatcgtggaataagccaaacggtatttttacaaatgaaaagtaatggtaatttgtaaataaaattttttatatacgtgttcttagagatccaaaagcaacaactgaaaaataaacttcgatgaaaaaaaaccttaaaatcaacatcaaatttaaattttggctgataagtaggagtatgagcataagcaaacagacgagatcgtaagctaagagcaggtacaatagcatagcagactataaacctgctataaacatattttaagaagataaaagatgatatataaaagcagtggactacagatttgtagtcagctgcagcacggactataagacgtatgtgtgtatgataggtgataccagatattgattgtgtagtatatttttatataactattgtatgaattgactattaagttgactatagataatttgaagccagcggtgagctataatattaaacttgctctaattaagcaataactcgcgctttcaactgacggagtgggtgcgtgtggtgggtgtgcgcgggcgaggcacacggctttgacccccgccccgccgggcgcggcggcgtgggtgcgtgttgcaatcaacaacggcaatttcttcggccgctgccgctgccgcttccgtccacacacgccacgccgcccggccgcgtgcgcgcgtcgacgtcgtacgtcgatcgaccgcgcgccgatcggccaaagccggtctactctcgaatcgaataatattacgcatggttcgatcgatcgatcgatcggtcggtcgtcggtcgattcttttcttctcagcaaagacacggcaggcagatgcacacaccgaccgaacaagaaaaaaacaaagacacgacacgacacgacagatgcagagatgctactactataggagagtaccctctcccccatgtgcacgctcgtgtccacacatgcgtgtaagttaattattggacgcgacttgtcagttgccatgcacggccaccagtagtactcgatcgatcgatccctcaggtactaccacgtttcaattcgcgcgcattctcgtagacgccgagaggccggccggcggccggatcatccatccatgtttcgacagtttgaacatcatccatcacaccagtagcttagctagcgagcgcgacgacacacaacgtgacaagaggcaacgacacatgagctagcgcgcgcgcgcgcgcgcgtgcgtgcctgcgagatggctgcgccgccatattcgcgcgcgcgtgtgtgggtgcaggcgcattggcactgtgcataggtcgtcgccggctggaaaagagtagtagagtaccggccggtgggtcgttgcccagctcgttggctcgtgagaaaatttgctatattgtgccgtctccagacacgggtttcatcggaatgttattctgcggtttggattcgttaagttgtattgatgtatagcgagctagtgaaaggtatgtaaatttgcaattgcctcaaaggtatttggtgttgggggcgacgagtacgtgtagtacgtgtgcctacatgttgcactgcgcgcgcgcgcccacggtacgtacggacacgcagagaccctggctggtagggactagggacggagagccggagtacctaattacgtatacgtacggaggggctctacgtacccgacaggtgggtccccgttatgtatgcgggccgatcgtcagttcgtcaccggaggtagagcgatgatcattcacgtactacataatgactcagtctcagtctcataaaaaaccaacataatatcggatatgatacttttaatactatgaatctgaatatatacattatattcggttctagattcgtttttttttataggagggagtgagtacgtacgtgcgcgtcgctgggtggccgggttgttgggttgtggtttgtccgccaccacgctggacattttccggccggacggggacggccggccgccgggcaatggctcctcggaccggcttaattgcgttgtcggccgcctctatcggcacaaacatatgcgcgtacatgacacactctgcctctcactctctctttctgctgccctctcttctcctcgcagtggaactaatcattctctttttgaaacaaagtggagctaatcattgctggtttggcgaggtgttggccttgcttgggaaacccccccaatctcgggatgcgctcagatcgaccctcgatccatgcttgcttgcttgatggttccttgcatctctctgtctgtccactactctgtctctctggtgttcctctcgttaatttctctgttttcttgttgacacctcgcaatgtagtgtagtactactagtagtagtacagtacagtacagtacagctagtatatttgttggtgacacgtttaacttaacggatgggagcacatagctttgcttttggtaattagtagtacctccgtcctaaaatgtagctatttctagcacaatactttgtcctaaaatgaagttatttttctacctaccttctcctctcaaccaatcacaactattctttttcacctattttctcttttcaaccaatcacacaccttcttcaatcattctcacctacttttttaatacccgtgtcaatctcaaaaatacttacatttagggacggatgaagtaattagagagcttgatatgtaagtacatgtaattgtataacggatatggaccgaattaagacggcggagtgtggattggtggacggacagtggtcaacatagtacgcgcgtccgttgtccttgtcttaagatatgcattgttgattgatgaactgcaatataatggactgtgactgaactgagatatgctcggatttgatcgggtacatgaacgaatttaaaagactttttgctgcgcctttaatttcgagtcataatgtagttgcattgcagctcgttttcgtcatgttcttttcgtgtattaggaccacagttttcatccattacactctagggtcttaaaatatatatgtccttttttacttttcaaagtatacagttctttcgcataactaattaaaaaaacagtttaaattgcaaccagtaaacagttttaaaccagacgagttttgctcctgcatacacgtggcactgatgatgttatctttgatatccagctctttatgaaggcgtctatcctggcatgcacaaagactgtctttatgaagaccatttcctagactctgcttgtgtaagcgtaatccctggaatgttcatctgtctttaaaagactatgtgtaatgggaacatatatccaaatatccaatcacatctaaaacgactagttttttaaatgacatgagtaatttattgacgatcaactatactcggtgataggttattgtttggagcagagttaccgttgtacgagttttttttttctttttcttccttgttttttaatctttgttttttcctctcttgacataggtcggtctggctgagtgtgtcgggtaaaaaaaactctattcttctaatatattcagggctggccctaactttttggtggcccggtgcggaaaaaaattcaccattaaaaaaaagataatatttaaaaactcattgtcattaacgaatttcacactaataagtttaaaatacaatcaagcagtcacgatatactcgatcgtcgatcggtcttctgtttttttctctaagcccatcaagtctaataccatagtattaatattttggaggcccctaatttttggaggcccagtgcgatcctgtactgccctaaggccggccctgaatatattggcgtacaattttttttgcgcgttcgtgaaaaagataggttgttgtttggctacataaattgtttaatttcgcgcgcgcacctctcggtacgttcaacctgcaggaccaaaggcgtgcgtgaaacaggtcgtggtaagctcgtagtggtgtcgatgcgcggttcctgaaagtacgcacgtacgtacgcaggctcggtgctttgcgaattgcgagcggcgtccggttcccatctcgttcgtacgtgcacgcacgcaagagaggacgacagtgttacgtactggcactggctatatctatatagtacagtatatattttgtacagggactgtgtgttgcatgcatatatgcacgcacgcacatatgtaagtgtatcattacatatttatttacatgcgctagctacgcaactggatacgcacgtacacaatgcgctactagaaaaaaaacatttttatatgtggctgtcggtgaaaagggctcgggggtacgcacagtcgagggaagtatccttctaatctaagtcgcgtgaccacgtggcctcgttttcccccgcccctcgggtagcgctgaagtggccagagggcctcggggtgtcacgtcacacccctcgggccttcggggcgtgctaccccgaggcccttgcccggcaaccacgtggcggggagagcaggcggggcgagaaacgctgctccgtgccttcaatgcgcggcgtcccaaccgtcctgcgccgcatttaatgcagcgtgggaggacgtgcggcgccgctcgattgactcatgtcaatcaagcttgaccggtccgtgactagtcgcaggcgatgggacgggtggaagtgcccccacgttccgccctgtgtcaagcggagtaggggcaggtacgccccgtcccattgataacaatctggtccaggtggggttggccgaggcccaacaaattaaggttgtccggaccccaacagttcttcggcacacgcactcggggaaaggcccagtatccctaaaagactagtccaataggggaagggtggctctcccttttaaggtggcttcatcctcccaagctaagtaaggtgggattattcaaagactcacagggttgccgcccgactttggcgtctttgccagcgggtaatagtggaggatgtcctcatcattcccacccccttaacaagggcctagctctgataccaaatgataacaatccggcccaggtggggttgaccgaggcccaacaaattaaggttgcccggaccccaacagttcttcggtacacccactcgaggaaaggcccaatctccctaaaagactagtctaataggggaagggtggctctcccttttaaggtggcttcctcctcccaagctaagcaaggtgggattattcaaaggcttacacggtcgccgcccgactttggcgtctttgccagcgggtaatagtggaggatgtcctcatcacccatcgacacactaccaggggcgcccctcacgcgcatggtgagccgccaaagtctctatgcatttaagagggaatgacagggatgtcccccgtatcaggcggagaatggtgctgggccccacctgggggcgctgaaccatcttgcttccggttgaaggcacggagggcggtctgatccaggataggtggatccccctcccatggaggagtaggtatggacggtgcatgtggtatccccttgaactataaaaggaggaccgtcaccaccgaaaaaggggatgactctcagataacttgagctcgaaaggaagaacagttgggtttcccttaaagctcaaaacctcttgtaaaagttaaccacaattctacacacaggagtagggtgttacgctcgatagcggcccgaacctgtataatctcctgtctttcacagaggctaggtagtgatctagcagctagactgcaagcggaagtacgctcttgatcatcgtgccatcttccccggccgaactaataaaggggggtctcacgaccgcccgctagagaggatctctcctcgacaatggccaaaacatatttttgcaggcggccataacctccgcctgcatccaaacgccggcggaaatcaatgatttttgcaggcagctaaatctacccgcatgcgaaaatattttcagcgtaaaaaaaattggctgcccccagccctacccgccgccgccctcccctccgaccaccaccaccacgagctgtgccaccacgatggttttgagagggagagggagggaaagggagctgcgcgcgccacaagctcaccgcgccagcccgccgccgccgctggccctccccacgacgtagttggatccgagaggggaggggaggggaggggagggaagccgccgtccgaatctgggagtgggagtgccatcgccgccgccaatgatcgcgtcgcctcagccgccgccctccccacaacgtagccggatcatatccgtgagggaaggggaacgccgatgacctcccgcctccgccgacaacctccggcgcctccaccgctgcatgcagccatcgctgcccttcctcacaatgctactggatccgggatgggaggggaagggccgccagccggatctaggaggtgggaacgccgccgccgacctcccgcgtccaccgctgcatgcgtacgttgtcgccgcacggccgtgcctcgccgccgtccgccccgcgccgccggccataggcctccccctgcccccttcaaccggatctaggagggataggggaggcaaggcgcgtcaggggtggatgtcaccgcccccgagcgtcactgtccccgtgccttgtcgtcgtcgacgccaacccagcgcctcgccgtcgtggatcccgccgcccccacgcgtcgccgtcgtcggttcccgccgcccccgtcgccgaatgcccacggtcgctgagggagaggagagctgagggctgagggagaggagaggtgagggagacgagaggataggacttagaaaaaaaatctagtgatgtcgcgtctatttatatttcacgccaatttttgcagtggtctgcctgcgaaaatagattttcacaagcggatagcgagcttcacctcgtttacatttttgtaggtggtcatttaattccgagggttatgtccgcctggaaaaaaaactcacgtctacaaaaatgctttttctaagtagtgatgcaaacgctaggcgatgcttagctttcgagctagcgcattgtccattggattcacatttatacgtgcacggtgaaaattagaactagctgatgatgctcactcgacacatgtcattgcagattattgcaccggccggccgatcgccggccgtgcgaggaagaagatgagatcagaatgaacgagccggacgtacaccgttgccgccatcgccggcgaggagagatctagagagagagagagggaggcaggcggatgaggaggtacgaatgttactgtgctggagcagcgtcatgggagatgtgaaggtgctcgcaccgacgtaccaaccacacacgcacagtgccccgatcgattcatcgctgcagtatagtactataccactgccgccatgctgcgcccccccagtagtgcgtactacgccgtccgtcctgatctcaacacacacgcacagtctctctctctctctctctctctctctcggtcagtgctacctcgagggctataagctaagccccatgcatgcattcatgcatacgcgcaacaagacttccacgcaccaggtgcgtcaacaggacgatattgtgtgatctagagagagagagagagagaggggccgggccggccgaccgatcggtcccggccttcttacaatctgtcagcgacaaaactggtagataccaaactcactgttccttcactttcacctctctctcctcatcctctctctagcttgctaaacggcctattgcagctagctagcagctattgcctgcatgcagcgtgagatcgatcatcgacagataggtagagctggacgagtacagatagatagatagatagatagatagccagtgcactcactcactgactcactcatcgaaagagaaacagagaggcttacctgcacgcatccatccatcgatccatgcaatggcatccatgcgttgcatagtgcgcggccggtagaagggagtagtagtggagctgtgagctgtccgtccacatgccctgtcgtcgtcgtgcacaagcacagcccacgcacgcctgttgcatgcaccaccaccaccaccccgtacgtaggacaccaacggcctcaaccggcctctctctaggcacgaactctctgtacgtgtgtggatcgagactatagtcacgtgaggactgatcgaaccgtgagtttgctatatggtaaacttatcgtccgtgttcaatccaaagcattagtttgaatcaattttcgttgttaagcctctcagccacaaaaaaaaaagcatgtctacttgatacaaattagaattattaacaacatatttaaacttggcggctgtttttttactgccaagaaatcagttggccgttaaaaaaattacggatgcttgtagtgattgttcttggttttgcatgcatcacacatttggcaagataaagaaaaagctaggctaagctagcttgctcacactgagatttttcttttatttacctcgagggataatctggcgctcttggtagtacggaacgttcgatcggacggttctggctggccaatagatcgatcgatcaggcagacaccgttcgcagcacagaggcaacgctagctgcacccggctggccggctcccccaccgtggggcccacaggcaaggtgggtccacgtgtcaatctgccctgccgaccgatgagcagtggacggccgatcgacgccttgtcgttttccctccggggaattcttactcgtgcatctaatctactagtagtacgtactccgtccatctaattgattttggccttttccatttctccgtaaatatattatagggttttaaagtactgctttatcaatctatacaaccactacatttattgcttctttgctcggcataatcttttccagtgagtaaattttcaaggaaatcaaaataatttcagtttaaatcttaaatttcggtaaaataatatgcatggttaaatccctcgtatttatggacggagtattatgcagtcgcactgcttaattccgtgcgtcttttcctggggccaatctcacgggggacccccagcgaaattatgcaaaagtaccagcagtgtagtataaaacgagagcaagaggggacacacgagtaaaaagaaaagaaaagggaagtgactgcaacaacagcgggcaattgttcttctcgggggacgcgaaaaactttgggggcctcgggattctcactgtctacctcagcaaatttcttaattttagctatagctagctagagctaagcatagatggatgagctagaggtagctagctagccagtatctttgttcggtttgttgctactcctacatcgactggtcatttggttgagataatcacagataatataggggtgctgtggtgtgtatatacacccttcgttctaaaataaaccaacttaaaaaacgtaactcctattacaacaaatttagataaatattaaatatttgtacaaattcgttatactgaagagcaacgaatctgaataaatattaaaattttattcagatttattatattaaaatgaatatgaacaaatatcaaaattttatttagattttttatattcgaatgtgacacatatccttctggtttgagttttttttatgaaggaagtgtagcactgtgcgagttgatgctttactgtttggggacttgtagtctatcaggagcggccgggtcctaccgtgggattgtacattgatctgacagcgtcatttatgcacatcgatctaagattgacgtttctagaaatcgagttttacgttggttaatgaaattaacactgtggtgtgttttctccatcccctaaaaactaatctaagatgaacatgacgatttctagtataataaatttaaacaaaccttcgtacaaactgcagcgtagtttagatgtataagttgtatattcaccgagcttgagaagtgagtttactaaacaaagaaaatgatgttagggaaactaacatggtgtactgcaattctctgggacaggaaaaatatcttgaccaagattgaaatgtttatcaacagtaactttttttaatacagtatgtcattacagtgcatttctctttttaagtacagctccagccaacttaaagaaacatagaagttgggtacctctaacttaaaaaaacaaatatcatggagttggagttgcggctaaattaggggaatgagacattttgttcatgttgataatgatattatattgtcaatcacttagttttaagttacaaactccattttctgcaaaagtccaggacctttttatatacattcatttgtacttaacgataacaataaccaaataataaatcatgtatatgattatatatagtcaaattgataatagagttggatcccggagggcaattaagaaaccatagacatatcaaattgatatttgaaaaccaatggcacaagatagggctacgttgattttatggtcttattagtcatcaatgaagtcttgagcaggggtttgcaatttcgtttttcattttccaaaattcagggacgaaagaaatatggagtttaaaattcagggacgaaagaaatatgaaattcagggacgaaagaaatataatgttagtgagatacttctacataaaatggcgcccacaaatatttcatgtttgaattgtctaagatgacatctaatttggaattgatttagtacaaaacacaaatattcgaggctttttctgaatctatgatgtaagaataaagtagtcgcaatccaaattctacttttgtgcgtaacaattagtaatacacaaaaaataactaccctcacatgccaccgacaccaagtatatataaccatagtgcaaattaattaattaattaatataattattaatatatatatatatatatatatgtgtgtgtgtgtgtgtgtgtgtgtgtgtgtgtgtgtgtgtgtgtgtgtgtgtatatgtactcaacataatgctgcacttaatacgaacacaaaaaggggagtcccttgcatcacaaaccagtgatattttggactatgatgcttcctcaagggattgccaagaccacaaattaacctttgtaacaaaattggtagttacatgtcaaactttacctgctatatatgtaaaacaacctcccattttatcatttgcgtgcttccgacacaacgcatgtccatatacacacacgtaccctcacactcgatataacgctatcaaagttaacacggctcgacgccacgcacatacgcaccacacaaaaattcgctactagctagcacagtactagtagcagttagtacaagctaaaacacacttgatcaataacccaagcccccccaggctagctaagctaagctaaccagggaccacggcacacacacttgcataccgtcagtttgttgacaagctagcacgcacaaatggtttgtagcaaccgcggcgggcatggccagatgctatcacgactcgaccaccacaccactggtgctatatacaaatatatactaactccaactccgctcgatcaatccccgttatcgatcgaccacgctttctacgacgacggcatcgctatataactaggttttaaggctacctctcaatcttcctcttcttcttgttcgtctccccctcctcacccaccctgttcatctcgcgtgtgtggcggtggtggtggtattctctctctctctctctctctctctctacttggtgaggaggaggaggagagtggtggtatcgccatcagagctcaataatactagtgcacgctcgccttgttttctagctcttgtcagcgaaccttcccccctgaaaaccccacccaccccctcccctcctcctcgtctgcttctcgctaccctctgtgtttgtgtttgggtttgtttgtttctctctctaggcctcgcgcgccgtgatcgatcgatttctggagtgatctgttgtttttttgtggagttgtgtgatctgggagatggctggagcggggggtgcggctacggctgcagcgggaggaggaggtgggggaggggtggcggcggggaggagtggaggtggtggtggtggtggcgcggcggcggcggcgggggcgggggcgccggacccgagggcggaggcgctgcggtgcccgcggtgcgactcggcgaacaccaagttctgctactacaacaactactcgctgtcgcagccgcggcacttctgcaaggcgtgcaagcgctactggacgcgcggcggcacgctgcggaacgtccccgtcggcggcgggtgccggaagaacaagcggtcgaggagcggcggcgcggcgcctggtggcggcgtggggaggggcgggcctggaggcggggcggcggcggccgtctcgtcggctggcggcggtgcagctgggacttcgcccgcgtcgtcgctggcgctgccgcagccagggtcgctgccgtcgctgtcgtcggcgctggggctcaccgggggaacctcgctggcgtcgctgctgctcgggagcggcggctccgggggtgaccacctcgggctcttccaggccatgcagtcggtggtgtccgacgcggccgcgttcgagatgcaccagcagcatcagtcgcaggtggatcacctgctcggcctcggctacggcgccgcgggggcgcagatccaggcggccaagccgtggctgcatgacggcggcgccaccggtggcctcctcgacggcttctacgcgccgctcctgtccggctccatcgtgccggggctcgaggagctccaagtcaaggcggaggccaccaccggcgaccaccagcagaagtcatcggcggcggcggccggtgagcagagctgggacctgccgacgccgtcgtcgtccaacgtcgaggcgagcatcatcgcgtcggacgcgctcatggccgccgcggccgcgtcgatgaacccggcggtcagcgccgccgccgcctccacggcgccgtccgcgcagtcgctcctctactggggcaacggcggcattggcgccgccgccgcggcatggccggacctcgccaactgcggatcctccatagcgacgctcttctagctagcccagcctgccgcgcgcgccgcctccacgccgccgactgtgctagctagctagctagctcgtcgccgttcgccgtcgtcgttaactctattttttttccaccttaattttccctgagttaatttcccgatctcttgactaaaaaataacatgtaatttgtggggaaaaaaaaagctgagatgagagagagagcacactgtggagagagatagagagaagagaagagaagagatcatcatcatctcataggcagaaaaatagctagctagagcagccaattcaacaaccaaacgaagaacccaaaaaaaattcctgcaagatttcatcgccggtggtcgatcaagaaggagatcaagaacacagatcgactaccgaccgcgttcttcctcgtctccggccggtcgatgatcttggaaaggcggcggcgagcggaagatcaatttgggatgcattgatgaacaagaaggaaggagagatcaacaaaatcatgggaggagaagagaagcaaagaaagtgtaagtgcactagctagtgttgctactacttgatttgctagctagctagctctacttggcttcttggcttcttgatctccttccttgggtggtatgtagtagcttattttgtatatagggcatacggtgtggggggatagatacatgagaagagcttgaagttcttgcggcatatccatggcggtgtggtggtgcaagaacatatatgggggaccttttctctctctctcatctcggcattttaatcggtgtgtttaattggttaattaccctaccttggctttgggaagtactctagatgtataagttataatagtactctttagatcaccaccttgcagcataattagagaactgtttttgagttctcatgcattggacttgttaagggtcgtccaattccttgttcctcttctagagtgaattttttctcttctttcttttctcattctcttgggggtttcctttgttcaaaactttgcttgtatcattgatgactttgtgagctatgagaaattaaaacttctgtttgttcattctgatggatatatattgtgaatttcttttcacagattaattaatttgctcatatatacatccctcctctgtgtgtacctaggattatagttctcttcacacatggatactccagatacatatatgtatatatgtagtgtgatagctagctagttactccatcacttttagtgcatggatggatgcatgtctcactttagtgatgctcttgcagctttaacacctttgttagctctctttttcatggcgacggtgttgcgtgatctgatctttgaattctgcgctggctggcttcttctcatggatgtgtttctttctctcctttttttttctgccatggatcataggattctccagtagtggtgatgtactcaaatttagtgctagtatcatggaggtgttgctagcttctggtcagaatctttttttgtgcatgctcttggctgctggagaggccaaaaacatggctgctttgcttgttcttacctgcatgtctcgtagcaactcggagacgcattttgatgcatgctggctatgttcacaccaactgctaggtaattacatatatatagtacatatcactcaggaaagggaaaggtagatagaaacaaaacaattaaatggggggacaaatggagacaatttatgtggagatgcatgcatatgggggaaatgggaaaacgatttgatttggaatttcgtttttttttaaatattgttgcttcagctatatatgtgttttaacttaattatagtagttatattaattatgaattctcatctgagtttagtttgttccttttttttaaaaaaaatactttgatgcttgttccaatgtgctaaatttctttacttctaggctaacatttgtcaaaaatgactttgcatttttttaaaaaatccaaaatacaaaggaacttgatgtcgccgaatttaagtatctcctttctgggccaacacctattaccttaaaaatcaccctttttttttacatatgagtgaaagaaattaattatttgacactgaaagaaaattagccttctgaaataggatgggttttgcattactaattaattaattactgacatggttttaaaattaatgttgaacttcatctagtatatataacagatcttacatggttgagaaattattttaggaacatataaccggtataagctatctatacgtctagcacatatatgtacgtactatataagctctagctagtgagaacatatatctatctatgtatcaaattaatttatttaattagcatgaaggtcggatatgtgatggacttattcagaacctagct

SEQ ID NO: 62374 - DNA, 703 bp, Oryza sativa
ctccatgttaaaaatcatttgttgacaatcttaagacagtgttgttaatataaaaggaaaaatcatacaaataacaattcagtgcttaatgatatagggcatcactttctagttagaaaattaaaaaaaatgatgaatttgctgtatattttatttttgtatggagcaattcacgtaccatatgcatttccaatctcattgatgctcccaaacattgtaacaaatgcaaggcaagaaaccagcaaaaaccagttcatcattgggatatatatttgacccatgaagcttctagaagtgtgaataatcttgaggcggggaaaacagccgagagctgtggcctgctttattgttgagaatatagcagttgtcattgtgcgactagcaattatggctgctagaattgctatgaataccactggccaaaatgcctgatctgcgacacggaatgaaactatttagaatttaggggataatagattccatttcattttgtgtgaaaacaatccatagcaatcagaaaatcagatttaaaagaggtacatagatgaaccagtttatcttactcgggatagataaaaagaagacctgctgattttctgttagattttccataagaaatgcagcttgccctaggtaacccagtagcaggcatggaagaacaagaaacacaaaggtaagctgcaacacattagacatagtaagt

SEQ ID NO: 62375 - DNA, 4749 bp, Oryza sativa
tatcggatgtatttcttcgatattttgttccccctctttggtgtgatgttttctatgattaaaatggtataccatcttcttgatcaagtgtatactcgttaatttagtgctggtattcttcctcatctgctgcaatattttaagatgatggaaatggctgctgttaggcgcacaaccaacttcatctacgtcatttcgattcaattttcctccagattttgtttctttatttttacagttgattagatgagtagttcagttcctgtttcacaacgtatcttttttgttcaggtaaactttgatggtttcttggctggttgctgctgtccttttgtaccttgtatgtggccaatcctggcattttgctttctccttattctgaagaaaatttaaagcagttgttcctagtgcttttgctctttgtggttgcagttctcttcctcttaagggtagagctcacgtcatctgtttaaaaacttctacagttttttggtgaactttagtgaatcaaacctggtatctacagtttttcccagccttattatcatcatgcctgatatatacagtccttttgattaccaatgtcaaagtttccagattctgtgctagttaattttttcatttccttgaggggaacaaagtctcaattacatgttcagttgctcatataagcaatagaccgctcattgaggacttgttaagttgttatcaaacttatgcaaattcttgccgtacttaacctggatgcttaaactgaaatttctctgcgagcaattcttggattgtatgcacacttaccacataacattccttctcttaatggaaccagatggaatccgcagaggcagaaccaacaaacaaaagcgtcattcaggtaattattatttatcaacaacgagcaagcgacaccaatttgctgaaccttcctttggctcttgtgatatatagtttgtacctaaatcataacattttgatgctcaaacatacagggaacccatgaactaaccgtatgccagacgacggagagactcgacacatggaagctgaatgagcagcagcaacaattggtcgatgcaagcgggctcggcaacctgatacacacagcaggcctagtcatcgatcgcatcgcgctcatggcattcttcgaactgtggagcaaggagaccaacactgctcagctcaatggctttgaaatggcaccctcactcagggacgccgcctacatactggggattccggtgacaggccgtgtggtgacaaccggagctgtgctcaacaagtcggtcgaagacctttgcttccagtatctggggcaagtgcctgattgcagggactgcaggggcagccatgtgaagctctcttggctgcaatccaagtttagccggatcccggaacgccccaccaatgatcagaccatgtatggcaccagggcatatctcctgttcttgattggatcagccttacttccagagagggacaggggctatgtctcaccaaagtatttgccacttctgtcagactttgacaaggtacaggaatatgcttggggtgctgctgctcttgctcatctctacaaggctctctccatcgccgtggcccattctgccagaaaaaggctattcggtagcgcggctttgctcatggtatgtttaacaaaaccattgtataggaaaatatcacttgaatttcgagtaggaaatgatcttccagttctatgaaactatcaaaaaactattttgattgttatgatctgttcatgttttctgaaaaggattaatgaacttcaacatgagaattgtaattgatagtaaggcataaagatgataggaaataacaaaattctccatttttgtttctcacaaaattttaccttacagaccaagtttgtgacttgtgccttcactgtgtccattgcgaaaatgttctgatatattctgaatatctgtctgtagggctggatatatgagtatattccggcattgcgccctgacatgtatgatcctccagaacacatcttcccacgagtactcaagtggacagggagcacgatctctcaaccggccaagaacgtttcagacatcaggaaagccttcggcctgcttcaagtttctgatgtaaaagtctatccatctgagttgtgattctcatcagtcatcaccacagttttgtgttcagcatttcatcctttcccttgccatttgatttgagaccatatgatgatatgaacaacaacttcaggtcaactgggagccctacaagggcgttgatcctgcatccattccgaagcattgcgctgctccggataacctctgcttctccagaacatggctggtcagcttcaacctcaaggaaatctacgccccggaccggttcgctcgccagtttgggcaagaacagcatcgcccgctcaacgatgtccccgcgttccagcggcagctgtggaacccggcagtggactggagcctgatgtacgcttcagagatcgaacggttccagcagctgatcaacgctgcagatggtggtgatcatggtcatacagcagatgccgccgccgccgccgccgcagatgttttcactccggcgaccatggcgcgagcttcccttgggctcagcctgatatccgtggtaaaactacctgtcggtgaaacacttttaatcacttaggtggacatctacccttttgctacatactatcaactaaatggttataaaaaaattaaaaaaaaaataacaaggtagattcatatgtaataatatgttatcctacaaatatgcaagctcaaattttacttatttaaattgtaataaaagtagcaaattaaattttaattagtatagatatattcgcaattaactttgttatcattgttacaactacagaagtcgaatttgctggcatgtttgttatcaatctatcttgtcattttttttaaaaaaatcatagtcatatagctaacgtataataaacgtgtggacatgcaccgagtgattagattagaatccatctccctaacactcgtgctgaggaagctgtcacattgacgtgagcgtgtcatcgcggttcagttcgggtgattgcatcgtgcgtttcgttgttgtgatcgattggatcggttcatgcaggtggagggcgtcagggaggagctcccgaccgtcgcgcggtttctggagcaacaccgcctccccgccgagctggcgacgtccctgtccaggatccgcggtctcatcgaggcctcccctcctgctccgccgcttaagcgaggcgacgccgcgccacagccccagccccaggtgatcgcggtgatccctcccctggctgtgatgccaccgcgcgagcaggaagcgccgcatggcacgggggacgcggaggctccggggatcgtgcgcggcgacgccgacgacgacgacgccgtgccgccgaaggagcggtctgatgagcagcagcagcaggatgaggaggaggaggaggaggaggagcagaagtggcggcggcggcggcggcgggaggaggaggacggggcggcgaagggatcaggcggcggcggcggcgcggtgcggcggagcagccggagctgcgtgcaggcgaagaggttcaggcgcgtgggagggaagggctcgcagtcgtccgaccccatcgtgctgtgaatctgcggccgctgctctcatcagctttgctactagcctaccagtagtgctacctttgcagtgaactacggttgtgttcggtgtccatgtgtcatgtgtgttaggcttaggcagacggtcgaagagctctggtactggtacttactcctatgtatgtcgttgatcgttgaattcaggttatgtagcatttgatttgactactatggatttgatgactacgctagatttaaaaataaaataagcattgaatttaaatgctactccctctgtcccaaaataaaccaacttcgtactaggacgtgagacatcatgttcatttatactaggatgcgtcatattctattatgaggttagtttattttgggatggagggagtagtttgctagcgaatctcataagaatctaaaacattgtgggcttgatcgaccgggattgttgttgcgactgcatcaattgaacaccgtggtaggttatagctatttttcaactgttgcaggaacaatagttgttgataacacctgataattcaaaagatgatgtgtttgaatgactaacagaaaaataatatttgaatttggattgattctaaaggagagagagacagagagaagacgcaattgacttcttaagagcatatacaataagatgaatcagcaggctccaaaaactttaatgtcatcatattcctaggtggagggggagataattaaggaaagagaagagagcgagctataaatctggcaccgggcggtagcacaacttcacatgtcaaacaacttgcatgcagccagtactagcgattaaaaacatgttttgtgggtcccacatcacccccatttgatcccatgtgcttcgtctcacttcgcccttgtgccagatccacatgtggcgcacacaagatgggtgcccctgatgtgcgccatcctcttcgctcctctggcgtacgaaaaaaaaaaaatcgttgcctcggcttcagtagatcgacgttggacgcccgccctctcacaccgacaccggtcgtcccagctggcagttcaatgtcgctccagtcgatcccgacctccgtcattgctgtcaacaccggggcggcctcaaacccaaacc

SEQ ID NO: 62376 - DNA, 1412 bp, Oryza sativa
ttctcggtcaaatagggcgacgactttagtgtggatggtggtggccacaatccctcatgttactcttccaccacagccaataagagctccactagtggtagtcatcggcactcacctacgctcgctcgttcattccggcaccccgtccgcggccggggcccacgctcgctcgttcattccggcaccccgtccgcagccggggcccatctcccgcgtcttgcagctacacaagatgtggaagagaaaacatcacaaagaaaaagtagaggatatgtttatactaggaaagctgagattagaaaaagaaaagcaatcaaaggaaaaaataaaaatgaggtttgaggtcatgggttaaattcatatggaattaacgtataggaatgtgattcaaaggaatttccatacttcaatcttacgttaacaacctagataagaaaaaattctaaggatttggattctcaaaattcatatgaaaattctttaatccaaaggtgccttaagtttgttgtatctcctcaactctttttcccttgagagggagttattttatacggttgtaatcacattaacgctgttgtacgatatacacgcacgtatgtgtcgtgcgtgtaatttacacacatttaaatattgtttgaggcacatgtactcacctaccaaacatgcatttgtgtaattactcaaagattattgatatataccggtggtaaatcggatttgaatctttataagctagatgcacaaccacgatatatagacatgaagtcatgtaatcacatcttagcttttgagtccatctcaacttgtatttggaattgttgtttgcttaccaccttataggatggattggaaaatagaaatccatcattgaaggtgcaatttatgtccagccacaaaaggaggaccattgtacaattcaaaattcaatccaactactcagtatctaaaggggttgatgataagtcagcttcactttttctttacctttgcttgaaatggtttagtttggttcatttttttttctatacaattagttgagaccaaattcagaaaggagctaaagaaccgatccagtcaaaaaatcaacaaatcttaatttgattaaaggaaatgttgttactagagcatttttaaaccaaaccaccgatcgagctagccaatcttcttcatataattttaatggatttttgtacaagcactttcggggggcaagccacctatgcctcctggtatgctaatgtttaaaatatactaatatacacattgaataattttttagagcctccatctaatatcgaacttttatactgcaagtgtaagttgtaaatttgcaagaggtagtttgagtcaaagtcacctctaattccccttaggtttggttgattatggtatttttaccaatgttcattttg

SEQ ID NO: 62377 - DNA, 8723 bp, Oryza sativa
  unsure (1)..(8723): unsure at all n locations
gacggttgggtgcatggcccccttacacgcagctctgtgaaaatcaacattttcacatgcgagcggcctaaccgcgtgtgaagatcaattaccacaagtgggcctaatgtggccgcctgctataatatattttcgcaagtggatgagttatatggtccgcctagaaagacatttttttccgtatgaatgatttagaatgcctacatgctataacagttttcgctcaaaaaaataaatttcaaaaagaattttgaaatccctagcacttcttggaaccctaaaatcggcatccacatgacaacattcagagatccatccacattcacacaccacaaacaaagattcatccacatccacaaactacaacaaacaagaacaaacatgaaaaactagagcttcaatcaaaacatagtagaaggagtagcagaaccgagttcgcagaggagatgaggtggggaaggagacgaaaaggcagaggggtggaggtcccgcgaagcagaggaagagtgggtggagaagaggctagcggttagacccagggtgcgcagcgacgatttagaggcagaggagcctgccctctcgaggtcacccacgccggagcaggcctcccgttgctgcaggcgagaagaggcgggggaggggaagcctccccgccgcaccgccttatgggggttggttcgtgctagccgaagaaaattttgtcttttgcaagcacgaggtggaggtttaaacccatgatctactggtcacacgaagagcatactactgatgcgctacctccatttttcaaacggaaacaaacatacactcaagatacattgtagtaatgctaatattataatttaattagttacatttgaaagtatttgacaaaataatataaaattttttgtgataatctcaaagagtacccgtattttttctccttcatgtcgataacaaggtactctctctgtcaaaaaaaccaacctgtctataacaatgaatttggacaatcctctatccatattcgttgtattaggagttaaagtttgttttttttagatggatggagtatactataaagcatgcccgaccggccagcccagacacacgtacgtactggcacgcatgcatgcaaaatgcgcttgtgtttctccctgctcgtcgattaccgggttgactcggccgcgccctgcttgcgcacgcgcgtgtacgtgctgtgttaatttgctgctgccatcgatccgatccagcgtcgatcgatcgaacgatacacggatcgatgttttccttgtcgtgaatgatggcagccggagacgacacgtacgccggccggccgcgtttttcctccttgctgatgatctcacgttggaaggagagtagccaccacgccccccgtcagacaaaaatgacatcagaaactgcaacttcgggatttccccaagtgtgcctgtgtgtgacggcactgacaagcggggtcccatgatgtttttccaaacaaattaattaaggacgaagcggcaccagtctcggatcggatnaacatttgcaactttttgcaaggttaacattttatcatgttcctcgtaataaaaaatggtcatgttttatttaacgttcgaaatctctcattatagatggttcatatggagtaatcttcggtaaaattatgacatacgtatagttccacacaaaagacactctaagttaatcttaccagaaaaggaagatttgtctgcaatgtagcctttgcatggtctctcacgtggaactgaataacacagccatcatttcctcagcaatttactctctccatccaaaaaaacctaagggtgtgttttagtagaaggggattgaggagaatgggaaaagcgtattgagtattaaatattttatttaatactcatgattaattgagtattaaatattttaaattttaaaaatagattaatataattttttaaagcaactttactatagaattttttttcaaaaaacacaccgtttaatagtttgaaaagcgtgcgcacggaaaacgagactcaatctcccctatctccccagaacgaacgatgccttaatttaggtgaggatgatcgttcatagtataacgaatctagacaatttgtttaaattcattgtactaagttgagttttttttttaacagtgggagtacactatgactctatgactggtaaatcgtgaaagaaaataaacatagcaacttaaaaaaaataaggtaaaacttttatatttatgtcttaattaaacaatttgaatttaaaggcaatactaaaaataaactacgagaaaaatcatcaaaattaattttaactagcatggtggcccgcgcagattgcacggctagcaccattatattttctgtcatataataacatactccatatgttttctcaatgtattattcagatatattaaaattatatatgtcatataattttaaattttgtactaccctgacgaaactactaatatataatatttatattgtattttatatacgtgttagttattaatttaatatcaaactttagttatttgtaaattatattcctatatggactctaggctcttcttccaatattatttatttttaattctgaatttttattatttctaattgtatttctatgtggactctaaactcatctttcaatactctttaatttagaagtattaattctaaattgtattcttatattgactttagactcttcttccaatgtttttataattttgaattttagttattgtaaattatatttttatacgaactctaaactctacttataattttattatgtttattcagaattttagttagttttaaattcttatatggactctatactctacttctaatatttcttatttttaattctgaattttagttatttcctaattgtatttctatatggactctagtctcctcttctaatatttcttattttttaattccgaatttcagctatttctaaattgtatttctatatagactctagtctcctcttctaatatttcttattttttaattccgaatttcagctatttctaaattgtatttctatatggactctgttttttctttttcttcgattaatgtgagaatttctagaccatgagagcgaacgtgaaggtttttttttctattcctttaataatataatagatttgtttttaaaattgtaactttggttgtggtaaaattgcaaacgatgccagttggggtatagttttacttttgacagtttttctaaaccatctaggataggatgcctggaataaccattcagtagcacagctctatcttaattacggccgagaagtatgacagggagagacaaaaatctcaccgcagattactagagtaaaaaccaagcttaactttgctgcgcggccatggtgaggacaaggtacgtgttcttagtactctattgaccagagggggagctgcatgctcgctgaacgctgaggcagagagcccagaggcgctggcttggctgccactgcatgcgcccaactgaatttgttaggttcccagggcggtagcgccaggccgtgcagatgcagatgagcgccgcacgcagcatctacaggacctgccggccggctgcggtgaaaattccaatttactgcacactactacccggtgaaaactctcgtcatcgatccatacataaacctaataatttagtaatagaaaaatagcaaacactgtttcagggattgctccctccgtgccaaaaacacttttatctgtaacgtttaaaatttttggcttaaaaatgcatgttcatttaattggaccttagaaattgtgaccaaaagtattgatgagggaaaacggtaatcatttcttctcactattctatccatcccaaaatataagaaacaatcacttttttttaaaagaaacacacattttacaacctttcataacaaaagatgtgcattcatacatgtattgcactagcaccttcctcctctttaatttgttttttatatcctttatcctcaaaatctctattcgtatggggtatacacattgttattatttggcaaattttactacaggacactgctattgtgtagttttagctgtgggacactgccaaaactcacttttgggggaaaacacttcataaatgtggtaatttgccaatgaacacgatgtcgattaaaataataatttctaattgagtaggagtgagaaatcgcgtaaaatatcaaaaatgcccttggccccatgtcagctctccatctctctctttcttttctttctctcttctcccggtcgctgtttcctcggtgacaccgcccgacgaagcatcgccacgacgacctcctcttcctcccatgccgcctcccttcgttccaccttcgagccagccagcactcaagcacggccacgccgcaccatcaccacccaccacccgcgcgtcgtcggcccgccccccctgcacgagaccactctgccgcgccggccttcccgcttccccagccgagccaccggtgcccccttctttttccccaccgctaccggccaccacctacgccacccctttcctcggcgccgcctccctcccatgccaccgtgccgccttcgttcttcctccgccaccacaccatggcaccgtcgccctccccagcgcgtggccaagccaccgccacgccacctcacaccggccacgcgccgagccacacccggccgccggcccgccgtgcacgccccgaccctccattcctcctctccaccaccgccggccctctccctaccgctgccagtctgctcctccttttttccccgtgccgcctccttctcccccccggtggctgccgagcccctgccgagctcgacccggccacatgctccgccgcaccagctgcaccgccgtcgtcgtcgccgccaccgccgtgcttgtgtgctcggtgccgccgcttgcacctcgtcgtcgttggcattgggtacccggcggtgcgccgctgcttccccggccgcacgctgggccgtcccggctcgggccgtcgtgccgactgtgcgttgcgcaactgctcacccgccgcgggaggaagaagaagaagggagaaagaaaagaaagaaagagaggaagagagatggagagctgtcatgtaggcgcaagggtatttttgacatttcacgtgatttctctctcctccttaactgaaaattattattttaatcgacacggtgtccattggtaaattaccacgtttatgaagtgtttccaccaaaagtgagtttggtcagtgtcccatagctaaaaccacacaataacagtgttttgtagcaaaatttgccttattgttttcattagagtgattcaaacgaggtgataataattctttcatgtctttacgtcagaggtatttgctgggatggaacaaggagggaatattagtttatcaagaatggctataaatatattctttatgaaacggaggaagaagtaggtaataataatctccctcaaagggaatgattagcgtaagtaacactcctggtttgattggttaattcctctctctctctctctaaacagtacacagctgagaaccaggcaaaagaaccggaggattagttgattgattccatggacgccatgatatgatgcacccactcctagcgacatcatacacgcatgttcctccccactaagctgtgggccacattgcatcacacgtgcccttcccgccttctctctctgccatcactaactacaccaaatggcttcaccaatcaccaatgtcttaatccatggaatgtcactcctgtccatcgatcgatcagccaatagtagtaacagnnntcntcagtacgctcatcaccattagttactaactgcaattaatcatgaggggatgaggacaactgtccttttcttattcactcacctcagactcagaggtaggataaacgtacgtactacgtactcatcacgtacacaagcattgcactatattcctagctatatgcaccatagagatgtgtactccttctgtccaaaaagattcaaattttagggatgaatctagacattcaaataacgtgcaaagtatgtgcttgtgaccctgaagccacaaggtaataacacttgggtttttaaagcgggatttttaatatagaaaaaaaatacaagattagattatcttagcactttaaatcctatgattaaaaaatacaagaaaacttcgaaaatgaccatttagatatagcacagaatacactggaatcacaagagcgataggcataggattttttttcaaaaggttagacctcatgtgaaaattcttctaacattcaaatttctatgttttgaaccaatccaaagaaacttcaacggcttgtttggtaactggatgaaatgggattgggagtttgatgataggattaagatgagaatttgatttttaatcccaatatcttgtttggtagaggtgatggaaattgatagagagtttagttgaagattaggtcattaataaaaacggatggctgagatttgcttagataaagtaaaggaggaattccctcccaattacctgccctacccaggtattgaaaaggtgggagttctttcctcaattctccatcctcattccaccaaaattctcatgtctcccaaccaaacaaaacacttaataatctcatccctctaaactctcaatccctcctaaaaactctctccaaccaaacgggctgcaaaggaatttaggacggctatttctttgatcggaaaatattttcattggattgagttcctccaaaaatttcaaaacaccctttgttccaaagaagcccttgattgtgaacaccctcgattgggaaaaggccgaaagttatcaccgcgtagcggtataagaaaacttaccaggcatggtaaggactctgtaaaattcagttactgtaaaattcctctgtaaatcctcttacccaaaaagagctaccagggtcttgtttggatccttcaggctattaaatagccctccggaatcttgttatttaggagtattaaacgtagattattgacaaaatttattccataacccctaggctattttgcgagacgaatctaacgagatatttaatacatgatttgctaccatgctgctacagtaatcaaccgctaaccatggatcagaagtagctgtgaaagagctactagaagtagctgtgaaagaaatggacgtgacaccatggtaaacgacacgtcttaaggcgtcgaaactgtcaacaagacccggcctggctcgctcacgcagggcttggatggatggacgccggtcactccaggctccagtgcccgtatctcgcattccggagattctcggttccacccatccatcaatctttccttcccaattccaaacagccaatcaatctcttcacgcttatcgcgacgcgcaccacggccgtgagctgagctgacacccaacacacgctgccgcaatcgcgcgaaccatcgacacgcagcaacacaacatcgtcgtgactggagacaaacgctcccgatgcttcaggtttcgagtgttaatactccagtgatcatcaagagcgcctgattaaatactgagctctgagccagtagtagtggtaagcagtacactgaaggagaacgaccgatctgatctggggagccattgatttagagcgggcaggaggaggggcgtacggcgtgtacaaggatactcggtgattcgagtgattggcgcagccgtgcagctgtgacaattgatagctctgccctgtctccgattcttctaaacacaagcggacaagcaaaagccgccagggcaggttttgtgttggctgggacatgacaaggcttgcattcagcagattcaggctccagtgccttcaccccaggaggacagcgtcttggtgaattacagcaaggagacattcagacataaagatgagtgtaggtaaaagtgaccttttgttaatgtcgctgaatggactagttcttttttctcattggcttcggttaaacagtagtattagctttgttagtgttttgatgattctgttggtggtaagcagcctgtttgaaaacctcttgccactctatccaatgggagttaaagtgcccttaccaccgaagtacaaaatggtatgcagaacagctgaaggcccttaaaccatgtattgcatagcgacctgcatcatccgggagggcggtatgctcagcgccgcgattcctctcctgcagttcctcctcaagaaggcgtagaaatagttgatcaccagcttcttgacaaagaaggactccttccgagctctgatgtcgccgtggcccaggaggtacaccacgccggactccttggccttgtggatgaacgagagctcgtcgtcgaggcttcccctcccatcgatcgcctcatccagcgatccgtcgaacgacatgctcgatccaatggttgggtgctcggtagtaccagccgcctcggcaggtggaacaccgagagaattgatactgccattgggaccgacgagagctcttgacgaggctgatgcaacctcctcttctgagtctgtaccgtcgtattggtcactctctagggagcgctcttgggcttcccgccgcatgaacttctcgagactctctatcagaagctgctgaaatgacatgtagtcctccttgcgtatgtccttgtacccatacctgcaaccatccatgaatgattaacatgcaacaag

SEQ ID NO: 62378 - DNA, 4147 bp, Oryza sativa
atctttctaaaatcagccagaagaggtaaatatcttggtgatacaaatcccctcatcgtgtcaggaaataaggtggagccaacaaggtaaagaaggtatgcccgggtgctgtaagcaatctcgttgatagttggattttctggcaattgatgaaatttcctgtacaaccatgtcaatctgattaagccacacagttgctctccatttccagggctctctcctaagaaatgcaaacacatccgcctcacagcttcatcaccaattggctcagcagtcaccacatgaccagtcactggaattccaagaatatatgaaacatcacggagtgatggggccatttcaaatcccatgaaatgtgcagtatttgtttcattgttccatctctcacaaaaggctgtaagcaaagaacgatcaatagtaaatcctgtggtgagggcaagatgtccaagaccactagcattaactagttgttgctgttcgtcagttagaacccattcttttagcttccgtgtctgctggctgggaagcagaacaccatatcgctgtggaaaattgagtgtctgcatgtaattttgttcacgatggccaagtgaaaacaaagggagaagcagctacataccgtccagatttgtgagcttccaaccggtctccgtccacttggtttttgttgttgtgttaccacaccttgagatgcaaggtccattttctcctggaaaacataagagggacaataaggtaattgttctatgatgcttggtccattgttaaacaaaaaaggaaaaaaagaaaaagggcagttgtaacttgtgtggataatacttaataaaacagtgtgtaaaaaaggaactatcaacacaaccagaacaacaaagtccataaataatgaagcaaaaacaaaaaagtgctctctcatacttgtttacgatatcagtgatagctgatgataagtaaattcacgcacaccatttatgaccaattattttgacaagttcaattttttactatattttgctaagataatgatagttgtcagcacaaagagagtcaagagcaaacgaattcaggtagtctgttgaattatttttctgcttactgccaatctaatagctggatataagaactaaccacacaaaagtgtgcagtatctcttgtaataaagagatagccggattcttcatgcaatttgcagggctagattatagtctattgaaagtagaaatgcatttgctatataactcttaggtttatttctagaaacacaattgtaactttcatacaggtatagtaaagaaagctctaaaatatatccaataaatcttcaccattataatctgagctcatcctgatgaacagtgacgatatttctccttttatttgataacgttgtaatttctagcccttgatagagaatatggtggcttctgttcagcctgttctaatagtaaataaatgctagtggtagtctggtggataagaatgtcgtgatgctcacatcaaagaaaaaagggggatgccgtgatgcttgaaaaaatagcatgtgagggcagttctatgtacctcaactgtcgcaaatgaagatcatgtagtaaaataggaagccatgcactaaatcatactacattatggtgatatttccatgtaataatgacaaaatgcaagagtatatagtaaggtcgatcgcttaacacaaggaaaggggtaaaaaaaggaaagcaggaaaaacaaatatcatccatttctagtgtttcctttttacattcttcagtattgtactcttattattttattaagaaatgtaaacagtggcagagaggttttgacagagtcattggcttatgaattttacccctaagtaattgatagttgagatctaccaatgctaatcccttctcatcctaatatctgtctagctatccagcaaataaattagaaaaaaatattctaactatttattttcaataaatgttccaggatacactttaaaaaaatagctccagttgttattaagtgtgtatggatttcagttcagttcagtgtggggtacatggtacccagatacccatagcaaggcgttttgggccatgcggcatgaggtgggccgagtgccctaggcccacatggttaacttgtaaactaagaaagagataagggataagttggccaatcctatcccttgtaaatagatggtaggtacccggattatgaaggctacactaccatatctagccggttgcctccgcacctatataaggagcaccgggaaaccctcattcttccataagcgccacgtgctattcctacgccgtgctgcgcactccaatacagatctaatccactcatctggactagggtattatctcacgtcgagggtctgaaccagtataaacaattggctccatctctcctagatctagtgcaccctataaattatattgccgatcataagaatcgacattcggctttacagcttcagccttatgaaaaatcaccgtgtaaagatagcacacaaaatctcaaacagtccagcacaaagcccacattttcagaccattgaaaaccaagagaagacccgcacattcaagcataaccacaaccagaaaaacatccgatcttagccccatcatgatgctccagcacaatgaaaagagaaaaaaaaaggaaccactctacttccatgaaagtttatcccatggcactctattaatcgctgccacacattcagtgatcgaaattaacaacaatctataccctcaaggccacaacatatccagaaaaaaaacagtactaagaacagatgctatgtgctaaacgcacgctaatttcccacagcatttcattgcactcccccaagccatctaccacgggccacgtactacgaaatgctaaaagaaaaaaaaaacctagaccatggaactcgcacagatgcaccaaaaccgctggatggatggatcaagaaccaccaccaccaacccacccaccaagaaccgaaacgggttacaggtacccctgatctgagattgcaggccctcctccgctactgtagcgacggaacgaggcgtaggaagtgcgggaggagcagccggtcaccttactcgccggggaaacgcgccgccgccgccgccaccgccgccgacctccgcttcggagcggaggagaggttggagaaagcgagcaaaatcttcgggaggggaaggaagaaagaaagaaagagagagagaaaagcttatcgagtgcgccccccaccctccctctgccaggtgggccccacacctctcccccgcaacccccatgtgggccccgcgcgtcagcgtcccgagcaccccgcggagccagccagccagacggttcgagccggaccgggtcaagggcttcctctttcctcttccgagttccgaccccgtcgcgttaaaaccctagccaccacaaccacgcactcctcttttttttttccccttccccaccaccaccaccgcctctctcgccggcgaagagaagggggaagcgcggctgcggcggcggcggcggcgcgcggcggaggtagggcttgaggtcctgaggtctctcctccgtctcgatctgcctcctaaccccgaagcgagagggattttgcgcggggagggtgggggtccgtacagcccggccgccgtatcccggggtggcgctgaggctgccatcaggttggttcgctactcgtttccttgtcctcgttccgctaggcaatttcggtgtggtggtggtttcgtggagtggggttgggggggggggggtctgattcaatttctagggtttcgagcgaacaggtcgccttatcatgaaacggtttcgtcgattggggttgggattattgcgattggtactgcgtaggtgagtttatggggattgcttatcgagcttcgtcttccacgggtagagatccggtggagatttccggcgggcctgtagctcagaggattagagcacgtggctacgagaccacggtgtcgggggttcgaatccctcctcgcccacagacttccaaaggggaatcgggacttgtagggttagggggggataaattggggcttctagggtttggtcgcgaactcacgatatttgctagtgttatgctcatgtgtgtctctctgctctgctctctagctgctaggtt

SEQ ID NO: 62379 - DNA, 1777 bp, Oryza sativa
atgcaggcagatcaactgcttcctataacgtcttggcccatgcattgttatcatcgaatggccttggcacagccaacattgacacttacccagcgctgtgggcctgcgagatatggtgagaggtatcggtgtccgatgtctgttaggcaggagcggatgtgtggtgaatattgacacgtgaaaaaaaattaataagcaagtcatatctggttgcatgtatgagaagtttaatgtttttgccagattctatgcaattttgtttgaataatactctcgaataattatgtacaattgaacacctcctgttaattaattgtacataagcaattctcattatttctatgttctgttcctgtttgtgtttactattttattctggcatgttaaacagcttgcctctatctgaatcttctggccctgaaaagaagctaaaattatttttctttgtcaagaccaaaaagtatttattcaaaccaaacactatgaccacacaagcttgtaagaagagaagagcagtttatataagcagtgaatcagaagactctggtacagactctgaggttgagggaagcaaactctccaaaaaagatggggtcacgtcagtctatacatgtggtcaccagccaacctctaagaataaggttgatccgatgaatactagcaagtcaaggcagtgtggaagtattctgaagaagctcatggatcacaaaagtggatggatttttaatacaccagttgatccagtggtatatggaattcctgattactttgatgttattcgcaatccgatggacttgggtactgttaaaaggaaactcacaagcaagcaatattccaacccttatgagtttgcagcagatgtgaggctaacattctcgaatgcgatgaagtataatcctccaggaaatgatgtccacggaatagctgatcaattgaacaaaatatttgattcggaatggaaattattggaaaggaaatggaaagacagaaatttggtacaagagcagccatcactgaaggtattaaaggctcagcctgctgttaccccaaaacctgtgctacctaagggggtgactgcaggcacaaattcagctgtgagcaagacactggcaactgcattatcctccaaagtatgatcacagtcatgtaccgtcattcagtgatttttcttcttgggactttgatcaaagtactgctctctttgcaggtaaaaattaaattttctgtgcgaggctctgagctgacctcttccaaaggtgtgaatagaataaactctatgcatacaatctttccattgttgattgtatttgacagccattaccaatgcttttcaattcagacacgcctttgcaagcagttggcagaagagacggcacaattaaccaatctctcccttgcaccaaggttttgggcacgagctcctttgtttatacttgagtattcttatctgagtcttggtatcattagctaaacaattgtgtgatccccctcttgtcttgtcttttatttttaggacaatgctaagacaccaaggatacaatcaagtgaggacagatctgaatcaactggtatgtttatgatttcccggtaattttatcccatactgttttattttactaagcagtcaattattatcttaggaaatgaattgcggccttgcgatgatgcttctacttcacctcttgcttcttccagacaaggttggacatgctatctatttatccatctatttgtgcatgttaatttgcatactagtatctctgttctcaaaaggatg

SEQ ID NO: 62380 - DNA, 1300 bp, Oryza sativa
atttgggatgggtgaccgaccgggaaattcttcccgagtgtacacgagtgaggacaaagtgtgcagaaaagacatgtgttggtctgtgagggcagtcttatgacctatgaaagctatcagatgtaagcgggcccggcaatttgggatgggtgaccgactgggaaattcttcccgagtgtacacgagtgaggacaaagtgtgcagaaaagacatgtgttggtctgtgagggcagtcttatgacctatgaaagctatcagatgtaagcgggcccggcaatttgggatgggtgaccgactgggaaattcttcccgagtgtacacgagtgaggacaaagtgtgcagaaaagacatgtgttggtctgtgagggcagtcttatgacctatgaaagctatcagatgtaagcgggcccggcctgggggaaggcgggacattacaatctccctctgtattatctttttttctccatttttttaaaaaatactcccaccatattaaattttaatgtatgtcgccgtttacttttttatcaacgtttgatcattcctattatttaaaatatttatgtaattatgattttttttattatgacttgatttatcatcaaatgttctttaagcatgacataaatacttttatatttgcacaaaaatattgaataagatgaatggttaaatgttggtaaaaaaatcaacaacgtcatatattaaaacatgaagggagtagtttctttataaaatgtaccccacactggctccgctgaaatggaggagaacggcagaagggaggattggagcaagggagaagaagatttgagacttggacagtggagtgatgaaacggaaactggagtggtaggagacagttgccatcttcgtcttttccccctcttttctttctctattttttcacccttctttagctttacttcagtgactattaatacttaacagtcggttaacttatctttttttcctcccattttttttaaaaatactccctccgtattaaattttaatttatgacgtcgtttactttttaatcaacgtttgaccattcatattatttaaaatatttatgtaattataatttattttattgtgacttgatttatcatcaaatgttgtttaagcatgacataaatacgtttatatttgcacaaaaaatttgaataagatgaatggctaaacgttggtcaaaaagtcaacaacgttatacattaaagcatgaagggagtagtttctttataaaatgtaccccacattggcttcggtgaaatggaggagaatggcagaagggagg

SEQ ID NO: 62381 - DNA, 5499 bp, Oryza sativa
ttggagcccgtttggatctatatgacacccatgaaaagtttggggacccaaaaatgcattttgagagtttaaggacctagatgacacatctatacaagtttaaggaccggccgcacttcactcaggaacaaataaggaaaaaagacatgcgctagaagtaagcacattcttagataatttagcattcaataatatatcacaaatagcattaacaacatggctaaaacacataccagtagcacatagaagacagcctccaagggacatccaagcttgggttgggttcctttcaaaataatagtatatatacataggattaaatgcctgtaatacagctgaaccatatgtcttcatgttataaattcctattccagcaaggcagcaaaaccatatgaacaaggcaggtccaacagcaagcgccactttgcttgacccaaatcgttgtagagtgaacaggacaataagaactgccacagttatcatgacaacttcacctgccaaagtttcacattaatagtaagtatgatgtactcgtagacagtacagacttaattcttttcctgaatcaattagtgctatgtgtcaataaactgaaattctgaggtcaccttcattaacactagatattccaacctttaagccattgacagcagacatcactgcagatttttaccaatagaaagaactggaattagttctacaggaaagagaaaacctggtctagcacaatatcactcataaaagcatatataatgatcattaaacacggtgaagagaaattcaatgagcaacgcatcagaaatatgtgaacctgacattgctggtgtgacaacaccatccgctatcaccatagaagtaccaaaaagaacaagcatcaaaagcagcttctttagcatagatgaagtctcaagacgctccttgatcttcaaagacctctccagttctactgaaggcacctggagttggaagcttgatatacgagtatcagagcgtagttggttaggaagcagactaacccttgcattcctgcatattagcgagtataaagcaaatgtccctcctgccatagatacagaacacggtttcattaaataaaaagattaaccaaaagtgctgtgttttagtctactcgtagtgacctagtagtacataatgagatataccttctccatcatcgtttccccataaagcaatgagagtatacttcagcaatggtattagaatcagagtgtatattacaagtgagagtgccccaagtacatcctccttcgaagtaatagggtacttgttgaacattacatcgaaagcatacaatggactggtaccaacgtcaccgaagacgacacctagtgtctgaacagccagcacaatactcctgcctacggtaatttcctgaaagaaaatgcatgattgagaaatcagtagagttcagatactcatgcatttagaatgaggcttgcacctcatcgtccaagcatcatatgaagtgatgatgtttggatttggagtatcaatgtccaatgagaggtacttatcaaacaacttgcatgacaacatagaaaccaaaatactgccttcattcatttctagatgttgttttagaataagtgaacctcaaaatttaattcacaaactaatttgtatttaatatgtgaaaatagcattagtagatttcacatgaaaactactttcatttagttatttgttaatacatagtgatttttgtaaatataaaagcaaaaagggcaatgataaaacaagtgcattggagattgtgtcgatgccctaaatgacaagaaaaaaagaacagagggagcagtaatcaaaattgacaaagtctctaaaatactactttggcagataatttctagtgtgataaatttgaaaaatctatgaacactatcatataatgatagacagttttcagcataaatgtactggtaatacatgtggttaattcaatttgactacattaatggtgaagaaagaaagagaaataaaataactcgtctcgctcattcatcaccagtagtttcacttaggtgactcaatgcaccacatgctgttctttccacagcatttagtttcacagaacaatttaactctgaaaagccaaaccaggagatgaaacaaaacttttcatgtcacggctccttattcacatccctaaggttctaacttctgatctcgagtagaagacgaacaatgaattgcaatagaaatcatgctccggcacatggagaggtatgcgtccattcatggaaaaaggatcagaattttgtcacatcaattatgcatgttttcgtggtgttttttgcaatattgtagtatacattttgtgttgggttcacttagactgcagaaaatggctaaataaaagaatgtctgggacagaaatagaataacagtccatgtgatctgataagcattcacaataaactaaaagccatgactgaacaaatattatatcgctaggtcgcaatatcacatcaacacggccatcgtgatattcctgtggatattgtagcttataaacttctcacatcacaacaaagaataagacatagatatgctatgctgctacaagtatcaacaaaaaatggagactagggtagtaattacaattcttcaaactgtccacaatctgcatgtaacacttacatcctcagatgtgtcacctacaaacaacaagattacgccgcaaaccaagaatttcactcatcgatcaataacccaaccatcaagagcatgcgtgtagcttgtggaccgaattgcactggttcatcagaaaagcattgcaaacacgttgcatccatacacagatggatacaacctagaagaaccacggtacatgctataaactagtatgattttgctaattcactaaccagaccaaccgaatgaaattacgcagtccacaccacaagcatatagtgagctcagtatgatgttcttacagcccaaaacccaataataccttatcggctccaaggctgcaatctcaattgagcagcagcgcaaagccgcctaatctaacactatcactagagtactagaccacgattgataagtgtcaggaacacgcaggcaatacatcgaacagttggcgcgcacaaaagtagaggcagccaattttaagcaaggccccgtgtttcccgtgggggctcgggcgggtgcgcgcacctggtggcggttcatgcctgcgacgtcctgcgcctcgacgtccagcgagtcggcgcgcgggccggtgcgcacgagccgctggcggagcatctccgcctcctcgtagttgtcgtcggagtccgagcagccgccgcgggagcccgaggcggccgccggggtgccgcccccgccgtcggagctctcgatctcgtcctcctcgtaggcgccgccagacaccacccaccgcatctccgccgactccgtcttccgcagcctcatcctgccgccgccgccgccgccgctggcgctgccgctgccgccgcttcgggtctccatttgggtcggcgcgggaggcgccggtggccggcgcgtgggtgtggggcactggctccgtgaagcggaggagaacggcagaaggggaggatcggagcgggggagaagaagacgctggagagtgatgaaacggaaactgcagtagcaggagatagctgccgtcttcgtcttttcccctcctcatttttcacccctcatttcagtgcacttaatagtcggttaatttatgtttttattttctcccacttcttttgaaaaatactccctctgtattatcttttttgttctcaaattttttaagaaaatactgccttcgtattaaattttaatgtatgtcgtcgtttacttttttatccacgtttttaccattcgtcttatttaaaatatttatgtaattatgatttattttattgtgacttcatttatcattaaatgttctttaaacatcacatataaatactcttgtatttgcacaaaaaatttgaataagatgaatggtcaaacgttggtcaagaagttaacaacgtcatacattaaaaaatgaagggagtagtttctttataaaaatataccctacactggctccggtgaaacgaaggagaacgacagaacagagggtcggagcgggagagaagaagatttaagagacttggacacctgagtgatgaaatggaaactgcagtggtaggagacagctgtcgtcttcgtcttttccccctctttctctctctatttttcacccttctttaacttttctttaacacaacagtcggttaactttctttttttcctacattttttttaaaaaaaatactccctccatattaaatttaaatgtatgtcgtcgtttactttttatcaacgtttgaccattcatcttatttaaaatatttatgtaactatcatttattttattgtgacttgatttatcatcaaatgttctttaagcatgacataaattattttgtacttgcgcaagaattttgaataagacgaacggttaaacgttggtgaaaaagtcaataacgtcatacattaaaacgtggagggagtagtttctttataaaatgtaaacaatcggttagcttataatagttggttaacatagagtttatagtacgtgcagcaacacctttataaaacataattaattcatattaagaccggcaacaaggtttttatatgttggataggaatctaggcacacatagtcaaacctaaaagagttgttaaactgcagatctcaaagttaaggatcataaaaaggttaggaaaaataagaaagcggtggccgctagtgctaccgtggtggccggttagggcaagaaattgggggaagaaggaagataggcatggacgctagtgctaccgttaacggtggccggtgaccagcgttaactagttcttggagaggatgtaaagggtgaactgaaggtttgaaagaatcgcctcccgggccacccaatggagcgacacaggagtccaagcaactagtttttgttgtaccgacatgcactaaatttatctattgtatatgttattttgctataaaatattgtgtgaagatgacaataatacaaaactctcggttctatatacccatccaagaagatactatagaacttttgattttgatttatagtgcagccatgacctgccgaaaatatgattgtatgttcaatgaaagccacgtaaccaggtgataacaatccggcccaggtggggttggccgagacccaataacttaaggttgctcggaccccaacagttcataggcacacctactcaggaaaatgcccaatctccctaaaagactagtccaataggggaagggtggctctcccttttaaggtggcttcctcctcccaaggtaagaaggtgggattattcaaaggctcacacggtcgccgcccgactttagcgtctttgccagtgggtaatagtggaggatgtcctcatcaacagggaatttcgacgttgtatatacgattgtaaagccaaaga

SEQ ID NO: 62382 - DNA, 1681 bp, Oryza sativa
aacagtcggttaacttatctttttttcctacattttttttaaaaaaaatactccctccatattaaatttaaatgtatgtcgtcgtttactttttatcaacgtttgaccatttgtattatttaaaatatttatgtaattataatttattttattgtgagttgatttatcatcaattgttctttaagcatgacataaatacttttgtatttgcacaaaaattttgaataagatgaatggtcaaatgttgctcaagaagttaacaacgtcatacattaaaacattaagggagtagtttctttataaaatgtactccatattggctccggtgaaacggaggagaacgacagaagtgagggttggagcaggggagaagaggacgttggagagtgatgaaacggaaactgcagtggtaggagacagttgccgccttcgtcttttccccctctttctccctctccattattcacccttcgtaagcttttcttcagcgcacttaacagctggttacctttcttttgtccatttttttttaaaaaaatagacctttcatattatctttttttgtccaatttgtttttttataaaataccccctctgtattaaattttaatgtacatcgacgtttactttttatcagcgtttgaccattcgtatgatttaaaatagttatgtaattatgatttattttattgtgacttgatttatcatcaattgttctttaagcatgacataaatacttttatatttacactaaaattttgaataagataaatggctaaacgttggaagtcaacaatgtcatacattaaaacatgaagggagtagtttttttataaaatataccccacactggcttcgctgaaacggaggagagcggcagaaggaaggatcggagcggggagtggggggagaagaagatttgagagagttagacacttgagcgacgaaacggaaactgcagtggtaggagacagctgacgtcttcatcttttcccccctctttctctctttatttttcacccttctttagcttttcttcacggactgttaacacttaacagtcggttaatttatcctttttccctctatttttttaaatactcccttcgtattaaatattaatgtatgtcgtcgtttactttttatcaacgtttgaccattcggtttatttaaaatatttatgtaattatcatttattttattgtgacttgatttatcatcaaattttctttaagcatgacataaatacttttgtgtttgcacaaaaatttcgaataggatgaatggtcaaacgttgctcaagaagttaagaacgtcatacattaaaacatgaagggagtagtttctttataaaatatatcccacactagctccagtgaaacagaggagaatgacacaagggagggtcagaataggggagaagaagatttttgagacttggacactagagtgatgaaacagaaactgcagtggtaggagacaactgtcgtcttcgtcttttccccctcttactctctctctccatttttcacccttttttagattttcttcactgaccgttaacacttaacagacggttaacttatctttttttgcctccattttttttagaaaaatactccctccgtattaaattttaatgcaagtcgtcgtttactttttatcaacgtttgaccattcg

SEQ ID NO: 62383 - DNA, 956 bp, Oryza sativa
acgtttgaccattcgtcttatttaaaatatttatgtaattataatttattttattgttacttgatttatcgtcaatttgttctttaagcatgacataaatacttttatatttgcacacaagttttgaataagatgaatggtcaaacgttgcttgagaagtgaacaacgtcacacattaaaacattaaagaagtagtttctttataaaatgtaccccacactggctccggtgacatggaggagaacgaaagaagggagggtcggagcaggggagaagaggacgctggagagtgatgaaacggaaactgcagtggtaggagacagctgtcatcttcgtcttttccccctctttctccctctccatttttcacccttcgtaagcttttctttagcgcacttaatagtgggttaacttattttctttatttttttaaatactcccttcgtattaaattttaataaatgtcgtcatttactttttatcaacgtttgaccattcgtattatttaaaatatttatgtaattatgatttattttattgtgacttcatttatcatcaaatgttctttaagcatgacataaatacttttgtatttgcacaaaaattttgaataagatgaatggtcaaaagttggtcaagaagtcaacaacgtcatacattgaaacatgaagggagtagtatctttataaaatgtaccccacactggctccggtgaaacggaggagaacgatagaagggagggtcagagcgggggagaagaagatttgagagacttggacaatggagtgatgaaacagaaactgctgtggtaggagacagttgtcgtcttcgtcttttccccctctttctctctctctctccatttttcacccttctttagcttttcttcattgactattaacacttaacagtcagttaatttatctttttttgcctccatttttttaaaaaaaaat

SEQ ID NO: 62384 - DNA, 1637 bp, Oryza sativa
gtgattctactacttctaggtgacgtatattcgccaaggtagaataggtgtcgaatatactagttctatttggttacggttggacttggagttataataggtggtaggggatggagttagagtcggactctataacccagaatctctcttaaataatgagggggcactacaatgtaatcatggagactacaatgtagcgtagacacgcagggagaggatggtggcaaggccatggactcgtagcggctaggtgctatattgattggggaggagggcccataatcagagctctggggatgtaggctttggctgaaccccgttaacaaatatggtgtgttactgtgtcgtcgtagacatgttttgggtgattaatgactgaagtgatcggaaaggttagtcgccgttccgctatatcgactaacttttatagcatagaccgcgaagattctactctaccaaatgaccttctcacaatcacaaaaatcatcatcagttgcgtcaacacacaacacaagtacacacacaaccgttctgtagccgcaggggagggcaaagcagccgcgacccgcgagcagctgttgcttgagccgaaccaaaaccaaaccggacatgaagcgggccgtctccagcatccgcagccgcgacgtggcccacctcgccgccgccgccaccgccccctcgccagcggcggcggaggcgtgggacgggcggttccggctgcacaagccgcgggggcagcacctgctcaccaacccgcgcgtcctcgacgccatcgtccgccgcgccgcgctgcgcccgggcgacgccgtcctcgaggtcggcccgggcaccggcaacctcaccgtccgcctcctcgagtcccccgccgcccgcgtgtccgccgtcgagatcgatccgcgcatggtcgacgccgtcaccgcccgcgtcgacgccctcggcctcgcgcacaagctcacggttcgtctcgccgtgcccaccatccgctcgatcaaatgcctccaagaaagctaacggggcccctcctctcctttttgccaggtgatcagggcggatgccgtggaggccgagttcccggagttcgacgtgtgcgtggccaacatcccctacgggatctcctcgccgctcatcgcgaagctgctgttcggcccctaccggttccgcgcggcgacgctgctgctgcagaaggagttcgcgcggcggctcgtggccgcgccgggggactcggagtacaaccgtctggcggcgaacgtgcggatggtcgccgacgcgaggctgctcatggacgtgagcaagagggacttcgtgcccatgcccaaggtggactcctccctcgtcgagatccggccgagggcggccgagcccaacgtcgacctcgccgagtggctggccttcacgcggtcgtgcttcggccagaagaacaagaccctcggcgcgatcttcaagcagaagaggaaggtcttggagctcttcaggagatcccggtgcgcggaggaacgctgcgacggcaatgccaatgccggtggcggcagcagactcatcgcacttggcggtggcgacgacgacggtgacatgagcgacggcgacagcaatgaaggccacgacggagcacccagcttcagtgaggaagaggtcgccgt

SEQ ID NO: 62385 - DNA, 1209 bp, Oryza sativa
cagcgttggcataattcatggtgatttcaagcctgacaatatgcttgtttgctacccaaggtaagtagaggtaaccagcttagctttcaagttagaacacttgatggagcttcctccctcttcctcttgtgatctctaactgaaatatgggcaaaacacacacacacacacacacacacactctctctctctctctcacacagacacacacaaaactatccagtgaccattgacatcttacttttcataaaatcgacagatttattctagttgcaatatttgtgtgccgtccatttgcccagtgcccatattctcttgctatttgttttggacagatcttgttaccatgtttgtgggtgatgatgtctgtgctgtaaatattttactccaagcttcacaaccatctacaacttttataaactagatgttatatttaaactgatctaataacatagttttcaatgaaaatatttgacatggatggtcataacaacaagcatgttggtaagtggtcaatttgttggccccagatgttgggtttggtgggggcaaagatccttgctgatttactactgtttcaattactttatatgagcggttactggaatcttgcttgatggctccatcctccatgtttccgctgagatgacgattttttttgtcatttttgttggccatttgctgctattggcttgtttcggccaaaactcaattataacccatctagtacatgttacgcctgaaaaaaaaagaaagagtaaacctaatgctagtgtctgttcctttttgttctcgctatccaagtcttcacctcttcaatctttagcccttgtctcgacatgtaattttcgttcacccgcatctttgttttgcgtgtggtggtctgtgcagtggagaaatcacagacgaaaccttcaaaggcgagacaagatccgagcggaatcaggtcagcttctcaatcccaagttcccaacacgccgagaaacttggttaagatgttctggatatctcctgatgcttataggattcccattccaggggctctgccttgttgactggggccgtggcatcgacctgaacctcttcccatccggtgcggagttctacggcgactgccgaacctccgggttcagctgcgtcgagatgcaggaacagagagcctggacgtttcaggtatctgtaccctcccaagctacttactcaaaacct

SEQ ID NO: 62386 - DNA, 7988 bp, Oryza sativa
tttcagtactatgaatctgaacaggtttagaaaatatctcatcctatgctagttagttatattttaagataaaggtagtagtaattaccatgattcgcagtagcgtaaataaatcagagattagattagatggcatatgtaacaggagctgtttgctgccattttgccccttgacaggtactggaacgtggagctgtggaaaaacctcttctccacgctgctcaacgcgacctccaacggcagcgacgcggccgtgctccggagcctccggatgtccttccaggagtacctgtgcagcaaccggcagctcgtcggcaagctgaaccagcaactggccaagcagaagacctccctgtgcctatcctgaccgagacatatacgcatctcgcgtttcatcctcatcatttttcccgattccctcgtgttgcctgtgtgtaaagtggtggagtataagataccttccgtaacttcgtagcacttcctctgtgcgtgcgtgtgcagcagtaattaacgtgccacatctccactttgaaagctgaaacatctactattgggccagatggaaatttcgtacagtatcttcttctccaactagcggctactaggtaccatgcgtctgtcacgtctagaggagttttttctttctttcttttctttttttctttttttgccatggtggtcgagatcgagtgagatttgtgggcagtgggcgacgagcgagaccaaacggaaacggacgaagcaacgagcgtacggctcgtgaagtcaaagggcgcgatcagataagatgaggcggtgatggtgtgtagtaggccacaggggctgggcccaattccagccgtccccggcccaggctgacggtcgctgctggcagttctgtttcgtgtggtcgcggaggccgggccttcgtcggtcggggtatcgtggacgtgatcccgtcgtcggaggacgtaaggtggggagcgtcatgcgccgcaactagctattcttacgacgtgttctaaaccacactagtggaagtacaaattattcgtgtcacgtttttatatttacgatttccctaaaatcttctgggagtagctatatttatatttatggtgtcatatttttcatcaataaatagtcaacatgtatttacattgtaagtatctaaattacatatgtaatttcagtgtatatgtaacgtaagtcataaaattacatatgtaaatccgaaaattacatatgtaagttttaaaattacatatgtaattatagtgtaaatagtatgtaactatgatgtaaccaacgtgtcatcatccatacaggaaaaatccgatgctaataaaaaaaggcaaaggattaataacgataaaaaggaaagctgcatccctcaagcctttatccaccgtacatcaaaccatcaacggccagagatccgactgttttcagacaagaaaaacatgcgacacataactttttacctcggtattgcttaaaaatatactatttcctaattaagctatttgctagctttataatggttaacttgtcgatatgagcaatttccgtttggttataatctatctattcatgtcatccagttataacgctcaggttgggtgaatattgttgtgctggacggtttcttccaaaacaaaacgtactctgctaacaaaaagtggctatagaagaacgtagatggttcgcgtattgcaaccatgcatctactagtaacaagtacacaccattgtatttagtaacagatctctgtcctaagttaatttattccgggacactgattgtactacggaattacttgtaagtaccagctaccaggtgtagggtgtgttttcacgctaaaattgaaaatttgattgaaattgaaacgctgtgacgaaaaagttagaagtttatgtgtgtagaaaagtttcgatatattgaaaaaattaaaagtttaaagaaaaaaatttgatactaaaccaagccgtagtacagatggctcggtttgacttgccggccggccaggccggttgaaggatcactggtatatatgcggcggtcgtgcacgggcgcgtgtggtgcggttcaaggagtggccgtcatcgtggctactactttccgtcaaaaaatcgtggctactactatagccgaagaatgataaggatgtttgctgtgtgtttgacgccccgttaatccaacaccgtttttgcatataattgcattgcacccatggaccatggtcgcgcgcttgtggcagtcgaaattttctgcgtctgtgactgacgatgagaggtactcctgtagctagctagaagcgtcggaaggggtgaaattaaagatcgatttctggtgttgtacgtacgtggtcgctagatctggttggtgcctcttgcttttctgggctcccctggaaaactgttactgctaattttagccccatttatcgatcggcccgagttccataccatgtctcagctcctgtagccgacctacctctgtcctagctctgacacgtcacagaaacgttaacatggtcagttagtcacgctgatacataggagtcgtagtacacagccgcgcgccgacccgaccgagccaaccaacctcccaccaacccgtccatcgcacggcgcggcccacgccaacgcaggcaagtcatcagtcaggcagccggccgcccgcgcgcgcccgcaccgtagcgtgcaccgaaggtgatccggttgtttccccgtgatcagctgtgcctgtgcacgctgcccctgctcgatctgcatgcgcgcgcgcgctgcagaggcagagcccgatcacatggccagcacggggcctgtagctctccacatgccgttgacgggatgacgggtcggcgcgcgcgatcgatcgatcgcggcgaaacgcatggtgatctctgatcaaaaacccgtacgcgcgatagggtttggtggtttgctgctgctgctggctgctgcggctgtgcaggggggcgcgaccacgcacgcaccggccacgcgcctgcggaccgatcgatcggtcgatcggcggcggtctcgcgcgcactcgagcgagcggcagagcgcgcggcaccgttggtttggttgggtgcgtgggtggttaacagcagctgggtggttgtgattggattggatggtccctgcagctggagctggggtttgtgcggggttgggtcgttggagttagctgggttcgctgctgttgtcgccacgcttgctggctactaggaggagtacgtactaggcgtggtcaccgtgggcgtattgtgcagcgagtagtagggttgtagggcatgcacgctctggacagtacgggtgtacgggtctgtaacacgcgcgcgcgtggtaataattaacagggaggaaccaaatagctatagatcgtaggggggaaatgagttacttgtcgtgataagagcgcaaaaaaaaaaaaacacgtacgactacgtacgccggtatgtaatttcaccttacgtatttttggctagatgatttggaccatcgaccaatcgatcgccgctaatatcaaacctcaagtataagagcacacgatcgattgaccacctccaattaatctccatgccaaagtagcaaaatatcacatcactcatcttcgaagattgtcctccttaaaaccaacaaatctaataagaaataatagaatgtgacatcctataatatctcagatctcatagtaggtatatttactttaggatgaaggtagtagccgtaaacggcgtgtgtccttgcgatgcttggttaataaaggaaaggaaattgataaagaattatgaatgatcaatggcactatttaattctcaggatcaaattaaccgaaattgtttattactctcaccgtcctaaaatatagcaacttttagcctttaaaatctatcccaaaattatatctacttctccaccgacattttttttcaaacaaatcacaaccttccaacattcaatttccctaccaaccttcacttctcatccaatcacaaccttcatcacatctaattctacctatttctcaatggttgtgtccaatctaaaaattcttatattctagatgaatagagtagcatattttagcgcggatcaactaggtggttgatcatctgtctgctagttagccaaaatggccgaaagtcatctgcgcgtacgtgggctgaccatggtttgcattaccatcggtaaccacacggttaccggccttaccgcagggtacggtaatagaaaaaccacaataactttcttaaatttaaataaatttaaaaataatttaaatttttgacaaattttacacggtttcgtacgatttttcacggttaccacagttatagcgtgttaactgtgcttaccgtctgataactgtgcttaccgtcgaggcgcagtaaccctggccggctagccccggcggtttaggaaaccatgtgaccgaccgggcgagtcgtgccggtgggatcgtcgactacacggccgcgcacgggcatgcagcgcacggcagcgcaggcaatttttgatcgatccctcccgcgcgcggttcgactgttggagatgagatgagtgcgtacgtacgtgcagtgcgcagtacgtacgtggtcgcgcgcgcgcgccatgtcaggctggtggtggttaacgcgcgcgcgcgggccggcatgcggcatgccccagtagcgatatagatctcgatgccgagaccgacctgcacagttgcctaggtttgcatgcagagtgcaggctgcacagtgctgtgcacatgcagctagctagctctagctacgggcgcgctcgctgatcagttggccgatcgaattagcgtttcgcgccgtcggccaacgattcagtttcgaaactcgcacttgtggagaaatcgtttttatacggttcgtaacccctatagtcccgatttgaaaatcgagactatgaatccgggactaaagatccatattttagtcccggttcaaatactcgggaataaagatgggagcgggcaatagttttttttttcatttacttactatttaatctctaatttattttctcccaaattaggtgggatgcatattccttaatcaaacccaaatacacaaatcaatcaatcatatacactacagattatacattccaaatcaaaccccaaatcaaagaaacatcccaaatacacaaatcatgtacatctcagatccatacaatgagattccaaaaaagaaattatacatctcaatccatacaatgaaccacagattcttcatctcaatctatacatggatcacaaattctttgaaaaaaaaagaaaaaaaacgaagcaaagccgtcggctggctgagccggctgctgcctcccctcctccccggccgccgccgcgccggcccccgcctcgcgtccctccgccggccgggccgcccaccccctcctgctgctcacacgggatcgagttgggaagggataagaaggaaaagagataaggaggaagggaaaggataaggattagagatggagggagagaggagttggtgtggatgagaaaagagtggatgagaaaagaggataagtaatatggattatatagtgcgttttgatctttaattccggtttgtaacaccaaccgggactaaagagatccgatctttacttcctgttcgtaactctaaccgggactaaagatcctggaggggcctgacaacacctgacagcatgtgaaccgggactaaagatcatgtagtctcgttctacttataaaccgggactaaaaaccatctttagtcccggtttttactgcatccgagactattgtggtttttagtcgaccggccaaagatggtttctttactagtgtcgatccaatatatccacgtgtacgtctcggtgggttattctttgcagtgttacgtactctctccgtcgaagttttagtgttgaacacggttattaagaaagcaggtagaagtgagtggtgaagggttgtcattggatgagtagtagaggtaggtgggaaaaatgaatggtggaggattgtgattggttgggaagagaatgttggtgaagttattatattttgggataaattctgaggaataaaatttgttatattttgggaccatagggatttttttttgaactgataactcgggaattaatcaatctgctagctagcatgcactatatgcttgtagcagcaacagactcgttctaattaaatacgtgaaaaataatcgaagtcattagtaaggttgtagattcataggttagccacatcaaaaaggaaatcaggagaatataaagagtacatactactccctccatctcataatataagacgcgcacatattttaagattcaacctttaaaacacttgactaacacttagtataatattaaataaattttatttgttaaaaaatatattattagattgagatttaaattactttcatatggttataattttgttgctacaaaccttatagtatataagaaattataagttaaacattagttttggagaccgtgccaactttgaccatgccttatattccctccgtttcgaaatgtttgacaccattaactttttagcacatgtttaaccgttcgtcttattcaaaaacttctgtgagatatgtaaaattatatgcctacataaaaatatatttaacaataaatcaaatgataggaaaataattaataattacttaaattttttgaataagacgaacggtcaaacatgtgataaaaagtcaacggcgtcaaacattttgaaacggagggagtattatgccaactttggagatgattgattattctctacggctagctagttccaattacttagtactccctccgtcccataaaaaaaccaacatagtattgaatgagatattttctagtacaacgaatttagacatgctcttgtccgtattcattatactagaagatgttatatctatagaattggttttttttaggatggcgagagtacagtagtacgcatgcaagggtggcaaatgtaagaagcagcagctagctagcaaggccgggttcaatttcaatcgatcgatcgaccgactgcatggaaatttcgagttggaatctgaatgtgatgatgggccgtgcgcagggtgcagtggggtgcatcgctcgcgcgcgtgccgacattcctttctcgagttccgagccaacggatcgatcgatcggggaatcagggaatcagatgcccctgcccccctagctaccttctctcctttagtttgttcttcccatcatactctccatggccatcaccatgatcgatccctctcctctctccacaagctaccttaatcagcttagcttagctatccctggaccaggaataatattagtttacgtgctactggtgaccaagtattggagcactactactactctagtatgtagctactactaattactctatcactctgttaatcgatgctgtcgtttcctccttttaaggccggccggccagccagccaaatccatccatctctaactctagttaatttaatctcgaaacatgaacatgagaataaggttttttatcactataaacactgacatggtcactgtgacacttgctatttgatgttaattactatgtataacagagaaaagttataagagacattaacaatctcttataagtataaaaactacaaaaatatatagtagaaaagttataatccattttctaaagttgcatgaattgaaatactaaaagagatattaacaatcaaaattcaaacatattgactgcacttatttagactagaggagtacataaaaaaaatatatgtatgcatcctaaacgtagagaccgaggatataattcatctttccttatataaaaaggtcagaaccgatgacactagctagctaaacaacatagtacaaatttggctagaggttttcctggtctcacttggatgtacatcatggtatggattcttagtacactagctcgtagtactatactactactat

SEQ ID NO: 62387 - DNA, 6640 bp, Oryza sativa
  unsure (1)..(6640): unsure at all n locations
tgggtaattaatgcaggcaaaggctgctctccaggctgcgtttaaaaagggtaatgctcgtgaaagacatgttatcagcaaacatgaaaaggaatcacatgaacccagaatttcggcagtaaacagtcatgatgccccaaggtattgcaagtttggttttagttttgttttgtactcgggaaacttttctgtccatttcttgtaacgcttcttaacagattcttttttttttatcctagtgagaatgctgacatggaaaaaggtcgcaaaccacgccagatacatgatggacaatcagctcctcaagcttctggttctgtatcttcacctgcactctcgtcattgataattccttctctaaaagaggtacagtatatttaactcattcccttttcaatctactgtgtttgctattagttgctacattgacactactcattatacatttgtttcttgaaaattctttataagccccaaaacacatttatttacgctcttaacatttttttataagaattaggttgaatttgaaggacatttgtgcttagctactcagctgcatgtaaaacgagataaaccattagcacatgattaattgagcattaattatttcaaacttgaaagatggattaatatgatttttttaaagaaacttctatatacttcatttagcaatttgagaagcatgcgcacagtgaacgggggaaagtttcagccaacattctgaaacgaatgaagccttaaccttaatattggataatccaatctcgaatgagttgtgtcatcaccacattttatcagtttgatctttgtacaactcgagacatgccaaactcttcactgtattgatgacatgctgcaggctactggtgacaagtttaacggaccagttgttcatacattccttgattccttgatgcatctcgaaaaagagctacctggatcttgtgaggtgctgattggcagaatgctccatcggctagggaggtctgagtttcacttgtgttctctcttatgcgctcctctgcttaccttacccctgtgctctcctctgcttaccttacctctgtgctcagcttgtagctcatgatacctccttgtttgcagctcgaaggagtcctcgctgcaaagtcttcaagagacggcgacatcagttttcgcaaagaaatctgaacctccctctgaacctccaagtaacaagaaaatggctaatacaccttccttggctgcccctaccgtaagccctttggcgaggttccttcttacaaggtttgtttagagaaattgtttcccttttcttattattgctttcccacaacaaagagtgagttgatgccattggtgcaggtggcaaaaccaagtttcccaagatcttaactccgtctgaagacaatacaaaaaaaaaaaaacccgtcatgattcaatgtataattaattttgagtgtacataacgctatggttagaaatctctttgttgctagctgttctcagcagcttgtgctgctaccggttgtttcatttgtttgtgttcgcggtgaataacacattttctacccattttataatgtaactttgcacccactgtacctgtatatcacctgaggaacattaataacacatcaatttttttccattttctgatgcccgagaatttatgaattaatctggcctcctatatctgttcggccctgtttaataggcaacaggctggcaagaaccggaatatttgtgtcacgctttgaaaactattattcctccaaaaagaaattatttaaactttttccaatttaacttgttactccctctcctaaaatataaggcatgtaagatttttattctccaatgtaaaacttttatcatatagaagagatagaaagatgaatctaatgtatttttgtacaattaagtagatatatggcacattcgttgtctttgaatgtcacatttatgttaggccgcacttatattaggacgaagaggagataatttatttaaacagaccaaacttaagattcttcttctcagctataagaataatatttgatttgattgagaatgtttttaccgaaatgagaatgtgagctgactccagtttgagataatgtagaacatgacaggtaggagtagtaattagtaagactcgcctctcccccacagtggcactaatctccctgggcctagcatgtcagtcacaccccacaaaaatagccgttgcgaccccgcgccggctccgagccgccgacccgttcacacacaagcgccgcacacctccctttgttaaaccgtttaaaactctcccgaccgttagagcctcctccccctctatccccccaacgttcgtctcctcttcccccgatccaaccaccaccaccttcttctcctcctcttccgctcgacgccatcaccacgcacttgagagagagagagagagagagagagagagaaaccctaagcctcgcccgctatccagccaagcaccgatggcgacggacgcgaacccggaggcggcggcgccgccgccgcagttactggtggacgagggctacgagttctgcgcgcccaagttcttcgacttcgtctgcgacgagacggaggaggaaatccgcgccgccgagcgctggttcgaggcctccgccagccacgccccttcccgtacgctccccaatccccaccccgccgcctcgatcatccccccctctcccgtgttttgctttttttgcgctgattagggctcttcttcttttacctgcttgcagcgttcgctccgaggatcaaggagtcgagggcggaggtcaagatcgagagcctctgcgacttcaccgacgcggagccgattccgaaggtacgaagcagaaagctgcgggaataaccccccaattttgccctaatttctgtaaatctccccccttcttattgtccgttggcctctgcgttcgtcatgataggaggtagcagtggaggaggcagcaggaagcgccgccaatccctcgcagaattctgatgggtaagagttggagaactaaagaaattgtttatgatgattcgttgtgatctgatgaagttaatcgatttctcgtgtgtttttcatcttcacttttggatgttcaggaatgtgcaacacaataaggacggctccatcaaacttgtacgtgatttcttgatgttttcatgttttctatgttctcagtttcagtaagtactagtgttgggtttctagcagctcacatcctgaattcttcaggtccatgaagcaaatcccagtgaaaattgtgtcactgacggcgatcataagcaccaagaaaggtgcatttcaagacctcaatttgttggttcattccgtttcttgctggttttggcatgtgaatgactaattggttgttttgggcagtgatgcaatgttggagtcgccaccagcagaggaggatgagaaggaatcgccaaaatccttcgagtttgtcccttccaatgcaaaatgtaagttgctagttatatatgagcaatggcagtggggaagaactctgatccctggattttgatatcaatgttgcatggctttagcagcagatgttgcttctagcacaccgaagattcagaggcctccacccgtcaaagctgtcactacggtgcctacctgtcccaagctgacagtgaagacagaagccttcactccgaaggtgcaggcaacgaactcctccagaggtcttgcacccttgactggctcaagggcacatccatctgctttgaagcagtcgatgagcgtcaagaggagtgtgatcaagtaagagtcatgctcactcataaaaaaatatattaatctggagattattttcttactaatgtctgaattgttggtttttcagatgccctcgtgagttgctggctgggaaggccgctactgctgcgaatgaaatcgcacaagaaaatcaagctgtcaagagacagaagcttgatgatgggaggacaagacaggtaatactgggatgagattaaagatggcacttcaaatacatgtgtttgcgttgcgcgagatttctgagaaacattgtgtttgccgtcgtggttagatactgaacgtgaagacaaggaccctgcctcacaaggggagaggaggtggtctagcaggaagcaccgagatgagcctgtcggccatgaggaagcaccgtgacgattcacactctctcaaggtagctcccaagttgctcttctgactcttaaatgatagacttaattgtaatgtttcttgtgagaatgcaagtataatgtgattttgttattgtgagcttggcacttagcaacttttgtttctgccatgtgcaggaagtgactcactatatatcggcagcagagatggtaaagaagttcgagtctgggactagagagttggccatccctcacaacagatcgctttctcatgttagcactcatgtgccctttattattaattttaaattgtgtgcatttctccaattttattaatatacatgtcttctcagtcttgttgtgggtatttggttccatacaaagaccgatgtcctttttgtgatactgatatctgcatatcaaatattgcacagttattacatctgaaccgttgacgacgaaatcattattggtactaagaattttgacatattgcaatttgtgcacaatgcaggaggatgcagcaaccgcattacaaagaagaacaaagctgatgctaacaaggccaaaggaacctgagttccagacctcccacagggtccgtgctgtcagagtgaaaagctctgctgagctagaggaggagatgctagccaaaattccgaagttcagagcacggccgtttaacaaaaaagtgagaaatttgtttgctttggttttgattatactaactactcaatccaggatctgaagactaactatttgtttgcttctcctttcagattgcggaggccccttcatttcctcctcttccaaggaaagctccacagcttcctgaatttaatgtacgtcttgtttggctgattcagaaatttatgagctccacagctttgtttggctgattcagttattcctttccaacacctacaggagtttcatcttaaaacgatggagagagctacacgacatgcagacacctgttccgaagcttcttccgtggggactatcagggtaagctcccttcacttaacctggttgctaatatcagtatgtaaattcttcttcttattagtctcctaaaaattaaaattcttggcattactgaaagtttaatcaaatcttgcagagtcagagcagtaagccactgaccttgacagcgccaaaaccaccccaacttgagacagcattacgagctagaccaccaaggtttccctttgccacttgcatcattcagaaaacaagccattttatgttattgattattttcgattactctaacatcatctttctgcagggtgaaaagttctcaggaattggaactagaagaattagaaaaggctcccaagttcaaggcaaagccactgaacaaaaaggtctccttatcttcttgaagcttgtacatttgatacattgattgcattgtgcttcaaaacatccagtctgaacatcatttcttgcagattctcgagagcaagggtgatattggtgtgtttccacatctaaaggctcaaccaacagcccccaaggaattccatttctctaccgatgatcgcttgggtcctcctgcagttgtggatctatttgataaggtgagggttctaagtcatgctagtaagctcattattttttttccagaaacctttcttctaagtccttttctattttgtagctctctctttgctcagaatcttcatatcatagcaagaaagatgtgcccagattgacaataccaaaccccttcaatttacatacagatgtaagcagtatgaaagttatttgttttcccaacacattgcatttacctatctgttgcaggcaaataactttgttatccatgttacaggaaagagggcatgagaaagagaggcagctagctgcacaactgctgcaaaagcaattacaggaagagaaagccaggattccgaaggctaatccttatccctacacaactgactatccagtggtacgtgcaaagtaacataccgaatattacatgtcctggttgctgaccatctcatattctgctagccttaacattttctctctcttcagataccaccgaagcctgaaccaaaaccatgcacgaggccagaaggctttcagttagagagtttggtgaggcatgagatggagcaacagaggataatggaagaaagagagaggatggagagggaagaggcccagaggagagtagtgaaggcacaccccataatgaaagagtaagccttcacattacggtttctcttgtcccaacagttcctggtttcccttataagatgcatattaatactgttaattttgttgcagggatcccattcctcttccagagaaagagaggaagcctctcactgaagttcaaccacttaagttacatgttgatgaaagggcggtccaaagatcagaatttgacaatatggtcagcaaannnnnnnnnnnnnnnnnnnnnnnnnnnnnnnnnnnnnnnnnnnnnnnnnnnnnnnnnnnnnnnnnnnnnnnnnnnnnn

SEQ ID NO: 62388 - DNA, 1795 bp, Oryza sativa
gtttgcatgtgcccgtagcttgcagttggcccaattaagttcatgcttgcagatacgttgcttccatgtctagtttgcactttgtttcaggtatatggtgctgcttttgagtttccactttgtatgctagtatgcgatgatagcatgatgtgtagcagacacttgtttatgaattttgcagttgagaaggttgcaaagctaatgtatgatccacatgtctacctactgaaaccatcattagttacatattaaagatgatatttccttatttgatttgtcaccgtacaaatgtatagttcaacccaatgtttttaaatatctccaaaaatgaacaactgggcacatatatatttttatttgtactagataaatacctgtgctttgctataaataaaataaaataaactataattttccctaaaataaatatatattttctatgaaatgtgctacccaactttttgctgagggaatactgacgttaatttgattttatatgtgactatccgtttagatttgatttttctaatattaagaagtccaaggggtattcaagggggtaatttgcaaaatttacaatcggagtagatggggtggcatattcactgccaccaccactcctcttcttttaaaggagtatagatgaatgttaaatttcggtataattccgaataattatctgtattatgactaattgcttagtggtaccttgcccgttggacaccagtattccgacttatacaacactgattattattgtttgagacacagatctccatgatacttatgccaaatatcatatggattatcctgaaaaatttgttattcgcatgatgcttgggctaagataggtatgtggccaagtttatatgctatttaatttaagtacataaatctggtatgggacgaactaaaaaaaaatctctttcctgagttgtaagcatctcaaagtaagaaacttgtgttggtaccacagtgcacacatagagggttacatctgagatgcacttaaatctttatctcttccacatatcagttgataccgggatcaattccatgccttgctgatgtaatttgtttgtgcaatttagcgtggaaagtttcaatcacacaatatacttggaactttagttttctcgtttttatagaaagtactagcttataggatgtttgatttactgacatatttttatagtcgttacataggatttgttgagtacatttctttctgcactcccaattgttgtgttcgaatccaacgatcaggagtgaatgtgatgatgatgctctaactcatgcctcattttgtgcatggcttttttaaagattaaagatttaccttatattttctccatgacctttcttctaatctaacctctttttctgtgacagtaaagttcagttcttactttatgttttcttgtcatttattctataggtttgacaaggaactgcataaggaagttgcaataaaagttatcgatttagaagaagcgtgagtctcttcactgaagttccctctgactccttatttaccatattatatcaggttttatggcatataagccaacatgtttcttgccatttgcaatcatgatatcctttttttattggcttattgcaagaagaaaaggtgtattgtgtactggtgctaatatatttcttgtaccagtaacaaagtggtgtattctgtttgctcttttagatttgcctggttcttttgatatagttttctacactaccagaattttatattagttacttatatgtcctttaattctatgcagtgaggatg

SEQ ID NO: 62389 - DNA, 8552 bp, Oryza sativa
tagaggaatctgatgaaaaaagcaggcttcagtaagacaaatggaagtatgactcacctttaaagcaaccaggtcttctgtattaccatcgacactggctttgtaaacttttgcaaaagcaccagtaccaggagaacctttgatctggtactttctaccaccttggtgcaacaaaagggatttgtaactaaacttttgttatgtcatcaatataaatggcctttttctaaataaaaaagggtatatttcttcctttttttcaaggagcattattatgtattcattgtgacttacagagcatggatcataaaggagccaaactacaaaaatgattatagttttggtaaaagactgacaagcaagaaattatagtttatacctaattcaatgactttgtttcttaaaacattctgaggcgaagttaatggcacctttccatgatagaccttattgctcttatgatagccctgtcaaggattcgggcaaccgtccaagatgagagctaagataaacactagcgaatcatatagagtaaatgcaacttacagcgaacttcttcagatcaacattaatgttctccaataaattattcatagtagactcagaccatggatccagcaaaataggttctttcttttgtattttcgatggtttcggctagcagacagtaacaaaaaaaaatggagttagtatggtgaatcatccacaaagaagaatagcattaggcgactataatatatgctggctacaataatggccagtaatgacaagtaaaagaaacaaaaaaaggtttttgcataagttacttcacaagcttaacagggttatatagatattgttcttcgaaaacatatagaaattgcatgtctcatgtttctttatctagtaatgattagtccactcaagcaggggcagggatgtagctttcaatggcacatcatgtggcttcagcccgatatttcattttattctttgcttttgcaatttgctcgattttctctatttatttatgaattgaaccgtataagaagattgtttggtatggcactgttatgctgatagtgccctatatttatgttctgacttcactatggtaaagctgtgcaaatgcactcccgattctatcaatgtaccacatagcataaataatatatttccgagacaaactcataatagaacacatacaccacaagaatcagtggaaagtacaacctgaaattcattcccaactatgattaaactaaataaaatatatccctaaacatataataaaaaaagccactctaaataactagaatcatgctatttttgtataaatagagttgcaggaatgacagaacagaaactctttccatgaaaatgtaaaataaaccgtcatgtatttagttgaaatagatgttatagatgttcgagctagtaaagatcggcaagtacaaagtagatatcattgtgattagccccaaataaatattaagttcacaacatgcaaacatgcaaataaatgaataaattatgtagaatgtatcacagttcacatgcacagaaatgtgaagacaattatcctattgcttgccaaccttttttggaaaaacaaatgttccaccacagagaaatatcatgtaagaaacaatatcaaagcagttcttagttcttactgctgcaagtttgtcagccttgtgaccaactgaccatagctaaaatactaacaaatctacaacacagccacaatgtcctgattactaaaaatgcaattgaatatgaaatatgtgaatcatttgacaaatattcaaggactcaactaatgtccattccaccacacagttatcatacctgggcatcggcatctgcttcttctacaatcttctccaagtgttttaaaaatatcgtatgcatcttcttcaaatgatcaagtggctcggcttttctggtccacggaaatgatttgcgatcacatcaacatgacaaatttgacatcagattgttgctgcccaaaaagttcacttcaacaaaaacataattcagtgtcatactaacctggaaataccaacttcatacaccttaccagcctccagcactttccccttactgaagagaaacagtgcatatgcatcatagagcagtgcatgctctaaaaacattcttttctcctccaactgcttatatgccttatcaaaatcacctattgcatccgcctaacatagaacaaagtgggggggaaatgagcaaaaggatagaaaatggataaggtaagaattgaaacttcaaagccaaacaattacatagaggatccagatcttgaggagtcgggggtctgtggagtactggtaatcgtcaccatacttatcaatgcattccattacacaaatcttgagccgatcaagcgctgctgcttcaaattttgggcctgtcctgagctcatccatagccttgttgatagacctgaataccaagtcagaaactaacataaacgaatgcatacaccaggactggggccctgaccaggacaaacaaaccgcagtgatacatagataaattatgcatgaataccagcatgtgcatgaaagattagatttaccttataaaatagatataatagtaccaggaacataaaaataagttatatatgcaaagtttttaccaaaaggacctatcagaaagcagcacattagtacagaaggagcacagaaagtgggcacattacattacttgacagttcaagaactgataaaggaataagagaaccgtctccacatgaacaagctaatccttcacaagaaaaatcaacctagctgcacaaaacaaatcagctccaaaactaaatccttcccaagtcccaacactggacattacgagtgaccagtcacaatgtctcggcaaaatgcacttctgtcgttgccagacactcaaacagtggtggtcataccctttgcttttcttttttttttttcggaacacacacgcccccatttctcacatttccgttcgtccaagttcaactgcacactgccactgagcaattgaacaggaatcgcagaggcgaagtgtcaaaatctaaatcacacgcccaattaactacataactcagaggaagggacagaatcccagtacgatgcgtacgccacacaacttgaggcgaaaccaagcattattccacgcagcgctacggcggaatcccacgcccccaaataggacctaaatcgaagggaacaggtgctgatatggatactgatctagccattacctgaggtaggggaggatgggatcgagggggggcgggggcacctccctcagaaccctaggcgacggcctccggagcgggctggaggcggcggcggctgctgctgctgcctcgggcaccaccaacggcgtgcgttcgagcagaaccatctcccgtggccgccggaagaagccctcagaatcctgcggcgatcgccggcggcgagctctccgctcccgtgttggggggtggtggatgcgtgcgctgtctgtgtggagagagaaagacgggaaggagatggagcggaagaggggaataatttgaatttcgaatggtttgggatgcggatcgcttgggcttgtgtagccatttttgaggtttaagcccacttattactacagctgtttagtgtttacaactggttgaagatataaaatggaccaatataatttttgggattttttttcgtgcacatagcgagcaaaaaccgagcagcacagctgaacaagcgcacagcacaatcagatcggtgagagagagaagagttgtggaggatggataaacatgcaattttatggccccaaatgtaaggccgagtttatttctaaaatttttcttcaaactttcaactttttcatcacatcaaaattttcatacatacacaaattttcaacttttctatcacatcgttccagtttcaaccaaacttctaattttggcacgaactaaacacacattgtgttcgtttctcccctctctcaacttttaattattctttttttcacacacaggtttttaactgctaaacgatatattatttgtgaaaataattatagaaaaattacttggaaaattatattgatttatttttaaaaattttaatatacttaattagtcatgtgttgagtgaccgtcagaacaaactcagcctaacgttgtgttcggtatggtaggttagtaactaatccttcggtatgtaacatggaggattacattagcatatgattaattaagtattagcttaaaaaacttataaaatagattaatatgatttttaaaacaacttttctatagaaaaattttgtaaaaaaaatcatcggtttgggaagcatatgtgcgaaaaacgagtggtagaagttgggaaagggaaggaaagaacacaatttaagtatctttcttatcgtataatgtactagccaaatatttatatgttgtaacggattattcaaaatagaaaacatatctcgtgcatcctcgttgaaaaaaaaatattagcttcaacttggtaaaaacaagacttgatcttaaaaggcaaaaaaaaaaggcattgctagatttttttttcagatgttatatgattataaagtatgtacttgttactaaattatgttgtctatctcattttaaactaaaagaaactaaatagtttgtgagtttttttaatcatgatggcaagaagcaaattaatggaaaaataaaggactatcttgcagcaagagcagttaaacactattaatacacacctactccctccgtcctaaaatgggttaattggatccatatcatcgtaaatataccatattgaaaaaaatgtcactactattcatgaaatcggatagatgccactgcgatcttctaaaattagaacaatgccactccatcatgatttctgtcgtctccgtcatattttctatcaatggtgccttcatctacttcgggtagatgccactgcaagcagcacgcctacgccagaagctggccagcaagctccgggaaggctagctggtggtcgtggacggcgacgactccacgcggtgatcgtggactgtcgaagagggagccggaggaggagggcacggcggatggtgaaggaacgggataggaggatagctcctcggtgagggcggcagtgagcgggccgcgcatctgctcgagctcgtcgatgagcgcgacgatgacgggctaggatctctgtccagatctggtgagagagaagccaccaccgagccgctgaggtcccactgtcgttcatctgtcccgccgcttgcccgttcagcatcgacaggctcaagcgacaacaggttggagcatggggcgcggtggcggtgacgggagagatgaggagctgctgcccaggcgcagcgacaacctcccctccgcttctttcttccatgccagggaggaggccgagccgcatgacgctgctggaggctgtggacacagagctctcctcgtctcatccaccggcgtctgctctcgttctccgccgcgatcactgccatcttgccctgccagcacccacactctgccaccgccgccaccaggcccaccaccaccatcaacaccacccaccacgacggcgtggatctggtggtggacaacctcgagctcttctctggtgacgcggatccggcggttggccggcggctacaaggggaaatcgacagtcgatggccggcggcgcggtggagttgatgtctctcccctcctcccttcaccgatgttgacgccggcgtgcctaaggtcgtcgccccgcggccctgcacctctctgctccagcgacgggagctccgactccaatggcggggataggagctccgactttggtgtggaaaggtgatgatgaggatggcgacttgacggggaggatggcgacgtgagataggaggacaaaaaaagtgacaggagtggcatggttccaattttataaattttcaatggcacccagctaataatgtgaagagtagtggcatattttcaataaggcatatttacgatggcatggatccaattaaccctaaaatataagggattttgaggggatatgacactcctaggactatgaatctggacagactcctaagaagtatcatatctaccaaaaattgcttatattttgggatggagagagtactccacaccattgcaggataaagcaacgtagtactcacgagttatattgatattattatggttaacatgtcagtggtggtggtggtggtggtgacgacttttttttaagaagtagtatatagtaatacaagtaaattgtgtatatgctttagttttctcactactaatatatccagatatgtatatgttaagttgtgtttttcagtacttgcttaatttaatataatatttattgaattagtattttcaatatatgtatagggttgtggaggtaatctcaccccttgttgttatagtatggtgattatacttaagtttggctattaaacgaaagaaggtagcctgcgcatacgcgcgagcatgttgtttaatcttatttgaaattttattattatgaatgtttatgtgtggatgatatttttgaaatattgttttactctactttaaacgtatgttcattaataactgttgggcatattacttgaacctgtatatcctcaaatttattagaaaaaatatgtcccaataatagagttagttcatatctatttatattgtgtgtgatttttttaaaaaaaatttggagtttccaaactttatataacattttttgttttgtatgctatagatgactttaggtaacattttaattttattatatattaatgaaatatattttctattaaaaatataactaatgatacttcttcatctgatcaaagatagacttatattacttatattcccctgtcacataaatcgaaggaggtaaattttatcccaaaacaatagaagaatttatacgtaaccaagacagtgattttctaaatattaccacgataatctccaaagtaccgtatcatattttgacaaatatgtatactgtagtgcatgttcgttcggtgtctggtttgttttccacatctattgtttctaatcacatgagacacctttagtaatttggagaatacatatgtacatttaagttagtgttgtatatttgtcaagtgttattcacacttaaaatatgatgtgaaattattatcataacattaattattacatgccggctccatatttgtgatgtatttatggctatagatattagtagtttatttatttaaaggaatacaaccggatcacaaattggatatataattttaaaataatttaaaagatagaatacttaaaagcattgattgaatattttatatttacatttgtgtaaatttgaagattattatatttttatctttaaattgtagaaattttttttaaggactgcccattttttggcctttatcataaatacgttttatgttattccggcaaacaatataagcattattatttttttcaaccatatataagtacggagtactttttccggtcaacagttatatatttctcatatatatgtatataggagaaacaattaatctaacggtgtaaaatgaaacaactaaattgtgttgttttcattttcacaaatgtaaatttaaattagtattgtatatttgtcgagtgatatttgacaccctaaaatatgatgtgaaataagaaattatcaaaacattaattatatatatatatatatatcagccttgtatgttaagatcgaacatttcatatttataatatagatttagtttaactacgtatatttacgtaaatttgtagagtaatatatttatctttaaatagtagataatactatttcaaaagaccatcgatctttttcgaatgatacgcttttttttgtttttttgtttttatagtaaaggatttcgaaaatactatttaaaaagaccaccgtgagtagatttttctttgttccgaactttcgatggatagcggttaagttttatttatttttccaagtcgtatgtacgtagggattacttacgttttttttctttttctagcctaattgttatatagttctcccgtatacgtacacagagtaataagttattagtttttaaaataaaatatatctaattgtttaaactatttggttcaccaatttaattaaaaatcggcggtgatatttgcttaaatttatatagtaatagattttctttaaatattagaaaactctattttaaatataatcgattttttatggtactacacacgtatgttttttctttgttttttttacagtaagtccgtgcatagtttttttctttaaataaacaataggtaatatattcattgttttttaattcttacgtatgtacgtacatatggagtactcgtgtttttgttttgtttttccggtaagtaagtgtctttgttttctttttccggtgaagtaaggtatgagtttctttttaaataaaatacatctaatgtaaggtaagattcatcgttttctattcttacgtatgtacgttagtacgttacctgtacatacgta

SEQ ID NO: 62390 - DNA, 7127 bp, Oryza sativa
aaagttgagcatattaaaacttcacttttgagttgaaatttgtaaattaggttgagtggtggattataggatctctagaaccttgtgcaccccgcgcaagagatttaggtggcgacccaaaacgtagcctctaccaccccttcctccctcctcctccgcactaccgtcactggatcgagcaataggaaaccgcctagtgcttattattgaattatttttaaatgttgcacgatgttccaccaggtatatcggaattgtttcactaagtagatcgaaaatgtttcactcgtttaaatctggtgttgtttcaccttatataaaaacaatgtttcagcaaatagcggaaaaatgttttagttcactgcaatattagatctatacacagtgaaacattataagtacactaagtggaacattttttggtgaaacaaaaaatgaaatgaattcccttaatttccaaaatatgtgggttttttattgcaatgaaatatttcagttcactgcaacattagatctataaatagtggaacattgttagtgcactaggtgaaacattttttgtggaacaaaaaataaaccacattcccttaatatagggtttccaaaatatgtgggtgatttattgcaacggcgcgttccactgcaacatttgatccatacacagtgaaacatcatgagtacattagctgaaacattataaaactattagttgaaacatcaaaagagaccacatgcaacattaaaaaaatcaataaaaaaattaaaatatttttttgtcgaaatataatcatgtgtggtcttgttataaagatttaattgtaacgaatttagtggtgcaattagatcgtagattagataaatagtttacgataaaaaaatcttttgaagaaataagaaaagaaaagattctttgcatactggcatgctgcagtggcagacagtgtccgatttttctccaccccgttggtcgtccgggggtgagcattttcgtgacgacttcattgcggtttgaccggctttgatctgtttgaccaacacatctccatcaagtttgagggtttttttaattttggaaaaaagaatttagtttttggtgtttctaccaaggctgccttgatattttacgttcgatcctacaatgtgagagttagatttactcatttacatatgctttaagataaaatatacatattaataaatatatataagataacacacgttttatcgtgtggttgaaaaatccggattttaaaaataaaatagttgcagttttcgaaagcctagagaagtgtattctaaaaatttaaatttcaaactgcgataaaaaaattatttttaaaaatttaaatttcacattgggataaaaaaaattaagagtaaattgtattggtggtacacaaacttattaggtaggtgcaatttagtacatgaacttgcaaaatgctcgttttgatacacaaacttatctgatccgtgcgaactaggtctaaaatagcttggcaaggttaattttacatagctgatgttgattaagatgtggcgtggatacatatagtgagtataaatatttataaatttgttctctactttattttgaatttcgtttgtttctaatccttgtatcattgctcggtttttttatatctttctctacatcactatatctcattctatctttttattgaacatgtgtatgtctaagtagcaaccttctcatacacttcatccatttcacagtgtaagtcattctagcatttatatctgtttaaattcattaacatcaatatgaatgtggaaaatgctagaatgacttgcattgcgaaatggagggagtatatgtttacgtagtatcctaattagcacataaatcaacaaaattagttatgtaatgtccttttgaccttagtttgcacgtgcaagataactttatgtaccaaaacgagtattttataagttcatacactagattacactcacctaacaagctcgtgtaccgctgatgcaatttacttcaaaattaaagtactagtagcaccttttcaaataaattttgtaaatattttctttattttcaataactttgtactactagtatatctgtaaatggtttagtactactccctccgtttcaggttataagacgttttaactttattcaaagtcaaactactctaagtttgaggaaaaaaatagtaatatttataataccatcatagtttcattaaatctataattgaataaattttcataatatattagtcttgggttaaaaatatgagtactactttttctataaaattagttaaacttagagtagtttgactttcactaaaatcaaaacgtgttaaaacctggaatggagggagtattaaaatttgttttctttctagttctaccaaaaagaaaaaagaaaaattgtttggttggtggccatcccatccacccatccgggctgactccggcccaactgctcctctctctcgcatcggggtcgctccctctctcggctctcgcgctcgctttctgtctgtctctgctctcgctccgccgccccgcctcctccgttcgccgagcgcccgccgcgtcgccggccgccacacggccaacctcttccttcctcgccgccccctcgcgcttccagttcctcctcctcctccgtttctaactagcgaggattagggttagccctactaccttcgcgctcttcccccaacccccgcttcgcttcttcctcgtctcggtcgcagcacgacgtccgcttcagtgagggaaggggagggagagggatggatgtgctgaggaagcaggcgagcaagttcaaggagcaggtcgccaagcagcagcaggttcggatcccagatctggggcccttcagtctcagtgtttgttagggggaaggaatggttaattttgtagcgggtgcgatttctccgtttccgttttggacttagtcggagggttctgcgccatgagaaaaccaaatagaaatggcgacgagatggctcgctgttgcaggaattttttgtccctgggatatcagatttaagctgtgaattactattcttgtatcgcctgatctgttctctgggtggtggttgaaatgtgaaactaagagctattttttatcctttttagatatagtttccccttctgtttgccagctgttagattgttactgattttagattaaatatattttccaccagagtgtaaccattaagataaagtatcacaaactacagatttaatagcaacattgtcacaaaactacaagtttagcaccagtataatcacaaaactacaacattttatagcttgaagataacattagtgttaagggtttaaactctaaaatctgtagttatgtgaaaaatttggtgttaaatctgtatttttgcgatgttttggtcaaagtatatgtagttttgtggaatttactcttaatacaggagtaattttgtaatgaggggcaacatatgcttgtaaacattaacattatgtgtaattttagtttttatccaagttactcagtctgtcggtcgggtatgttcgcaattcttacaaatggaagacatcacgtacgttaaccttcctttattaggctcggtcgcccaattgacaatttgatacaattgtcatagtgcaattatatccatgggaagctttaatttggcttagttgtcacttataaaaccatgccgctctctgtaaatgactaaatattttcttcttggaagtgtctgctagtgcttcatgtgctatattcatggtcaagtcttctttgcttacatgtttacatttcaggctgtgataaagcagttcagtactacgggctatgaacattcagacgctgttgtaattgatgaagttgaattacagagacatcaacagcttgagaaattgtacacttctactcgttctggaagggtaaggaaggagaattgcagatagcataaaatacatacctatgtaatatgatcagctggcagcaaattaatcttgcatttatgttattgatatattgctggtgtatttcatttgacatgtctgatttattcagttcattacacaatgtttttaagacattaatacagaagagaatatttgcatgattacgtgaaatacttcccaagaattccattttcagttattaaactcaatgcgtgcatatatgctaacaggatttccaaaaggacattgttcgagcggctgaaggtttggtttctattggaatcaggcatgttgaagtgggtatgtggttcatgccttccatcctctgttagcttattatgtcatgtttggatttgcatgcttttccatcatttttatgcttgaatggtgggaatattaatgaggatcagatgatagaacctctctaccttccagaatatgaggtgtttaatttgagggatgagctggctgtaaaatcacctgatccaaacttctaaacttcaccttctttgtctgagagcatgatttatcatgtttcacgtggccagaacaccaatgggaaaacgaggaatgacaatacccacaaaaaccatgtgatgacatcataataggagtaggacgtgctcatcatgaatggtgctatctttagctaaatgtactagaatggaaacttcgctatcgattatcggatcctgctaacttgataatatttattaccactttttgattgggctgccagtaaatgttgtgaaggggcttttgggaattgagaaatgttctctcaacttgcaaaatcagaggatgaatatgtgacaaaagaatatgactatcaaataaaaatttgaatttcttgagcctgagaccttttttgtgaagacaaggcaatggttaaaaatgtatgcaaggaatcctttttcaaaaagaatagcattgcatgatctgctcgaatccccccaaattcaacatcttacgagtgataccggtatacatttttctttcttttggtcacaggaacaaaattttcagaggattgttatagatatggaggtgaaagtagtgctagtgatgaagcccttgcaaaagcagcatctctgtatggaggtgctctaagaaatgttgagaaagagtacgaagaatttaatagaattttatcttctcaggtaacttttttggatgttaattagtactgttctcacacagacaaattttgctggcttgtgcacagtaatgtttatttctctgtaccctgcatttatgttgtcaatcggtggtttttcttagtatgtacatatatatggtattttgaacccttcttttgttattcttgtatgcctcaatagataggtgtatctctctggtagctgtacgaggagctactagtctacaaaaagagccttgctactaccagtgttctaaaagtcggtgctaggcacagggtagctgcctcaatttggcatttgatggtgcattatgctgctgcccagccttgagggctctagtatttttatattgatgttctagtatctttcttgtatgtcatatgcttgctaattggttggaagccgctagtcaacttggttctaggagctgcctagactgcatattggtgcccctagtcactaggcacttgctcttccaaccatctggcgcctagcgactttttgggccatagcaagaaataactgtcctttttttgttatatcaccaacataatgcagtcagcctagcactcaatcacttaggctggagtagagagaatgtactggaatttgcaatgaaatgtttatgtgctgagaagtgcacatgcatactcaagcctagatatgtatatactgatggatctcatccagttcatatctttacattggagtatatcctaaaagtgtactgatggaagggaccactagagatctcatttacagtccagcatattgaatatgctggaagtcctttaggctgatgattgtggaatccgaatttttatgctggttcatcctattcaataattggaaacttgtcggtgcattaaaaccaagcagtaatgatgtctcaccgcctggtcccaatttttgccctatcttctctcttagacacaattttctaggtctattgatctaagcctggaaataaaacaccatacaacattttccctttaccttttggtgcacgtgatttatatagttgtcatgcaagcgatcaccaattcaccattattttgaagatgcagtttttgtcattctttttcagtgcatactggggcttagccttcaattaaagatctctagaaatttaagatctgtagtattgcattggtccttcaatgtattttacaaatatacttccatttattttgaatttcagactatagatccattgagggctatggctgcaggcgctcccctggaagatgctcgtggtcttgcacaacgttatagccggatgagacatgaagctgagatccttgtatgtattagcaacttgttccatattgcaagcaagcaatcttactattgctacttctatgcttcatagaatacttttccccattatgtatcttaaccctcttgtttgtcatacagtctgctgaaattgctagaaggaagcaacgggtacgagaagctccacttgctgagcacactacgaagcttcaacagtctgaatctaaaatgatagagcacaaagcaagcatggctgtgttaggaaaggaagctgctgctgcacttgccgctgttgaatctcagcagcaaaggataactcttcagcgcctggttggcatggtaatgttgcctgcctctagcatataattcatctatcaccattgagttgtttcatttgattcttatcctttgtcacttatcctgttgaaggtagaagcagaaaagttatttcatttgaggttagctgctatacttgatgatgttgaagctgaggtagaattttcactctgcttatcatgtaaactgtcaaaatctcttgcatttctgaattttgcataattcttatttctagatgtcctctgaaaagcaaaagagagaatctgcaccgcctactattcattcccataagcgtgctgagaaggcccagtacttccttgctgaggttaacatgagtaactgacattaccaagcaattataccatattttacatgtcatgtgcattgaaccttcttgttgct

SEQ ID NO: 62391 - DNA, 1276 bp, Oryza sativa
agagtatactagtaagtaatacattcatgattcaccattgcatgaaagctgttaggtttgtcccagaaaagtatgcttttgtaatttgctgaacacacctgaaaaaaaaatcatctccgtccagtagctctctgcatgtcataggcaccccagggagcgtgcgttgagccaggcccaaactgggagccggaatcagcagtgtttgcctggggatgtggcttcaaaagtagcaagaaatgaggatgaaagaatatgcaaataggtattgcggaaacaaagaataagagacatacttgatttatgttgtatccagcattataaggatttgcggcatatgcggccttaggattcccatagcctccgacgtacactgcaggatgggagcaccatgtcatgatgaagttatattccagatgtgcaacacggaaagagatttaaactacatggtcaaccttacaaattatgccctttggttgacatgatctgatttcaaaacattaagtatccctacataacacagatggtcccgaaccactaaaaagagtactagagaaaaataagcatccagagtttgttaagtaccttgattgcctccagacacagcagctcgtgacctcttctcggcctcagctcgaagcttctccacttcagaagccactgatatcaatttcttctgcatctcttgtccctgctcatagctctcggcatatcctttcttctcaacctcaatgccagatctgcaggtcaaataatacaaccatataaggttgaaaaacataaggttattcttggaatttcactctctctactactccaggggtaactggaattcattttggacaaaaaaaaagtaagagctcattccatttcaaattttaattataatagatcgtaacttgaccagacaaaccaaaagagttcatagaaccaagagaatggcaaaacaaaacagcgatggattgttttctcacaagtgcaaaggagatagctaagatgattcagtgggaaatagataacaccaacaattttgcatatacagattatatttttgcaaaaagactaaaaatacacatcgctctctttcagaacactgaaagtgcatatgaaattaacaaggctctacctcaaatgttgtgtttcatgccttatctcctggatctcagcttttaacgcagccacctgctgcaggtccactgctgatcgagccaagtcctgggtgaacccctggacctgacccatgagttcctgccttgctgcacccaacttctgaatgtcg

SEQ ID NO: 62392 - DNA, 2297 bp, Oryza sativa
gatgtatttaaaggcagtggattaagatgatatgtggaaataattggggaaatagaaggaaataagatattaagaacagatcagttaagattttttttggggggaaagaattacatatgccattgtacgaccagaagtttcaaacatcatatcaagcagtgtgaaaatacttacacagctccaataaacagagttttcgcatagcatgtgtttggtttgagggcgaggtgagatgggttgggtccatccctgtcatttattttctgtttggtttgagggatgggaatgaaccctatttttttgtttggtttgagggataaaaagggatggaatggtcctatcacctgtttggatggagggatggagggatggagttgggatagttggatagagatacctcctcacattgagttagtgaggttacctctcacaccgagctttttttttttctaacaaaaatgccctcttttgtgatgtcaatccaccgtcacatattttcacaactatatatcatgttgactatactggtagagctgctagagctattaatttgcatatacgtagatgtctttctctttggtgatgtctatccactatcagaaatcgaaaatcacgaatcaagcatcacagccaagctagctctgctcctcagctccagaattcagctcgtagcagttgacgagagaggatgcgaggacaagcagcagcaacgagcaagaggatgcgagaagggaggatgaaggagccgcagccgtcactgactcttgtgcacgtggccgccggcagctcgcccgcacgcatgatggagggaggaaggagccatggccgttgctgacttgcgtgcacgcggcagccaccatggaggagggaggaggaaggagtggcggccgtcgctgacggcgcgcacgctaccatcgccactctcgctcctgttgcatcgctctcgctgggtgggtaaaaacagggaaaaaatagactctggctgggaaggataaggtcactgtatggatggaggtatgtgcgggtcacgtgatgtgcgcgggtgaagtggataggcgcggtccggccatttctggcggaccgtctcatcccaaatattgatggaatattcctttttggtttcatcccattccacctagtccttcaaccaaacacctacaaaaatgggttggccccctcccaacccaccaaaatccctccaactaaacacatgcatagagaaaattctggatttatagggagaacgctctgtgctgtttaaatttactcattaattatgatatgcaaatttcagtgtatcactaagaaaatctagaacttagccatgacaggttgcatatttgtcaaatattaaaatgaactttttcccttgtggacaaatgttgtgcaaacttggcatccgaaggggaaagttattgtgcttggcatcgaaaaggcataaacatgcgccttgtctactctagcttgctgccatctcccctctattcttagtttctcactcgtcattatctccctccctgccgcatttccattgcttaccaatcttgcaagagggagaagaataagatgacttcaaatgaagtgagcagttcacggttcaccttgtatgtgaataaaatccatacccaggattcatgaatgtggatattcacacatcttatggagttacgggcattgcacttctaagtgctgacctccagctccgtgcattatcagcatagggggagacggatggaaacaacactaaggtggatgaagactaccaaaacaagaatatgatggattgtagtggttctgcttgcaagactaccaaaacaagaatacgatggattgtagtggctctgcttgcaagcccagcccttaaccctaccgtacctacactgccctctttccaattttcttctcactgaatccctcacctttgcaaacaaaggcacaatgcaaggcaaatacagtataccactggctccgactatcatgcagtatttcccaacgcaaaatttagagggttccaaaatagacaacataagttcttatgctaacataatcgcttcaaacagacccgcattatcatgcacctaatatttcacaaagcaaaatttggagggttccaaaatagacgacattggttattatgcttgcataatcacttcaaacagacccaccgcaataaaattttagcgcaattgagtcaggaagtcaaagttggaactaaatttgcaggaggaatttatagttttggcgaactaaacagaccatatatatgcaagggataagcatcgggattctgtgctata

SEQ ID NO: 62393 - DNA, 11273 bp, Oryza sativa
tgcccacgcccccgccgccgccgcgagggaaggatgggggcggcgggttacggtggcggccggccatgggagtcgccggaaccctaggtcagacctcgggcgaccgacgggaggagattttgcgcgaataacctcgagtttccgaagaatgggagcaggtgttccctcgccttgacttgctttccatgcgcgatagcattttggaacaaacgaaatatcaattctacattaatttctaaggaattttaagatgagtatttgaactaatcttagtttagctcaataatatcatatactccctctattcttttttcatcaacgtattaaaaaatgaattatgtgctattgattgtcaccaaatataccctattcgattgaaatgtagtggttcgttatgtttttcacataggattactgcgcttgtatgttaagatggctatatattggttgacatgcaacggctttaaatgacttgtacataacaattacttctcaacaaaaattggcatatcaactggtagacggggccaacagcacgacgtatacgttgttaacaaaaagtcatgcaaagagtgttggtaccagtgcatagatgaaacaagtttgctcgtcgaagttatagttatctttctcatttactacaaattgcttgcaatgttgaaagtcaaaataaggaggacataagaaagcaataactttgcttatcctatcttaccgtgagatatgtagatgaatgcatgttatacattatagaaaatggtaggtgcatatatctaaataatatgaaaataatgtggagataatgatatgacattgcttacatattgagttctaaaaatacaataaaattgtaaatgatatgtcatgtttgaatgatatttaaaatactctagataataattgctagtgggtgatgatatggcacagatgcatgtgatctaaaacattttagataataattgctagttggtgatgctgtggtacacttgcatattgagctttagtagttagtgggcattaactttatagtaagactagatgaaaccccgtgcgttgttgcgggagtttttgtatgatgttagaagaaataatagctacacttgtataattttcagttttaatcaactattgaaaaaagctacaaataattaagatggtggggtttataacaatttatatcatataggatttgatcgttgaaaagtaaaataaaggtggtttgatattgctgcggaaatacatgagatactttcagttgtagtattctaagactaatctttgtgtatggataactgatggaaatgcctagtaaattgaaattgcatttgctcaaaaggaatcgggtgggtctactgcatatatatgcatttagattaaaccaatatgtgaccaattttcatttccatatcgaaccaataacctctcaaatggcgttggttctgttcagttacatgtatgtgattattaaaaaatctagaagaattaatagagatttagaaggagaataaatggcactaaccatggcccatggcctctgatcataaacacactgctcaacatctcacccatacatgcttgcgttacatgcattctaaattaacgcatgcataaacacactgctcaacatctcgtccggggaccttcttatccaacggttcatatgcgatctcatccaccgatcgaacggctaagaattagcgatgacgtggaatactgaggtttcagctttgggtcttaactttatagaaaaaatagatatgggtgatgatctgacacacttacatattgagctttatgagttaacagataccaactttatactaaggtaggatatgacgatcaaaatgagcacttttcaccaaaacatgaaagcccaatattttttttgtggatgcctcgccaactatggctgtgttcggcatcctttttcccaatcggaacggtacacacgaaaaacggagcgtttcattagcgcgtgattagttaagtattagctattttttttcaaaaatagattaatttgatgttttaaataactatcgtatagaaactttttgcaaaaacacaccgtttagcagtttgaaaagtgtgcgcgtggaaaacaagggagagtggttggggaaaaggggtgccgaacacagcctatatttatctcaaattttctatgtatactcatttatcttgtcaaattcacttgttgctttaggcaccctcatcatttttccttctatatatgacttgtttcagattgccgtatttgaaaattttcattgatcatttatcttgtttgttggttgttttattaaacatagtattgtcataatcattgtcagataaccaatcatcgggctaattatcaagaaacttaaagcaccctaccccacttcaatgaccaagatattcaagggcttaacatttgagcgggacatgtcattttactacctttgtcaaaagctcgcatatgccctgttatatcattgaggaagagaagtagactcaatggatctaaagtaccaacacaagcatgatcccatgaggcacgggatatatagagattaatgtcatagatataatggataaagaaatggtggctctacccttagttcgcattcaaagattaccaaatatggttaattagatatataacattacaaattttttaattttgaaatttaccactactattcatttatttagaactatgctattggtatttgtctgaaattgtaatggtgccattgacatacatattttacatatatgtgacggaaataccctcatcttcaacctctctcctctcagtctcagactctcagttgcctcggtatagcaggagcagcaggagctctttctcactcactctctaattaatccttttgtgggttaattagatatatgctgccggtggagcttggcgtggtgcctctcaccagcatcgggggctagtctcgtcggcgtcgccaaggcgcggcagacaacgggcaggtaggaggaggcgatggtggcgttgcagtagacggcggcagtggtcgtccaccaccacgtcgccacggccatggccccgccagtggcgcgaggacgaatggaagacggcaggacgctggcgacacgaggatgagcagacgaagccggcgatacgaggtggacgagcggacgccagctcaagattcggcggagctcggagcggacgaggctccggccagctctcggtggattcggcgccccctctctcgctttatctggatctgggcgaagccacttgcggcggagctcgggccaggatgcaccactgctccggctagacggcgtcggtggatctgtgacagggaggctcgggcgtagctgcgcacgaccggtggcggagctccatcgtggccggcctcgtcaacttcaaaagttcttccccggcgccgtctcccggcggcgggcagccgcgcaatacctctccgccgccggattcctggtcatcgtctcaccgcgcggaggggtcgtatggtcgtgtcgccggggactacgtcactgcgaggcagcactccgccggaggtggggaagaaggcttcggctggtgttacacagaaacgagagatggaggaggaagacgggggcaattatgtccaatacggctaaaatatgtagactagtggcaggtttcaacttacatgcaaattgtaatggcgcggatccaaatacacaaattataatggcatatctcaaaacacatcaaatttataatggcatgtatccaattaacctaaaaaatatcaatcttctatacaaacctatgaggatgtagttagtcatgaaatgttttactagtaccgtgctagaataagaatggattaagatatgcaatataaggtattttaggacccataaaccttgtgtacttggccttgatgttagccaattatgttgaacaaccataatcttctcatttgtgttatccccacccatctaaagttgtttgattagtaaatcaaggaacaattatgtcaaacaaacatcaattcactatcctataaagtagaaagtaaatattatatattttttgagtatttaataaataccgttctttccatcctaaaatgtaacaatttttagttatgaatgcaggcaagagtttctgggacagagagacacatagagcaatgtgttctatattacatgtagtttgtgcagcgttctttccatgactttagagagatttgtagcacacgtgaaacgagaaaactcattaacatgtgattattaagtattaactattataaaaaatttaaaaatagatttatttgatttttttaaacaactcatataaacttttattataaaatatgcaccatttaacagtttgaataacgtgttaacgaaaaatgagtaagttgaaatttggagttgaagaaaataactgggcctaagactataatacaatccttactcaacattcaatatttgttccaaaaaggacaaaaatatccgaaatggttttagtatttatctcatcttcatgcttcaaaggttactttttatacgttaaattaataaaaggaaggaaagccaagagtaaattctttatttttcatggaagttgacttagtcccttattttctctcggaaactctctctccctttattgtgacatcacccttcatttttaactattcttctttatttgcccaaagaaccataaaagtattttttttgcccttggtagttcacaagaggtgctctctcatggcaaatattttgttatcacttacaaaattcataattatgatgcttgatgaagagtgtaattgaactggtaatgatgcaccaactaattattatgatctcaagaatttcttaacacctttttcattattaccctttttattcccatatggtatgagggtaccacacattccaaataaattcataatctgcccttttttttaaaaaaaattctcattaatgaaactaaaactgtatgttcataattttattcatcaatatgtgttgtttggatgacacatgttaattaaagaaaataatactattacgatttttttaaaaatttacatatgatgcaacgaataaaagatatacttatgataccatatcccaattttatttttttccgtttaaagaaaataatttattagattctactattcatgcaggggtaagatgggcattttttgaaaaatttaaatgaagaaccactcaagggcaaataaaaaaagttgagaaaaaagagacaataaaaggggagccaattttatgagggccaaatatactattataaaaattaaagatgtttttgccggtattttggtacgtcatccgtgtatgagtcggtttttaagttcgtttgcttttgaaatacatatccatatttgagtcagtttttaaaatcgttcacttttggtaatacagaaggaatcatataagaaatatgtttaaaaaaactcgtatgttaacttgagacgatcggattcctaactgcagctcatgattttctaaaaatatatatatatccaagcagactcccacactgaattttatcttaactaaaccatataataagattaaaatagactttacccgttgcaacacatggacattttttctaagtagagaatacattcaataatttagagggcaaataagtaattatctcggaatccaagattatgtttaaccgttaccaccatttactttgcactagagtacaaaattctctaaccgacctagtaaaaacacagcttgtaataacatcaaacctacagggtcccaagtggaaaactcccgttgggatttttacatcccaatccctcccgctaccaacaaatcccaaatcccccacgccctcacctcacctctccagattcggaggggccaaaatcaaaatccacccgccgacctcttcccctcccccctctctttccctctcgccgccgccgccgccgattcccagtcgaaccggcgccgcccggtgctcggaggccgccctccgctccgcccgccggcgaccatggaggtgagtaatctgtttcgagcgcgttggggttttggggtagtcagcgagcttttggtctcacgccgagatggcgcttcctctctctttgttccagggggacatggacgcgacgatgacaaccctggggccggaggacgacacgggcgcgcaggggctgatcctgccgagcagggatagggtcatgtaccggccgccgccggggaagtccgccctaggtatggtggtgcttggttttacttctgcttctgtatttgacgagacttcaggaaattttgattttaagtggatttctagagttgctagggagttcgatttccgcgagcgagattagtgtgtaaaacttgatgagcagatcccaatttgaatttgactcagaaatcgtcgaggcctgcaaaatctagagctcgggtgagctgattctgagatgtggtttttgcaggtttggacctcctcgcgcacaggaaacgggaagcagaaggcggcaatgccttcaagccgccgcctcagaaggtagtggcagctgctacttcaatcgatgaagatgagaagccgggacctgcggagagtgatgagaagagcctgagcagtggccatcgtggcagtgtttctcgccgctatcgaggagccaactctgatgagagaacctctttcaaaggtcctatatatatacactcttgtatgttacaaatgcaaatgattgtccattgtaactaaagcgttatcgccattttcagaacctaccatcactgatgaggatggaaggggtccttcacccagtcaccgagatggatcttatcgacaagatgttagtgattacttgtgtcccatattactttgggaacttcataaagaatctggctgttttattttctcttcaccttactaaccaagtctgtttctgttcatgtcgttttacagacccacaaatctagaagttctcaaggttcccattctcgtagcactcctcgtagatatgatgactatgaggataggggatcccgtgataaacatggagaacgggaaagatctgcatccattggctatagtagcagtggaaggcggggacaccatgatgatagagaatcgcataataggcgtgatgaacgtgagagatctacatccgttgactacatgaacaagcgaagtcggcatgagcatagctcaagaagctcaagaacacctggtatcatgtttgttatcttattcttttcatgcttaggctaattggcttgtcacttgctgataaaattgtggctgtgattgcaaattgttagcaagatctgattgggacagtggccgatgggaatgggaagatacacctcgtcgggagtaccgtgatgatcgctcaaattcccatagacaacatccttcaccatctcctatgcttgcagctgcatcccctgatgcacgcttagtgtctccttggctaggtgggaatacgccacgttatgcaggtaacaaaagctcagctattcaatgttgtttgcacttttcttctttaatttaaatcaaataaatcatacttctattgttgttttgaatatccagcatccccatgggataacgtatctccatcacctgcaccaattcgcgcttctggttcatcaaaagggtcttcttatccacgttctggtggaagatcccaccagcttactttttcgtctacatctgcatcaaatgtaagtcaggattctgttttcacaaaacatgcctttatgtaggaaaaatcaaaacatgcctttatacaggaaaaatcaggtgttttttttttttgcattcatctcatatgttgcaagttcggtatgattattttaagacatccatacacccaggaggtgaagtagagtagacgaagattgtagtcctatgggctatatacattgtagagagttggaagccccattcatacattcctaaacactatcacatctattgagaaattaatcctccttttagcacgacagtcttttaatgttgaatctcctggaatgccgatttttagaagtggtaactctgctggtaatttaattcaaccatttagaccagtgctcgaaacaatgataaatgtaatgaagcatgtattttgttcacttttttctctctatctgtgtttttagaataattgtcattggatgttcgatatttatttctatgaactgaacgtgtgtatagcattacttaaactataactgaagtaatgttacgaaattaccatgtgactgatctaagttgctttaatttttctgcctctttctgtctgaagagtattacagttaggctactatgtaattcatttaattatttcatgtactttcaatcaaacaatagacttgattgagtctatttggtatttactgacagaagtctaactaactttaagtttcatgttgtttgtggatcactttatagtatattgcaagttctcattttgtttcttcactggtcattctgacaataacctctaccctgttatctcaggacagggaatctgatagaagcccctcagatgccgatggcaactatgagatatctgaagaaatgatgcaggagatggattataatgctgatcgtgcgtggtacttttctttcctcataaaatttccctggtttttgtattcaaaaggatgatgtaggtgtctgatagaaaaaaaatatatttgcaaaccaagtgatcaacaaagcctttcaattgctgctgttgcatttattggctccatttataatagctaaaaatggtaatggcatctgaagtaagttggcacaatgatgtttttcatatatctgtaacaaaattctgattttatgccatagttctatccagacatggtagtgtagagatatgaaagtacaatgatttttgacattctcttatcattatacaacaacaaattgattacacattcttctaacctttacaaatatactccaggtatgattgtgaagaacacaacaccatgtttgatggtgataattctatgtatcttgaagatgatagttcctacaaaaagagggaagcacaattaccaaagcggctggtaagttccttgcttgtttacatctcccgtgcttccatgcacttcgtgttagccttcataagttcttatttgttctgagtaattgagtagaacttattgcagctacagcctctatgaaaccatgaatatatctgattaattagtaaatgataaggtcgtgctattgtggcgctggactgaatgtatggatctgatacttctatcttctagcaagactccgcctttgtaaaaatgtcttgcattttgtgatttactgtaaacatccgataatttgtactcagacatgtaaaagtgcaccggtaagaagtaaagtaaggcttgagaataccaccaaattagatgtatgttttttccttgttcaagttccttatgtatattatgaaaattgcatcatcattaggaaattgtattcatttaacttttttcaagactgccaaacccatgtgcagcaagacctgcaaaaaattggatggtcaagaattatccacttagtttttcagtaaatatagttattttgtaataatttttcatatctttaacttgtagagaatgtcttgtattctgatttcttactatttttattgggtgcagactcgtaaagatggcagtctgatgacccttgctcagagcaagaagttatcacagatgactgctgataatgctcaatgggaggatagacagttgttgagatctggagctgtcagaggaacagaggtgcagacagaatttgatgatgaggacgaaaggaaagtaatacttcttgttcatggtacgttcttcgaatatcgcagcctcttatcgatgttatagttgtcactaaacaagctacgaaaatgtttggaaagcatctatctatttctcatgtaatggtgtatatgcaattttacttatgaaaataatagacactatttatgttggtaaggtaagctcgcagttgtactaactgatgaggtccttgcatctatttatcttattatgcatttactattacgtgcatttgctagtagatgtggctgcttcatgtgatccttcttgtagatactctcggaacttctatgtcgcagaaagaatgaaacaagcagatattgaattaatagcgggtatgagctgtgaacatatgtaggagaggtgttatgtaccattttcagggcacatatttccacctttcctgtctatgtcagtctgaaacttctaacctgcattaggagttatctatgttctctgttttctctgttgtacatgctacattgtatcgaattttgaagagaatagaacattacctagcgtgctgcatacttgtttcacaaagtttttttactactacttgtttacaatatattgatgctgttgaacttaaaaatgctgacggtataattttttgcagacacaaaacccccattcctggatgggcgagttgtattcacaaaacaagcagaacctgtaatgccactgaaggacccaacctccgatatggcaatagttgcacgcaaaggttctgctttggtcagggaaattcgtgaaaaacagagcatgaataagtcacgccaacgcttttgggagctcgctggatctaagcttggaaatattttgggtgttgagaaaacggctgaacaggtagattatttgccataatatatatagtcctaatagtgtttagctggtacgctttacttattttttttttgaaaaatcaggttgatgcagatactgctactgttggtgaccaaggtgagattgattttaaagaggaagcaaaattttcacagcacatgaaggtaaaagcagaagctgttagcgactttgcaaaatcaaaatctctttctcaacagaggcaatatcttccgatatttactgtacgggatgacttgctacaggtttgtaactaaagtttataaactcattttcagtattttatttgcagttttcattttgttttcctatgctagtttacagcatttgttatgtttgaggtatgttgcttttctatagtgtaaattattcaaaaacaaatcggtagaatattttgaatatggttttgatgattgtagtacacctatgcagctatcctcaaggagaaaggtcaagataataattcttgcccttcagaaaattgtaattaatttgaaaatcaagtttcctttggaagatgttgatttttagtttctttcaaaaggatgcagtggtacaagttcttgattaccttgttttgatttcattga

SEQ ID NO: 62394 - DNA, 5292 bp, Oryza sativa
agaagaacaataacaatcctaatcaggatgagaggacttgctttgtgtgtggccaacctggtcatctggctaggaagtgtccacaacgcaaggggatgaaggcacctgtagggcagacttctaagtctgctaatgtgaccattggcaacactggagatggaagcgggtatggtaatttacctactattttttcagttaattagtctactaattggtgggtttatactggggccaatgtacatgtttgtgctgacatctcattgttttcttcttatcaggtcgcacgaggttccaccgtcctaatggggaatgggtcatatgcttctgttcatggtattggcacggtagatctgaagtttacttcaggaaagatcgtctagctgaagaacatgcagcatgtctcttctatagataggaatcttgttagtggctcccgtctaactagagacggatttaagttggtttttgagtctaataaagtagtcgtgtctaaacatggatattttattggtaaaggttatgagtgcggaggcctgttccgcttttccctttctgatttctgcaataagtctgtaaaccatatttgtggcagtgtggatgatgaggctaatgtttggcactcacgtttatgtcatattaattttggcttgatgtctcggctttccagcatgtgtttaattcctaagttttccattgtcaaaggttctaagtgccatagttgtgtgcaattgaagcaacctcgcaagcctcataaggctgccgaggagagaaacttggcaccactagaactcctacattcagatctttgtgaaatgaatggggtgttgacgaagggtggaaaacgatatttcatgacgttgattgatgatgctactagattttgctatgtgtacttgttgaaaacgaaagacaaggctctagactattttaaaatttataaggcagaagttgaaaattaacttgatagaaagataaaaacacttaggtctgatcatggtggagagtatttctcaaacgagtttgacttattctatgaggaacatggcattatacatgagaggacgcctccatattctcccgagtctaatgggattgctgaaaggaagaaccgcacactgactgacttggtgaatgccatgttggacatcgcggagctacctaaggcatggtggggggaggcattgttgacctcgaatcatgtgttaaacagagttcctaatagaaataaggacaaaacaccatatgagatatggattgggagaaaaccatcactttcttatttgcgcacatgggggtgcttggcgaaagtcaatgtaccaataacgaagaagcgcaaactgggacctgagattatggactgtgtctttctgggatatgctcatcacagcattgcctatagatttttaatagttaaatctgatgtacctgacatgcatgttggtacaattatgtagtctcgtgatgctaccttctttgagagctttttcccaatgaaggatacacatagtagttcgagccaaccctctgaaataattcccagttcgatcacaccaccagaacaaactaaacatacacacgaacatgtcactaaggaggatgtcagtgaagctcctcgaaggagtaagagacaaaggacggctaagtcctttggtgatgatttcactgtgtaccacgtggatgacactcttaagtcaatttcagaagcatatgcatctcctgatgtagactactggaaggaggctgtccgtagtgaaatggattccattatcgctaacgggacttgggaggtgacagagtggccctatgggtgtaaacctgtagggtgcaagtgggtgttcaaaaagaagctcaggcctgcggtactattgaaaagtataaggctcggcttgttgctaagggctatactcagaaagaaggcgaagatttctttgacacttactcatctgttgctagattgaccacaattcgtgtgctaccttccctagcagcctcacatggtcttctcgttcatcaaatggacgttaagacagattttcttaatggagagctggatgaggagatctatatggatcaacctgatgggtttgtagttgaaggtcaagaaggcaaagtgtacaaattattgaagtctttgtatggtctgaaacaagctccaaagcaatggcatgagaaatttgacaaaacattgacatctgcaggctttgcagtcaatgaggcagataaatgtgtgtaccatcaccatggtgggggtgagggagttattctgtgcttgtatgttgattacatactgatatttgggacaaaccttgaggtgataaatgaggttaaatcattcttgtctcaaaattttgatatgaaggatttggaagtagctgatgttatcttaaacattaagctaattagaggtgagaatgggattacactcttgtagtcccattatgtggagaagatcttgaatcgctttggctacattgatagtaagccttctccaacaccttatgatcctagcttgttgcttcgcaagaacaaaagaattgctaggaattaactggaatactcccaaatcattggctcgctgatgtacctggctagtgcaactaggcctgatatctcctttgctgtgagcaagttgagccggtttacctctaatccgggagatgatcactagcgtgcgcttgagcgagtaatgtgctatctgaaaggtactatagaattggggcttcactatactgggtatcctgcggtactggagggttatagtgattctaactggatctctgatgtggatgagatcaaagccactagtggatatgtcttcacactgggtggtggtgctgtttcgtggaggtcttgcaaacagatcattttgacgaggtcaaccatgaaagcagaactgacggcactggatactgctactgttgaggcagaatggctgcgtgatctactaatggatctgcctattgttgaaaaaccggtgccggctatccttatgaactatgacaatcaaacggtaattgtaaaagtgaatagttctaatgataatatgaaatcgtctagacatgtgaaaagacgattgaagtctgttaggaaattgagaaactccggggttataatgttagattacatccaaactgctagaaacctggcagatcccttcacgaagggactatcacgaaatgtgatagacaatgcatcgaaggagatgggtttgagacccatgtgagttatacaatggtggtaacccagtctatgtgatcggagatcccgtgaattagaacctgggaagaacaaaccattagtaaactagaggagagtaccaatctataccctctctaagtgaagatgcatgtactctcgtgagctgcaaggtaggttggttatggcttaatgagttctgttggctttaattagcgaagatgttatcctgcagagcattcttgaaagaactcacctttgtaagcttgactattgatcgcagtctatggagattttgggtgaatcttctaggaagcttactaaagacctaggagtatgacttatacgctccacccgaggggtagtctacagacggtatagtactagataagactctgagtgaaacttgcttgcacgagacttgcaattcaaggcgtagtccattgttcaagttgtgagtaagtgtagtttggagttctaggtggatgttcaaccttaatcggtctccatcgaaccgctggtatataaacagtacatttgaaaaggcaaatctcagtgggattttgagatttggtgggggattgttggaattaatagatgggctaagacccattcgaagattaattatttggaaaatcacaaaagcccacctcatgggatggcatgcatgtggagtttaggaccaccttgcttattctaggagaggaggacctccttaaaagggaggatgccctcctagccacttgaagcatgtgtggtggagagaagagggggaacacacgcgctcgcctcgcctcgcctggcagggaagggcaggcgcgtcgtgctcctcatccttgcgcagatgcagcctccttttgcagttttgttttgctgcggaaaattcggatttgtttttgttttggaaacattccgaaaaatccggtgcgtgaaaacggcgtgaagtccggataagttacgcgcgacttatccggttcggttacacggagtagagatcgtgcgggcgccctgatcaagcgacctatctctatataaaccgagccgtcgccttcacgcaacatacgcaaaatcaatctagggtttgcctcctactctgtgctgcgccgtcgctcgtagacaactccatcccgctcgccggcgtgcaccggcgatcaggagagcaggtctccggaacctctaccttcatgtcctgcacggcgagaaggcggcaataaggtttttgggaagcgcttcgcgcgactgctccctgttcgttcgctacggctcgccttcctctctgctcgcgtgctgcgcgccttcgtcaacgcccgcaaccgcgagtagtacctgccgagcaaccggtttttccgccacctcggtacgtgttcgacatgttgtgcatatttgatccgttcatgttttactgcttagtttacatgtgtagatctaatgatgtgttcatgctagtttacatctgcaatgtcatgatttatttatggaataaattaaatcattatgtgcttataatttctacaatccaaaaaccttattataggcgctgtgattttactatggctggttttgccgatgcactgaggccggataaattcaccggtgtgcactttaagagatggcagatcagggtcactctgtggttgacagctatgaaatgcttctgggtgagtactggcaaacctgaaggagttcttactgctgatcagcagaagcaattcgaggaagccactactctctttgtgggatgcattcttagcgttcttggcgatcgtctggtcgaggtgtatatgcatttgactgacgctaaggagttgtgggatgcactgaatactaaattcggtgctactgatgctggcaatgatctgtatatcatggagcagtttcaagactacaagatggctgacaaccgttctgtagtcgaacaggctcatgagatacaaaccatggctaaggaactcgaactccttaagtgtgtcttacccgacaaatttgtggccaggtgcattattgcgaaactacctccatcttggagaagtttcggtactgcactcaatcacaagagacaggaatactccgttgaggggttgatagcgtctcttgatg

SEQ ID NO: 62395 - DNA, 3243 bp, Oryza sativa
aattttgagcattgtcaaatcgtgctacagatattggccttcatagactgttggcgctagatgtctgtgactttgatcaaacagagctcttgtttccaatgttactgatggcaaaattttattttattttattttttccttggcaggaactttgcaaaccattttcaagtttcagaagcttctgaagatatcattgtgtgggaatagtaatgttgcacagatcgacacctgttcactcttatcatctgaattaagatttggtactactctaatcccatgataaatacttatatgcaatactcaacctaaggttcttccagctgagagcgttatactgaaaattatgatcagactaaccctgaaaaaattaatgaaattttacctgttgtggtgtttctgggagctggttccatttgctcgtacgcttgtggcctccggtggcagcgcggttcaggtgttcagctacgcgtggctatgttgagttagtacggtgcgatatcaaccagtgcctttgatctgtcgcattttgatcagtgatgctcatttagtgagttcttacctgtgctagattgctagaatgctaaatggtacagtttctgtcttgatagctgcagcacctaaacctgttctacatcatcggtaatgcattttgtatattgataactcaaaattttaaggccacatacttatcggaccaaagcaatgttggaattaatagatgggctaaggcccattcgaagattaattctttgaaaaatcacaaaagcccacctcatgggatggcatgcatgtggagtttagtaccaccttgcttattctaggagagggggaccttcttaaaagggaggatgccctcctagccacttgaagcatgtgtggtggagagaagagggggaacacacgcgcacgctcacctggccaagcaggcggcgcgcgtgcacgttgttacgcgtcgaatggtccgcaaaattagctcctcactcttgcgcagatgtagcctccttttgcagttttgttttgctgcgggaaatttggatttgtttttgttttagaaacattccgaaaaatccggtgcgtgaaaacagcgtggagtccggataagttacgcgcgacttatccggttcggttacacggagtagagatcgtgcgggcgccctgatcaagcgacctatctctatataaaccgagccgtcgccttcacgcaacatacgcgaaatcaatctagggtttgcctcctactctgtgctacgccgtcgctcgtagactactccatcccgctcgccggcgtgcaccagcgatcgggagagcaggtctccggaacctctaccttcgacgtcttgcaccgggagaaggcggcaataaagtttttgggaagcgcttcgtgcgactgctccctgttcgttcgctacggctcgccttcctctccgctcgcgtgctgcgcgccttcgtcgactcccgcaaccgcgagtagttcctgctgagcaaccagtctttccaccacctcggtacgtgttcgatatgttgcgcatatttgatctgttcatgttttactgcttagtttacatgtgtagatctaatgatgcgttcatgctagtttacatctgcaatatcatgatttatttatggaataaattaaatcattatgtgcttataatttcaacaagcaaatgtacatgatacagagagaccatttctgaatttaacaaatttagaaaccaatgtagccatggtccagaagaagtcaaagaaccaatctgactgtatggaggtgtagatgggatcgtgtttgctgcaccaatttctggggaggcatgcgaaggaatgaaagggtgcaaaatggaaaatagcaagaggtggttaaacaccatcatcatgttgccgtaagtatgtaattaggatgctaagcataatttagcaaccgacaactgcatgttttcttagggatttctactactctcgagggatctgtctaagcatttaatggctgaggggtttggctaccatacaggtagcctagcaattaaattgggttagtggagtgtatttggatttttcattgtgctctgatttaatctgcactaatagcttcaatttttcacttttgaacttttcaagcaaattgtttgttttcatgcttctatgtaattggaccccgattaattaaccattgaatttatgccgaaagtacatggcaaagattgtgaaaaagaaatggagtagtactatttgtagatttaaacatatataatttataaacaatttatatgtagcctctgtaagttggttttcttttgaattcaggtaaggtttatctctccagtctagacatcagttttgctacactacagtgtattattcctaatggtatatattacaattgtctatcagaattacgatggtggcatattcaataagatcgttgcttgaggagagaactgggagaatccaaaggttcctaacgaataagttagcttgttttttatttactaagataggcatatggttgcctggtagtgatgatggttttgatgggtaggttttctctaagatggaagacattaatgctccataagcacgatgcaatagtattgtatctaatttagttcttaacgatgatgtcgatgctaaggctccagaacataatttatttatttagatttttttctttcttttacgtttttgtgcttaatacttgtgatcttgtttgaacataatgtcagaaaacttttgaaacatatattgttacttttggttgtttgctttacattataaataatgtcgtagcgttagcacggacatattactagtaaaataagtttaactaagtggaagaaacataaagcactctattactattcttctaatatacactcaaatcttagtttacatctgctaatatacaatcatgtggccaataccccctaacagtgtcctcctggtacttcgagagaccaccctgggttggcgagatacttacgacaacctgtcatggccgtccaaccggggctacatatagaggagtaccctcccttcgaatttgtcttaggaatatatactaacgtggagaaatacccatactgagctatcaccatcagcggcccacctctaatgtcctgcaacatatatgcccaattaatgatatttaataatctaagcaccatgctaacattactaaatactactctatagcgtgcacccgacatagagcaactgataaattagacattaaactcgcaccattac

SEQ ID NO: 62396 - DNA, 1810 bp, Oryza sativa
aacaaccgtcaacgaaacccccaagcttaaacctttgctcgtcccaagtaaaggacgaaaggaaaataaacttggttgttgatcaggagttgctaccattgttatatttaaaatgtacaagtgcatagtttgagtactctctctctcatgttaagtaaatgtgcacggaggcttacccttacgcctaaaaattgtagaacacccgcttctcaccaccttaggcaattgagagacagaacagatcaactggagcagggaactttatactttgtaaccattgcctactcataggttgcacaggagaaactttaattttactagatgctagggcgcgccattgcgcgctgcctgcatacactaaaatacgtccatgtactaaatcaatcaattgataaatatattagtaacatcatatattctatattaactctcctgtgtatatcaatgacaccagacttgagtcagtaatccattctatgtaacaaatatcccatgtaactacaaagtaatgggcactttattatcaatgcaaagcatcccctactaaaacctcagtttgttacactattagttcaaacatgaacacaatgctttcattatataaaaaatataagtaattccgcgtacaaattgctttggtacatacaccaagagaatgcattggtgtcataaataattgatgacaaatttaaaggtcataatctttgcaaataggacaattgaagaacaaagggctcgactttccaatattagattcagcatcgcatcacatcctgaaaaatgtaaacaggttgaaatgaaagcaaacattagctaattaaatcacattcaaaagaacctgcagacctgcaggtacatactaataccctaatagtaacatcttatcatagtgcgcacacactaagggaaaaaaggacaaccttgtttctaggcctatcagtgctagaggaacattgatccatggatgtatttttatgaggtagcagcaatatataggagtattttgcaaaatcacattcatcaagttataaaccaaaaaaaaaaaggattttacccttgaagtaatgccattctatcttctcacagctgcagttttgtagccatatacaggatagtgtaagtggagccaaaattgtagcatatctattgtgtcatttgtggaattactaatattagtatccttcaagctgaaagtgagaaaagcataagtaacttaataactaataagtctccaaaggctcatccatcttttactaatataaaaaaacatagtggcggtgatggtagcattctatgatgaataatattgtactatctttttggtaaatgagtgaatcattccattagatactcatctgtatatgcatgaggccatttcatttaacgtgaactcataaggaaatattttagatttggggataccattttttttctagtttagaacttttgatatatttatgacaaccatcgacaaaatactgatttcaaccaagtataacttcccaattttttgctgaaaactaatcaacgtctagcataagatgcagggatacgcaaacatgatttacatatttataaaaatagtcatgtgcagagcacccacacaataccaagtgaccgctggcccttttgaaagcatgaaagagcagggaaaatagatggctaaatccacaatatatacatgcattttttgcgaggattatatacatgtaatccatacacctttcttaaatgaaatacataaacaacttgcaaaccaaaaataaaagcacaaagggacgcttaaatacataaaaagaagatatattga

SEQ ID NO: 62397 - DNA, 1856 bp, Oryza sativa
tttcatggccaaggtacaacaatcctcatctaacttagatgcttcactttcctgattacaagtttacaacatctccttaaaagttttgaaccataagcaaaatttatgtatatgctatatggaaccaaaaccttcaagatcaaactaaaaggtagtctaaggaacaaaatctatgccaaaacggtaacgataactactatatttgaaaaaatacttgataattccaaaaaaaaatatccacgagattcatttgagtaaataatgagatggaaataaaatgtagccttgaaagctattgtaccaatcaacagcattctgtttactcatgttcaaatgaaaaggagcacataccatgcccagagatttggaagtataaaacaactgaagcatcactcaccatggcttccacaatgtccttgactgtttcaaggctgaaatatttttctatagcctccagcctatagtaacacagaacaaatgagatatacatgaacaaataatacatttttcctaatcagtgacatgaacaatgtggatgctatacatacattcacatgaaaattcatcattatttaagaatataaaaaagcatgcaaggtgaccccattctcagcacattcaaagtgcaaccaatgtatattactaccagtcaattatattaccaagcgaacctagctcccaaagaaatatataaaccacagctttacaggtaatgcaaagattcatgaaccacacaaaatagcactcggcttgattaaatgaattaagaactatatgccttataaatatagaactatctattccatatttccatgacagttttgtgtgtctttctgcagaataatgtaattacactgaaatagatgatggtctgagttctgaaatgcagtccaaaacatttttaccaagcaaaggaaagcatcttgattctactataattcccatgctatgtttaaaagaggacaagattatctagcattccagcaacttctgcatatgacatgttaaagcacttaataatacattctcagtttataaattagaaatatatttacttcttatatgtcttacctacaaataatgctattcttatccggatacacaatatcctcatgtatagaaataatgctgtcatcatgctgagagagagagagaggtcatttgtgaagaagagcaatactgattcagaactaatcatcagctgagaaaaataaatcatattatagtttcaggtttgtcactctatttagtaaataatgttgttccacttttttttgttaatgcgtaagttccaatcttagcatacctttgtcgagttaaaatgataactacacaagtttcttctgtctttgacaccttggtctccacagtttcatttcacttttcaaggatgaatacaaattaccaaaggggtccgtgattgagccctcaagagaatcaagacatgtgcttaaaataagtagtaagctctatcttcaccatttcttccctttctttgtcgtttttttattgacagctttgtagttgatttgagacagtgcagatagtatttactttgatggcatgaagaattttgagaatcaaactgaaatgttgttagaatgaatgggcatgtgtctgatacagtttcccgatacctgggactattttctcattctattcatgcatttggttagcattgagtgcatgaagagtagcaaataagtcaccacagataatgctgtagaaaatccatggccttttcataattaaaccaacttctatcctgttttcattttatcatgccaaaaggaaaagaaagaagaaagaaacatcataatcatgtaacactgtgaggtagcatttcaatgcaatga

SEQ ID NO: 62398 - DNA, 7279 bp, Oryza sativa
aatacatagtctgaaatatacacttcctgataatcttgaaaaatctaaggcttgatgacatattttatatccacggatagtttaacctgccatatttatcttcgccctagcttatctgtattccacaaatttatgaagtagaagaagtatatctgcatatctgacctcatagtactgaatacacataggtaaaagagaaatgcattcttcagtcttggtgagacagaatcaacagttaagaagacactacagatggtcgacatataaaaccactcagacattgttgtggcttggattaagaatgtacgtaccctgaaattagtgtcaggttcaagaaaattaccagcataactggtgcccgtcgcaatctgtcaaattcttcacttacaaattttcctcacttccctttctcctctacacaagccatagaacaaataaatttacatacttttagtaaaagaactatagcagccacatcgaacagtacactgggggaggttcggtttggaattgtggcgcttatgacataggtttcactagactactctagaccttgcaacacatcacgagcttgcaaataagcattgtggtagctaaagcgacaacccataagaaagatcaatgttgcagtgctgatcaatttattttcaccccttgatgcaaatcatctaaaaacctggactaccatcatattacctgaagatgaattattgagagctgaagaacatggaaaattctggtatgcaatccaaaggtgtcaaacctgacatgaaaaaggaaaatgatcagatcaacagaggctcatcataccacaccatcctcaattttaagtcaaccaatctcatattatttgcaattgactgaaacctctgcatgaattaattatttttgtctctcttttccttatggctatcaagcaaccatcagtgaccaactgcagtcccattttaagtatttaacatttaagaaacattaagtacagtaaaatgggagattgagattaacatcttttgaataatagtgccaaatataagctcatcctcctaccagttgtactaaaaaaatttgactgccaataaccaatacgctaactactaaaaaaattcatccagtatgtgaagcttctaaatttttccacaaacacactccaaaatcctattctataactaagtcccaagaaaacctaaaataccaagaaaaatactaagaaagagaatagattaatgcatctagaaatgaatcataacagattgctagaagtgattcgctattgattgttcagagggcaacgagtatgaaatatagctaaccaacctggtcctctgtgttttcagatgtcatggcatggtcacagcaagcagaacaaccagctatggtggaggattgatcagagtcgtttatatgatcctcaagcacaacactggaatgaaaaggtgccacatgtatagaaatacaaatctgaaatattaagtaaccatggggaaaaaatggctcactcattggggaagcatgatatattgcagattccttcaaccaaaaaagccgaaaccaccaaatacaaaacaaattttgagacattacccaaatgcattggctctgaagtgaaatgataggcatgttactgcagatttattcgcggcaaaagagtttcaactttccaatcacccctccacaaacccactccaaaaccctattctataactaagccccaagaaaacctaaaataccaagtaaagtactaagaaagagaatagattaatgcatctggaaatgaatcataacagattgctagaagtgattctctattgattgttcagagggcaacgagtatgaaatatggctaaccaacctggtcctctgtgttttcggatgtcgtggcatggtcacagcaagcagagcaaccagctaaggtggaggattgatcagagtcatttatatgatcctcaggcacaacactggaatgaaaagcccagtcaaaaaaacactagaatgaaaaggtgccacatgtatagaaatacatatctgaaatagtaagttatcatggggaaaaaatggctcactcattgggtaattgcagatttttgatgggatgtctccatctctaaagcagcttctagtattagtgcaagactgcttcactatggaagacatataatcctttgaataagcattgtagtccctttctttacttggcactgcatgagacaccttgatgtgagtttatggaaattgttcacaatttttttataaaaaaagaaatctctaaatgctatacaaatgggagaacctatggcaatgagcatagtgttgatattaggttccaatgttgtgattgcaatgtcccatttttcgaactttcttctagagttcacctagaaaaaaagatctgatcagtacttcaatcccagctgatgagttcttttagatggaatggatgcaggttctgtagaacatcataaacatggcaagattagggtctctcaaaatttcatcaccaacagtggcattagagcacctggtaaattggtataatagttaggttgctccattgcattaataaaaaaatgaaaatcactgtcaatgttgatgtgcaacaattcatggtgtataggggaaaaaacgagattaactattcctcatggcaaccttaaaagaacaactcacacaaacctgcacatcctttgtaagctcctgtgccaagagtttagtagtcaccgtcgccaccgccgtctctggtgccatgagttgctcgctgctggtcattggccttgtacattgacggcaacgcggctgccgatgaagcgactacctgtgacccagagggcacagatgggagggaaggggaaggcattggtgcggcgtacggtggatgcccctgctgctgctggtggtgaagtggcttcttaacgcagtctgttggcgacggcgacagtgagggcgacgccgacgaccatggcgacgccgatgagtggtgggctggggtgtccttgtggagatgagaagcagatctggcgccgggaggacgaagaccgcgcccgcctcaacccccactccctccgccgtctccccctcgagttgatgcgtccggaacctcgcggcagtcccgccgccaggattgggccctcagcttttcgcgccgcctgtgatgcagccgtcggcgctccgacctcgtcgttgacggatgccggaggcggagacggctgcactcggtgacggcggtcggagacggcgacgcaatggcgccagcggcgcagggcgacggggacgatgatggcgacgacgcgagggggatgcggaagcagaggcgcttggagacggtgacgcgacgacagcggctgcgtaggcggaggcaatggcgcgaggggaaggcggaggcgagggtgggggaggagacggcggagggagagggaaagggagaaggagagagtgggggaagagagggcggaggggagacggacggcggcagctcggccggcgatggggacggcgggaggcggaggtggcagcgcgatggggaggcggcggcgggggtggaggcggcggcgcgaggcgacggggacggcgtgagggggaggcggaggcggcagtgcttggtagcggcgcgagagagggagagcaagcggctagggtttgaggggtctgcgctagtgggagtattttttcgaaaaagcccctcgtcttccacatatcacaacgaagcccctgtccgcgattttttctcttcaaacacaggacgcgaggggcctatacctgattacgaagaaccggagggctttttcgcaaaaatccaacctcgcactgtagctactgtagcaaaatccgacgtggacacgcccagcgtccgccccttccgccacacttaatagtttctaatgaaccatggcatatagaataatcaattcattatcagagacatggcaatccatttgtacataagcctaagagttagattatggatgtcattggttctgggtttcttataaatcggtgcaccagaaatatcttcacagaatatgtttttctcaaaaccggaagttgccttccaaaaatcgactctacaggattcggggaaaccgagaagtgtgctcaatccactacataaaagattaaactctttacggaaaagtcaaaaagtaacaccaccctctgcttctctaagtgtgcagagaaactgtatagttagtagacaagagcctaagtgtgcacagaaactgtatagttagtagacaagagccaagctcgtctaccgttgcaaaggcgtgccaacccatggttctccaaatgacactaaaatctacatccatacttgttttccggagtagctttggatcgtacgctcggttgtgagcgaatgatcggtccttcagcatctggtaggcttgtttctctcgtctgtcaacgatatcgaggtcgttgtcggtcaggagctgtggtacagcgtcagtgttctccattgacacgtcggcagatgcccgatcgctcgactggttggatcgggagccggatcccttgagcaagtgggagagccgtctcctcatgactgcacaaaggcaagaatacaaagcgaactcgagcaggggttagcacaagacaatatacccgccagttaactttgcaccaaaagcaacttgctaatgcgagaatggaggattttaactatgaggctgttggctgttgttaatgacagactttatgccaccaatacctgcataaatcaaggaaataaaacatccaacatagtgatagggttaaattctgacatattccacgagtgttggtgtatatttgtatgcaggtaataaaccaccaaagttggaccaaaaatagacttgagtgaagaataattcctatccataccaagagtgggccaaaaactaccagaaaacatcttcaaatgggctttccactcacagaaatggatagaggacgcagagaaggagcaacaggccgaagatgggctctgtcgagccagacctgggtttggtcgaacccatggttcggccaaccactaccacagccgttcgaactggggcttcgcgtggatggtctagatgagctcctaaatgacggttggagggcagaagtgtcttttcgcgttccataaccatcatacctgttggtgataagccctagaggcaatcatagagatgattgtatcacatactatatttacatatttatccgatattgttccttgaaatagataactcattattggttaatgaatatgtgattctttcatgagactctttatgttgtatgctactattttggatgaagcacaaagaacaactcgcactaaggtaataaagttgtttaaagtccaatggaatcaccatacagaggaccaagcaacctggaaacgggaagattatttacaattggaattcccgtatctttttgaagactcctaagcaaatctcgggatgagatttatttaaggtgggtaggtttgtaacatcctcaaattttaaactaaaatttgactgcatcatgctggcttttgactatattagcaaaattaaaatcattgttatttgaactctttttattcttaattttggttcaagtattatttctttagaactcttttaacctaccctaattatttcctttaccctaaaccttagtgaatgttggcggatgttaaatgcagattctataccgacaacatctgcataaagttcagataataaaacatccaatatagtgataggtgcttaatctcacatattccacaagtgttcgtgtatatgtatatgcaggtgtcggtgacatggggccgggggtatcgtgactagaggcttgggtagccgcggtcacccacgtggcctgaccccctcggggggggggggggggtcgggcccgagggtgacgtggccacccctccctctgtctccccaaggggtcgggccgctcccgtttcggccccgagggctggggcgcccccgtttcggccccgagggctgcgacgccccgaccccctgtggttttggcgccacgtgtgtgagttaggtgagcacagcggggctcacctaaccgcatttataacaggttggacgagcgcgccacgccgcatttaatgcggcgcagcgcacgcttatccggtctgtgaccagtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagaaccattccaggcttcagcgcaagtatggcaaggaagtcgctggccattaaatgaaggttgaaatgggcgtccaccggaaaagcgggcgagcggggcaggaggcgtgtgctctgcttgtcagaggtcacttccggctgtagactagccctcattgtaaaaagcatgtttcctttcttaggcagctggaggcccttgtggtgacccctgaccagataaaaaggaggcccaggcctaggaaagggggggactctggagagaaaagagaaaagaaaaaaagaaaggggactctggagggaggagaaaaaaggggaatgggtgctagaccctgaactctggctcgctctccagctctctgtattccttcacgcacagatccactagaacacaggagtagggtgttacacttcccagcggcccgaacctatctacgtcgcccgtgtcttgtgcacttcctctctcgcggacgttcctcagatcgagggcaaagaacctcacttagcgcccccggccgaaccggcaaaggggggcctgcgcggtctcccggtgaggagccccacgctccgtcatctggcgcgccaggtagggggcgcgcgtgtctttttaagccctcgtcctctttcgtgtgcaccaagcttctcccgctcagcctaatggccgaacgggcagtggcgcacagcctctctccgaacgctagcggtgacgacggggagcagaacccgcgccgtcgggctcgcaccccaccgtccccctctcactgaaatcttgggcggggggaggcgctcggggaggtcgaaggaaccgcgacttcaccgcccgcgggcgacgggggaggacggcgagacggggcgtgtcgccgcctcgtctacggcgatggcggcacgccccagggcgcgctccaggctgcgggcgcgctcctgcgtcacccgcccgtcgtccccgatccagagactccagcccgacgttggctggatgacgtggccgacttggtca

SEQ ID NO: 62399 - DNA, 10158 bp, Oryza sativa
gtcctccgccaccgagagcctctggcgctgccgccgccggctccatgtcgtcgaggcggagggcgcggcgagcggcggccgttacccgccgttcgtccgccattccctcgtcaacgcctccgacccaagaagatgtgcgtggggggccggatgcccgcctcgatatcgagcggcggcgcgacgcgcgccgcccacgcaacggagggcgcttcctcgtccggagcgccacttcggtccgggcacgggggccggccccccgtgtccccggttggcggtgccggctgtcgagcctttgtggcgagccttcggaacgtccgttggccccaaggttccggccccaccatcaccgaaaaatacgacggaagcgtcaaccccgccgagtttctccagatctacacgaccgggatcgaggccgccgggggtgacgacagggtcatggcgaatttcttccccatggccctgaagggtcaggcgtggggttggctaatgaacttgccacccgcgtcggtccactcttggaaggatttgtgccagcagttcaccatgaacttccagggcatatatccgcgcccaggcgaagaagcggacttgcatgcggtacagcgaagggacgatgagtctcttcactcgtacattcagcggttctgtcaagtccgcaacaccataccgtgcatccccgcacacggggtgatctacgcgttcagggggggcgtacggcgcaaccgcatgctcgagaagatcgcctccaaggagccccagaccaccgcgcagctttttgagctcgcggaccgtgtggctcaaaaggaggaggcctggacctggaactcctccgattctggtgtggcagcttcggccgcccccgggtccgccgctcggtcagggcggcgggacaggaggaggaagaaggggtcggcccgttccgacgacgagggtcacgtcctcgccgtcgagggcgcttcgcgggccccccgaaaggggaggcctgtgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagaagcaggagcgctgtgagggcaaaaccccggcggctcccaccggcaaccggcgaggtgaggccaagcagaaggccaccgccgaggacatcgacgatggcgacgatgacctggggttccaggagcctgaggccaccgtcgccaccgtcgatgggggagcgtgcgctcacgcttctcgccggagcctcaaggacatgaagcgagagcttctggccgcggcccctacccatgaggcgacgcggcgggcgcggtggtcggaggttgccctcaccttcgaccagaccgaccacccgccgtgcgttgcccggggaggacagatcgcgatggtggtttcccccaccgtttgcaatgtgaagttggggcgtgtcctcatagacgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgccaacttccgcacggagcgggtggacttcgatgtggcggacctcagtctaccctacaacgcggtcctagggaggcccgcgttggtgaagttcatggcggcggtccactacgcctatctccagatgaagatgccgggccccggtggccccatcaccgtccatggcgacctcaaagtcgcgcttgcttgtatggagcagcgcgcggaccacctcgccgcggcgtccaagcccgcgggtggcgacgagaggctcagcacctccgtcccggccgccccaaggcagcggatggtcacgtgcgacgaggtcccggtcaaggaggttgccctgggcgacggctcgtccaagaccacacgaatcggtggtcttctggacgacaaataggaagacgcgctcgtctccttcctgcgggcaaacgccgacgtcttcgcctggagaccggcagacatgccaggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgtgaggtcatccatctggagtggctggcgaacccggtcgttgttcccaaggccaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcagcgtactactcgaatttctttgggtagccagataggaagcaatgttgaggcctatgttgatgacttggttgtgaagacgcgcaaccaagagaccttactctcggatctagcggaaactttcggaagtctccgctccacccgcataaagctgaaccccgataagtgcgtgttcggcgtgcctgcgggcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcgaggctgggagagaaggcgctacccctatttaagctcctcaaacgctccgggccgtttacctggacggaggaggctgagcaggccttcactcagttgaaggcgtacctcagttctcccccagtcctggtcgccccggagccagatgagccgttgctactctacctggcggcaaccccgcaggtggtcagcgcggcgttggtcgtggagcgcgacgaggacaaccctcactccgcgcatccccaccctgtgtcgactcgacccgggagagagcagggaggagaggcccccgagccgaacggcggcccaaggcccccgacggtcggagctggccctccgcctgcttgtccgacggtgccaggcgcccccgacccccaggatggccccggggccactgcgggaaggctgcgcctgtcgccctctgaccccgaggtcatcggcacagaagccgagtgcgccccgcgtggcctctcggacgaagagcgccctggagatgcggcccctggcgaagaggattggccccgccgaaaggtgcagcggcccgtatacttcgttagcgaggccctccgggacgccaagacccgataccctcaggcccagaagatgctttacgctattctgatggcttcgaggaagttgcgccattatttccaggcccatcgggtcacggtggttacgtcttacctcctcggccaaatcttgcataaccgagaaggtactggacgggtggtgagatgggcaatcgaactctctgaattcgatttgcgctttgaaccacgccacgcgatcaagagctaggccctcgccgactttgtggcggagtggaccccagctcccgagcccgtctccgcccccgaggccagctcgggcccctcgcagctgcctcacaccgcctactgggtgatacagttcgacggttccctgtctcttcagggcgccggtgcgggggtcacgttgacctcgccgagcggagacgtcctcagatacctggtccgcctcgattttcgggcgaccaacaatatggcagagtacgagggactccttgcggggctcagagtggcagctggactggggatccgccgcctcctggtgttaggcgactcccagttagtcgttaaccaggtctgtaaggagtaccagtgctctgacccgcagatggacgcttacgtgcgccaggtgcggcatatggagcgccatttcgacgggatagagcttcggcacgtgcccagacgggataacgcggtcgccgacgaactctcaaggctcgcttcctcgcgagcccagaccccaccgggcgcctttgaggaaaggcttgcccagccgtcggcgcgacccgaccccctaggggagacggacgcgcctgaacggcccccgaggcccgtcggagtccaggcctcggggcccgaggggagcgctcccagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacggagtcctcctgaagtgcattcctcgggaacaaggcgtcgagcttctcgccgatgtccatgaaggcgagtgtggagcccactccgcctcacgcaccttggttggcaaggcctttcgccagggtttctattggccgacggctctcaacgatgcggtcgacctgatccggcggtgcagggcgtgccagttccacgccaggcaaacccatcggccggcccaggccctgcagaccatacctctttcgtggccgtttgctgtctgggggctcgatatcctgggtccgttcaggcgggccccgggcgggttcgagtatttgtatgtcgctgtcgacaagttcactaagtggcccgaggcttatccggtcatcaagatcgataagcactccgcgcttaaattcatcaggggcatcactgttcggtttggggtgcccaaccgtatcattacggataatggcacccagttcactagtgagctcttcggtgactactgcgaagacatgggcatcaagctctgcttcgcctaccccgcccaccctagaagcaatggccaagtggagcgcgccaatgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcggaggtggtcctcccatctgagctcaccctgaggtcccctcgggtcaccatgtattgcgaggctgatcaagatcagcttcaccgagacgacctcgactatttggaagagcgaaggcggcgcgcggcgcgcgctaccagcagagcctgcggcgctaccatcagtgccacgtccgggcccgatcactctgcgtcgacgacctcgtcctacgccgcgtccaaacgcgtgccggactgagcaagctctcaccaatgtgggagggtccgtatcgagtgatcggcgtcccccggccgggctccattcggctggccacgggcgacggcacagagctgcctaacccgtgaaacatcgaacaccttcgtcgcttctacccctagtgggggtcgggtgtcatgtctcgggctcgggccaaccccgcacccccccgggcgtgcagggttggccgggggctaccacatgcatatacttatcttttttctcttccgtatttcaataaaagcattttcgatttcctgaggactgtgtctgtgccatcgtttccttttgaagaatcttggcttgaattagcacgctcgtgctcgaccctgccctcggtggcccgggccggctaaaatcgccaaatggggcccagaaccgagccgtttcccggggcgtggtgaactccgggggggaatcggcaaaggcccacaatcgggtcatccataaccctcggtcaccgctctcccggcctggccagtctcgacacgtggatctccccaggcactagccccgacccgcgccgtttgaggctgggacctgggcactagcccttgttcaagccaagacacagaaggaccgcggcacagaccatcctcgtcttatacacacaacaaacagaactgacgcagaaatttcctctttacttgattgcagattaaatcagtctatacaaaaagggggcccgaaggcctcggaagaagaaggaaaagttattaagattggcggggccttgggggctcactccgacgcgcccgggtcgccggcctcgtcgtcgctgtcgtccgcactgtcgtcaccgccctcctcgtcgaagtcgagggcgaacgcgagccgaggggccgtaccctcaaagctgtggacgatgtggtcggcggaatcccggacctgcgcgcgcgcgccgtcctcggttccgggagggaaatcttccagtgctgcccacggggagaagtcagggtccctggcctggtagcttgccagtacgagctccaccgccccccgggcgaggtccctcgaggatgacttgatcgtctcctcgagctcctcggggagccgctcgagggccccggccatctctgagaggcgctgggcgaggcccccctggttggcggtgtacttcgcgtaccgcccgccccagaggcccgcctgctgcccgaagcatgccgggccctacctcgctcgccaagcggagggcctcgacctccccggcggacgagtccagcgcgccctgcagctcggcgatggtgtgttcggcggctgcgaggcgggcggctaggtcgccgtggcccgcggccgccccgccgctgtgcgctctcgcgtccagctccttcgcccgcgcctcgagctcagcggcccgctgatccagtgcggccctctcggcgcgggcgccttccagattgcggcgcgcctgctcctcccgcgctgcctcgcggaggaacaggctgttcgccagtcgctgcgccgcgggctcggcctcttcgagagttcgcccccgctcggtgagcgcgtcctcgcggaggcggagtgcggactcctctttagcgcaggcggcctcgcggtccgccaggtttctctccttcgcgtccagggcgcgggcgcgctcctccagcgctgtggcgcgagcctcaagggcctcttcgcgctgccgggacgccgccttgttctccgccgcccgccgttcccgggcagcggcggcgtcaaggactccccgggcagcgtcgagcttctcctctagctccgccgcccggctcccgtattggaggcggaggtcgtcccgcgcctcgtcgagcacggcggtggcgatgagggcagtctcccgctcctcctccacctccctggcgatctccgccaggtccctacgacgggcctcgagctgtgaggcgtgccggcggtgtgccttgcggcccgcctccaccatggcctccaccgagcgccgcccctcctcgacgtgcgcccacgccgcgtcgagctccgcccgctccgcatgcagggcctccatctgggcacttaacccgtccagcaccgtgctgttcgcggcggccaaggcctgcaggaggggctccgcgctcagtggggcagcggaaggcagaggggagagccgcctcagtgtgggtgccgcgcggctcggcccgccgatcgacgtgccggactcgggggcgtcccccgaacctggctcgtcccaagcgtcgcccgaggggtcgggcccgagcggcgcgcccgcggcctcgtcgtgggtggcctcggaagtcggcgtcgcctcgggcggagtcgggtcgggggtttggcaggccgcctggcgtgcgcgcgccgcctctgcctcccggacggactccccggcccggcggagtctagcctcctcccgagcggcctcctcagcctggcgaacccggacggcctcctgggcagcctcctcggcttcccggaggcggtccgcggcttctcgccggtcagcttcccgcctccgggcctccgcggtcgccgtctcctcggcctcagaccggctggacttggaatggcggggagggcgcgacgggatctcgcttaggcagaagaaaaaccagaagacaaaaagaaacgggtgagtgaaaactcgccttgaaaactcgcggtgggcgcggggacgaacctgcggggatgtcggctaaacgaccacctcgggggcgagatgaggctctcccggcatggctcggtccccccatcttgcggagccgtttcttctttcgctccccctcgggctgcggcgtcgacacagcaccctccgggcgcctgctgctggcacgcaccgccccgccccctcggggaggagatgggggaggggtaccctcctgcttcctcttcccccgggcgtcggtagggcggatacccccgggcccccgtcgcggggcccagaagcacgaccccctcccggggtagattgttccctcctgcggctcccgcccgcgccatcgtggcctcggggggcccgctcccccgacgccccgaccacctacatgatggccaggatcttggcgcgctctggatcgcagcagatggggaggaccccttgggggatgagggatgcctccacggagctgagattcagcacccgttggaccaccatcctgaagtcctcagggtccaagtcccatttgcgcccctggtgggtcctcacgtagtcctcgggcccggtgtacacccaggcgccccgggcgcgccgctggagcagcgcgatccggcgatgaaggtagtcaccgaacaccatggcccccgtgagcccctgggatcgcagacccgccaggcggtcaagaacggcgtcgtagccgtctcccagatctaccgtcgcccgccagctggaggcctgcgccgggggctggctcggaagtcggaggcgcgcttcgtcggcgaggggggtgtagaaccaatcgctcttccagtcatcccactttttgcggaggacgcagagaatgtagcggttcagcacctgcccccgcggctggaagtagcagccaccgactaccgtcggcggcgacaccggctgtacggtgaagaaccaccggaacagccggagagatgggcgcaccccaataaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgtggtgtcgggcgtccctcgcccagcgcgaccacctcccggccggtggcggattctggcatgaatcggcgcggcagcccggcctgcctctcgctcacgatgcgggaaggcggcagcacgctaccgtcgagcggtgcggagctccgtgccatgacgccggcggaggaggagcttgagagcgagcgagtgcggcaagggtagggcacaggaaacgaagagttagagcacaagtggcgaaggcaagggggagagtggcgagaggaaaggaacgaatcccttcctcgacgtctttacacccttgccaatgctatacccggcttctcgcgcccacgcctccactaacccactcgctcgtttgcggcgcacgcggcagatgtgcggccgtggcggttgagatggggcagatcgtgcgcgcattaactacgctcgccaaccgtgaaaagcgccatcatcatgtctccaggcgaaacgaaccggctcgtcccgattcgcgcgctgctcgagtaatgtagcagtcttaaagaagccgctcattattgtcggtcggttttcccttgctgatgcgcgcgatttgcgaccgctgggtttctgcccgcctgtagggaccggccccacctgtcaccgggcctaaggagtggcgtcacgcccgagcgcttccctcgaggggggcgatcgccctggcgtaacgccgggggctactgtcggtgacatggggccaggggtatcgtgactagaggcttgggtagccgcggtcacccacgtggcctgaccccctcggggggggggggggtcgggcccgagggtgacgtggccacccctccctctgtctccccgaggggtcgggccgctcccgtttcggccctgagggctggggcgcccccgtttcggccccgagggctgcgacgccccgaccccctgtggttttggcgccacgtgtgtgagttaggtgagcactgcggggctcacctaa

SEQ ID NO: 62400 - DNA, 6833 bp, Oryza sativa
aaccattccaggcttcagcgcaagtatggcaaggaagtcgctggccattaaatgaaggttgaaatgggcgtccaccggaaaagcgggcgagcgggcaggaggcgtgtgctctgcttgtcagaggtcacttccggctgtagactagccctcattgtaaaaagcatgtttcctttcttaggcagctggaggcccttgtggtgacccctgaccagataaaaagggtgcccaggcctaagagggggggactctggagagaaaagagaaaagaaaaaaagaaaggggactctggagggaggagaaaaaaggggaatgggtgctagaccctgaactctggctcgctctccagctctctgtattccttcacgcacagatccaccagaacacaggagtagggtgttacgcttcccagcggcccgaacctgtctacgtcgcccgtgtcttgtgcacttcctctctcgcggacgttcctcagatcgagggcgaagaacctcacttagcgcccccggccgaaccggcaaaggggggcctgcgcggtctcccggtgaggacccccatgctccgtcagcaggtgataaacctcgatgttgggaggaaatctagactaaagtgaggagaattatgtatccatacaaggatgggttatgaacttcatcaaaatacccgagagtcaacccaaaatcctgagaaataggtagagaaggtcaggggggaagatgcgcaaagagccaggccagatgggcctagctgtaacgccccgattttcgttgggattaaaaatcattaaataatgtattttccagaaattaaataaaagttaaagcaatttaatcaagtgaaatattgagggaattaaaaatttcctttaaaaatcattgggcgagaatattttgtaatattctttgtgccctaaatattctctgaaattttgccgtgaattttcggagctcaagaagtaattataataatacaaagttcatttaatcaatttaaataaaaagaaaataaaataatcttccccttcctcccttttgggctcggcccaaattctttcccccttcacctccggcccggccgccctcctccctcctttgggccgccggcccagctcctcccctccctctccctcaagtcctcttttcctcccctaaccggccccctcttgctttggccgacaggtgggacccacggcccctcctcctccttcctctggctagccggctgcaaccgccatggccgcccgagccgccccacgtcaccgctttccccgcccacctcctccaccctgcaccactcctgcccgaccgtgggacctcgtcacccacgaccccgctcccctcccccactccgtcccgcgaaaaaccgccgccaccacccccaagacgccgccccactccccctcgaaatccgccgctccccggccctctcctcgcccccttgagctgtaaaatcaatcctcgtggcctcctcttcctttttccccgttttcccgagtcccccacgccctctaccgagctctccacgtcgatccccatcgccgccgctcgccggcgatctccagccgcgcgccgccgctgctcccgccgtcgccgcgcctcatcgcgtgtgccatcagcttcgccatcccgcgccgcacgccggcctccactcggtttccttcaaccgccatcggaaccacctccccaccatgtaacctctctccgccgcttgccgccgaactccggccgcctctcctcgccacgctagccaccgccaagccgcaccaccgccagtgtcggcttcgccgctccaagcagagcaccggccactgcctcgttccaccaatccgtggccgagtcatcacctccaccacccacccaagccgttaccatcctccgccactccggtcgtcgcctccggccacacctcactgctctcagccaccccgcggccgccattagctttaccaccgcgagggcaagctcggccgcccatccatttttcccctccaccaccagaaccaccttcctgccataccaccctaccggccgcctttttccgcctccggtcgccgttcggcttcaccctggctgccgccgcaacgcatcgccggcttcgccgcgtcccgctcttccccgtccgccgcccgatcgccgccttccgccgccgggagccccttctcattgtcgacctgtggagcgccgccgcctccctccgccggctgctctcgccgtcgccgtgcccctcggtgagctccgccacctccctctccctcactgcctccgtttcctctcgccgcttcccgcgctgcgcgccgctgctccctgtgccgcccgccccccgccgttgctggtgactgcgcgccgccgccctctgtggtcggtcgggccagccccggctgtgcccgtgcccggccaccgctctcctcagccgcccgatcggcttgggccgatctgggccgtccatcccgtggacgggcggtggaccgcccttgtggtcccggtccatggtggaccgagcccccttgagccactgatgcctgggacccgcctgtcggcgccggccccctctcttgctaacgtcagcggcagtccttttcctttgtgaaaatatttaataattgcgcaataatttggtaataattatagatattaatttaatggctcaaaaccttctaaaattcatatctaattcattcgaactccgaattgagccattcaacttgcaaaattcatctaaaattgagctctacatgtttgtttactttttatataccgttttcttggtttttattagagtttttccttgttttgcgtgccagcgtgtagttctcgtcgtttcggaagtccgcggtcacgaggaaaagagttcggaagatcaaagtgaagaagcaaggcaagtcacacattcccctttagcatgttgatcccaatttacaaatgttttactatttgcaaataaatatgcgtgttttgctaattacatgggatcagggtttacctatctgctcgcttgtgccatatttacttgatatatgtcctttgtcaacattgggtaataaatcgactagctcatgttacttatgtgacctagctagaactatatgcttagccatgcttaattaccactagctcagttgatgggataattacaatattagaccttttagtatcagaatgagctgcgtgctcgagacatctggccatgcttcatggtcataattatccaactaaaatgcgactgaagggtgggctgtgggtgcatggttttgctagtcgcacccatggcaattaaggaccggttcacgggaaaccctggaagaatttctcgtacttaccacaagccagcgtgggcaacggctgggcttgtagtgtagctttcctctagccgacgcatccaggcaagggtgggtgtgatggagcggggcgggccctgcgacggcctctgtcgcttccggattcacctaggcacgagaggggattgcccgctgccttgcgaggagtgggggtgaaacctgaggtgtggtgtgcttggctagagagggttatgcgaaggatcctgtcacgacctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaatgaatcgactcaatgcactgtagttcaggtgggttggttgggcctgttcatcgtggtgtagcgttgatcagtggagatttaatattaccttaattactcaacagttttagtattttgctcaataaaatgttttacaactgcctttatgcaaatagccacaaaccgtccttgtgtccccttgcacgtctgcatcgttggtgtggcttgctgagtacggtggttgtactcagtcttgctattattcccccttttcagaagtgtagtgcttctgagctgaagacgaggttagaagaccaaggctcagaccccagtcgagttttgcctgtggagtggagctgaagccccgctaggatcgcctttttccactgctgctgcttttgtttcggtgtgaggactaagtgcatcttctgtaagtattttacgctttatttacgtttggaactgtatattacttattgttttgtgtaccctggctggtcctggacagggatttaatacacaaaatagtctggaaatttgggctaaatttctgggcgtgacactagcccaggttcagccgaggttcggccgaaccacaatctcagccatccaggctggggtttggcgtggacggtcttgatcatctcctgatggcggttgcggggcatttccgacaattcgcattgtataaccgtcatacctacccctaaatagggtcgccaatgatcgccttggtcaattggaggctgctcaaattgacaccaactccaagttttcctcctcattggagaggtcccttgtggctgtgaacacttctcttgcaggtatcttgaatacattggagagaatgagcaaagatggtcatgatggatcggctaggcgcaaccacaatggccatgatgctaatagcagcatcgcagcaagggaagaactagagtacgctgctgacaccgagcatgatgaggaggtacttggtcgtcaacgaagacaacagtgccggtagcgccatggcatgggcgctccaccacggcgggaggcacgtgataatgatgattctttaggcaagatcaagtttaccattccttgctttgatggaaaatatgaccctgatgcatatcttacttgggagttagccattgatcagaaatttgcttgccatgattttcctgagaataaacgtgttagggttgctactagtgagttcactgattttgcatccatttagtggagtgaatttgtttgttccaatccaaataacactccccaaacctgggatgcaatgaaaagattcatgcgatctagatttgttccttcatatcatgcacgtgatttgttgcataaattgcaacaacttagacaagaaaacaaatctgtagaagagtattatcaagctttgcaaacaggaatgctttgctgtggattggtggaaaatgatgatgctggtatggatagattcatgggtgggctgaaccgagaaattcaggacattctagcctacaaagaatataattcaatatatcgtttgtttcatcttgcttgtaaagctgaaatggaagtgcagggacgaagagctggcttcaggactaacatttctgcaggtcgtgctagctcttggaccccttccaacgctgctgcaccgtcaactcgagcagcagcaccatcgtcctcaagcaacaagttgcgtccctctacaacaaactctacaccatgcccgagtgaacccacaagaggggttgctgctacatcttccaagagctcatcatcagtggcattatcaggaaggacaagagatattcagtgcctacgctgcaagggctttggtcacgtgcgcaaggactggccaagcactcgtgtaatgatcgtgagagctgatggtgggtactcctccgctagtgatttagatgaagaaacctatgctttgcttgcaactaacaatgcaggggaaggcgacgcgccccaccaagatgaggaacacattggggccgaggctgcagaggactatgagagcctcgtggtgcagcgagtgctaagcgcataaatggaaggggctgaacagaatcagcgccacaccttgtttcaaaccaagtgtgtgatcaaggaacgctcttgtcgcatgatcatagatggatgaagctgcaataatttagtgctgaaatggtgaagaaacttgcattgagcacacagccacatccgcagccctactatattcaatggcttaatagcagcggcaaggtaaaggtaacacgattggtaagagtacattttgccattggttcttatcatgattcaatcaactatgatgttgtgtctatgcaagcttgttctatgttattacgtaggccatggcagtttgataaagattccttacactttggcaaatccaatcaatactcctttgtgcataatggaaaaaaacttgtgttacatcctatgtctctttaagttattttaaagaatgaacttgctagagctagcaaacaaaaaaacaggagcatactagcatcatattgtggctaatgaacttgagaagcataagaagaaatccaccaactctattcaaaataataaaaatgagattaagctgaagggatcttgtttcattgaaacaaaatcagatttggatgaagttgacactgacactgttgtttgctatgctttggtttgcaaacaaactttatttccaattgaggatactcctatttctttgcctcctccggtcactaacatttcgcaggagtatgctgatgttttcgcaaaggaggttccattggggctgccaccaattcgagggattgagctccaaattgacctcattcctggggcctctttgccaaaccgtgtaccatacaggacccactcggaggaaacaaaggagattcaacgtcaagtgcaagagttactcgacaaggggtatgtgcgtgagtctcctagtccttgtgctatccccgtgcttttagttcctaagaaagatggctcatggcgcatgagtgtgaattgtagagcaattaacaacatcacaatcagatatcctcatcctatccctaggctagatgatatgcttgatgaattgagtggttcacttgtgttctctaaaattgatttgcgtagtggttaccactagattcgcatgaagttaggagataaa

SEQ ID NO: 62401 - DNA, 10604 bp, Oryza sativa
  unsure (1)..(10604): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaagccatggagcatccaaaatagccttgtcaaacctctatgctgatgctggtcattggagcaatgtgtcagtggtgaggaaggaactccagaatgagaatttggaaagacttacaggaagcagtggaattctacaattataggtttcactcttttggtgacaactgcaaaactgctcttatgtcggtgaactaattgcgacaagcagtttattttcgtgcttgatctgttctgttagccaacacatacaatcattattttgctcttttagactaaacaatatgtgaactaaagaatctctaacatgacatggcaactattcatattggaaagttgattggctgttagactgccaagaagattagctggaaaagtagattagcatcacttatggaggtccccttggcctttgccatgttgtcatttggataattgcatctccgaacttcgatattcagtgttataagtgcttaattgacatgtctgataattaataatcctaggtcagtgatgccagcattcagtcttcggtacatgtttagactcttttactttttaaggtaaatgaatgacatccatgttcaatcgtacaaacattgtagtaatatggccagttctaagtgaatctttctagcattgatagtagttatttggtgcagtttgtatgtgaatacaggactacaaatattaagtaccacacatattttgtgtgcgcacggttttgtttcagttgcaagatgcattttgaatttgtaaaaaattggctcaaacaatctcacttgaaaagtttggagatgtaatgagatgttctgggtacacaaaaagaaaagttaaatttagtgttaagagtgtgattacttgtgttgtacaatagacatgtcaatcatcctatgctcttaaatcttaatccatgcttttttagtccatacacctttatattatttaaatattttgacgatcatgttatcttttgtaggttttagaaatatagctccctcaaggaacaataattcttatagactttgacacagtagggcatatttcggtcttcagcttcacatatgaacattaggttacaagaaactcaattgtcaggtaatatctcattatataatgcatttgttatccaatcttgtatatgctttcttttattctaatacaaagttttgaacttgctgctggtgctactcaaaagcaaataaaatatccaaactattgtcaacaagacagagatgatattttcaattattatggaattttttgcaatttgaaatcttggccggtaagtgttcccttacaacagtcactgtgtaacctttattgtcaaattgatattgcaactgtatatgttcttatcctctccttgttcatatttgtcggacatcgtttaaaatgtttgtcatggtataataacaaaaaataaaagtgattcagtcataaatattatgactgaaagcaatgcacttatttgcagcctagtaaaagagtggagctataacaagtaaggggaaatagaaaaatggaagttcatatgggacacgtgatagagatgattggaatccagaataaacagaatttagaggatgctatattttggatgtaatcttaatattatcatatattaacatggattcactctggaggagaaattaagacatctcattggcacattcatgtgtataggcaggaaattgaactaaaatcatgcccatacatgtggataggcagggtttttgcccatccaaatcgtggccttatggaactgaacagtcctgtaaaatgtcatatgcaaatcttgaccttgtggaactggatgtcctgtaaatttttagatgttacatttccaagaagaatatgttctgtagacaaaaattgtttttctaataactagcattatgcctgtgtgttgcaacaggaggaccattatgaaattttctgagatatttagaaattattttgatgtatttcttatagacatttaatgtgtatggatttttagaaacaaaaactattttgaatgaaagtctataagatcttttaggctgaatctggatgttcccatccatccctcaaacccacctgacgccctcttccccagggacctagcccaccttattttccaccagaataagttcactcaggtccctcaatttgtcattgagtctgaaattcatccctgaaccgaaatacagatactatgtgtccctcaactcccaaaaccatttcaaatagggttaaaatgaggggctctggtgtgtgtgcggccagcaggggtgaggggccggttgggaattgagcagcaaaaagtagctgccccaatgttaatgctgcagtgcaaggtgtaccttccccacctcttttctctgtagcaaccttcatttgctgagagccaggcacattaagcagcacacatcctgaagcgcatccaacggtgcagattatgggtgcagatgctccagagttccaaacggcattttcatatattctggtcatccccttgcaaacaattgtgatatgtaatagtcaatttttttcaagaattcctttccgatctgaaataataaaatcataaacatggctcacgcgcagaggatctacccaaccagcagggcgccatcaaaacctggtcttccactactatggaaaggaatcaaccgagaccgagcaaggtgccgagcttatcctccacgccatcatggtaatccctagctcttgtagcctcttcctagtgccatagaagctggcgcctccaacaattttggcgaatagcgcccatagccatgcagacccgagcgtacattgctccgtcgtcgagctcaccgtggacatgccatcccaaagctcctctcacccaccttattagcaaaatcgaaccccaagacgctctgtacactcctccattcaataaattggccggagtccccgactatcgccaaagccccgaacctccttgagctcggccatggcgttgccatgccgcaacgctcgcccctgctccgccttgcgccgccaccacaggtggagggccgtcggaacccgttcgcacctcccttggtcgtagccgagccatccccggccgagtccgcctcgcaccagccaacgctcatgcgtctacttcccagtccagaggttgaagacgacctcaggccgattttgactagagtcaagcacctgtcatttggtctacaaaattattcttaagagaaataatttggtaaatcagataaataaaccttagaccccacatgtcagccatggtaggttgtggataatgtttcggaataaaaataaatcaattaggaacagtactgtttcacaattattggaattacttcaaatttgaatattgttttgactatatctcactcattttagctctgatttgagtgaaacttgaacctgaattcatctaaatttaggagctttccaatggtatataattaattatttaataaaatttattttataattataaaataactaatgtcaaatggttagataatggcaaacctaaaaatgtgctaataaatgaaaattgtcattgtacagtaaactaggtaggagaataattgtctttaacatgttgtgccactgtagaaaccatgtaaatcaattagaagtattgtttcgaattaattgaagcttaggaaatactagtgccatttattaatatatgtccatatataattatacacatgacttccaaattatataaatgaattttagccttatatttttgtcactaaaaatatgaatacatatagatcagtccttagattgtttgtgaggaataataacagagctattatgaatgaaccaccaaataaagttgatttgtgcaatagcatatagttggattggttagcacccattaattaacaaaacagtaaatagctcatgctcagtaaatgatccaatactagtatatttttacactcacagctactctacattccatttaaattatatagaagaacaatagcctaccttttgcattcctctgtcccaaaaagagtctaatcatagggatgtatctggacatacaggttgtctagatacatctctagaattagatttttttttttttgggacagaggagtacatgataagcatgtatagtagaaaaatattaattctaaatcttgacctcatataattgtagttcaactgtgacttaggattgtttattgtaaaattatgcaatgagataatccttaactacaatattatggaccacacgaatctaacatactgagcatggatatttgttgaatgttaattacaattagaaaaaatctacccatcatatgtcatgaagaattctagtaataatgctagcggaagttaactaaactgtgccaacaaataaatcaaccatatacgttagtcttgctaatgttatgtgatttccaatctccattaataagccaatccccagcctgtccatttgaatcattacatttagattactctatgagccatttcacgtctctagtgccaatcattttatgtagagtggagccactgtagtgatagtccatccatagcccagtaagtagactaaaccgcatgttaacaaaatgtatgtatcatgtgtgttggttagctcctaaataagccatcatgacaatagaaggattaagaagtcttagcccctaagctctcttgcccataaggtgcttgcatgttgagtaatttagagcctaagctacctcaattttcccccttgcctatataagccgctaccgccattttgagatctcttagcaccatacaatccataagcaaacgagagtagtatgagcagccctaggtatgactccaacatttatattttgtttgagcatatttgattgttgtttgaatattggtttttatcgcctatcatagaatgtgtatcggttagtcgtgaggcaactcatgcaacttccaggaggtgaaggtggatcaagtattatcaagaataaggactatcctgagcagataagtcatcacccctcccttaagcatgttgatcccaattgcgaacttactttgtttacaaataaaaatgtatgcaatgatgaatatcctacttgctattgtgacatgcatttgactattgtttaccttattcctttgtacccataattacgtatgagtccctagtcacttatgacaaatgcttagtaatgctaatttagattcatgcattctcatatttattaaatgctatatgcttgggcaattaccttagggaaggtccaattgttcgtccgggtgtttccattctacatccgtctatcgacccaaacaagccaagcccaacatcccagccacgactatttcgtccaaccactccaaaactaaataataatgtgatgtaagacctaccatataaccaagtcagtccagaactcaccataattttcatgggcatttcttttcttctcttcaacgtcgtacatatgtgtgtgtgttgatatcaaaaattgacagccgatgatttttattcggttattttatttggacgaggtcttgccgaatgtttttattcttctacttaattgaattcggttgttcaatggttaatcaggttattatcagagaatatatgggcaagtgcttctcctgaatgtgatgcatgcatgtatggtttaattccagttttactttgcctcctggctcctggcgtagcagcagtacattttctatggaagataaagcttgagaacaaaattaatatgctgtgatgctggatggaagatcacatgatcaagttggcagcatagaggtgacgtacagaggcaaggaagtcggaggcgctgtgcatatgcaacgttttcatttctatgttaattttcattgttttggttaataccatgtgatctctaatctaattagtgtgggaccaagccaaagaccaggcaccctatatatgggtctaggccgattggaaacagacaatacacaatcaatcgatacaaaattcctgtcatatttccttttactcgttttgctttcctttgtgttgttttgttcgatccccaatacggccgccggtgtctaccgtcgtcgcagtccctccggcctgctggtggcgacgccgccgcggcagagcagccgctgctgcgtgcacgtcggctggtagcagcagcaggagacgtgttgctcctggcttgctgtgcgataggcttgttgtgcatctgtgccacagcaaggaagccatctcctacattccgttacacgcacacacaatcgtaccaggtgaaacttcagtgttgctttttcaggacagatcaagtgttgcattcctagggcaaatcttggtggcaacacattttggcgactccgcgactccgctggggaatcgatcgaaagaaagaaacaagaactggagcggctgacattattgtgctttcagaagacgaggcaaggtatcgtccagaaggaggctacactgccatccgtctatgtcgaacctaaggtaaaacccactgtaagtgatccaccggtgacccaagaacaaattgctcttatgattgatcaatcagttagtgctgtggtttttaatactcatgaagtatttattaaaaatatggatcacgcattagatgctcgtttcaatgcttgtgttaaatctgttattagtgcatcaaatgggaaggacacacaacgacaagtatcacataatactaatgcttcaacttctagcactactggtaaatcaaagcaaggattagatgcatcggcgatgtttacaacacaacaaaatacgccgatgacacaaatatatagccgaactaatggtgggggttcggctggtagtgcaggagcattgccatttcccatgcagcatgatgttggacaggggggcacaccattcacattgccacagccaaatagttcagctagctcggctccgattatcactaattcaaattatgatagccgagtaaatgggaatttagaaagtacatttgtgcctccatatcctactgtggcgtataatatacctcgtattccaccacagggttcagtcattacatatggtgcattacctaatagtaataatagttttttacaacacgcaccatatacaccgccgacccaaatgacacaatttttgcatggtacaccacagcctaacattttttagcagcaaccacaatttgatgtgacccctaatcggcctatggccgagccacatgtggtgccggaaacacttagagagcaattggtcagtgtttttagagaaacatttgatgtggaacctaagagtagagcacgcacttatcgaaaaccatatcctgatttttacgacacagtgccatacccccgtggttttagagtgcctgatttcattaaatttaccagggatgctggtaggacaactttagaacacattagtcagtttactgcacagtgtggtgaagctggtcctagtgatgctttaaaattgaggctatttcctttatcattgtctagtactgcattcgcatggtttaccgctattgcacccaattctattcatacatggtcttagttggagcagaaatttcatgagttcttttatactggagatgtagaattgaggttagcacacctgacatcggtcaagcaaaaatataatgagcctgttgttgattatattagaagatttagagacacaagaaaccgatgttttagcctagcattatctgacaaggaccttgctgaactagcacattctggattacttccacactttaaagaaaagttagagggtaaaatcattttagatgttagtcaggtattacaacaagctctggctcaagaaagccgtgctaaagagtccaagagtttttagaggtctaatgataaatctagtcgccctgtcaattttgtagacgatgatctcatgtcatcggatgatgagaatgtggatatgtgtgtagccgaatggtcatgggcatcgaaatctaaaccatttgtttgctccgctttgaagccggtgtcccaaaagaattggcaagaagaaatgaaatttacttttgatgttgctaagtgtgatagaatttttgattacctattacaagaaaaacaaatcaaattgcctaatggtcatgtcattccatcacccgaggagcttaaacgaagtgcatactgtaaatggcataattcacactcgcatgctactaatgattgtaatgtttttcgtcgacaggttcaatcggccatcaatgaaggacgattgaggtttgctgagagcccaaaaatgcaactagacagtaatccctttcctgtcaatgtgattgattttgagaatagcaaggtacttgttcggccatctcaggccgaatccactaaaaataaagctgtgatagttagtgatggtggtatgcatacagtgaagactcctagttctgggtctggtcagagtagtttgccaaggatgattaaacctagaagcccagaaattggtcggtggaaggttaatgagagtaggaacaaagctacaaaaagggttgaaaagccgaagcccacattcaaagacctttcggcaaaatatgagggaagagccggcaaaggagttgctagccggccaaataattttaaaagaccaagatcacctccaatgcaagggtttgagggtccggatcgtcgatgggaggatttccatgcatcaccgccatatcctccttttgggccaccgatgccgttaccatggggtcctcctcctgttggttttcctccttgtccaccatggggttggtgtggtccatgggtgcctcctgctccaatgacttatgagccattccatccgatgccctatcaaccgttccacccagtgccatatggaccattccatccagtgccatttgaaccattccatccaggttgggaagcaccaaggaggccggtgtttgataggctgtcatggcctagggatgaccgatctaatcaaaggaatcggtcttatgatgagaaaaatggtggattggtgaataaggtgcatcgtgtgaaagaaggtggcgattcaggaggaaattcgagtgcagttttggcagcaaaaaatgatcagtcgacgagcggcaattcacatgtgagtaacaaagtgattagtactgcggttgctacagaacaggcccaggtgaacagtgctccgactgctacagtaccagcccagatgaacagaaccgcaatcacagccgtgcctgccgaaatgaacagttcttccgctgcagtgccagcagctgattgtggtggtggttcatgtggagaaaatgtgtctatgcagcccggcaaaggtaaacagctccaatggtgccctccagatattggacacactcggaagcggaggctgcaaagattacgcgcacaagagttgagacagtctaaggctgagaagatgagagaagaaattttcaatgatatcaatcctgaacccatggtacgtgttcgcagggaatggagggcgaaacaagttgcagcttcagttcaagaaaacagtgatgaagagcatgatctgttagaatgtggttccccggtaattagagatggctctccgcttccagaaagaatggatattaatatggtttttacactaccttctgaatttagggtcgtcgatgaagagattgcacaattatgtcttgctcctaaagatgttatttttgaaaagcctgatgaatcgagccgccatatgaaaccattgtatatcaaagggcatattaatgggaggcctatttctagaatgttggttgatggtggagctacagtgaacttaatgccatattcagtttttaagaaattgggcagagaggacagtgagcttctaaaagctaatttgacacttaatggattcacgggagagccaacagaagctaaggacattatttccatggagctaactattgggagcaaaactctccctactgccttcttcgtcgccgaggtgcaaggtaattataatgttatgttgggtcgtgattggatacatgcaaaccattgtgttccttctaccttgcatcaaactttaatacagtgggtaggtgatgatgtagaggttgttcatgcagatacttcggcttgcgttgctttagccgatgcctcagttgattggcagtatggtaatattcagtgtttaacaggcttagatctttctgattatgattatgttattgtcactaaggatggttttgtacccgtgtctataaagccggcttctgcagctcggctcagtagtgtgatgttataaatgaataaagaaagcaatttagattggttacaaaaacgtgcagagcaatatcggtcaaataagaacgatatttgggaggctattgatgattttgatgaagtagaaaaattaggacaaggtttttcgtcggctgaccctttagagaaagtggatat

SEQ ID NO: 62402 - DNA, 1195 bp, Oryza sativa
ccgccggccgtaaatggggaacagttggaggttgaagaagagaagagagggagagactgatcggtgggacccacacacaataccatttaacatttaatttgattttcaaactttagaagcccatatattttaaaatatagattcatttccagtgaaacttgaaccaaaattcttctaaaatcattctctatcttttgagaccacttttgctatttttatattttattttatttttacctatttttggattttatttgaatcccttttgaatttgaattttacatgtttaacccttggtcttgaggaatcttatgacacattagataatatcagtcaatctcaggacatcgagcaaggcaagttactatacacattttgatcgtttaagcctatattttacaagttatttatttataacctttctactcaatactctactttcacatgcataattcaaccatagaaacccagataatttagtattgcttattttgcttacaatctggttaaaatgttttatacttagattgggacaggacatacgaattggatgatttccggatggctagtactgtctcgatcgatataagttgtcaccaggtacttatgtcaaacgaacgggtgcgaccgcagtttctagaatggggactgacctagtcattatgttaattagcaatgtggtacctctgtatagtggctcttattgttaagtccttgagcaggaggcaactgtcacaccctgaagttcttctcccaagccaaaattgaatttataattggtctcgagaaaataccggtgtaaaagcaagagtgaaaccctaaataaattaatgcaaataataatcggaattggcatgtggaatttttcttgagctctacatgtcgaaatgtgctaacaagatttttagtggaattttcatagctctagaaataattttaaccaatcaaaaatgagcacaagcaatatttaatcccaagaaaattcatttcctcctttttctttttctttttccccttattctttttcgaatgggccgccggcccattctcttcctcctccccctccccgctgggccgaccgaaggccacgacccagctgagccggccgcccgagcccctcctctctccggggtcaccgacaggtggggcccacctgtcgggcccgtctcccaccttcagccgcgccgccgcatcc

SEQ ID NO: 62403 - DNA, 2558 bp, Oryza sativa
ctaagacgcaacacaacaacgtctcgcacggttgtagtcgggtcatcaacatttctcccaaatcgtagttatcatcaactcaccgacagatcgggccaacaacagcctcgagtgtctcgagtggagctcagggttcatcaaacggccggtgctaatctgatctctaaatctctcgctttctcctatttgggcaatggagtgataatactgacctacaaattcttcaaacatcatgttgggcagttgattgaaggatttgcgattataaaagatgttcttgttcatcacaataacaaagaggttgtcatggatttccacgcttttgaaatccaagacattgacgtcctaatcgggcatccaattaagaaacttctcatcgacaccatgtaattaggaagcctcgaattctcattaggaggggatgagttttctgtttcattctcatggtcaagatatgccttgaccgatgcccttcctgaagatgaatttgcggaggaagtgacggttgttcttccatttgagccccctgaatctcttcttgaatatgatgtccccgatttcattcaagaggaagaatcgggcgaaacctttgaattgtcgtccttagaaccaccaccaccacggcctatgatcgaaataaaacatcttcctcagggccttcgctatgcttttctacatggcaacaaggaagctcctgtcatcataagtgacaagctttctgaggatgaaaccattcgtcttgtaactgtgttagagaaacatcactctatcatgagctgctctcttcaagatctcaagggcattagtcccgctctctgcacccattgcatacctattgagcttgagagctcactgtcaagggaaccccaaagatggctaaacaatgcgatgagagaagttatcaagaaagaggtcttgaaactcttgtgtgcctggattatttatcccatacaatgtagtgagtgggttagtccagtccagattattgaaccagattactataagttagattataataagccgacatagaataagttgttagctgtttgtttctctagattattagctgtttgttagctgttagccgaccttagtcatgtaaacacggtgcttagattattgaatatcatcaagtttgctttccaaaaccagatgagttttaacaaaatgatagagactcagctggcgcagctagctgctctagttcctgctaaggaagcgggacggattctagggcaacccaaaccgtccctagaaaatgttaaggcgatcaccacgaggggaggaaaatccactcgggatgtcacgcccggaaaaataccttttcccaaacgctagtgtattaatccccgtcctagaaaagccggggtacaccacacaaacatgatacaaaagacgcatctttattatatcgataatatttacattattacaaaggcacttcaggcctgacaatcaaaaataaacagcagcggactagcgggcctacggctccatcttcacaggcgctgaactggggtataagccaggactccacctaggacttcttctccaaagcttctcttactgaagagggaaagattgagcaagaatgagtacaaccacagtactcagaaagtcacaccgggagatgcataattaatgcgaggggatacaaggggataataataggggttaggttttgcagtaaacatcatttaaaagtcacttagttgtccaaagctattttgtaaacacgatcctagagctacacaatattattaatcaaggtcgtgaacccacacgaacctgcttaacccaaggcctacgatgattcagaccgaactagcaacctgacctggatcccaactcgtcccaagccaacccaggccaaccattccatatttttgttgttacgcaagttttaagaagtaaaccactaactttggtacattgctaggcttgcccatacccgagggtgcggctattcgaatagattatactctgatcagaggtgtacatctttacccacaagacacgcctttactctgcattccattgcaagtggtatccatcataaaaaacgtgacataactgttgacggtcgttatcgatcagttttgaccgtcaatattactaaaatagaggggaactagtgatgcttgcaatgcatatatatgttagaataataaatttccactagtattatgtatactaaccttttgcagagaatgacaataaagtggaggagaatcgacatcaacacagacgacaaatcaatcggacgatgtcgagaaccagacttatgtatgaatgggccaagaactcagaattgatacaaagaattgggccaaaattcacaagtcagcgaatagaagcaacagaggaggccgctagccgaaattgggctggattgggccggccccaggttcggccgaaccagggagttcagccgaaccctcctcagcgccatccgatccagggcttcgcctggacggtatggattagcccccaatgacggttagagggtatttccgaccattccaaccgtcacaaccgtcattgtgaggctatataag

SEQ ID NO: 62404 - DNA, 2776 bp, Oryza sativa
tgaaaaacaacatgtattatttctatttccttcacagaacaaaaatataaaaattactaagcttcatttccacatctatccaaaataaaagaaaaaaaatagttatattagataacacaaactgtatctgtagagcatcagtcatacataaacaacattgatataagtaattaagtagccacgcttccaatcaaaagtagaccacttgacaaacctttcaccaatttttggcctagaaattgacaaagggatgccgacacgcaccatgtggggcttaggacgctataatcaggagttcgtcttgatcaaaggcaaaactcacaaagtgtattcacagcatttgatgctacatcatatcaatttggggatcaaatctactggaaagccacatggagcaccgcccaaacggaattgcgtcatggtggttagttgctcgcaggacttgtagttgtaccttagctagttggttgtggttgtgcatgggcgcagtcgcagctgtggttcatcctcgttgccacccaatcgaccgccagagccacatccacgtcttccgtcatgccatatctacccatgtaataccccacatggattagaactgattttataatacttagagtactgatagatccatatgtgaaaagaagctcataacaaaggcaagagggagcagcagtacattaagatcccattttatatgtcgattaaatcaaattgaataatcaaagtcatcatattttcctaaagttatcatatttcccttagatttcctttagaagactcaccaagatggtttgttggctcatcaagcaaaaggatggttggattcataaacaaagctcttgccaaagcaatcctcacacgcaccagaaaaatccagagttttctttgcctgcatttgtttattaaagcccaaaccaatcaatatgtcacagatatagcaataggaagcgtttgaagagctggtcacctgagcagacgaaaacaaaggaaagggcctgttcactttgatgccaaaacaaaattttggcatagttaccaaaatttgccaaaatttaccaaaattttggtagaatttcttatatagttactaaaatttggcagcaaaataaatgtagctacttttttttttgtaaactttaccaaaaattggtaaggttgaaaatggcattaaagtgaacagccctaaaaacaaacaaactccgaactcacggtggtggtgatccaacgggcggacacagaggaccccaaccatgacgaggtgcgatggtccgaggaggaggtcggtgatggtgaagatgtcagcggcgggcgacgctgtcggtcagcaagggctgtgcctcaatcgagccagcgtcggtgaagatggcttcgacggcacgacgactgatagagaggggcggaggagatcgatgcgacggcgctcgcttcaacgacagctgcgcgtggcgacggggacccggcgactgttggcgctgcgagattggtggcggccgggcggagatcgatggggcggtggcgcggcgactgatggggaggggaggggcaacgataccctcgctctcagcgccgatgaggcggcgatgaatctggcgttgcggcggcgcgatggagcgggaggggatggaggagcggcggagcgtcgatgtgcgacggttcgggaaggaatgaggaggcggcggcgtggggattgcagaggttagatcgtgttcccgttctttttttttcccgttctttttttttcgtatgagtagtttcctttttttcgtgcgcgagatatggtgctgtttctttgggccagatgaccaggtgggtcccacgcgaaggattgcagaattatggatgaactcgtactttttatattaatatacataacattgaagtgcatagctctatgatgctatagaacttgtgtttactcaaaaaggatctgagatgaattttatataaacttctaaagttcagctaatctaaaactagtcattttaaaggtaatagttttagaggcatttgatgtaaagtgtgtatatgttttatttcactttgtttttagagaacatgttggtggatctttagaaactaagtttgctctaaaatgagttgaaatgtattttgtatgcattttataaatttgtatatgctttatgtatgatttatcttagatgaattttagaggctaaatttgtactgtgagtgcaagtttttatttcataactttaaagttcataatctagtgagttcaaagaaatttgaatcatctcaaaataagctttatttgattttatatggattttacaagttctaggtttctctcttgtatagtctcagattttatctccagggggtccactgtcagtgatttgcgaatatgcagaaagacccttacagtttttaagaatcaatccgcagtcctaggcccatatatatgtcattgagtggaaagattgtacaataaaccttatagttgtttaaattctcaaaatgaggtcctcgtcttctacagaggcagagcagccatggctgagctcgatctcaggttcaccggaggcgattggtggctcgtttggggttgaggtaaaaatataaaatgaagagaactctctcacgattccattcctctacttttctcgattagtggacatcggagtagcgccggcggcgggtccgagcgaaagatggtttcgggtggtggtgcatgtgactttaggggctggatctagatgaataaagtgcatgaatgcgacactaaagcctcaagaatgctcgccatgagtctagc

SEQ ID NO: 62405 - DNA, 2380 bp, Oryza sativa
agatggtgtgtgcgcgagtaatcgagcaatggctcaccggaggaggcggaaacgacaatggcgacggcaaccggaggtgaagaagacggtggccgatctccacactcgtagcaccattcttcgtggttcttgaggggaaatggagaggagtacgaggcgaagacgatggcgcgatggcatggcccggcttggtccagatcggtggcgacggcgacgatgccaccacagcgacgtttggagcgcgctctggagctcttgagggcacgtcggcgttcccgtcgatccgctgcacgagagaggatgaaatcaaaaggagaaattttccgtatggtgaggtgagtatggaacgtggaagagatagggttggcgaagactcgtaggcgaggacgagcgtcgtcttcatcacagccggcggtgagatcgaaggcgaggaaagcagctagagcttgttctctcggtttggtcggcactggagtgaggagtgaggatgggcgatgtggctgggaagagaaggaggctcggctcggcgttgccacgtctcggccacgcgtcgcgcacgcccagagccgatcactctctctcgttcattgtgggtctttagattggtggaaaagttatgcacagagttggagctagcttgtgacaccgtcaagtgggcccaggtcggagcaaattaggtgaggatgagaagtttgggtccagaagcaggtgggcacagccgacacaggtctcaggcaaattccaggaatttttcttgattttatttcttctcccttctttgttaatttatagattaatttttattgcatatgagttcacatggattttattggaggcagatgaatgtacctagtttccattttatttggttgtactaaaaaattatggatagattgttcaaaaaattaggagaagatagactcattggaaaccagtttgaatttttaagaggcttagaagagaagataaattctgcaaaaattatatttattcatgataattaacctaatatttgaataaattatttccctatacactttcatgcagtttaatgcacatttattgagggtaggtttttagccgattaaggattataattaacctactgtttgactggtttgaccgatttattttaggtatcaaatttagttattaaattataccaaaattacagtgagttgcatgtattaagtagagcctacatgaatttttccataattttatcttgcacgaattattttagataattagcaaggtcttttctttatatggacatttccaaatcttagatgcatctaaatagttgtaagaaatttatttagactactcttaatctatagtgatactatttaacctcattttcatgtctttataattattgctcaagtgtggttgtaggtttgattagtgaaactttatcttttatttatgctcatgagtcctagtatgcaatgccaaccaaaaatctaaatgcacaagaaagactcaagtcaaaacatgttttatgcaagtatccatgctttcacttgagttgcatctagtcctaggttgaagatgaaaaagttttaatttattctaaaattttattcacgcaagagttagatcaacttcacctagatttaaaatggaaatttttggttcacaaaattgaagaactttcctttcaactagttttgatggaaatttcttaatcctagaattcgggtatgttaaccggccgggagaggggactgtaccccatttcaacacattttcattccctctccaaagtttgctctcaagctcattcaagctttgatagtttccctcaaattcaaatcacttagttgcatttatacaagttgctttggtgaaactaactggcgggtgaaactcttgtcattcctaacccccgtcgagttagtccgttcttgcttcattgtacagaatgaggaggcgactgtctcgtctattcaagggatccggctcttcatcaagtcatcatgacgagtctagtactcgttcatcagctgatgtttcgatggaggatgccgaagttccgcgacgactcctgaacgacaccgacctcgaccttgtcagtgatcgggagagacaagtctactatatgctgagcgaccgggagtatgctgacacgcaccggagctgctgaaaaagataggtatggatgttgaatttcgttctatttggaaagcggttggttggcagagatttgctgtggtagatgagcctggttctcgtttgcttactttgcaatttctgtgcactttgaaagaaatagaatatggtatttcgttttgtttttccataaggagttcacacttacatggaaaggcttaagtacacttcttggttttcacgattcatgtaaaatcgatctcca

SEQ ID NO: 62406 - DNA, 818 bp, Oryza sativa
aaaagaatcttaaaatgtgggaagaatgtttgcctcatgttgagttttcttataatcgtgcacaacattctactactaagaagtgcccttttgagattgtttatggccttctgccccatactccaattgatcttttgcccctcccaacttcagagagagtgaactttgatgcaaaacagcgcgctgaattgatgttaaaactgcatgagaccactaaggagaacatagagcgcatgaatattaagtataaacttgctgggagcaaaggaaagaaacatgttacttttgaacctggtgatttggtttggttgcatttgagaaaggataggtgccatgagctgtttccttatcatcttgttcttgcttgttcttcgattgcttacaggttcaaggttgttcttggcacggcaagaacagcaacaacgtggagtcggtgtaccggttgctaaggcgcagcacccctgtggtagttgtagtcggaccgccaacgtcgtgccctcccccaaatcgaagtttatcctcctctcatcaaaagatcgggaacccccgttgctgcatcacctctaccacccctgccatacccaatttccgagctcatcaatggcgttgatggcgcccgagctcatcgacatcttgtgaccctataagtaggaccccaatcccttccttgtccatcatcgatcatcaccaaccataaccccacaaccccaaagctctgctttaccaatccatctcatcaaccatcctcgcccgccggtcgaacaccttgtgcgcgagcgacttcacaccactccatccaccctttaccctaaccaacc

SEQ ID NO: 62407 - DNA, 13381 bp, Oryza sativa
cgccgccgccgacaccgctccggccgccgctaccgtcgcaagccgctgcgccgagccgcgccgtagacgtcgtcgcgttcgccgtcgtgcgggccacctcgtccacccctctcctgtcagattccgccgccggaactcactccgcgccgtgcgccggtgagcactgccatggccgccgccttcggccggcgtcctcgccctcttccattttcctctccatctctaaccccttgcaccgtgttcgctaggtggttccggagcttgtcctgtcgccgtcatcgccctccgtcgcttgccgtcgtcaatcgccgtcggtgagacacctcctcccctctccccttcctctctctctctcccgcgccacttagccgccgcgccaccacctagccgcttagccgccactatcgccgtccgcgccgtcgcaccgccgccgctcatcacgccgccatcggtcgccgccgtctgccgccgccgccccgcgttagcgccgccgtgcgccatggccgccgggccggcttgagccgcccgagcgcgccggccgcgtgctccccgccgccatccgatctaccctcgggtagatcggggccgtcggttcggccgcccgcgtggcgtgccacatggctgccacgtgtgcgccacgtcggcgccacgtggtgcgccgcctccttccccggtccgtggacccggtccaccgtggaccgccacccgagtcactgccatgtggggcccgcatgtcggcgccgtccctcccttgttgacgtcagccctgggatatattgcgcaataaatcaattaaggatttttctgtttaaagtaaaaacacagtgaatcttctaaaattcatatctaattcatccgagcttcgtttaagcctattcaagtcgcagtaaatcaagaaaaatgcataaaatccattaaaaatgcttttgttctctgtttcagtagtcttatagcctgtttgcattgtttgctttgtatgtcgcttagattccggctctcctgacgctccggtgtactttgaaatagtcgccgaggttcctccagcagcagagcaaggcaagtcatgcttgtcacttgaacatgttgatcctatattgcaaatgctctatcgttttcctttaaaaactgcatcgttttataatgttactatgggatctttacctactgttacagccatgctatttctgtaccatgctcctttgttagcttggggatataacatgactagatattggactagggattacttagccatgcttagttcaactaacacacaatggggaaaatacattattgagttgatatcagattctagtaataatgttggttaatgccaccgctccggtgttggttaattaaaatatattaaatggtgggttgtgggtgcatggttttgatggtcgcgcccatggcaattaaggaccggttcatgggatgccctagaagaacttatcgtacttaccacaagccattgtgggcaacggctgggcttgtagtgtagctttcctctagttgacgcatacaggcaagggtgggcatgatggagcgggacgggccctgcgacggcctctgtcgcttccggattcacctaggcacgagaggggactgcccgttgcccgctggggatgggggtgaaacctgaggtgtggtgtgcttggctagagggggttatgtgaagggtcctgtcacggcctctttccggtatgtcgtggtggcatgtcagtgcacggtaacatgtcgtggggctgtgtcttgtgggtacagttgtacacctctgatcagagtaaaactattcgaatagccgtgcccgcggttacgggcggtcaaccagattcaccgtgattagtctcacccctagttagctaatgaactggtgtagttcaggtggttggttgggcctgttgcaacgtggtgtagcgttggacagtgattggttaatactgattaattactacaactgttttactgctttgaactaccgtctttaaatgcccgctttatgcaaatgaacctttctagccataccttgattataccctgcatcataccccctattttggtatgacttgctgagtacggtggttgtactcagccttactctattttccccaaaaccccggagtttgagtacgtgtcagatggtggcttctccgaggagtaggcttcgtccgtgccgtcgaggatgcctgtggagtggtgttcccgctgcagttcaagttaaggcttagctccatttatcttttaattttccgctgcatttatgtaagacttttataatgtttgtaagacgttgatctgtatgtcaactttatcgtttgtgtaccccggccggtcctagacgggggttttaatgcacattctgcttggaattctattcgggaatttctgggcgtgacaagttggtatcagagccaaccttgaccgtaggacaatccttttcattgcatgtgttctttgcaattggatttgttccgggaaaattgggatctgttcttgtggttcaagggaaaaatcttggtcgctcatttaatgtgagatttgtcaaattaggtcagtctagggttttagtaaaattatttgaaatttattcgacagtcagtcgggatttgatgggaggaatgcattaggtcctaactcaggaatatgggttgctaggtatttatgctcttattattattattagtatgtatctaatttctcattattttatcgctatgtaagtccgtcttatttattcgctctcatgcaaaaatgatctatttgagttttaattgacaaaattctgctctcatttgttcattttaattgagttttttttactgctttatttaaattggatttgagcatgcattgatcctacccctttgtcttctctagatggccgaccaccaacccaaccaccgcggagacggcatggatgattttgtggctgagttggctcgcatgaccttggtggtgggctaccccaacgcgccggagtactcgaccgttccgccgctcagtggcgagcttccccaccgtgttcgtctggaggttcattgctatttgggcaccagcctcgctaacatggtggttgaggcatctggaggcaccgcagatcacgcctatcaggaggcagcatacctaatgatggccaggcttcgtgatcaccacagctacatcttctgcaacacggcgtaccgtttccaccctcgccgagcaagtggcaacgatatcagcaccttccgcccgacagtcggcgagaacgacaccaccttcggccacatgtgcgccgtgatgaggggaatggacaggatgcactctgacctgcacaaggcatccaaagccttgaatgatgggaagcttgtgaggatcatagctctgaaggatgagatagcacgcctgaagaaggagaacgctcagttgaagggtctcccagcgccaggaggagtccggatccgcaccacgccccgcaagtcgacgactacacccgtacgcattcagcttgcacacagggacccacctcctcccgcagtgtcacgctatgaaaatcgcctattttaaaagcttacaagttaaacactaataacctaggaaaaatttcaacataaaattgagctagataaaatttcattaaatactttgcttgtttatctattttctagatttttctgggaattatttgagcaaggaaagtatttttaataaatgaaacatcatttcgcgaattattttaattggaaaagtttttaaaatcgtctcctaagccgttgggctgatttcagcccaacatctctctccctcgcgcgcgtgctgtgcagcccaagccggcccaagtcgagctgcccttttctttccctgttctgttctcagtccatccgaaagtctaatttgcttccctttgcactgttcattttcaacctcaggacagccgaactgagaccgagtgggctcggtttttcccctccaaatccgacctctcttgtgttttcctaaaattagttgaggggaaattatctcctccttatcctcttcctttcccctaaagtctcggagattaattttgcccggataaaccgaatcgaattcgttttcgagtttatctctccaaactaaccctcggattttccagctcaaatcctctcatttggagtccgatctctctagtccaagcctatataaagcatccccttgtcgtcctcttccgtttgcctcaagtcccaagccgagccgtcgcccgtagcgccgccgccgagtagctctagcgccgccgccgccgacgccgctccatccgcgtggcgccgccgctagcgtcgtcgccgtcgccgtccgtcgccgccaccgggttcgcacggtggaggagcaccccgtccgccccttcgcagctgccaaagaccaccggagcgccgtcgccgtcggggacccgagccgagccgtcgtcggacctcgtcgccggccgtcgttcgtcgtcgtccatcgttgttctttgcacggtgagttcgcgtcgtcgtcctcttcgtgttggtgtcctcggatagcccggccgagctcactatcaccggtggcagcgtcgtccagtgctaggccggcgatgacgtcatcgtgacgtcataaatcctttatttaattcgtaataattttctgtattagatgaaaatcgattaaacttcggaaattcataactaaatcatcgtaactcggattcgagtggttcaagttgctaaattcatctaaaatcgagatctacatgttaaaaatatccacatatactgtttatgcttatttttgtactgttttgttgattttgtttatttgctttagtttccgacgttccggaggagagcgtttacgttgaggaaggttcagaagcgtttgcggaagcttaaggcaagtcacacagatcccaaacaaccctttgagcatgttgaacccgtttaaagctaatgttttatttcaacttatgcattattttcgaatgtcatcgggtggtgagcctttcccaattaattaatggccgaaaatgactttatttttcctatgggttataatttgattagctagaaccttatatattggtttggttcagctaaatgctatatgtataattgcttagccatgcttagaaacattagctcattaatgggatgaatcatactacattattaattatggttatatctaatggtagctcacgatggttaatcttgttatgataattaattgataattaaaagctgattaaaggtgggttgtgagcatatggttttgatggttgtgctcatgacaattaaggaccgattcgcgagctactgttgtgaaacattaatcgtgccaaccacaagccaacgtgggcaacggctttaccttttgtatagcatggttcattacggggtgccagactgtgaagcggcgagaagtccgtaggggtcgctggggagtccattgcctctggttttgagggggagattatgatccaggaatggcgcactgtggtgagttgtgttgtgtgagaggtattgtcacggttcctttccaaggtatcgtggtggtatcgaggcgcatggtaacatattgtggagctgtatcttgtgggtatagtggtacatctctggccagagtaaaactattcgaatagccgtgcccgcgattatgggtgagtttaacaatgtttttcgtgattagtatcgcactactcattaatgataatactgtgataattaatttgactcttggtttggaatggtatattcctggtatggaggtttgatctgtacaaccggggttggttgttcagatgaggttgggcctatgcaacacgggtgtgttgtatagtgtttatttaatattgcttaattactcaactgttttactattctcaaatgtttattaattgttgttgatgcaaataagctatataatgtcatcctttgttatcctatgcacttgcatatttgctgtgtggctttttaagtatgtcatatgctcattcttgcaatattcattcatcagaggaggagtacttcaatgaaggtgatgatcaggaggattaggctttgttcgggtcaagttgcttgtggagtggagtcgccatagctgtttagtcttttgtttttatttccgctgcgtagaattttattctttcgagaggaattgtccacctctgtaataattatttaatttgcgaatattaattaattgtttaatagtactctattatcaatttgttattgtgtgcctcggctgattcctggacgaggatttaacacacatgtaagcgtttggaattttggatagaaattccaggcgtgacacgtagctcctccagcacctcccgcagttcccgcagcgctcgcagctccagctccggttccggctcccgttccagtgtcagctccggcgtccgctctctccttctctccagcgtcagccgccaggggtccagccagtggcaacggaggttggttgcctgctactcccagtggcagccgcgaccacagcagcagcagttccagtagctccgagccggacagcggcaagacgtatctgccagactccaggagccgctcagagggacccggcgacgagcaggaggacgccttctactccaccaaccgcaggagccgttccgagcattaggctcgttttcccttagtttatcgactgcttagtaattgcctgttagtttgtgtgtctaggtttgttcgcttgtgggtcagtcgacggtcgacatcatgtgcctatgatgtggctgtcttaataaggattttgcttgctgttttaagtgttttaattcagatcagaacaattgcagtttaaattcctctataataaagcttagttcctgagcatctgtttttcttcttttccaccccctccgtctgctcttccttcagatggtcaacatcaggaatggcagccgcgcagccggtgagggcagcaatggcgaagagcacaccgacagtggatatcccaacagcgcctctggcaatggtccgccaccgctcccagagaacccgacgcttgcacaagtgatggcccatcagactcagatgatggcggccatgatgcagcagatgctgcagcagcaccagcagatgcaccagaggatgtagcagcaagtcgaacagtagcagcagcagtttggtccccctccccctcagtccaagctgccgaagtttctacgcgtcaggccacccaccttctctagcaccaccaaccccatggaggcgaatgattggtccatgccatagagaagaagctcaatcttctgcagtgcaatgatcagaagaaggtcacctacgccacacaccagctccagggtccctcgtcagcttggtgggacaatcacatggctacccgtccgccaggtacggaggtcacttgggcggagttctgtcgcagcttcaggaaggcacaggtgccagacggggtcgtggcacaaaagaagagagaattctaggcactccaccagggcaacagggcagtaactgagtacctccatgagttcaatcgccaagcgcgatatgcaccggaggatgtccgcactgacgcggagaagcaggagaagttcctagcaggcctggatgacgagctgaccaaccagttgatctctagggattacgctgacttcgagaagctggtagacaaggcaatccgccaggaggatcagcgcaacaaaatggacaggaagagaaaggcagcgcagttccggtccaaccaaggaagtcaccagcgaccgcgcttcactcccggacagcagggtggacctaccaccatgattgtccaccagtatcgcccgttcaactcaagtagcttccaccaggtcgccagtggcagccagaaccacccgggaggtcagcccaaccgcagtgcagctccgcgcccaccaatggccacagcacaggcagctccatcagtccaagccaagaaggagactggagtaaagccagggtcctgcttcaactgtggcgagcatggccactttgctgacaagtgcccgaagctaaggcgtgctgggccaaggtttgcccaagctcgtgtcaaccacgcgtccgcggaagaggcgcaagcagcactagaggtcgtactgggtacgtttcctgtcaactcaatttatgcaacagtacttttcgattctggtgcaacgcattcattcatttcaaagaagtttattggggaacatgggctaataagagaagagcttagtacaccaatacgggttcatacccccgggaatagttccacctcggtttaattcagcccttctgtaacaatagaaatccaaatatcaccatttctagccaacctcgtccttctcgaatccaaagacctagatgtcattcttgggatggattggctgaccaagttcaagggtatcattgattgtgcgaatcgcacggtcaccttgaccaatgagagaggggaaacagtggtgtacaagtcaccagtcgcactgaagcagggaatctccttaaatcagattgaggtggagaattcggtggtcaccgcggagaaaagttcgaggaaattggaagatatccccatagtctgcgagtattcagaggtgttccctgaggacctcactaccatgccacccaagagagagattgaattccggattgatttggcaccggggactgctccaatttacaagagaccgtacagaatggcagccaatgagctggcagaggtcaagaagcaggttgatgagcaactgcagaaagggtacattcgaccaagtacttcaccttggggtgctccggtcatttttgtggagaagaaggacaagacgaagagaatgtgcgtcgattatcgcgcactcaatgaggtcacaatcaagaacaaataccctttgccacggattgatgatctgtttgatcagctgaaaggagccaaggtgttttccaaaatagacctacgatcaggttaccaccagttgaggattcgggaagaggatattcccaagacagctttcaccactcggtatgggttgtatgagtgcacggttatgtcttttggacttaccaatgcacctgcattcttcatgaatctgatgagcaaagtgtttatggagtttcttgacaagtttgtcatggtgttcattgacgacatacttatctattcaaagtccgaagaagaacatgagcaacatctccgtctggtactcgagaagttgaaggagcaccagttatatgccaagttcagtaagtgtgacttctggttgtcggaagtcaaatttctgggtcacgtcattactgctcaaggtgtggcagtggatccatcgaatgtggagtcagttaccaagtggaccccacctaagacagtgtcacagattcggagtttccttggacgtgcgggttattaccgtcggttcattgaaaatttttccaggattgccagacctatgactcagttgcttaagaaagacgagaaattcaagtggacagccgagtgtgacaagggttttgaggagctcaagaagaaattagtgtctgctctagttctgaatttgcccgaccagacgaaagacttccaagtctattgcgacgcgtctcgtcatgggcttggatgcattctaatgagggcagagtggtcgcttatgcctcacggcagttgcgtctgcatgaaggaaactatccaacacatgacctggaattggcagcggtggttcacgccttaaaaatctggaggcattacctgattggcgatcgctgtgaagtatatacggaacacaagagtttgaaatatatcttcacccaacctgacctgaatctccgacagcgaagatggttggagttaatcaaagattatgacatgagcattcactaccatccgggcaaagccaatgtggtggcagatgcattgagcaggaagagctactgcaatgctttgtgcactgagggcatgtgtaaggaattgcagcaggagcttaaacatctcaacttgggaatcgtagaacacgggtttgtggctgctctagaggcacggcctacgctcgtggatcaagtcagagcagctcatgtaaatatcctgagatagctgaactgaaaaagaatatgagggtcggaaaagcccgggatttccacgaagatgaacatggcacaatctggttgggagaaagattgtgcgtacctgatgacaaagagctgaaagatctgatactcaccgaggctcaccagactcagtactccattcatccaggtagtaccaagatgtaccaagatctcaaagagaaattttggtgggccagtatgagaagagaaatcgctgaattcgtcgcactctgcgatgtttgtcagcgagtcaaagcagaacataagaggcccgcaggactgcttcaacctcttcagatcccggaatggaaatgggaagagattgggatggatttcatcacaggtttgcccaggacatcatctagccacgattcaatttgggtagtcatggatcgactcaccaaagttgctcatttcataccagtgcacgctacttatacaggcaaaaggttggtagagctctatctctcaagaatcatgtgtttggatggagtacccaaaaagatagtatctgatcgagggaggtagttcacctcaaaattttggcagaagttgcaagaagaattgggtacccgtttgaatttcagcacagcttaccatccgttgacagatggccagaccgagagcgtcaatcagattttggaggatatgttgcgagcctgtgcgcttgattttggaggagcttgggataaaagtctgccttatgcggagttctcctacaacaacaattaccaggctagtctgcaaatggcaccgttcgaagcgttgtatggccggaagtgccgcacacctctcttctgggatcaaacaggcaaacgtcaactgtttggaacagaagtgctaacggaagcagaggagaaagtcagaaccatcagagagaggctgagaattgcacaatctcgacagaagagctacgcagacaaccgccgaagggagctcacttttgaagcaggggattatgtgtaccttcgtgttactccgctccggggagtacaccgtttctagatgaaaggcaagttggcaccacgcttcgtgggaccatacaaaatttttgaacgaagaggagaagttgcctatcagctagaacttccatccaacatggtcggtatccatgacgtattccacgtgtcccagttaaagaagtgtttgacggtacccgaagaacaagccgattcggaacacattgacattcaagaagatctgacatatgtggagaagccagttcacatccttgagaccagtgaaaggaggactaggaacaaggtcaccaggttctgcagggttcagtggagccaccactcagaagaagaagcaacctgggaaaaggaagatgagttgaaggccgcccatccgcacctcttcaccagctcttccgaatctcggggtcgagattccgtttaagggggtaggtttgtcacaccctgaagttcttctcccaagccaaaattgaatttacaattggtctcgagaaaataccggtgtaaaagcaagagtgaaaccctaaataaattaatgcaaataataatcggaattggcatgtggagtttttcttgagttctacatgtcgaaatgtgctaacaagatttttagtggaattttcagagctctagaaataattttaaccaattaaaaatgagcacaagcaatatttaatcccaggaaaattcatttcctcctttttctttttctttttcgaatgggccgccggcccattctcttcctcctccccatccctgctaggccggccgaaggccacggcccagctaagccggccgcccgagcccctcctctctcccggggtcgccgacaggtggggcccacctatcgggcccgtctcccacctccaatcagtgccgccgcccctcgctcctacgtctcccgggccacatcgcccacgtcgctgctcgcgcccgccttccccgcgcccactccctctctctccctcccgcgcccgcactcgagacggccgggattcaatttttgaatcccacctctctctcctccccacctctccccactccgctggcgaaatcgcggtcaccccggccacgatcgacccctgtgggcctatataaaggttccccattccctcctctctttttcgttttgcaaccatccgttcccgtgccctccatagccctagcaccgtcgccctcttttccgccgccgccgccaccgctctggccgccgctagccgtctctagccgctgcaccgagccacgccgtagacgccatcgcgttcgccgtcgtgcgggccaccctatccacccctctcctgtcggattccgccgctggaacccactccgcgccgtgcgccaccgccatggccgccgccttcggccggcgtcctcgcctcttccatcttcctctccctctctaacccctttcaccgtgttcgctaggtggttcaggagctcgtcccgtcgccggcatcgccatctgtcgctcgccgtcgtcaatcgccgtcggtgagacacctcctccccttcctctctctctctctctctctctctcccgcaccgcttagccgctgcgccgccgcctagccacttagccgccgctagcgccgcccgcgctgtcgcgccgccgccgctagccgtcggtcgccgtcgtctgccaccgccgccccgcggtagcgccgccgtgcgccatggccgccgggccggcttgagccgcccgtgcgcgccgaacgtgcgctcccctccgccatctgatctaccctcgggtagatcggggccgtcggttcggccacccgcgtggcgtgccacgtggccgccacgtgtgcgccacgtcggcgccacgtcagcgccacgtggtgcgctgcctccttccgcggtccgtggacccggtccaccgcggaccgccacccgagtcactgccatgtggggcccgcatgttggcgccgcccccctttgttgacgtcagccctgggatatattgcgcaataaatcaattaaggattttttctgtttgtagtaaaaacacagtgaatcttctaaaattcatatctaattcatccgagctccgtttaagcccattcaagtctcagtaaatcaagaaaaatgcatagaatccattaaaaatgattttgttctctgtttcagtagtcttatagcatgtttgtattgtttgctttgtatgtcgcttagattccggctctcctcacgctccggtgtactttgaaatagtcgccgaggttcctccagcagcagagcgaggcaagtcatgcttgtcacttgaacatgttgatcctatattgcaaatgctctatcgttttcctttaaaaactgcatcgttttataatgttactatgggatctttacctactgttacagccatgctatttttgt

SEQ ID NO: 62408 - DNA, 2926 bp, Oryza sativa
ttagccatgcttagttcaactaacacacaatggggaaaatacattattgagttgatatcagattctagtaataatgttggttaatgccaccgctccggtgttggttaattaaaatatattaaatggtgggttgtgggtgcatggttttgatggtcgcgcccatagcaattaaggaccggttcgcgggatgccctggaagaacttatcgtacttaccacaagccattgtgggcaacggctgggcttgtagtgtagctttcctctagatgacgcatccaggcaagggtgggcgtgatggagcgggacgggccctgcgacggcctctgtccttccggattcacctaggcacgagaggggactgcccgttgcccgctggggacgggggtgaaacctgaggtgtggtgtgcttggctagagggggttatgcgaagggtcctgtcacggcctcttttcggtatgtcgtggtggcatgtcagcgcacggtaacatgtcgtggggctgtgtcttgtgggtacagttgtacacctctgatcagagtaaaactattcgaatagccgtgcccgcggttacgggcggtcaaccagattcaccgtgattagtctcacccctagttagctaatgaactggtgtagttcaggtggttggttgggcctgttgcaacgtggtgtagcgttggacagtgattggttaatactgattaattactacaactgttttactgctttgaactaccgtctttaaatgcccgctttatgcaaatgaacctttctagccataccttgattataccctgcatcataccccctattccggtatgacttgctgagtacggtggttgtactcagccttactctattttccccaaaaccccagagtttgagtacatgtcagatggtggcttctccgaggagtaggcttcgtccgtgccgtcgaggatgcctgtggagtggcgttcccgctgcagttcaagtcaaggcttagctccatttatcttttaattttccgctgcatttatgtaagacttttataatgtttgtaagacgtggatctgtatgtcaactttgtcgtttgtgtaccccggctggtcctggatgggggttttaatgcacattctgcttagaattctattcgggaatttctgggcatgacagcaactatagccacgaagggcaattttttccattaccatgtacaggtaaatggtctatgatactcgagtataattatgattataattctaaaccctgattgagatgacgtgtaatggataaggcttaactcggtgctcagtctagtcctgaataaaaggacacggatagagatggatgaagtcgttgcgacgatggatatctctgaggcaaatgaaagctacacgagctacggctcggcagtcgagatgtctaggcaaatgaaggctacacgggccggtgtccgttagtcgagatgccatggcactggactagtacgcgggtggtctcacccctatgtgtgtggcgcacccggtctaggtcctgttgctaggggctcaatcctaacctgcctgtctcgggataccggccgtaggcagggttgggtcggttcttttgttcatggctaggatgggtgaagggttattgtgggtatttcttaacgacattgctggaaatataattcccaacaatggcgcagaaatacttctggtatattatgtttacagagttcatccgcaagcgcacggatataccattatagcatttcacccaagagtattccaagggtatcgtatttattttatcctgtgggaagatcatgtagagagagcttgactaataatttatatattacttgtgataatcatattctaaacaggggttaagataatccaaggatagagtaacagacaagcatgaactactcattctcataataactcatctaagctaagtggaaagaaaagagaaaggaaatctattcctatacttctattatacatagtatacatatattctagttaactgatatactagctaataccctatatccgatgccctcttggtacttcgagaagccacccctgactgccgagttccttacgacagcccgtcatgaccattcaaccggggctaaatacggaggaataccctccccaggaaattaacttaggattatataccggcgcggaggaatacctgtactgagctgtcaccatcagcggcccacctctcatctgcaatatataacctcaaataatgatatcccgtaatctagacaccacgtctaaactaccagatactactctaatatcatcgtcatgagatagagtaattgcataagcaaacattatacccgcaccaaagcatctcccaaataagctagccgtatattcagtgtaacatgaacataatgtaaaattggcattcatatactcggaaagtgtttcaataccataaatgtataaagaagagtattctaataaaagtacaatgcttacaaaagaaaagagaagagctcttccgaaggcttccggacttgatttctactctattcctattccaccagctagatactactaaactaaacttgacagaaatgagaaagctattgcttgaggtctatgagtgaagtgagaatggcaactccttatatagcctcacaatgacggttgtgacggttggaatggtcggaaataccctccaaccgtcattgggggctaatccacaccgtccaggcgaagccttggatcggatggcgctgaggagggttcggccgaacctggggtcggcccaatccagcccaatttcggcaggcggcctcctctgttgcttctattcgctgacttgtcaattttggcccaattcttcgtatcaattctgagttcttggcctattcatacgtaagtctggttctcgacatcgtccgattgatttgtcatctatgttgatgtcgat

SEQ ID NO: 62409 - DNA, 776 bp, Oryza sativa
tgaagttgaaactttgaaaacaccctatggaaaaaggtaagattctgatctacagagggaactcaattgcaagctgatagaatgtacttacgaactgtgttctcttgtatattcatacgtagttgtagcatatatttttcgcttatgaattctattggacttggtaggccagactagagtatctgtgaggtgtcttgatttactcttttgttttgcacccgtgctagcaacctttcattatcaaaactgagatgtgccatctatagaacatcagaactatgttacacattttctagctatgaatatactaaaatgttctaccagccaattattttcttttttttcattcataagccttattttgtttctgtttatccataagttctgtagaaattggcaatatatatttttaaaccatacattgtacaagttctgacctacatttatgtgtagtaaaaattaattgatgtcatgtggcaccatctctacaatgttggatccgccctcatggtttcttatgagtttgatctcctcaataatatgaaaggagcgtggtactcacgtgttcgaaggaactgcatatacaaatgaaagtacgcgttgatgcgtcctggaggaatggtggtcttgcataccgctggattaggaggtcaaataataggtggcatgagttaaagttagatcattttcggctatttattctactccttccgttccacaatgtaagtcattctagcattaacattaatataaatgtgagaaatgctagaatgact

SEQ ID NO: 62410 - DNA, 11901 bp, Oryza sativa
gcaacctgctactattattatgataccaaccaaatttactctttctgaaatgtcttgcggaagaagtaatgaattattgtcgtgatgccattaatttttgaaaaatagttgcagttctatgaaatttaatcaatataatattgttattaaatagaagcaaacactttaaatggttgaaaccaaacgactgttgggaaaaagaatgattaccttcttgaccgtccagcaaagcaatgaaccagaacattgccaccagagctgatagattcatcaatgaaactaaagcattcatcaaaatgctttgccaaatcaatgtctgggctgtcaagtactgtatattggtaaacaaataatgatttaggagtgcttgggaatttggacaagggcaacagaaaaaagagggtataatcacatcaataggtatttgaaacaccatgacacagtcaagaagtttaagtgctccatgcttatttcatttctcttgacattacagttttccagattgagtgataatctaacatgtctggtaaacttacaacacaacagatgaaaagtacataatttagaagtaaatgcagcacatttcttaaacttgcacacagagttcaaataggtatgtgaacttaagcgatgcgcattattactcctaaatatgcatacttcggttctaacttagttcttactggcaatagatgattgaatggctcattgcttcacttacatgacttcctccctccatccctcctcaccctctctactctctctgcatcctgccacaaccctaatttagttgttgcatccccaaacaacttcctcaaaacatagctggctagctggtaagattgaaccaccatgacaaagtgacctcaggcactgggatacgttagaattggggccctcaacactcaacaggcaaagtagaggatacgtgtgaagaagaaaaattaatccagaaacacacttatcagtcactgtggttcgccagagagaaaacaatcatggctttatattgtaggagaaaaaggaagtaaaatgagtgtggcagaagagatggaaaacaaggagtaaatagtgcttcaaaagtgtggggacagaaaaaagcatatgggagggctttctcacaggtgagctttgctgctggtgtagctggaggaggagaaaagggaagtgtggggatagaaactagcatgggagggctttctcacagatgagctttgctgcgggtgagactggagaaaaatggcacatcaaagccacatgagcgcctgctaggctgccattccatgatcaattgaatttaagctgacccacatatgcagctgtaggaatataaatatgcatctctcaagtacatagacctgtttgaaccaaacatacttttttttttcttgaaaacgcaggactgcacttcatttcattatgaagagaaactgtaatgtggttatggtgcaagcaacacattctaaatttatatggtgcaagcaacttaatctgataaaccaagctggcatgtggttaccttcaatcttcttgtagttaaattcagctgcaaaggctggatttaatgatctggcaacaatcaagatatgggttatgttcaagctctttaaagcatccttgttcattgctgccccaacagatcccaagtatagcccctacgaatatgtcaaagatattctatcaaatagatggaaaaagctttaccatagtaatgcattcttcaagcaaaaatacggtaaaagaagcaatatgttgctacttgattggcttttccttgcattcaattgaattggagagctcgtattagcacaatcgagtttcccaatttccaattaatcagtgtagtttctccattcgcgacacggacaatcaacggtgctaaagttaggataaacggtgaatcaatcatcctgtccttcatcgcgagaataaaaaaaaagaaaggcagtctgttttttttctttccatccagttccccagatttgcaccagttaacaagaaatccactcaaatagcgcccgaaagaactcaacctccttggattatccggtgtcagatcgatcagccgaaacctgacctccgacatcccgcggacgcatccatcaccgaatcggcagcacgagaacaaacggattgatcacatcaaggaggaagaagaacatgggcggggaaagaggaaggaacctggacgatggggcacgggatgttgtcggccttccggtagcgtgcggcgcagaagccctgcatcagtgccatgagcaccctggcctgctgctgctcgtagtcgtcgtcctgctcccgcccgtccctctccgagcgccccgcctccggcatcgacatcgtcgtccctccctcttcttcctcgatgattgttggggggtggggagatgtgcctgaccgaataggggaagtggcgaggagagaagcgaggacaccggctgatcactcgcggagcactgccaaggaatacatggtgggcagtggcccccgaaatattcaactatttgccactcacacgaaaagaatttttttcccaaaatccactctactttatttttatttctatttgtcatccggtctcactacaactcgcgcgtgtcattatttttccttttctcactggcgtagattttcaatttcatccagtccaatgtgaaggataagatgaaaagaccaaaatgcctttcggctcacttataagtctcttccctcctcattcgatccgatcgagttgagaagagcaaagcacatgcaaaaaagggagaaaaggccaccaagataaagcaagataaaggaagggagggagaaaagtagagagctattagggttggcattgtctaaagcttgtcgcctcaccctcgatacttgagcctgccgctgccctgctttttgctgccaccacaaccaaggcatattgttgttgttgttgttgatcttcggctttgtcacttgactgtggagtcgtgttccatgacgatgatgtagacaaaactagcggcatgcatatattgcctctgtctcgaaaaactcaacttaggtggagatttgacccatcctagtacacatgtccagatttattgtattagaatgggtcacatttccatctaggttgagtttttgggatggagggactatatgtttgtatgatgtaggggaggcggcgtcacgcccagaaatttagcctaaatttccggactattttgtgtattaaatccctatccaggacaagctagggtacacaaaatgacaaattaatacacatatccaaatgtaaataaagcgtaaatacttacagaagaggcacttattcctcacaccgaaaaaaagccgcagcggcggaaaaaaggcgatcctagcggggcttcagctccactccacaggcaaaactcaactggggtcaaagccttggtcctctaatttcatcttcagctcagaagcactacacaaaggggaaaatagcaaggctgagtacaaccaccgtactcagcaagccacaccaatgatgcagacgtgcaaagggatccaaggatggttcgtggctatttgcataaaggcagttgcaaaacatttatagttgaaaacggtaaaacagttgattaattaaggtaatattaaatctccactgatcaacgctataccacgttgaacaggcctaaccatcccacctgaactaaccagttcattaagccaatttattaagggtgagactaatcacggtgaatctagttgaccgcccataaccgtaggcataactattcgaatagttttactctaatcagatgtgtacaactgtacccacaagacacagccccacgacatgtttctgtgcgctgtcatgccaccatggcataccagaaagaggccatgacagggccattcgcataacctcctctaaccaagcgcaccacacctcaggtttcgcccccactcctcaacaggcagcgggcagccccctctcgtgcctaggtgaattcggaagcagcaaaggccgtcacaggtcccactctatcacgccactcttgcctggatgcgtcagctagaggaaagctacaatacaagtacagccgttgcctacgctggcttgtggtaactatgataggttcttacaggtcatcctgtgaaatggtccttaattgccatggcgcgacaagtaaaaccatgcacctgcagcaatagttattagaaccagaccggactggcggtctgaccaaaaaaaccggaaccagggcgtcggccagtccagtccagctaaaagattggcgagcaaacggaccggtgaaaaccaattgaaccagccgattttctgcagaaccggacaaaaaccgaagttggttcgaccggtcacgttgaggagcagaagctgcagcgttgggaaaatatgaaaaggttttctacagaaccggacaaaaattggagttggttcagccggtcacgtggagaaacagaagctgcatttttgggaaaatatgaaatggttttctgcagaaccggacaaaaaccagagttggttcgactggtcacgtggaggagcagaagctgcagcgttgggaaaatatgaaaaaggaaaatatgaaatggttttctgcagaaccggacaaaaaccgaagttggttcgaccggtcacgttgagttgaagaagctgcagcgttgggaaaatatgaaaaggttttctgcagaaccggacaaaaattagagttggttcagccggttacgtggaggagcagaagctgcattgttgggaaaatacgaaaaaggaaaatatgaaatggttttctgcagaaccggagttggttcatattttcccaacgggaaaatacgaaaaagctgctgttcatacatattttcccgttgggaaaatatgaaaaagctgctggattaagggatcaaacctacaccctcctcgttcccaaggagggtttcaaccaccaggctatgccacatgttgtgactagtgttataacacatatctatttgaaccgtattaaaccggcggtttgaccggttgaaccaataaaccagtgaaccgagtgccctaacggttcaatcacaggtccggtcttaataactatgcccacagcccaccattcagttgcactttagttggataattacgaccaatgaaacatggtcgggtgtctagagcacgcaactcgtcatgatactaaatgtctaattagcaagacatgcaattttatttgcaaataataaaacatttgtaaattaggctcaaaatgctcaaggggaatgcatgacttgccttgcttcttcaaaataatcttctgaactctttcctcgcgattgcgatcttccgaaacggcggaatcaacgcgctggaacgcaaaatgaggaaaaactctaacaaaaacctagtaaaaagtacataaaaagttaaaaaatgtgtagagcttaattttagatgaattttgcaagttgaatggcccaatttggagttcatatgaattagttatgaattttaaaagttttaagccatttaaatgaatttcttagaatttaaaccaaatttattgcgcaattaatattagttatggcgagagccgaggggaaggggtggcgccgacaagcggcccccacccgtcagtgactcaaggtggcgggcgcacggtggaccgggtccacgcgtggaataggcgcgggcgcaccacgtggcagccacgtggtggccagggcagcctagccgggaggaggtggcgcccacgtggcgccacgacggtaccgaccggggcagcactggcaagcaacgtggacggcccagattcatcgaggtgaatcgagcggccacgggtgagcaggagaggcgtcagccggccgaccgaccgggaggcggcgaccaccagcgtggcggcaggcgcgggaggcagtagagggaagcgaggagggaaagaggggggcagcggagctcaccgagcgcccgatggcagcgagcagcagcacagggaggtcccacagtggatatggcggcggcgcccgtgggacgacggtgtaaatgacgctcctgttggtggacggaggcgactgggtggcggccagggaagcgcgtgatgcggcgaggccagcgatgcgggcggcgcgtcgcagcggtggccgtggtgatggcaaacggcggctagaggcagtggaggcggcagtgtttcgggtttgctttagggtggtggtttcggcggcgggttgggggaaaagaggcaacagccgggcttgcccttgcggcggggcagccggtggtgctagcggcgtggcgcggcggtggctagggcgcaggtggttgtcgggcgggggcggcggatggcagtggcggctcggtttggcagtggaagcagcgtttcggtggtggtgggggaaaatagagcgaaggtcggggtgcgaagaagccggcgaagaagctggctagagagctccggcaagcggcggcgcacggactcgccgtgaagagagcgggagggggcgcgaggagcttggggaggaggggaaacatacgaggggagcgcggggagagattttatagcttcggatgcggagatcgtggccgatcggggcggaatcaaccggcaacggccggcaaagtgggggtgctgacgtggaggaggtgggctcgattccgtcgccgaaaattggggaaaatagggaaggaggtggaggacgtggggcagaccgcgtccacgccgtttggactcgggaatgggggcgagtggtggcggatttagcggcggaatggggcggcatggcggcggttgggaccggccggaggtaggggatgaccccgataggtgggccccacctgttgatggctcggggagaggagggaggagggagaaaaaatagacttgggagacaggggccaaggtagagaggtcggcccgaaaggaaggagggaaggaaggaggacgggatgagccacgagggaggaaaagcaggactttgggccggaagaggcccaaagtgaaaagtgaaggaggggatttttaattggttttccatttaatttaattgattaattgaactttgtgattttaaattacttcttgagctccgaaaattcacgagaaattccaaagagtacattagggcacagagaatattacaaaaatgtttccggccatgatttttaaaggaaattttaatttcctcaataattcacttgattaaattgctttaacttttaatataatttctggaatacattatttaatgatttttaatcccaatcgaaaattggggcgttacaggcggagtggtggtgcagcgtcgccgagaggacgcattagcgtcaattaagtggctgaggctcatgtcgttgtccgtctctctctctccctctccctcttgctgtttgctttgttaaatgtcagggagtggaagggagaacattttcaatggggccaaaccccaatgacatttaggtctttttgccacatcttccatatcaaatagtggtgaaaacaaaaaaagtaacatcatatggacaagaaaaatgaaaatagtggcacacgggagagttttagtggggaccagatggtaaatgaaaatgaaattttgaggaagtggtatatgggcatatgaaatttcgagggagtggcatttggatatatgacatttggaaggatggcaaatagtaaatgtcccgtgcctcctccagagtgctttcttttaaaaaacataagaacttgtgaggagacaataggggagactccattctaacccctccttttactcctctccttctcctcgttccttttttccacttcacttcttgatccaggttattagatttgagatctatgagggcaatttgttgtagaggggagagagatgcgaactcacgcacaggaggaggggaggaagggggcgccattggaggctggggagctagggttcggtttcctccaaccctccttcctccagggtttttacatatgggcaagggagtgggttgggctcgtgggcctagacccaagctgagttggctcacttacatggaaactgctcttttatttatttctattaacatctttattttaacaagcaacccaaactaaaaacctaaatatcttttaatatacaaggtattacaagtggtgacagccctcgagatctctatagttctccctgtccaggtatggagtagagcgtgatttggtaaaagcgagcaagccagtgcctaaattattacgataggattaaacttaagctttcttaagaccttgttcctcactagcaaatcctctctacccctttgcctatttatgccttgtgtccttggatgaacctggagaagagttaagcacacgcgttccctgtggaaattcaataccttggaatacttcagggtgaagtgctacagcggtatatccgtgtgcttgcagattttatctgtgactgtaagaaataccaacaagcatttctggcgccgttgccgaggaacggttgttgtttatctccgaaccttgttcattatcgtatctttttaattttctttcttctacctctacccggatacctttagagaagccttcctgtaaacacttctctaccatggagcacaaacctatctatcaattatcagctcctaggggtgaattttatgagccacctccttcaccgaagccaattcttacatctggctatgaaattcgtcctaaaattataaacatgattagggtgaaatccttctctggcttagatcaagagaatccctaccatcatctgcgagagtttgaggaattgtgttcatgcctcatgattcaagacatgacacaagaaatcatacggtagaaattgattcggttctctctttaagagggagcgaagcaatggtacacatacatcgttgggaatgtaaacggtaactagattatgttgtgagataggttatgcctcgccttcttccatgtaacccatattacatctcttcaggtacatatcctcagttttcggcagattgaaaaagaatcaatcaatagcttgggccagatttactttattagtacaatctacgcctaacttgtctatacccgattatgtgttgttacaacattttcatacaggcttagataaggagtctgcattccatcttaacatcactgctggagagtcgttttttcataacaccccatctgaaggcacggaaatcctagatcgaatcttggaaaatacttcctttgttgagaaatattctgaacccctccaaaaggcatctgtgtcaagtcgtgaggacccatctttagtcgaacctgagtctgacctttccatatctgtagattcaattaaagaatcctctcccaagccatcaacaccggagagcaaagaaattcgaactccaggatgtgctcctgacttcagggacgattttcatgaagattatggaaacaccctgaattatttcaacaaaaagaagccacatattcttactccacctcccgatccaatcgaagatgaatatcttggagtaaccgttggggagttaaccacaatcatgagcaacgaatggttgaaagagaaggagttctcttctaaagtaattcgggttaatacttctcctcataccattccttgccaaataggagggaatactgtaggcattttgtatagtccaacggtgatgtgaccatggctactatagatacaaccattgctcacatcatggatgaacaagatgatatcaagatcaagtcctccaagtgctggaatctgattcggccacctgctacaatgctgacttcaaacagccgccaaatttgcatacgaactccgttttgggcccgttaatacttgatggaaaggtctaggagtcctgtttccaacggatccagcctcattaccaaactcagtctcagttggccgcaatcaaagaaacaaggtgctacgtcacttgtcatgggcctatgggcatgtaacttcgttagggacctcggcccaagtggggcccatgtggggtgcgccccaactaggtggaacatgaccctagggttcctttggtcatccttccaccattataattagctacgtacccctttagagtttcttgggttttgtttagattaaagtttagctttgctactttgccgtgtaatcccgtgatcgattagatcgccggtttactcgttacggaaccccaacttatcatttgtgttcaattcctatctgcaattcagattgcttttatcttgttcttgcttgtttcttcgatttgcttgcaggaataaggttgatctgcaccggcaagatcaacaacccacagagaggtgtatcgatcgctaagacgcaacacaacaacatctcgtacggttgtagtcgggtcgtcaacgtttcttccaaatcatagttatcatcaactcaccgaaagattgggccaacaacagccttgagtgtctcgagtggagctcagggttcatcaggtggtatcagagctttcgttgctcggtgagtttttatctacccataaccagaaaatagccatacaatttttttttatcatttacctagccatattgtgccattgcattgttcttttcagtttttgctttgttgaattttgcgttgcatcgtcacgtcgtgttgctggtcttagcgtctagttcatttagagtttcgagttctggtcacgttttgttccactgttatcgccgccgccgtgttcttgttgtcttcgggacctacggaaacggaatcggctcgctgccacggtttcatttttctagctttagaagtttctgtcggtcggttttggagttgttgagttgtatctaggttttctgttgcgtggttgtatccgtgatgatgcgcctgtgatgtgcgggtgagaaagatggaaggagaagattatattagattggatatttggagaacggttgatttcttgttttagcgcacagtttccaaaccgtgtttccggtttccattgagtccaagtcccacacatgcccagtcgcacctctctgcccagacttattagtcggactccctcctccctctccaaatcacgttatctctcagttctgagtcgtgtcaaataatttggagaaattctgttttatgtcggttttgagatctgtttggaaaaacataaccgagataatttgtgaattccatttttgtataattttaaattttggtgtggacttttacaatcgagtccctgtaattttcatatttatgtttgagtccctgtaattttgcattgaggtccttaagccgttttgttaaaaaaaatttaaaaaaggagagaaaaggcagaaaggtgcataaaaaaaagaaaaaaaaagaaaagctgcaccaaaaatacagagaagaaagaaagaaaagagaaaaaaaagaaagaaagaaagaaagaaggaaaagaagaaaaaaatagttgtatctttgagctgaatttaatatatcagagtgtgcttgagttgtttctggtgttatcttgtggtattgtttgtgtctaggatcgcgtctctagcacgttctagcctaggaccagcacggtgcttgactttgaacaattattcaactttgcattctcttatttgagcatttgctattcctttgctacgtatttaagcctacccagagctccatagaatagattgcagccgtatagcaagtgtttggccaaggcatcgatacatccaacctctatcggggtgcttggttgagttggtgtatatcaccattccgcttgctttggtaagaacttgtaagagtttggttaaaagcttgagtatgtgtgatatcatgagctgccactacctagtagttgataggagcgtgcatattcttgtgtagtgtttcttgtttgctactaaccatggcaggattgagcaagggaataagagatcatcaagttcttcactttcgacgagatatgacgacttctccacgcaatgcatataaggtaca

SEQ ID NO: 62411 - DNA, 1069 bp, Oryza sativa
aaggattttagcaccattgcagccccactacatgagcttaccaagagaaatgtgacattcacttggtctgcagcacaaaggaatgcattcgacactttgaaagataagttaacacacgctcctttactccaacttcctgatttcaacaaaacttttgagcttgaatgtgatgctagtgggattggattgggtggtgtgttgttacaagaagacaaacctgtagcatatttcagcgagaaattgagtgggcctagtttgaattattctacttatgataaggaattgtttgctctagtgcgaacattggaaacatgacatcattatttatggcccaaagaatttgttatacactctgatcatgaatctttgaaacacattcgaagtcaagcaaaacttaaccgtaggcatgctaaatgggttgaatttattgaattttttccatatgtcatcaaacataagaagggaaaagaaaatgtcattgctgatgctttgtctagacgttacacaatgctatcccaacttgacttcaaaatttttggcttgtaaacaataaaagagcaatatgcgcacgatgatgattttaaagatgtgttgttaaattgcaaggagggaaggacttggaacaaatttgttctcaccaatgggtttgtgtttagagctaataagttatgcattccagctagctccgtgcgtatgctattattgcaggaagcacatggtggagggctgatgggaaactttggtgtgaagaagacgaaggatatccttactgatcatttcttttggcccaagatgaggagagacgtggagaggttcgttgctcactgcacaacatgccaaaaagctaagtcacgccttaaccctcatagtttgtatatgcctttgcatgttcctagtgtgccttgggaggatatttctatggactttgttttagggctgcctagaacaaagaaggggagggacagtatctttgttgttgtagatagattttctaagatggcgcatttcataccttgtcataagagtgatgatgctacacatgttgctgatttgttctttcatgagactg

SEQ ID NO: 62412 - DNA, 2283 bp, Oryza sativa
tccccgtgttttatgatattcttgtcataattatcttcatttgcgcaacaatcttgaataatcacattgtccagcctgttttgatttcctccagatggtttattcttaagacgacaatttgacatatcaggcatgctgtgggctggattatcatcattgatcgtaccagatttacatatgcattcccgctacatcatagttcaaatcgtcagttagaaatgcatgatgataagatcccagggcataatgaatgaagtatattatctaaaacaataatgagataacgatgtatatgttatcacaattaatagatcgtgcaaataacatgattttgtaacatcataaatttactcttcaaggttctcatttgcacttgcagggaataaacaaagattgcttgcatcacagcatttaaaagtttacttgtcaatagtttgtgtatagcctgacattttattgaccacaacaaataaagaattaatacaggacaaccatatttcactcccctacatctagctcgtatgaacagtttgccatttgattctgagcttatggtagcaaaattatgtacaatgcacctaaggtaaaccagcttgctctctcttttcctccctggattaccccaaccacacatgcaacaagggagatcttgtttcttactacaactaccagtcatatctagggtgattgaaattgagataattgtttatgggacaatcataagaagatttataaatggtagaaagtcagttcaatgattggattaaggatcctgtgggatcatagcaacgtggcagttattctagcttttctaggataaagaagactggaatactttgtaaccaatatgctataacaagcacccaatatgctaaaataagcatttatgtgatcttaaggcatccacatttctttaactctgctctgctctccagtctctgctctcctcgttcactgctttgcatttgtttattctctgctctgactaacggtcctaagcagtgcctagacatcagccctgccaataatctagagtctagtgccttctttaacactgagctcatgccatgtcggagaaaggagcgggaggtggctcatgctgccagaatggaagctccctcaccaatggtttgacaagagaagggaagaggttgcagagggcatttcggtcttattcatgggtctgttaacaggacatggatggcactggcatatgaggaggaaaagttcaacctgagtggaatggaaggaacatgttttttctaatactaacaaataagggattctaggaactctcatatgcatggaattttctctgtacaaacctcaaatttgcacgacctatctatgtctcaaatatccagttcgacaattcacaaacagcgcgtacttattgactttccaggccaatgtaccacttttataatcattgacaccacaaggaacaagcaatccacaaattttctggtaggtcccaatcgaagtgtttatttcttttgcagtatcctagtacatgttctttcctcccccgtacaagtgacgaaacagcataaatttctaatctccatctaaacagagttgactgtctccactaagataataccggaaatccatgtactcattaaaatttcccattactaccaaaacatccagtccacaaatacatcaattaggaacgtataaatgctgcgagactgaaacatatggtctaggcagctacaattataaacttccaaacaccccacaccaaggcattatatatattccttcgcacgcgaaacatccgtaaatgcgtaaagcgcatacatctagcgcgcctacgaattatcccaaaatctatcacatccaaattgcaatggtacagtacacatggagagcatgatgatcatcaaaagctagtggagcaatcaaaccaagcaagcaagagggcgaatttacctccggcgaagacaggagcgacgccagcgcctgcagcttgctcatgctgaggttgaactgcgccgccacctcctccaccctgtccctcacaccctccccaccaccaccaccacaccccctcccacacccacccatcgcccacaccagcagcaagcaccccaggaacccggccaccgccccggcaccggcgtgcgccgccttccctcgccgtgccccgcagccgccgccgccgccgcactctccgaccctgctcatctcactgccgccgccgccgccccaaagcctccaagaaacgcgccacactagcagagaagaaatccggggcgagctagctctgacgggggc

SEQ ID NO: 62413 - DNA, 7919 bp, Oryza sativa
tttttttttgagattttatgatgtatttgatgtgtgatgtgaatctgtgaatttgtgatatatttgatccgtgatgtgaatctatgaatatatgatgttatcattgatctatgatgttatatgtgaatctgtgatttggggatgaagggagcaactcaattatgggaaatcaatatgcaagcagtaaaaacaaggaaaaaaagaaaataaaactttagtcccggttggtatatccatctttagtcttgaattgggcgtcccagtttacaatccaggactatagggggttacaaaccgggactaaagaccacttcaccaatagtgggaataggtccatctgtctatgttaccgtcctcaactatcatatttgtatgaaaaataatcctcaacatataaactatgtattattcatctcttaacataaaatattttttcactttatcccaaacctaatacgaactgagatgctttccaaaatcccttatattttaggacggagggagtagtacagtaaaataaaagatgggcatcacctgctaatcaaatactactcactttttcttccttccccttctctatcttttacatgaaccattatcatgatgcacaaggctcccacaattaatatattacataaataaacatatttatgtgtacatagcaaagaaaacataagcaacaaacttgaaagccaagcaattaaaagcactttctctttcagttcaatgagaaagaatctcaaacgggtgctcccccgactcccgtgtcgctctctggggacgacctgggggaggacaactgccagaccccattgctacctcccgagccgctcacctcgacgccgctgttgttgatggtgtcggtggcacccacacccaccccctttgaccttcttcatctctttgttccctttccttctttttttttcttcacaaatccagtttcaggttggctagttggccagatccgatggctaggacttaatggggaggtttgctcagtggatttagggcagacgtgatgcggatatcactcttttggatacacacaacaatcctccaatggtcattcgaggacagataacaagagctcgcgcgcgacaattgaatttagaagtgagctcgttcctatgttcttctttgtacgaatttgagaaaagattgctacctaggggcagatttaacgtataaccgatgggggcccaggaccccagtcaaatttacactcctaggtatattcatagtagtatgacctatgggcccccactccaattggaaaaaaggaccccactcctcctagttttcgttccctcaatcgcaagtgcgcgtgagtcgaggagtcaaacatccgctcctcttctttgattctctaaattccattattaagtggcaaatatgcaaattagggattaaggaagggaacgggaagctaatccacctcatctctcgccaagtcatcgcgtttcccacatgccatagttcatcttctcggcaatcgctgcttccttccttcctcgttcgctcgtcgtcgtcagcgcctcagcggtgctgcagctgctggcctactgctcactctgtcctctctgcctccatccctggtaagtactcctttccctccctgaccccttcctcctctcatattatagtagattgatctctaggtctccctcatgtgctctatctaatcaaccatcatgattttataggaaagataatggacaagtttttgatctaaacaaccgttgagaggtgtttctctgctatgaagattgtctaagaatgatttgcacaataagatgggtgacaagtttctgagccatagtctcatttgctttgtagagaaggatatgttagacacaataactaatgatgtgattgtcgatcgtttccatatggtgatacaccatcgtgaaaaggataaaaaggatgccatgttgttctaaaccatatttcttatttatatatcctactttcagtaatatttttatcggtttgtgttaactaataatttgtattgtttttacatgcaataacattatttggattttggaaggcatatctatacattactatttaagataatgtaatatctcagagtttttataagttgcaatgaggtgagttttacttggctttctaactgttctatgagttatagatgcgcccctagtcattttttgtcctgcgtccgcccctgttgctacctaatgattatattgtgattaggattaatggaggggacaaggagacacttggagaaggacttagagtcatggaggatcatcgaggacgtccaagtcaaggtggaggcccaaaccaagtcgacctctggtgcaactcggagtccaggaccagtctgcactaaaacgggcgcccaggtcgcatacgttcccggattggagcgttctttatatggatggaaatctaagaagataacctttccaatggttttggttccatgttcaaattctttccgagtcaatggtaatcgaccgaacaagttgatgttcagaatctgttccggtgctgcgtcaccatatttgggcctttgggccatgtatcgtgttggaggccattagggctgcgttaaggcttggttgcacgaccctaaactctatatatcagtacccgccgtcatctttagggtttgtgttttgcttagattattctgtcaagaacagtttcgctgctagatcggtttgtaagaccctaacttgtgagcttaatcattcatctgcaattttggttgtatcttctttgttcttggttgtgttcttcgattcgcaaacagggattagccttctcgacgaggtcatccacgtttcggcatgggtgataaccagaggagacgtggtgctgctattgcggggctcaagagcgtgctcgttcaagaagccagatcaatttgtgttgcgactcagcccaaatcattgattatcagaacctttcggaagatcgggaaccctagtgcacatcaagatggacggtggccgtccatcggcgccatcggctttatctcctctgctgacagctttgaatctaccccaatcgttctccgtacgatgtaggtacaagtagcggcatggctagcctagacgatgctctgtgttgggctaggtggtgtcacttgcgtccaagccacttccacataaggcttatcctcttctgaggttgattttcttccagatccaactgtggggagccatgtgctacagtggtggctacggtagctatgtggtgtttggtgttcgaggcacaaacattgggtgtgcaggtgattttcaggtgtgcaggtggcattctatggcttccctcatgaacttcgtggttggatgtaaccctagggtaaaagtgttgctcggttttccagtgctagcgacaacaatgccctcaagtgttgttcaacatcatggaggcattgctacgtagctttctccaccacctcaagaggtctctctaggtgaaaaccttatattcattttagataaggtgttgttgccgttctatcgacgtgtccttcttaggagtttcccttgttggattgctgattgtaggaccaatgtgtctagtctatgtggctaattcgcttaaaatgtaagggtttttactagtttcctgcaaataaccatgcttttgtaaggtttttttttggtgggaggggggtggtttccctcataagctagatcaagtcttttcttctataatgaaattgcaggagctccaacgcttttcggaggtttacctaaaacactttgtgtagaggtgaagatcatactttaaggcatctcaaattagcaactaaggttggcttactttcatttgcttcaatatataccaagatgagtataattattttcctataaaatgggaagaggtatagaagatcttgcatccaaaagcatattgccaaagctgagcgaggtgtttcattgtatttgcgtcaaactccaacactgcatattaaaaggactatgtaagaataggtgccacaaagtctccttaagcagtaggttgcaaacaacacacgtgagatcattatgttgtggtaaacaatgttttctatccaacatgcatatcccttttgttgagtcgatcaatcaaaaggagccatcccactttaattttcataattaacacaattgcttttccatatccaattcaagtagactgtaggccaaatagacataaagttgatggcataaagtttctaagagttataagaagaattgccccaagtatatacccattgaccatattgctaagtcaaagatatgtctaaatcaagcttttgcaaggttataaactcatgatatgctaactctgaaagaggtaggcggattaaaaatctctgcatgcatttttccaacaactttataaatagtccttcagattatgtgcaaatgaacaaattagaattctatagatcttactatctcattcctcttcctagtagagacatgtctttccatctgaaatgaagcatttggctatccccctcaagatgtcaacaaatcgcaatatatttttctacagaaagaaccttgcaccttagttgcataagaaatagaactactatataatacttatcctagattaatctaacctattggcagcgctatcgaatttactagagattctagtcttaaacagttaaccttctagtttgcctgttctatttaggctataagttgccgatcagaactctcggtacctagtttttggttcccatgagggggcaaactcagggtcatgtctcacaagaagtaggtgcaacaaatagagtaaatgagtaagaacatgcagtgaagcaaatacacaagcaaagcaaacaaggattttgcatcgaagtttggatctgaacaatccagctctgctaagacagtccaaggagacagacctagattgatcccaagcctcaccgagctaacaactaggaagaagttttagcctctaagcaaccaccaaaacgtagcatgtttccatgcaaccaccaaggtccaaagcttagacaacaagcacctatctccagtgaagcttgctctacaaggcaacctcctagacgatgcctagactgctagatagagaaccaccaaaaataacaaacacaatgatgaagcatgatgcccatccctaagtgtacttgctaagaaccctagacttgaagctcaagagatctaaatccctctcattgacaaattttttgctgaagtagtaaggtggagaagggtacaaaccccagggagcctatgggagtaggctgaaagatgtgacagccaacacctcaaaagaggggatactccctcatcctcgcaactagccattactcacaaaatttcgatcaggatggccaaaacttccggtcacacttagtctagctacgaaaaggggaagtggaacttagggtctaaaagacttgaacttcaggtccaaggtctatgtttcaacgaagagtgatgactagaactttcggtccattgaccataacttctgatccattgactagaagttccggttagcctctatggccaaacagaaactcttgacctaaagtttcggtggaaactactgaaacttcaggtctaacttgaacacttatcccattttgcccattggtcgtgtggtgctttatgtctctctacaagatcaaggttattctagagaacttagacgcaacaccagatgaacttttaatttccccctttttggtggtgatgataacaaaactcagagcttacaaaagatttataattaatggttttgaatgaatagggatacaagagaatccccctaaatatgtgcaaataaaaataattaagttaattaagtttcacatgcacatatttgtttgacgcatgggaacccgtatctcttctcattcgtgggatgcaacgtgtgatagatacacgacaaaaggaagtctaaatacatatggcatggcattttcacaaaaaaggataaaataatcaccaccatccaaaacatgcatacacaaggattgcatatataaacaattaaaagctaaactagcagtcattacaccgtagacaaattgaaaatagtaatcacatgtccaacagaaaatgtattgtctaaggtgacaagaggaatcaaaacttccagtggatagagttcaaagaaaatgagttacccctttagaagaccatattgctccctccttggcatcaagacaccaaaaaggcaagaaacacaagacaacaaagaataaaatcgatcactcggaagtggtagaagcaacatccccttctttctcttcttctacttcttcaatggctccttgaagtggagagctctcttcctccataaggatgctaccaaatgcttcatggaaagcacaaacccaggaaatcccaacaccctaggcaactccttgagaagcctcccccttaccaaaaggatgctcaaagtgaggagcttgaggctcatcaccagactcatcgaagaggcatccacatgcaacaatgcaggcaaagtttatgtctcttccccatcctttggaggcacatcttgttttcaatgattttgatggcgttagcggtgtacactaagaacaaggctttcagagccttgttgataggagagtcatgcttgagtggggatgaagcaccagaagtagaagcatgcgtagctttagaggtgcaagtgttgatcttggaagcattagaaggaggaactcggagggggggggtccgaaaggcttgctttatctcctcctcaaagacggtcttggttaccatcttgattatataagatatggtgcgtaagcacacgtccatctaggatcaatgtctataaagtagatctcatcccaaataaacttcatcacattgagatatgcttccttgggtctcgagtaggagaggggatcaacctccctggactagagagtagtaccatcacccaccttgagattgagactgaagtggaagaggttgttgaacacatactagtggggaggcaaaccatcagacgtaccaaggcaacctagtggtgcatttgctccataaatgaaagacaactcatgtttcaacttgtgtggcatggtttgaaggccctaatattggatatccatcatgtcatgttgaagagcgcaagcaaacttgacaagagtagtactttgtgccttgcatcctccatgccatcctctcttgattgcccacaaacctgacaagagtacaggagtacttggtgccacgcatcctctatgtcatcctctcttgattgcccggatatgggtctattggcaccacctgtcaataagcgtgttggcctggaacaaagtttatgcactttatagtttaattccattatataaaaaaatatctagaaatatatattatacatagaacttattggaaaaggaaagtaggctaaggccaagacgtgaagggaaaataagtcctttttactctctcaaactatttcaccggagcacatcacccctaaacattttttttactcattttacacgccaaactatttaaaacagttcaccttactgcttaacgatatttctcttttatttgttctctatataagtagtattttccactaaaatttggtaggaatgatagatgcattataacttacctctaaacattttttagaattttcaaatgcaaatgagccaagccccaaaatgaaaagatgggtcagttcgtgcaggcgtcacgctcttgtttccgccacaaccattttgtatggagaacattccttgcatgcaattgagttttcactcaatctcttttatgcctttaaattttgtgttaggcgttacatgcctcgagttttaattttaatcccctatataaccattttgttagttgaccattattttttttaaatgactatgttactctttttcatacctatctggcagctagcttacaaagataagtcca

SEQ ID NO: 62414 - DNA, 2353 bp, Oryza sativa
gagtgtagactgtagagggaccaagatgaaaaccctcaaagggacagaacggattcagaaagaaactcacgtaaggagttatctttttcgtataatataggtggtgcagtacaggccttaggctcgcaggcggggcatgatgcgtacgtccaattcggcagctaccgtacgtccttatgcacaccccatactccactgcaatttcgatcgcactccacctgcaagagcgctctggaaataggggcgtgtttcacgttaaattagaagtttagttaaaattggaacgatgtgacggaaaaattagaaatttatgtgtgtaggaaagttttaatgtgatgaaaaaattgaaagtttgaaaaaaaaaagtttacaactaaacacggtgtgtgcaccgcctcacgaatctccaagcactgatatgaaaattactagcctgcagcagcctttgtacagtactctctctagcttgtctcctgcatgccctggtcagatgttctagcgatttttttgaatttgagctagacatttcactttttttttcgttcagcactcatgaaaataaagccgagctagaaactataaaaaaacattaaaattaactaatcctaaaattaaattctaaaatttaaaatgaactttggattataatgaacaaacagtgtttgattggatatttgacatttggccatttgggacaacttatttcataaatggatcacgatcgaaagaccataaaaaaaaccccctaaactcagtactattgagactgacgctgaggccgaacatctcagtgctaacctcgatgcaatgacccctatgccgtatctcctgtcacatcggatgtttgacactaattagaagtattaaaattagactaacgataaaacatattccataacactggactaattcgcgagacgaatctattgagcctaattaatccataattagcctatgtgatgctacagtaaacatgtgctaattatgggttaattaggcttgaaaaatttgtctcgcgaattagctcttatttatacaattagttttataattagtctatatttaatactcaaaattagcgttaaaacatcctatgtgtagttcttggatccaaacaccacccaagtggcataggggtggctagcgtggcaagtggttagcactctatcaaggatgcagctaatctctctagctcagttcccagtgtcgttagcgctaagataagacaccataaagttgttagcgtcgaggtaaggcattaccataaaattcatatgccaacctatctctcacgcacattttctacaaaacatgcagttcaggctgggctatattgaaacaaggggttttaagggatgttagaggagttcagtccgatgaaaaaaatttctatgtggtgctttggattaaagcaatagccatccaaaaatcatagaaaatcctttggattggttcaaaagatagaaatttcttaaaaatcatttgtgtatatctctcttctgatttctgcattttttctgcgctccatccaaactatcctttgtgtagtttccctacatattttcaatccatagaatttgaagtgttaggacacttcactcatgtatttttttctattattgtgttttgagaatcccgtgttacaaaaaaaaaaaagccttagactgttcagaagtgactctgaaggtaacaactgatctagatataacccttgtggatcaatattgttattaccttgacagattgatttttcactttatataggtaatgctcagattgaagtcgatctatatgcattttcgttctcaaaatcttcaggttttgttgggaaaatcggtaggtaatagctatgtttgacagtttgagggttgtaagtaggtggagaattagggctcaaatggtggatcatgagtaatggaactttcttgttgatttgtgatagcagtacatttgctttcatggtagatttgtgaggggataactggtattatatatctttttccatccatgtgaaatggcaacacattggttttttggatatgatgatgttgagggaaattttgataattaagaagaaacatctttaaccaaacatacatccaagcattgtttgaaacttaaaaaataatcctaaaaattaaattctactacctccgtcatatattacttgtcgctttaactttttgcaagtaacgtttgaccattcgttttatttaaaaaattagtgcaaatataaaaaaatgataagtcatacttaaagtattttttataataaaacaaatcacaaacaaaataaatgataattttaaaaaaattttgaataagacaaatgattaaactttagaaaaactga

SEQ ID NO: 62415 - DNA, 6759 bp, Oryza sativa
ccaattttaccgagttagacactgattagaatgcgacgtgcatacacgaggtggacatgagacatgctatctttgtaaacttgacttgtgctttaatattctttgttttaccctttacatcatttccttttttttctcttcctgtaatgtaatctttaggtcttattgaatctttctactgaacaaatatatatatgtgcgtaacattcttcttacgtgtgtatttatataacatcctaattaacacttgaattagcaagattagccttattttggttttggttcgcgcatgccctcgacaagtttgcataccaaaataagtgttttacaagtttatatactatattgcacccatctgataagttcttgtatcgctaatataatttactcttttattatttttgtaattctgaccacataactcacttttctatcaatgtctagcatctattttggcaaagatatatcgtgcatatggatggggtaatttgtcggtgcatcggagccgatttgtttaaggttgttaatgtgcatttaggaagttgtttggagtagtctaaactataacgacggtaaaactactcggtctaagaaaaaaagattgacctaagggtggtttaaaatgaacatttagcaataaaatatgacctaaattgcaattcactctataaaatgctctgatctacattaaggctgtgtttagattcaggggtgaaaatttttgtcatgttgcatcggatatacgaacacacatttaaagtattaaacgtagtctaataacaaaacaaattacagaattcatcagtaaaccacgagacgaattgattaagcctaattaatctgtcattagtaaatgtttactgtagcaccacattgtcaaattatggagccattaggcttaaaaaattcgtctcgcaaattagtcacaatttgtataattagttatcttttagccaatatttaatacttcatgcaggtgtttaaggttcgatgtgacagggtaaaaaattttagggtagtatctaaacaaggcctaacacacacaatttgcatatatgggtcccttggcctttgccgtctaatcaaacgtaaaatgagaagaagcaagcatcaatcagaacaataattggcaacagtgccaggacacatacacatcaaacacatacagcaagtcccaatcagcagcagaagatgtcactgtttattttgagaggctttgcagtttgcatgcatcacattctccatgtgatgaagggtgacaaaagaagttacagctaaccatggccaacgtcgatcatccacacaccagggtcacaagcacaacaagcacacaacacagacacatcacaaaagctgtctgaatgattctccagagagccattggctctagctgcagcagagctgagttacctacctatacctagctagcaggcatgcagctaccacctactccattcatcccaaaataaatcaaattcttagagtttaaattttgttcgaaaataaattaattcttacctttttacctacccttgatccaaagatgagaagttttctcttcaacacttcttaacttcccactcaccaacaccaatactatttttctgttaatgaggacaagtattttttccctcgttagaaattatcttaaaatataagagtatggtttattttaaaacgcaagaaggagcaagatcatcatcagctagtggagcatgtggcctactgcaagatgcaacatcatatgtgtgcactgtggctgtggcagtggaaaggacagtggaaaaggatagctatagctctggatgaagctgggattggatgcaatgcaatgcagtgcagtgcaagcctgctggctgctggctgctgctgttgcatgctggtgcttcttttgggtgtcactccagtgccaagaaaaaaaaaagcctgtgtgccattttgcttccatgtgcacaaatggaggagaaagcctgcaccaacaaattggtgttgcattgcatggataggggtggtagtccttttctttcattggttgcttttggatcactgctactttgtctagtgcatgattggccaattcagtgcttaattgcagttcacatagtagctacaatatgatccttagatttagggcctatttatatctcaccccaaaattttacatcatgtcacatcgaacgcttgaacacctgcatgaagtattaaatataggctaaaaataattaattgcacagattgcgactactttgcgagacgaatcttttaagcctaattgctccatgatttgacaatgtggtgctacagtaaacatgtgctaatgacggattaattaggcttaataaatttgtctcgcggtttactgacagatactgtaattagtttttttttattagtgcccgaacaccccataggacaccctatataatacccgatgtgatacgccaaaactttacacccctagatctaaacacacccttaagtggtggttctacatatttatcttacactagctacaaactgtgccatgacatagaagacctatgtaggtgttattttctcctgcaaggacaagctgtaatttccatttttatgtctagaaataaaggtaaatttagtgtggttattataaattgttttatgtttctccatatggaatggataaaatgatgtaatacctccgtccaaaaataaattcatttttaactcatttcacacataccaatacaaaaccaaaaaggctacaatacaattactttatataattccattacaactattccttattttatctactcccaataaaattattacgtactttcacaaactacaatgcaatgattactctaaaaataaagttatttggggccaaatggaaggggctaaaaatgaacttaatatagaattggggaagtacatgcctaatttagtttattattaatacttatagtagtaatgggcatgtttgtgctgagcaatggatcgatctcattattgatgagagtatgtaaacattaactcaacaaggtttgacaagaatttctcaaaattaaatggcgtgtagggaaaaaattatattgctgaaatgtgttggcttataaagcacagccaaattttaaaattttcaaacttaataaaaaaattagtttaaatatgtaagtcaagcctggaataccttaatttattgataaaaaaagtcacaacaaaataatgatacttacatacagatttaaaataaaacaaatggttaaatatgtcatatccaagtcaatgtaaccaacgtagcatattttactctgtagaatatagtagacaagaaaaccaacaacaacaatatggagaaacctctgaattgtcaggctgtgtgtgcatgatcatctacaattgcgactagtgcttgtataatatttgagcatgcatataacaaatatatatgattctactagagaataatatttcaaataggcccactcagcccatatgtaatctagacttctacatgggtccaaaatgggcttaacaaggttgttgttgcttctcagagatgttagtacaaacaaatttcccgaacgtattacttgcttaaaaatagttttttttttgcaaaatttatctgacctagcattattatttaaaaaacttaattgtggcaattaaatgaaaacttccataggccttgttaaaaacaggaatacgtccatattgttttgtctataaataagaatttcacatagacgcctaggtttgaactgatggggttaacttgaatggttcaagagagtgtattgtatctggtatagaagttaagcaggttttctttttagactaatgagatagtattaaaaactttgttaacactacatcatgatagcaacatcaggcacggatggttgactaatgtgaaacatataacgcaccatatatatggtgattaagcaagagatgcacagtcctgaccatcataaaaattgtagcataatacttagtcaaagccccttttcattttgtatatacattttgttaaaattttcattatgataatgactatgcatcttgcttaatcaccatatggtgcgttttatttatcaaatatatctaggttaacctgctctcacaaaagtccaactttctccaactgtagctagtaaaagaaaaaaaaacagaatactaagtgcattaggtttgcatgcttcatcaatccttttaactgctcatttggcttatcacttccattggttcatggttagatctatatgcatctcccaacaccactgttcagcatcagtaccaaacaagaagaagcatcaaaatagcatcatatgctctgcatgcatatccatggacaaatgtgcttttggattgaagatccagagacatcctgtgttggaacggttcaccatctctgagcctcctgtcccaatccatgacatcaggcaaatggttaaacgatgtgaccatcagaaaatctgcttggagagacaaacaaagctggttattcttagttttttttcattttggtagattaaaatatacttaattattgtgtagtgttatgatagagtccttttctgcaaatatataagacttaagtgtgtcttctagctaccattatataacttttcaaatccagagcagttgagagtttttaggcttcacaaaactggagttaaaattaacttgaaattgtgtgagttctatcactaggagaacaatcttgttaaatacctagcaaccattacagggcttaagaggcagagaaaaatagcgttgatgaaaataatgttttacttttttaaaaaaagaaaaggaaagaaaatggtgttttccatgtaagtcagcttaatatcattgcgataactaaggttatacccaggggcgaagctagcatcaaaacaaggggtgcactactattgagaatttagaaaatttcagtacaacactgtacattctagtgtttttaagtgagaaattaggaatttgggggttcatgtgctgcctccccccgcaacataatatagcctcgccactggttatacctaaataagattttggttatattgtcgaatattggtatcatagcatgcaaagagaggttttgtgacaaagaagctacaaatgaactctggctaccctgtacatttttaatatttatatatactatgtacttggaaccaatttattatagttattgctaaaaataatataatgtaagacacataaatgtattcttttacaatgaaaagaactttgaaattatatacttatatatatccagatgttaattttgttcaaattttgtactactatatataatatggtcccacgcgctaattaactagcctccatggagctaggagacccaaacccacaattgtgaatatctccataaagaatagatactacccacaattggttatgtgtccctacaaactgtaaagcaccctgtcaactactggtgaacatgttccaaacatgtcactctactataaatatgtccgccacaaccataaaacacatcgctaacaagcttgttgactgtaaattcatcccaaactagtaaacgagttttcgaacatgtttgccaactgtaaattcattcaacacgattgggaaaaacatcatttcagtttatacaattatgagacaattatcttcactccagttataataatttttttctttaattttacaaacataagtattatatttagatatgtgtatgtacatgtgcaattttgcggtcccaaataatgctcgcttttacagccgtgaacttgttttacagaaaaccaccaaggatatacttgtagcgtctatagctcaatagatgttgctgacaggaatctgtaggatctcccatggttaattaacaccctagccaagttagcagcctgatagtggtgtagcaaaggcccatatggcctaggtgtggttgtagttggtagttcagtaccaccttagaggtttatctaggtgaggtaagcttatataccctatgagttaaccttttatccgaagtaagcatgaacgtgtaagtgagataatatgcaacgagagtacggtagtgtggattttggtggcaaggccgtatttgcatatgccttatttatgcatgcaatgctacaaagtgctccattcgcatctctaggcgttctttctaatagaattggatatttagaattggagtaaacatccatatctctaggtggctatttagatttggatataatcctatatcaaatggagaaaatagaaaccgcaaattttaccacgcaactaattactgattttgccaaaagagttctctcatgtgctgcaatctgatgtccgtgatatgttctttacattgatctccgtatttcctcgatagagagaaaatgagtggcacggtggagggggaggagggaaagttggcatggtgtctttgttagggttgtctattggatcacctaggtttagatctagtcgggtggttctatttgcaatggatgaacaacaatagatgaatgaacaaagagggagtgagaggatttagggttgtgaccagtcgttgttgaggaagaggaagtccggccggccatcgtcgttgtcgtcgcgggcttgacgtggacggcggcgacgatgtgctcggttccgatggcggtgatacggttgcagcagcgacggtgtcgacgacgaggcgtggcgctgcggtggacttcccgtcactggctgcgccccctcgatcggttagggtttatggggtggagtggcggcggcgac

SEQ ID NO: 62416 - DNA, 4112 bp, Oryza sativa
tatatggcacagtgtgaccgggggcccaccagccattgggctgggcgcccccgatcagggcgcgggtcaaggcccccttgagccgttgggctcaaggggagggagatccatctaacagtcttggcctcatatcatgttgaccgcatcggatggaattgccatggaaggagggaaagtgaggctaagaaaatggtgctcagatgaacctagaaccatgcataaaactcaaaataaaaacaacaacctccctggcaataaaatcaccagggaaaccaacatgtacaaaccctatgatggtaaaactaagtgttgtttatatatatatatgctagattttacaattgttggatggtgcttggtgtgggttagtcagttggccaatgctacaaaagcgtgtgtttggggtcagggtcaacaaagctggtggtgtgctggcagtgccccttggctagataatattagtatactataatatataagagttcataatatatttttatttctagggttgaaccattgaagtaataatatgaaatttgatatatcatttcctttggtctctttttaactaagacattttatactttacgtgtaaaaccttataactcagcagtcaaaatcgattgacaactaatagaaagtgatgtacctgcagtgaaatgtattttaaaatgtggtctaacaaaacattataaaagaaacataaaaaaggtcaatctctgatagaatcaaaattggttggttctactcgcatgtagattgaaaatttcacttaaaaaaaatacggaaaggtcccactctttccaatcaagcaagggttatcagacaaaacatcactacaaaatcatgatgaccatattcctacaactcgttgccaaacactaccttccagtttgttttgtactatctgttcacccattactcaactttaaaaagctaggattggccctctcttcagtcctcacatcaactcaccaaaccactacactgttcacgaggcctcttctcctttggattttttcacttcttcatgattctccgagcaaaaatgctacaccgacaaattaacttaacctcagctagcaacaatgattccacaactgaaaccaacactatataaagtagccggagccctttcatttataggaagactcatctggatgagcagtaagttcgtcaactatatatatatatagaaaacatttcatacaattgaagtaattttctccttctacatacagagtgagaattagaataaaaatacactaaatataactttagcttgcttatattggtgatggaagctaattataatccgacttaacacctctacacgtcaaaagatgtatccaataaccaacttttcatgctattaatgaacaaaattagcttgtaacgtatatacttgtgttgtttgttcaagtagtaccgaaatgctatcttctgccaaacctttctaatagaatgcacaaacaattaatagtaccactttgtctttagaaggaattccatgttgatcatttaacaaaaataggaacatctctcctaaaaacacttacaatagtatagatgaattatagtcaatttagattgccgcgcttacaattagttctcaggaaacactatgctagataacgggaggccatcatcactttagtcttattttcgtcaccatcatcatcatcatcatcagaccttgtagagaccttgtagagacagtacatgttgtactctgccttgtctctaatctacgttaatcagcagaaatcaaacttgacactgcctaaagacaatggcacaatagttgttgcgaaaacccctaagattttccagaacttgtaaatatgcatgtgaaatttgtgtgtggatgtagcagctagctagctccacctatcttccacttccacatctcccccataggattatttgctggatccaccagaatccggcacagaaatacatgcaatgaggagtgaaacgttacaacacctcccttataaataccctaaccccacacaagaaacccctcctccatattacaatcaagagaggaaaaaaaaacagagagagaaagatcaagagcatataatctatatatacacacaggcacgtcgcgagtaaatttcacaaaactacatagactacgtggatccgatactccgatcccgacccggccatgagaaggcaaggaggcaactgcgaggtcaactcctccatcgccctcctccaggagaggttcaggaacctgcagaaggtgagggagatgagggaggggagggagcagctgctgcagacgccgccgtcgccgacggcgacggcgacggcgatagccggtgcaactaccactggtgctgctgcgtcatcgtccggcggcgagcagccgaggtggttctcgcacccggagctggtccggccgtcgtcgaggccggcggcagcacagcgagccaccgccgacgacgatgctgccgccgttcgtcagccgccggcggtgagcgttggcagggcggcagccatggttttgcagagctcggggtgtaggagcgatgtggaggtggacacctcgcttcacttgtgaagaagtgaaaattaagtagatagctagtagtagctagatgcttatttagctcggccgaattaatcattttttcccccctttgatccttctagttcttgtttttctcttgatcgatcacatcttgtatgcgctcgtggatgctgtcgaatttgaattaatttggttctagttcatgttgattagatgtttagatgagggagtgtctaaggtgttgtaaaattaaatttctcaaaaagatctactatacatactaagtactaattaactacctcagatcaatcactattttgggataaaagattctttttgggtttttttggggagagggccagaaaattcggggaaactaaaattgaatttgggatatatttttgctgaatttgaacaattctttgcttcaaaatttgttttttttttccagatgtacatactaccggaactcatatactctctctgtacttaaatatttgacgtcattgacttttttaaacatgttgaccgttcgtcttattaaaaaaatttaattcattattaaatcttttcctatcatttgatatattgctaaatatgtttttatgtatacacatagttttacatatttcacaaaagtttttgaataagacaaacagtcaaacatattttaaaaaagtcaacagcgtcaaatatttagggacggagggagtatattaatacacccgaagttgtggattgaaatcgtggaccctagctacatcataaatgttattacctctgtttttaagtttttgtcactgaacatgcattattcaattgttaattttgacccctctatttgcatttgcagaaggttcatgtatatttaaaatatgccatatacaatgacattgtatattatcctacagtagagaaccccggatttttatcctatgtgtgcccacgcaaacctcaacatgcaaattgaatccactactatagaaaagggaataggtgccggttgagaaccagtgtgtcagatttcctagctgacacccagtaggcggcacctttgagaggactcaaaggtgcctgttcctaaaccggcaccgttgaggtttcagaaatgcaaaagaaaagctaactcaatgcatcggctcgaatcgatccgatgcattgagcagctcccatcaccggtatccaagaacacatgaacagaccgaacaaacaagaacatcaagaacaccatgaacacatgaacatcaagaactaaagtcttgtcctctatgccggccatcacctcaccctcctcaccggccttctccaccatcaccgccgtcgccagatgaaaaggaggagaggaggggtgagcctctttctctaccaccactgtcgtgggacgccactgacaccacagtcgcccgaggatccgccacaggaagctagatctgtcgtggtcgccgctggatccgtcatgggaagccaccgacgccgccagatctaccgatgcccatccttgctcaccacccatccgtggtctccgtcgcgccactccattggatccacccagccgccggcgccgctc

SEQ ID NO: 62417 - DNA, 6349 bp, Oryza sativa
  unsure (1)..(6349): unsure at all n locations
agccccgtgctacctcttccgccgtgtgtgctcggtgagcattttccccttcctctccttgcctcctcctccacttcccgcattgccgctgcgcccagtggtcgctggctatgaccaccaggccgtgtgccgccacagttggtaggatcggccggtgagccgcctcgctcctagttgtttgattggtccgggccaatctagggtgtccatgctcgtggaccaccctgtgctcctggtccacggtgcacccggcaacctccgtggactcggtccacagtaggccggccccaaggccggccccttgacctactgacgcatggggcctgcctgtcggcatagtaaaataaataataattgtgcaataaaacgagtttaatttcagaaatttatttgaatggctcaaaacttctcaaattcaaaactaattcatacgaactccacttgcaaaattcacctaaagttgagctctacacgtttgtttacttttcatgtactgtttactaggtttttattagggtttttccttgttttgcgtgctagcatgtagaatctgctgttctggaggatcgcagccgcaaggaaaagagttcagaagattgttcgaagatgctaggcaagtcacacattctcacttgagcatgttgaccctactttatgattttttactgcttgcaaataaaatgcatgtttttgataattatatgggaacaaggattacctatctgcttgcgtgtgctatgtttacttgatatccatcttttatcaaacttgggtgacaatttgactagcttgtcacttatgttggtattgctggaactatgatatgcttagccatgcttaattactactagctcacctaatgggacgatcacattatgtatatttagtatcttgacaagctgcgagctcgagacacctggccatatttattggtcgcaattatccaactaaaacatggcctaatggttggttgtgagtgcatggttttgattgtcacacccatgacaattaagtaccggttcgcgggaaacccttgaagacttactctgcttaattaccacaagcaagcgtgggtaactgctggacttgtagtatagcttttccctttttgatgttctcaggcaagggtggatgtgatggtgtttggatggaccgtgtggcggtctatgcggcttcaggattcatcatggcacaagagggggttgcccacctcagttttaagagagggggcaaaacctgcagcgtggtgcgcttggtcaggggagttatgcaaagggtcttgtcacaatcactcgcatggtgatgtgtccggccggggatggaaacatgatggtgggttgtgtcttgtgagtatatatagttgtatacctctggccagagtaaaactatttgaatagttgtgcctatggttatgggcaatcaaccagcatctatatcgtagagctgtaggccgaagtctctttggcagaccaggggtaagcaggtgtccgaagcaatcgataggggtttaccttaacttaattaaaataattaacccataggaatcatctctattctcaacctaccatttagttgttgtccttggaagaatcttgtacttagattatacaaacacgttccctgtggatacgataccctggaatactcttaggtgaaggctacaatagtatctgtgcagttctagattattctgtgttcgtaataaataccaacagctacttgaaattcatctaacgagaacaagaagaaaatgaatatgttttctagattatattctgcttatatgttattttgggaaatagtgttggctggagcatcgtcactactattcgacactaaggtgtcttaattgatcttatccatggaaacagaagaatggctatgagtttgccaaatccttctataggttatcaagtgggttgggtttttccttatccacctggacacgcatatataattcacgacccaggaatagcacggctcatttggctatgggctgtgctatcactgcccgtctagccatgctatgcttgggctgctacccatcccggtgtgccaacacaataagtacatgtagcgagccagcacgacatggcctagaaatgataggaaatggcctggtccatgtggcacggtggtgaacaatgactggcaaacaaccgtcagtcgagcaactgccatccaagttgaagccaggagaaaaggagaacggaagaaccgctgaagctagggcctaggggcagagaaagcaatggtggacgctcattgacataggccaaaagggcagcgtggtgacgcggtcgacccctttcgtgagcacaaccactaagcgtgtcagttgttgggggctcatcagctccgaacagagcaagtaggaagtgaagggccacgacagtgcttgacggggaggaagaggaatgagctatctgtcagcagagaaccttgctggagcttcgccggagtttgtgcggcaagatagaacagactcaattcacattattttttatggtatatgtcaattttgggctaacggacctccacccaacccacataccccaatcgtgctaggccgacacgacacggcccgatatctcactgggccgtgcggcccgtgcctggctcctagcgtcagcctcgccattttggcgtatagttggcctctgtcgtgcgtgcgtgagttatccgtcagttcgccggccgccgccgcctccgacgatccccatccatcccgcgagcgagcagggcgccgtcgttcgtcctgctgcatccgcccgcatccatctggtgagcacatcctccgccaccgccgcctgcgccgatccccatccatctgctgcttcctccgaaacgcatctctctttcccatctctctctacccacgcacttcactttttctcgaatttgcgttaaccctagctagctttctgttctagaaatttgccttaaccttaatactaataacagtttgtttgttcccaaaaagttttgggggttcaactgaacccccatgtcccaatgttagatccgccactggtggtaaaatgtagtacactgtattttatttttcaactttgttttgtaaaatcctttgtagaattagtccaatggtgttgatatcttggcccaccatagctttctgcatatagttattctacctttggattcttgtaaagggggaaaataagcacggactgatttgtttacaggatgatagatgatgcgtaattttgatgtagctttctgatttccgctaatctcatgttcctatctgtactgcagtaggatcaatggagacgaagttatcgttttatcaggacagcccgccaattcccatcatttctgctgttaaggttgccatttagttgcttcatttacttggtgtgttatttttgtgattctttggtgtggccatttttttatccttttgttagtttgcgttggtggaaattgttcgctggtcctatcagaagatataatattatccagaagtatgtgtgtggtttcattgacttgatcagtattagcattgaccactaaatgtgaattttgattttattttgaaattgagtcagtaaggttacagatggccagctagtatatatcagggcctttttttggtagaaatcctaactttaatgagtcagacaaaaggcataatattcaaaccgaaacatatagatattggaatttttttttttagatattgtagtggttggcgataacatatattcacagccaattcactaacattgcaagcattagcctttctcggtaagttagctaaacggcatgttatttaaaatcaaattagttgttcaaaataacgcatattcatagccaattctctggttgcagatattgttgttggttgaagattgtcattaggaacggtgttgtgttgtgggaggaggtcctttggatgagacaaggaggagccaggaggtcctctgaaatttccttccctcgcagaaaaggtgcacaaataaaacaaacaaaaaggaagtctgtatccccacgaccccacccatggcattcccctccacctcgtcggtggcgtatcccagaagtctgtccccactgcgccgctgccccggattcctcgccctccttgttgccgtcctccttttcctctccttccaggtacacaccacatctctgtactcatcatttcctcattgtaatggcgaactgtcaacggtttcagaaaacaacctactacagtgtactagtgtaggattcctgccttctcattctaactaccaattcaatgctacagctcatgattcatgttccctccatcagattggcagtgtccggatggctcttctccgatcaccagacgtaagagttaagaacagccacagcgttctccgtcccattgcacttatttaagattctaactttgatgttactatcttgggttcttgaattgtcagtgggcacaagggtcccgggagctgtcctggatgccacaatgtacagtttatctgatatcttctaatgacatatatgaggtcaggaatagttggatcctgtttcttgccaaattactaagtgtgcattttgtttacctgacagggcatggataatgccgataagactattgcttacacgaatcaggatggtcggatcaggctgttcaaagttaccacaagagaattcttgtcgtcctctatctggaagaatcctttgttgccgaaagataccgagccggtagctgaaatagtatgttgtgaataaaaacatgtttttatcttgccaagtcattgcaatttttcggtttacagttctcactgctctttcttctgctgctgtaatagcaagagattgcggaggagcagctactagccactgggtcagaagtctccaatctttcaagcacagaaactttggaaactagaactgatccaattaaattaaagagagaggttgatttcctatttgccttatatcgtaactattatcaatgacgaactttggaaactagaactgatccaattaaattaaagagagaggttgatttcctaattgtcttgtatcataactattaatgatgacagatattttacctgtatattatgttcctttcttgttcctattcgattaactcttcaccatctcagcatatctgatataccattatgattcctgcaggtgttccgacgtaaaagaaaggagcataggattcaggagttgcttcaggtggacaaggaggctgagctccatatgcgaaatgtagcgacaaacagatcgaggaacttcagtaacaaagtaagagccagctacaacatatggaggctgcagtttcaccatactaatacggattcaaccctgagacttatgaaagatcagataataatggccaaggtgtatgccacaattgcacattcccagaagcaacctgacatgtacgcgttgctcatgaagtgcataaaactatgccaggaagctattggggatgcacacatggattatgaacttgattcgaggtactctattttacacccttgaagatttaccagttcagtgtctgtttgctgtgacctggttcagttatttattgctgtgactctaaaggttcaattatttatcacccacatttcttatgcagtgctttagagcgagcaaaagcaatggggcatgccttgtcttcagctagagatgttctgtacaactccgatgaagtatctagaagattgcttgttatgctgcagtctacagaactaaatattgatagtgttaagaagcagaactcattcctggtgcagcatgctgcaaagacggtccccatgcccttgcactgtctgcatatgcagctgacaaccgattattactttcgtgatggtatgatcaaggaatatttccatgatgccgctttgaaggaagaagaagataaagcaaagcgtgaggataggtcactataccactacgctatattttcagataacgtccttgcagcctcagtagttgtcagatcaactgtgacacatgccaaggaaccagagaagcacgtgttccacatcgtcactgatagacttaattttgcagctatgacgatgtggtttatacgtcatcctcctctacctgctactgtccatgtggaaaacattgacaacttcaagtggctcaattcatcatactgttcagtcctacgacaacttgagtcagctcggctcaaagagtactatttcaaagcacatgatccatcatcactctctgacggaaatgaaaatctgaagtacaggaaccccaaatatctgtctatgcttaaccatctaaggttctacatgccagaaatacacccnnnnnnnnnnnnnnnnnnnnnnnnnnnnnnnnnnnnnnnnnnnnn

SEQ ID NO: 62418 - DNA, 1075 bp, Oryza sativa
agcggctaggcgacaatttacaacaagcgacaagcggccgaggaggagcgcggcatgacaaactcagcggtggtggtggcgcggcttgaggtggtcgagaatggcggaaaatggtggccagaggcgatggatatggcggcgactttgggtacgcggggaagacggtgctcgggcggtggtttgcgggaaatggagtggtggtcgtggtgcggagtggcatggcgaagccggaggctctggtggtgcagcgcggtggcggcactagcggcagtagggcttgcccagaatacgacagcaggcggtggagctcggggttgcggcggggtaatgggttggggacgcggcgagctcgatagagaccggaaaacaagcaagagaagcatgggtatcatttatattgcctcgagaggacgagattgaggaggagtgggcgaggcgacgggcatgaagctccgatcttcgtggaggtcgtggtggtggtgcggtgcggttttattcacaaataatattttatttgctaataagtgattcggataagaatatgaataagcgaaacaatggggctctagataaggtgaccaagtagtcttttacctctttacaattctacctccattaaacatgtgatccctctttcactgaatgatattttaaattgaatcaatcaactattaggaggaacataggctttatttctgtctttaacatggtaccaaagtattatgattcctcatcacctaggctatatccagggattcacatttcttatggtgctaggtaaattccagaacatgaccggtcttagaaaaaaaaacatgacataacaatagtgactggaggagtagaaatgagttgttattgatgtccttttgtactattttaccgattgagacctcagtactttatatctacataagtaatcactactagataggtgtcggaatagctaaaaccggcacctttaagcgactataggtgccgattctataaaaaaaccaacaccaatactatagatgtcgtttttttaaaaaaaaccaacaactttaatttattataggttctagttaattaaaaa

SEQ ID NO: 62419 - DNA, 1175 bp, Oryza sativa
cccgccggcatcccgtccgggcctggagctttcaggtcaccaatggcatctagggcttctttaacttcttctcttgtaaactctgcccggagcgactcattcatggcccccgatactttcctatccaccacatccaggaggttctgcgagttttgacccccatttgaggtaaatagttgtttgaagaattcgattatcatcgctcttttgtcttcctccctttccacccaggaaccatcctctcttcttagcttgtttatcctatttcatcttctcccctcagaacagctggcgtgaaagaatgacgtgtttcgatcccccttattgagccaattggtatgagctctttgcttccaatagatatcaacctgttgctcaagcttttccaacctataacgaagcacttcctctcggacaacttggtccctgcttattggttgacgacggcaggtttccagctcctttttcactttcttcaatcgtttttccagatccccaagaacatttgagctccagctcgataggccagccgccacccccgccaaggatgcatggaccagtagtccctgaagaccagccgacacatcccatgcttctttcaccacttccttgaatttctcctcttctagccaggctgcctcgaaccgaaaatcattatggccatttcttcctcttacgcccttgttcttcccttccagctcgataataaccggcctgtgatcagagtgacgcgggtcgccgtttatcactcttgcagctggaaacattgctctccattcgggattggcgaccgccctatcaagccattccctgatatacccttcctgcgagtgactgtggtttctccaggtaaaagcatcaccctcaaatcccaagtcatctaggccacagtctgtcagagcgtgccggaactcatccatcgcagattgagccttcatccttccacattgtttctcatgggagaacaaaatctcattaaaatcccccgccatcaaccaaggagttgttgggttgtctatcagccctctcattgtggtccaggttctatgctttgtttcagaatgtgcatctccatacaaacctgtgaaacgccacattgtcccccagcatctcttacttctgtgtcgatgtgatatttggagaagctccgaactaccacatcaacccccctcctc

SEQ ID NO: 62420 - DNA, 7518 bp, Oryza sativa
acataactcacgtcgttgatcacttcctgagtgctcacacacttactggcctccacagcagccccctttttggatgaaacaatgatttctttggtcgatctgacctctcagctggaaagcccttcttcaaagggctagttacttcatcctcaccctgcgtgcctttctcctttcctttcgagccatctgtaatctccttttgccaggaaggagcgtcactacctttacaactgctggcacccgatttcctttgcacttggaatcgactgccgctagttttatcactgcttccaccctcccatatttttcgttcaggaatgaaacggaggcttttattaaacaaaggggcctccccctctgcgagctttttctcacacaacttctccgtatgacccacgatgccacagatataacagaagtcaggaagaaattcatacaccagcgggcaccatagcggcctttcatctgcacccacaaacaaggtcacgcctctcatgagaggtttcctgatatctatccggatcttgatgcgaaggaattggcccacagctgatccatcctcctctaaatccatcgtcatgaattctccaacctccctgccgatcgccatacccgtctccttggtcatcagtcctagaggtaatttcatggcccttacccagatcgggacaaaggcgaagatcatatcctctatcagcttggtctcatcaagatctatcatcaccactagatctttgttaaacatccaagggccatcctcaagtgcacgcctcttccccgatgcctgatgaaacgtgaagagaaaatgattttctcccagatccttgcagctgactcccttgatcgggcaccaaatcttccccagggcatgtgccagtccatctgcattcaccaatttctctgccaacacctttccgattcaccctgaagctagctgttggtgccaccgcggatctagtgaattcaaatgacgtcttaatttggtgaattccactcatggatttgtttgccatcgcacggatctagtggccatctcatggatctagggaccatgttggtgtcaatgtttcatactgacaataataggtggtgtctagattcagaggtgtaaagttttggcctgttacgtcggatattatataggatgtcgcatggggtgtttgggcactaataaaaaaactaattacaaaatccgtcagtaaaccgcgagactaatttattaagcctaattaatactatgttattagcaaatgtttactgtggcaccacattatcaaatcatagagtaattaggcttaaaagattcgtctcgcaaattagtcgtaatctgtgtaattatatttcatgcaggtgtttaaacgttcgatgtgacagggtgtaaaatttctatgtggaactaaacagggctatagtaggggctatatacaagataggtttagctcctactccctccgtcccaaaataagtgcagttttgcactattcacgttcaacatttgaccgttcgttttatttgaaatttttttatgattagtatttttattgctattagatgataaaacatgaatagtactttatgtgtgactaaatatttttaaatttttcacaattttttcaaataagacggacggtcaaacgttgggcacggatatccacggctgcacttattttgggacggaggtagtacgttaagaaataatacattacccatgtattgatggattatatattctactgaatatattgatgatatgctgttggttgcgatcttgtgtggtcagttgttctaccttgcccattttatatgggttggagatagagttatcaggtaaggtaacctaaacctagctgaatattattttagtttgtaatctagataacatagtattcggtcagagctctatacactatcttggtttacagcctaatatgataaccaagttctactctatctcatattatatagatatgatcccctcctatttttagtcggataagcaaactgtgtgaccattgatatatgttacctatactcttcacaatcggcctcctccggtgagatgcatccatgatgacgataaatctagcgcgcaacgtctgttgatggcggcaacaaattccttatggctggaccataaacatatgggcaacctttaacttgaggttttatgtgtagttcctgtaacgtatatggattatagccaactataaggttcataataagattaagttatgagctttcttgttgcaccctaaatagaaagcccctagaagggcagttaatacttttgtaatcttcacattgtgaattgtctacattatatttggggtgtcattattaatccgtttgaccatgaatttttatttttgcattaatcttcagtgaccgcccgtcatgtcgccattgtctcagccaatggagaggggagggggagggggaggggaggataaggagaggagaggagggcccactcgcccccctgtgctaaaaaacggaacccgactccttgctcaactcaccgacatttataatataccaaatgtgtcaaggttacgggtaaggtataccctctacccttcgatatacgtcacatatcgatatggtatacttgcgcgtatacagacgttttcggcataagttgaggaaatccattatggagtccacagatgtaaggagtcctactcgaatagaactgggtcgtcattgtatcgtgtcgggtctgatgtctccgagtcctacttggagaccagttgacctgcggtataaaagggaccccccccgggatgacccgaggcatcgaatcttaccgccaacacatccaccatagcctacgaagccggagcctacaggagccaagtcgccgggtgatctagtcggatcaactcgactacgatctcgtcggtaccgttgagttccactattccctttgtaatctgtgttttcctccatataatcccatatcaactggattagggctattacctatcaaggggcctgaaccaatataatctttgttttctgcctgcttgatgtcgtattacgtagatcctcgtaccagcgtaccccaataccctctatatctggtctacgggtatcccccgtcgacagtggcgcgccaggtagaggggcttggtgcttaaggttctactactatgacatccagcttcgccgacaacaacgtcaacactaacctcaaccaaggagtttctgcttcaacaatgttggtgtggactcaagtcgacgaaatcgtcttcccggtttacaccacggtgccgatctcagccgatctgtcaatggccgaaaacgagaacgcagtggctacaacccagggcgattccatgtcgaaggatcctcccgccgaagaggagatcggagcgtcgacgacatccgagcccgagaaggatcctagtgcagccaagccttgtctctccgacaagaatcacgagccgacgaggatgaattccaaggtgacaaggtcctagtgtcctatccacaaaaccagaaaacacacattgcaactctgctgggtttttctcaacgtccacgctgaaattcgtgcctgcaaagagcgtggaattcagcgtacttctccaacacgtgatgtctattgtcctgcaaagaatcacgacctctcgagctgcaaggtctttctcagcgccatgaagacgccacctcctaaggtccagcagtcacgcgtccccctcagggatgaggacaaggaacaaggagcgacgctgatttcagatcgatttgttggggtaatcgacatcgatccccacgaaccatcagtcttgcacctgctcgaagactatggttcatcgacaatgagtacgtcgcacaaggtattggctatcgacgatgtcggcacgtcagcgcgcgccaatgcggaagcggagaatcaagtgactacaccggcccagcacatcagagccgtcaacgcaatacagagggaaaccccctacgatcccgttctgaatgacgatctcgcacgatggacagagcggttacgggaatcagtgaccaacctcagcaacgcgttcgaagaggccgctgttgcagcacacccggaatagccaccaactggcgatgctaatggtgaaaatcctgaacaccgggaatcgcctcattgagccacccctccaccgcgcggcacttgcgatctccacgatcacctgaatggccgccgagaggagcgacgtacacgagacaacgagaaccgttccgacatcgcgtctcttcacggcgtcacgataacgaagaacgaggaggccgttcgagcgaagaccgagaccgtgataaccgccacaaccgccacgatcacgacgatcgcgaatggcgggtgctgggcgatactggttgaggacgtcgccataatgacgacgacgatggagatcggcgccgagacaacaacgggagacgacgacaagattctcgagaacccggccgacgtcctcgtaatcgtacgccggaaccaagcgacccatcctcatcgtcgtcatcttcctcatcctcatcatcagatagacatccacgaaggacgtacgatcgccgacaacccaccggccctagcgctgggtgtagagctttcggtcgttcacttcgagatgtccgatggcctgaaagattccgaccaggagcaatagagaaatacgatgggagtaccgacccagaagaattccttcaggtttactccacagtattctacgctgctggagtggacaacaacgcattggcgaattacttgccaaccacattgaaaggctctgcgcgttcatggctgatacatctcgccccctactcgatttcttcatgggcagacctgtggcagcagttcgtcgccaacttccaaggaacgtataagtgccacgcgatcgatgacgacctacaggcgttgacacagaacccagatgaatccttgagggattatgttcggcgctttaatgagtgcaggaatacaatccccgagatcaccgactcttctgtaatccgcaccttcaagtctggtgtcagagattgctatactacccaggagttggcaacgaggtgcatcacgactactcggagattattcgaaattgtcaatcgatgcgctcatgcggacgacgcactgagacgcaagaacgacaaaccgaagactggaggagagaagaaaccagtcaaggatgcaccggagtcgagcaagaagaaaaatcgcaagagtgggaaaagcaaaactcaagcggatgttctcgcaacagaatacgcggaccctcccaagcgcccagacccacaatgcagcgacacgaagaaaacatggtgccctatacacaagtcagacaggcactctctagaagattgcctcgtcttcaaaaagtcgctcgcaaaacacatagcattacaaaaaggcaagcgagtatgtgtggtcgagaaggacgctgaggcggctattcaggaatcggactcagcatacccagactctgatctccatgtctcgcacatcttcggaggttccacggcatactcctcaaagcgagaatacaagaaggtggaacgtgaagtctgttcgatgtggcagggggctgcacccaagatgaagtagtccgagcagaagatagaattctcagaagaggaccaccccaagactgcagtcatcccagggcgatatccgatcgtggtcgaacctactattcggaatatcaaagttgcacgagttctgatcgacggcggcagctcaatcaaccttctcttcgccagcaccttggacgcgatggggatcccacgaagcgagttaacacccaccgatcaacccttccatggaatcacccctcagtcatcgtccaaaccattgggcaaaattacgttgcttgtgactttcggccaagcaaacaacttccgaatggaacagatcacctttgatgtcgctgaattcgatacagcatataatgccatcattgggagaactgcactcgcgaagttcatggccgcatctcactacgcgtatcaagtactcaagatgcgggaccgaagggaacaatcactattcaagggaatactaagctggcagtgcaatgcgacaagcggagcctcgacatggtcgagcacacgcccagcccacctgccacagctgagccacccaagaaagtgagcaaaacaaacaagacgctgaaaccagacggtgcaatcaagatagttccactctctagtgccaacaccgacaagaccgtcaagatcggggcatcactaggcgagaaataggaactcgcgctcatcaccttcctctggacaatgctgacgtgttcgcctggtaaccgtccgacatgccgggggtacccagggaggtgattgagcacaaactcatggtgcgacccgttgcaaaaaactgtggagatttgcaccaaatcgaaaacaagccatacgagaagaactcgataagcttctcaaatccggtttcatcagagaggtactccatccagagtggctagccaacccagtcatggtgtggaaggccaacgggaaatggagaatgtgcgtcgatttcaccgacctcaacaaggcgtgtcccaaggatcacttccctcttcctcgaatagaccaactggttgactcaacagccggttgtgagttgttgagctttctcgacgcttactccggctaccaccaaatcagcatggcgaaagaggacgaggagaagacagctttaatcacgccgttcggggtattctgctacgttaagatgccgttcggactaataaccgcaggaaacactttccagcgcacggtccaaggtgcacttagcgaccaactcggaaaacaatgttgaggcctatgtcgatgacattgttgtcaagaccaagacaagcgactcattgattgacgatctgcgggaaacgttcgacaacctccggcgatatcgcctcatgctcaatccagagaagtgcacgttcggagtatcatcgggcaagctgctcggtttcctcgtctctggcagaggaatagaagcgaatcccaataagatcaaggcaatcgagaatatgaagtcacctacaagactcaaggaagtacagaagtggcgacactaagtaggttcgtcgctaggatgggagagcaaggacaacctttcttcgctctgctgaaaaagcaagacaaatttgtatggacacaggaagccgaagaggcattcattgcactcaagcgctacctatcaaatccacctgtacttgttgccccgcaacctaatgaagaattatttctctatattgccgccacgccatattccgttagcactgtcattgttgttgagagagagaaagtacaacgaccagtctactacgtcagcgaagctctccacgatgcaaagacaagatatccacagatccaaaaactgctctacgcggtaatcatgacatcatgaaagctacgccactacttcgaagcccacagggtcacagttgtatcctctttccctctcggtgaagtagtgagaaacaaagacgttgtcggccgcatcgcgaaatgggtagtcgagctaagccaatttga

SEQ ID NO: 62421 - DNA, 1002 bp, Oryza sativa
caagtcccaggtacttgccgactttgtagccgattggactatgcctgataacaggtcagacaaccaagtcgacaacgaaacgtggacaatggcgttcgacggcgcactcaacaaccaaggagcaggggcaggattcatcttgacatcaccttcgggagatcaattcaagcatgcaattcacctcaacttcagggcgaccaataacacagccgagtacgaaggactgctcgccgggataaaagccgcagctgcactcggagttaggcgactaattgtgaaaggggattccgaactagtcgcgaaccaggtgcataaagattacaagtgctctagccccgagttatccaagtatctcgcagaagtcaggaagttggaaaaaatgttcaatgggatcgaggtccgacatgtataccgcaaaggcaacatcgaaccggatgatctagtacggcgtgcatccagacgagagccacttgaaccgggcacctttctggacgtcctgaccaggccatcagtgaaagaggcaagtggcgaagatagcccggtcgcccctaacatcagctagggggctacagaggcagagcgcgccgttgccgacatcgagacctcagagttgcccgaaccaatataatctttgttttctgcctgcttgatgtcgtattacgtagatcctcgtaccagcgtaccccaataccctctatatccggtctacagttgcttaaagttgtagtttttgtgttttcagtccgtgtggggatgggaaattaaagatctataggtgtcttgatttagcactttcggtactaagtaccgacatctatttatctttctgtagtagtgtcatactgctgactcgatattattgtttttggtgggtctagacaaactgaaacattttcatgtctttctcaagcatgaggtcactagacacagcagttttacattaatttcacataaaccagttcttcattttccacgaaacccagcaaatcacccattttcctg

SEQ ID NO: 62422 - DNA, 2939 bp, Oryza sativa
atatagagcatttaatggaattggactgtattataacatattgttaatgtggctgattcatgaatgatctgaaccttcaactcttgtgacctactaaccagattgtctacttgactctaaatacttcagaggattgcatgatattggcatatctatatgttaggttggatttattttctgctactttgatgtaatggggattggcatctatcttggcattgtccaattagtatgtagccaccgagctatcttaactagaacaacaataggtctcgtcagtcttactgccacatagtactgtaggacttgctagccatactattatacgtccaacttgattccaataactcaaagtcatgcttaagtcgagctttttcttgaagaaattacagagctgtccttttgccctgccaattgtcaaatgccaataactcaggtgtgttgattcctttgcagaacatgttaaattgagcttaaatgaggctaaagtagaaaaaaaaactatatttacatctcttaagaaataacttcctacggaatcttcttgtatcaaataatgctattaatttcacagttttgtattgcctaatcagagttaattatcctttttttttctgcaactgtttttgacatttcatttattaaagagaagcaccttctccatgtttctaatgccatttttggtttgtattgtgattatctattttcttgacttacaatgtcatgattcatagcatgttgatctttaaccattacaaattcctattgattgtaccttttcgttttcaatatatttagctatgcctatgtgacttgtgtattgtcattaatgggctgaatgtacagcagaataacgccttgagcttcaatcacgggatgatatttagtttgtctgcttcccttggaatagttgtaattttggtagttataactattttcaaaagagggaagcaagcaaatgaactgtgtcagcatgagaaactcctccagacaccgagtgttaagataagtcgaaaatggtcaaagagagccctgcttcttggtgtcttagttgggctttgtagttctgtctggatattttcaagcatgcatgctgatgttgttgctagaagaattgagaatcttgaaaatatgtgtgatgagagagctaggatgctacaagatcagttcaatgtaagcatgaaccatgtgcatgcattggctattttagtctcaacttttcaccatgggaagaatccttctgctattgatcaggtttgctttctttggatacatctttcttaattgcaagggtgattcaacaaacttttaatattattaaaatttttttgataatttaataatttaatcaggtttctaaaaatgcattgtaaaagaaattagctgtgaaagttgtattttgaaggccgtgtgatcaaaatggtatgtttttgtgactgactggaaggagtataaaatctgattagccattagcaatttgtttgtccaaagaaaaatgtttagaataggtgtctccattcaaaactgcttataccatgataagtcactgggaaaaaaacatcattatagctgaaacaggaggccaggaggggatgcacagtttttcaaagatttatgttatttaaaagaaaacatcttgttattttctatcctattaatactgtgcattttttcaagattatgagatcttgttatcattgacatttgacagaaaacatttgaggatttcacggctaggacaacatttgaaaggccattgatgagtggtgttgcctatgctttgaaggtgctgcacagcgaaagggagttgtttgagcaaaagcttggatggaagattaagaaaatggagaccgaagatcaatcccttgttcatgactacaatcctgaaaagcttcagccttcaccagttcaagatgagtatgcacctgttattttctcccaggaaactgtaaagcacattatatcagttgacatgatgtctgggaaggtgagctactatatctgcaagcccttgtgtatatatatttatttatttctgaataggataaacttatttaacttctgattagaccttcattttttttttcaaattgtgaaatgagtaattcagaatctaataacgtcttactttaaaaggatgggtgcatgaggtattattctttacatggcagttccatatcccaaattagaaatccgactcacagaggagtccctattctagtataactacaaactatatgtagtctcagacagacagcagtcccataacttcccctttatcattttgatttgctccatggcactagcctgccttggcccttcaacctagtcttgctacacagactctaaccactttgtcctgtatgagccatatacaacactgagcacaagcgaagcccatcccattggacatggaatctgctgttgctgtgttgcaatgttgctgctgaggcatattgccaatctttgtgtggactctgaggaggccttcatgctgaaccggatggtgacatggatgagcgaactcactatcgaatgtaagtgagacacaaacatagtggctgtccacagtggcagcgataggaaggaagaagctggcatggagagtgagggaggcagtagcgagtgccaaactctgcgagagatgagggtcatgaacaagaggcagcgaagtacaagcaaaggccgcgtaaaaggtttgattagttatgttggatccatctcagtccaaacaaaatctgtagaagtggtttgatctgagttggttcagcatgattagccgtcttgcagcagactgtgaacagctctggaccctggcagaccatgtatacaaacctaaagaacatgtttgagttttattactaactttattttagacaagggaagtgtaaactcctggcctttgcatcagctagggatgcacacaaccattacattat

SEQ ID NO: 62423 - DNA, 2014 bp, Oryza sativa
tgcagccctgacactatgatcttgatttcaggaagatcgtgataatatattgcgctcacgggcaacaggcaaaggggccctaacagcccctttcccacttcttaaatctaatcaccttggtgtggtgctaacgttcactgtgtataagtatgatcttcctccagatgcaactccagaggagcgtattgaagctacgctggggtaatatctgtttcctaataaatgtcaagttgaactacacacttatatttatttctttttaagtttgagagagttttctatcaaaagaactttgagagaattgaccatagatttgttgttaacacttgacagttatcttggtgcctcatttgatgttccgtctctggtggagagactcctggagcaacttgctagcaaacaaaagatagttgttaggctgtatgacatcacaaatcatacttatcctactaaaatgtatgattcggatgttattgcatctgatgatctgcatattagtaatattgatttcggggacccgacacgcaaacacgtaatgcattgcaggtacttctttcattgtgcttgggattatacttttgtacttgaaaataagctcactcaatccattttcatattttttatgtcagattcaagcatgcaccttcactgccatggtctgcaattatgatatcttcagcagtagctataattgttttgcttgttggctatattatctatgctactctgaattctcttgaagaggcagaagataattatacgacaatgagagatttaaaaggacgagctgaagctgcagatgttgctaagtcccaggtccttctatctctagcagtgttcttatcttttgctatgtttctttagtctcctccatgattgctttccttcttctccttatccgctaagtagatctttgtttaccttgcagtttctagcaactgtttcacatgagattagaactccaatgaatggtgtactaggtttgtcctttatactttgtttttaattattcttttctatcacattgataccttctgtattatcgtcagaagacaatgctaaatgagttatgagagtggatttctacctgaaccaggtatgctacagatgctcatggatacggaacttgatacaactcagcgggattttgtagttacagctcaagaaagtggaaagtcattgataaacttaataaatgaagtacttgatctcgctaagatagaatcaggcaaaattgagctggaggcggtgcgatttgatgtccgtgatattcttgacaatgtggtatctttgttttctgaaaaatcatgggctaagggcatagaggtgagtcgtaatctatacccattggactctaagcttttcattcaacgggatgttaggacctgaaatatgttgtttttgcgagggtagttggctgtacttgtatctgatcaagttccagatgttctgatcggggacccgtggcggtttcggcaaatcattacaaatcttgtagggaattctatgaaggtcagttttaaatctagattggctaccataattcctctgatcttcaatttattgttatactctggagaacattgttgttgtgggttccttattctgtcatttgcatacatctatatgctgtgatgctttcatataacagcagtagccagtaggagaaagtatgatccagtactcgctgttttgatatttatacaagtgaaagctcaaactggatttccttatgtagattacaaacatggcagttgctttggttagaacaaaaaagtagagttctgtctattatgcaataatctttcactgatataatcttttccaaatatggcttcctgtaaatacagtttactgaacaaggtcatatcttcattcgagtgcatttaattgaggaagtgaagagaaaaatggaagctctggatgacacttctcctgaaaacatagaagttacagcgaattccaaaaatacgatgccatataatactctaagtgggcttgaagtagcaaataa

SEQ ID NO: 62424 - DNA, 1384 bp, Oryza sativa
atttctttttcgggtattaacgacatcataaatgttggataaatatttgttaacttgagttttattgtgaagccatcataaatatgctgttatgctttcaatattcataaaactattattatgtattattttctgacactgttgcattttatgtgttcaagtgtaaaaagcagtctaaatatggtgcttgttgacaaagaagcttggggcgaggactcaggcttggcatttttccggtgtcttatagatcttcggctgaagggcacactcaagtcttggcaaaccatgccaaagttctttcttttggcaggttcaataactcctgctgactctgattgtttgaggttggcggggtattctaatagcataagaaaaccccttcgtcttagtactgttgctgcttgtcttagtaaagcactaggggttggacttacaggccgacgaagtagagataattctttggttcttcgaagtgtactaacaggaaaaaacattttagttgtggacgacaatgctgttaatcgcatagttgcagctggtgctttgaagaaatatggagctatagttacctgtgtggacagtggaaaggaggcaatttctaggctccagccacctcataaatttgatgcttgttttatggatgttcagatgcctgagatggatgggtaatcttccttcccatttgttaaaattcatctaatgatgccttctaaagacattattttgtgttacgtgcttcactgtgttataagatgaattagtaacatatccttattgcttaaatatctcttgtagtttcttcaaatggtttcatattgaaataggtcgcctttttttctttcacaattgcagtcttgagctagaattctttttttttattattgtgtccattgtaatgaacgacttcataagtctatatatggattgttatgaactttgaaataaccagaaaacttactacatgtagaacatcgtacattctttataacaagtgtcttctgcaattggatcaactgaactgcttcctttttttttttttgcaggtttgaagctactagattagttcgttctgtagaaagtaaaatcaatgatacgatccaggcaggtgaagtgtcttccgagatctatggaaataaggcccattggcatgtacctatattagccatgacagcggatgtaattcaagcaacttttgagggatgtatggaatgtggaatggatggatatgtggcaaagccatttgaagaacagcaactttactctgcagttgctcatttcctagaggctgatgcaacagatccattgacctaggagatttagtttgctagtggccacagtgattcagggttctctgatgcagcatctgctaaaaacccatttggag

SEQ ID NO: 62425 - DNA, 1875 bp, Oryza sativa
aggtaggtaggaaaaatgaatggtggatggttgtgattggttgggaagagaatgttagtggagaagttgttatattttgggacaaattctaatggctaaaagttattatattttgggacggagggagtaataacctgacttttagttctttttcttgctggttaatacacataattattttcaatattcatttgatcattaagatgcttcatctgaaattcctgcttctcaaatatatatgatagctctcagggaggtctaacatcaaatttagaacatcccacaagtttttggcatctgaaaatggatgatagaaatattttggctattggatattatacttgttttgctttcttttgaataattggatgctatgacccttcttgtagaatacttggccctggattccggaaccattaagttcagcctacgctagcaatcaaaattttgtttcatctgttaattgttatcttgtttcgtctgttaattgttattccctccgatcaaaattatctgtcgtttccaacagcaaaacagaactactagcaggacatttctactgtctgaaacgacgagtatttccgatcggagggagtgtcttgtttcatctcttaattgttatcttgtgtgtgttctacagacaattggatgaaatctatttcaacatcacgccttcagccatgtgcttaaggggaaactttgaccatttttacccagtggaaatcaatgagggacatacattgaactgacatagcctccttcatgctgttccagtgtagtggctgacaagatgacatcaatggcgttcttgttgtacagctaatatagattatgagaaggctaatgctcctgtttattctgtattcttgagtgtacatatgaaatggcaagaaaatagtgagagttggaggatttgtctggtggcttgaagaatgtaaataggaatgttcatatccatcttttctgaggtctggttatgtggggtgtaagttgtacatatgttctcttgtagaaatgtaattgattattagattacggcaatgttccaaaaaaagtatatatattatgcttccaaatccttgcttgttgagtgccctgtaattttcatttcaaatagaacaaaatgcaaattgtccggaagatccaaattgtacacttcttttattgaacatttgggagcatatgttggcaatggctgtggaatatgtttatatatctttgaaccttttcagagagaattttgaaaatctgtggtctagtgaagcaaaactcaagcttgtagttttgttatgaaattggtacatcaaaatcacatctagggttctctttgtaaatttaagggattttggacagataaagtgtcccatccatccaaagtcccactttaggagggagggagtatattgttctaccatgcaaacaagatgtcgatggcatggccaaaagctttattatttttagaaaaaaaagtccagaactctaaattacaccaaaacattggagaccctccctaaacagcacactctagaacgaagaataaataaataaattgcttaaagcctactccatcctaaaatacaacaacctacgactactatctatattcgtagtactatgatatattctctctagtcgttattatattttagaatggaggtaatataagaaaatttatttgtgcacttatcctcatcaagttttagaaaagaaagcgaagtgagagtagctcgagtggttacgttctttgtattagaaccaacccacccggattcaaatacattcaacacgggcagggccggccctgacagggggcgagcagtgcagccgcactgggccccccagatcgtaggggccccaccccaccccccgcgtagc

SEQ ID NO: 62426 - DNA, 2225 bp, Oryza sativa
atgcataaatgtccaaaatttttaaggtaacaactagcaactgacaactcatgtatatactgattattatttagatattatactaagggccctatctctagtttcgcactggcccctgaaaactcaggaccggccctaaacacgggtgctcgcatttacgactaattattctttcaatggtagacgacgtacccgttgacaacgagacgcccgtgaatagtcttctggaggtgctcatatgggtagggaggcgcccacggatagtcttctagaggtgctcgtatgggtagggaggtgcccacggatagtcttctagaggtactcataggataggaggcacctgtagggtttgaaatttcgattcgaaatttctaaaattttggtaatttcgcccccctaccggcatactcaaatctcacccgaaatttttggttttttgtaattttttatgaatttggtcaaattttattcaaattcattcaaattcagtcaaattttcaaataatttcggccagaaatttacgaaattaccgaaatttccagtaatttcggtcccccgacataaaatccaatttcgaaattaaaaaccctgaacacctgtggtgacttcatcgatatcaagatatgcctcttagaaaagttttagaaaagaaaaatacggcaaagtgctcacccatttacaagggaaaagaaggcctacaaatccaaccatcgtcatccataggtatgacccattcttggttcgatttgctatccatctcctgtgtgatttttttatggcatttgacattttttttggccgctatgcaccacttgcgatgtgagcggcagctcacggcctgtgtcacccagcaatatggctaatgctgctcggcgagcgacaccgtccctctcgtcgtcgtgaaatataaaattacgatcctatataactaaaattacatttgtaaatttagttaatatgacatgtaagcgcactgtaattttgataaaaataatgtgtaagtaaatatgtatttgttattttctttaaaatataaaaatacagtcctatataactaaaattatatttgtaatttcagttgatatgacatataagtccactgtaattttggtataagtaaatatgtatttgttattttctttaaaatataaaattacagtcttatataactaaaattacatttgtaaattcagttgatatgacatgtaagtgcactgtaattttgataaaaataatatgtaaataaatatacatttttttattttcttttgtagttcgttggatgtaaatctaaagatagaaaaaatctaggtgattttttttagaaatcacacgacaaatggatagagttagcaaattcgttgtgcgtaataaaaaaaaatcggaagcaaattatcgatgggccgcacgaagccacgtacacaattgcgtgacggaacccaatagaaaaaaagtacactgaaggtccctcaaccctcaacttgtcatcgggataaaaaacgtccttgaaccgcaaaaccagggtcccttagctatagaaaaccggtcacaataggtccctcggcggttttgatcccggttttgtcctacatggctgctgagtcagcgtgggacccatgtggaccccacatgtcaggatgccacgtcgacacctttctatttcccctcttctctcccttctctctcacttctctgcttctttgcgcaggctagccgacgggaggggaggaggccggtggggcgcgcccaccgtgcgctccgcgaggtgggtcgcagcggcggcggcgtcgtcgtcgccggccgcgccatctccgtccagttcgccacgtaccgctggcgcagacccgtcctctggcgccgcggcggcggcggggaggcgggtgtacgtgaccaacgttgcaccgggcgcgagcgcggagcggctgcgtgccttcttcgcggggttcggggagctcgagggcggcccgttcggcttcgacgctgagacaggattctcccgcgggggcgcgctcttcgtgtaccgcgcggcggagggcgccagctcgccgcctaccccgcctggaagagcaaaccacgcatgccgccgccgctgcgtggaatcacattggtaaacagattaccacccaattctaaagcaatcaagttgggaatgtttgctataccagaaggaattgatcctaagaactgatttaatcccatgtgtatcagtgtatgtactgccgtt

SEQ ID NO: 62427 - DNA, 2778 bp, Oryza sativa
ggatatgcccataaaagaagttgccgcccaattggaacttttggagatctggtagagagttaccgatattggatggtagctctccgcttagatgattggaagcaagggtaagttaaacaagagtagaaagattcaggatagcttgtggaaactgacctgccaattatttttgcacccagatgcaagtatactaaaccaggcaactttgcaaaatcatttggtatgctgccatcgatgttattatacagacaactaaaccttttcagcgttgtaattttggcaacagaaacagggatgggtccagtaagactgttaactgaaagttgcaagctttgaaagcgttgaggcaaatctgcagggatttgtcctaccagattgtttccattcagccatagcaccttgaggttggaacagtttgcaagattaggcatccttctttgcaatgtgttattgctcaagtatatgatttgcaggtgatgcatattaccaaaggattgagggatctctccggtgaatgaatttgcaggtacaaagagaaatttgaggaatgttaggtttccaagaggagacatctgcccaattaatcctctatttgtgaggtttagcgccggcagcggtgacgccacggcagcggcggccgcgcgcgtggtttgctcttccggcggagtcggcgtcgagctggcgccctccgccgcgcggtacacaaagagcgcgcacccgcgggagacgcgtcgaagctgaacggccgccctcgagctccccgaacccggcgaagaaggcgcgcagccgctccgcgctcgcgcccggtgcgacgttggtgacgtacaccgcctccccgccgccgacgccgccgccgcggcgccagaggacaggtctgcgccagcggtggcgaactgggcggagacggcgcggccggcgacgacgacgccgccgccgcggcccacctcgtggagcgtgcggcgggcgcgccccaccgacctcctcccctccggtcggcttgcctgcacagagaaagagaagcagagaagggagaggaggagaggggaaatagaaaggtgttgacgtggcatcctgatatgtggggtccacgctgactcagcagccacgtatgataaaaccggaattaaaaccgccgagggacctattgtgaccagttttatatagttaagggacccgcggtatctggttttgcggttcgaggaagcttttgtatcatgatgacaagttgagggaccttcggtgtactttttccaacccaatatgtcgtggtgggctggtgatggctgcgtctccatagccctgcaaagttctttggcccattggcaacctgttagtatttgtgtttggcccattttgttttactccaacttggtgtataataattcgatttcatatatgtaaaaaccttgtcacttgcaaaattatactatgatagatcatatttagactaaattacagttcgagctaattttacattggtcgaccacagttctctcttcttctttttttcactttgtaccagataattttgtctttgatctttgtttataatttggataactctagaccactttttttgagcacatcaacaaacacgagtacattgactctatatgccgatgaactccatcacccgtgggcaaatcatatctctctttggcggacgcatggttagacatgattagcaagagaattggtgtggtccaaagtgtgaaaagaaattaaatttaactggtccaaaacaaaagaagatcagtcaatagatggcacaaattaaactgcggcaattcagtccgattgaattgacttatttccatcacgttacactaggcaaagcatatacactagctgtgcccaacttatttattcatttaggttactacagcactggtgattgacatggagctatagctggatcgttcaaccaatcatggtgccgccgcgccaatgccgcagcccctccgctcggcggtgagcatgtgcggcgcctcgtcgatggccagccactgatccaccgcccaccggtgcgtcatcgacgggagtctcccctgcccgagctgcgtcaccatcacgtagctcacgtaccacccgggcttgttcccagagccgtcggaggtgagcaccatgttgcagggctccgacggcatgcagtcgccggcgcccctgaaccggtcgaggttccccttctcgaagtagtcgtggccggcggccatctggccccacgactccaggttggcgaccgtcagcgtcgggcccctggcggcgcgcacctgcagcgagacgcgggcgtcggtgccggcgttcctccggccgtcggtcttgacgacgatctcgaacgtgcatcgtgtggtggcggcggtggccgcggcggcgaggaagaggatgaggtagctggcgagggcgagggaaagcttgttcatggtaagcttcatgttatttgttattggatgtggtatatgtgatgaattggggagtgagtttggtgtggtattgcatgcctccacaatgtaccgttttataggaggcagaggaggggtaagggcaattgcactagccaatgttttgattaataataattctgtgacttgtgggatgcgctactgtgagctctgactgggtgtgtatattttacgagggatatgtggaaattaaaatggtctgtgccacgcgccttatcttctcgtaaaattagatcggtggccgccattctcaattgactaaacgcaccgacacacatgtgtacccatcccctctctcccctcggtcttcgttcgtggc

SEQ ID NO: 62428 - DNA, 18401 bp, Oryza sativa
agcaagacttatctcttatatgtgtttcccttttctaaatgcatgtaaatgtttataaaaattatatttggactgttcttatcctggggtgatgttgatatgttagaattacagtttaccttacacatgtcataagcttcttacctatttatgtataagtttaatctagtattaaattaagagaatgcttatagagatgattcagataaaatttaccctatatgagttaatttatttgttcacttccatgttcatgacttgtcttgagatggatggcctaattagttttatggggctagacattggcgttattgatatattttaaggtgtattatggttcctatgtattattttccaatagttagcactaggccctaatggtttaatggtttagttgattgtctagattttagttattattcatgagacctattatgaaatgcaaatcgaaaatccaaatgcatatgaaggactcaagtcaaaacatgtcctatgagagtatgcatgcttacaaataagtttacatttttgtcctaggttataaatgaaaaagttttgatttgccctcaaattttattcatgcaagagttagatcaatttcacctaagttttaaatgaaaatttttggttcacaaaattggagaactttcctttcatttgacgaaaatttcttcatcctaaaatttgggtatgttacaggtctcctcttgccacaaatcccttctccaagacctcaaatatgagcagcacagtgaagttagtgatatgccctagaggcaatcatagagatgattgtatcacatactatgtttacatatttatccgacattgtttcttgaaatagataactccttattggttaatgaatatgtgattctttcatgagactctttatgttgtttgttactatttctaaaggatccctgatcgaatatcatatatggaacaaatatgtttatatgatcagcacatgtattaattgatgatcatgtctcatggatcatggtatagagattccaaattaataatgtggacacatgttggtgaacatgttgttggatagacccaacatgagacactgcaagagccatatgtgttgtgtcatcagtgatctcatttagtgttggtgttgaatccttagacctgagattatcatggttctcaacatatgtagtagcttacttagggacttctaaacgctactccgtaaatgggtagctataaaactagttttcgggtatgctatgaaacatgtagtgagatatgaataatcaagatgggatttgcccctcctatggagagatatctctgggcccctcgatgttgtagattatggaagtgcatggccatgccaaaggtaattgaggagtcaatcacaagttatataatctatcaacaggttcgagtgaatgattgagctattagaggatggcacatatctagccttgagtttaatcgatatcatgaggcaaaggggttcatacaagtatacactagaggttcagccgatatgatctttatgtatgcccggtgggtcaatatgttctgctaggggccgctgttgacgcgtggaccgaaaaggagttttcgggttacagccgagtatatatgaacctatagggtcgcacgcttaatgggccggaataaggggattggatggagatccaatatgagcttacttcggatagggatccgaataggagtcctacgggccttggaggcccgagtgatggatcctatatattcatgaggggtgtgaccggcggaggcattgcatgacgtgagaaaccctagccgtcactttcctccccgagcaaaaccctagccgcgcgcgggtgctagcatatctgctcgtggcgttccgtccctgtacgtgtggataccggtagaggcgccgctggtttgcggtgctgatcggcgtgggattacggcgaggagaacgcatgaggaggagaaggtcgagttggtgcgatcgactacttcctctacatcgacgcgcgctacttcgcgagagttccttcgacttctcagcgtcttcttccgctgcacagcgcatcgagtggtaacgatctatgatctaatacttgcatggttcctggtttacgcgatagaaaattttgatttatgctatcgtagcctacgcgtatcccaacaggtggcatggccagtggttgccgacggctgtagttgagtggaggagggcccagacagggttgagtgtggctacaacgttgtggatggaggagtcaaggaggacttcaggtgggaggtgtcggtgctggaggaggtgctatcatctgcggtgcccataagagcacggcgggacctctagattgcggcggcactacaggtggtgcagcgacgatgtcagcgagtagtggtgctgggcgtggctatgcaagggcatagccatggacgccgcgacaacaataaggagggtgttgccgtcatcgatgcggacattgcctccaccttccctcaaccagtcctccccactccaatgctgcaataggcatctatcctctttggtgccatcactgccatcatccactctccaactggtggttctccggccctcccaagcactaccgctgcaaaacagcgaccccaggccaccacttcggcactccactcgtggtcctcgcaagaccgagttgtaggccaaaccaagaatcccagccattttcgtcgttgactggactggatggacaataacctcttcgaggcaaacttagtccttctgcatccacattgcattgaaggctcctcctcttttaccttttcacatccttctgcctcctggtgttgtttgtaagtcgtgaccacaatgcgtgatgcatgcatggaaggtgctcgatgaaatgcttcctcaatggaaggatgcatggtggtcacaactaggagatcagtgtttgtggagggcaatgccgtaggacagtgcaaatggcggcacaaggcccatggttagtgcctcctcccacttggcttgtaattcgtattgcaggcaatccattgagctggccatgtacatctcagctttgccggttgcaattggtattgatatctagatttttttagtgtttcataatcatctagctcgctagagttgttctggtaggcaagtttcctgaatcttgagaggaacaattttatacttatatatactgaacttcaggtaatatctccaccaggtccgcctatataagtatacctttttcttgcctaaaatgtagctttctttcttacatatttgtacctagctatgttcatcttcattctctaaccaatgcaattcagcatatgcaaacacactgcaggttaaaaagtagtatttggagagacaaaggcaattcagtttgcacaggcacaatgcaggtgaaatgcagtcacaatcatattacatggtgggatgtttgtgaatgtcctattgggcttcctctattgaatatcaacgataacttttttcccgattatactcatgttacatggtggaatgcacttccagggtcaggctgtattccaaaatatggctttgtgttgctgagttatatgcttcagcactctcatgttgctttcatctaatccatgtaagcattctaacttttttgctctggtttctttttctgcaaactagtttctgatggaaaatttcttatcgctagaaattgtcatgtaatctccaatgtgctctagaaatttcagattgagctatttgaattttgctatgttaatttgaagaatactattctaaagtggcagcggattatcataaccagctacctcaaactattcaattgcagcacttaatttaatcatctaatttattcaatgtgcattccaaatttcgcatttcttaatttaatcatgtattttggtttgagttgatatagttgatttggacaattataattgcaaagtaaaattgattttgtcgttgtaaatatgactgaattttctggacaacatttaatgtgattttgtcaaaaacacgatgaaccttccacttgtcagtatagtcctattttattttacttccgaaagtaagaaacgtatcttacaacatatttgactgatatctagattttttagtgtttcataacatctagctcgctagaattgttcttctaggcaagcttccaatattcttctaatgttcccaccatacatggagaagaactccaacgcacgcttctctagcagcttgcaatagctcttaaccatttcttcgtcaactcctttaagaagtaaaggccaagtccttgcccaaagcgtccccatgaaaatgacctgtaagaaagatataggattggagccattaaagaccacatagttcctatataaccaaattgcccaaagaaatgcagctatccccacaaacaatattatcttgagcctaggttcaacacaatttagccaattctcaaacatttgagacatgctacacggttgcctaatcccaaaggtaaaaaggagcacactccaaatatacctagtcattgaacaatcaaattaagaaaaggtactgtattgtttccttagagctacaaaaacaacttaggctaccgttccaccttctctttgctagattattcttagtgagaattaccctttccttgaggtaccacaagaaacttttgattttaagtggaatcttgagcttccaaatgaaattcttcctaggaactaccccttcatacatgagcgacttgtacatagattatactgtgaaaataccatctttattctttttccaaaagaaacgatctttctgatctgtcaatgcagtgtttacaacctttgacactagctcataccaggcttccaagtttcttcccactattgatcttctgaaagagacatttaacgagattccactcattaccttggccaccatctcatttttatttctaactagactgtaaaggttaggatactccttctcaaaggattgaactcctatccaacaatcttcccaaaatcttactcgtgagccatcttgtattaagaaggaaccaatcctttgaaaagactctttgtctaacatgagactagcccaaaaaatgcgagtcccctggtcttttttggacttgcaaaattgtttctttgtcaggtatttttttcctaagcaagctttgccaaattccttcttcattgatgtcgagggggcgatctctctgacaatggggagtggagatccctccccgagagtgaagatccggccatggggtttgcggtgagaggtacggatgactgcaatcataaagggttcacggggaccgaccatcctgcgtagagagagagagatagataggaatttatacaggttcaggacacccggaggtgtaatactgtcggagaataaactccatcggggaaccgtgaggcccccctttgtgagttcggccaggggcagcgggtgaaattcgagggcttggtgagcgaagctgtgtaatcttgaggggattcaaccccccaaagacgatgagacaaaaggggtttatacaggttcgggccactaagaagcgtaataccctactcctgtgcttgattgattgagtgtagaacataagtgcttggtgttgcaagactcaagcgccagttcgctcggagctcccccctccaccactaggcctggacctccttttatacctcaaggggttaccacatgggcccaacaacctaacctagctccggtagagaagtattataatctttgcattaaatgcatgtcttgtctcttgacttgggaagccaagcgcacgtcgtcttgatgatggggcctgtcaaatcttgtcgcctgacacggggggtgcccatgtcagtcaccatttaatgggtgaagacttctgggctcctattacaccggaaaacgggagccttgctttgaccagagcaggaggaccgactccggctgggataagaggatgagaacctctcaccatcattatttgatgggatatgtcgggctgcacgtcgcctgacacacgcgatggtgcgcctgacatcctgggtcccatcagtcattcgaccggtcatagaccggttgagtgcactgcacaccgcattaaatgcggcgtagcgcgaccgctcgggtcgccataaatgcgggtaggtgggcacctgtaggcggacacctaacccaccgtacgtggtgacctaaagagggggccggaggagcccgacccctagtcacaggaggggcagtcgtcacccgaccttgggcccgatcccccctcgggggagggccatgtggcacctggggtagcctcctccgtccaatctctgggaaggagtggccgccaccctatctcgggcccgactcccctcggggagggccacgtggcattggggggcagcttcctccgactagtctttgggaaggagtagccgccatcccacctcgggcctgactacccttgggggagggccacgtggcattagggggcagcctcctccgtccaatctctgggagggagtggccgccgccctaccttgggcttgactcccctcgggtagggccacgtggcattggggggcagcctcctccctctaaacgtgatacccccgggcccatattaccaacagtagcccctggcgttagccctgaccaaaacctttcccaggtggtctgggttgacgccaatctgctagtcagttgacatgtgggcccgatcttctgtcctatcaatctgggagttgggcggtgggagtttagtcacgttcatacgtcaccttaacttcccactttcctcccggtttccgaggcgctgtgggcttgggagtttagcccataccttaggccgtgaacttatttcctatatatattcagcaaacgttgttagactctctcgggcccgtgaccttacgccgtgtacctcgcttgcccctgcctcttgttaacctctattcgtgttctacttcatctattcaaacgattatttttgcgtgagcatggggactgaactttccatagtcagcaatctttacccgcgatcaagccaggatgggcgccgtagctagccagcggggccaaagctagctgctacggaagagccagcacaaggggccccgggctatgacggcgaccagagctcgacgcagggctaggattgggctaggaatcgtagcccccacacttctagcaaagagtcgtttgaatggacgaagtgaatacaaactttttgttaccaagggaggcaagccagcgcgcgacacgtgggtaccgcggaaccgcgaggaagagatgggcgagagataaacataagcaataataattctatgcaaactatcatctttgcgcgagtgcgaggactaaattttccatagccaataatcttcacccatgatcaagccaagctgggcgctgtagccagctgctacggaagagccagcacagggggtcccagacgtcgacggcgcccagagctcgacgcagggctaggatagagctaggaatcgtagcccccacacttttagcaaataatcgtttatatgaatgaagcaaacacaaaccttgcttgcatgtcgcgacctttcaaacctttagcttgaagagggcctcccaccattggtccctaaccactttgggaagcctgcgaccacttagcaaacgaggtcaggttcccacgagcctgtgtcctcacgctacacattctttttgctctttcctttcggtggcctccttccaatatctctcccttctacacggacgactactttcgcccgagtgtgagagccgaaaaactctagagccagcgatccccgtccacagttgagctaggccgggcaccgtagccaaccggcgggaccaaagctagctgctacggaagagccagcacagggggtcccaggcttcgacggcacccggcgctcaacttaaggctagaatagggctagaaaacttagcccccacacttagcgaggaaacgttcatgtagatgggagagaggttgggcttttaccaccgagggagcaaacaaacgcgcaaaacgcgagcgtcacagggccatgagaaaagaacagggggaaaataaatataagacttcaagctgtattaagctgatgaattgaaaaattaaaaatacttgaagcttgaaaggacgattagttgagccgggccgagcaccgtagccagccagcgggaccaaaactagccgctacggaagagccagcacaggggatctcgggcttcgatggcacccggagctcaactgcaagagtcctcccaggagtagaccgaggcaggtggtaggttcatgagcgatccccgtgcttggccctgaagggccatggggaagaaactcgccttgacccggtcgtcaccccacgccgcctctatgatcgtcgtgtggacctggagggactcggaggggttgacgctaccgtggtacctttcggtgaggctgggccgaaactttgggggttatccgactttccgaagattcgccataaagacctggccgccagccttatccggtgaagatgcggggggcctagccccctgcctggggtggcgcggcactcctgaggaagctgccccttcccccgcattggcagtgcgacgcttatcgcgccagcgctcgaaagaacctcaaaaatcatgaatgcaccccctacctggcgcgccagatgtcggagaataaactcctccatcggggaaccgtgaggcccccctttgtgagttcagccgagggcagcgggtgaaattcgagggcttggtgagcgaagctgtgtaatcttgaggggattcaaccccccaaagacgatgagacaaaaggggtttatataggttcgggccactaagaagcgtaataccctactcctatgcttgattgattgagtgtggaacataagtgcttggggttgcaaggctcaagcgtcagttcgctcggagctcccctcctccaccactaggcttggacctctttttatacctcaaggggttaccacataggcccaacaacctaacctagctccggtggagaagtattataatctttggattaaatgcatgtcttgtctcttgacttgggaagccaagcgcacgtcgtcttgatgatggggcctgtcaaatcttgccgcctgacacggggggtgcccatgtcagtcaccatttaatgggtgaagacttctgggctcctattacaccgggaaacgggagccttgctttgaccagagcgggaggaccgactctggctgggataagaggatgataacctctcaccatcattatttgatgggatatgtcgggctgcacgtcgcctgacacacgcaatggtgcgcctgacatcttgggtcccatcagtcattcgaccggtcatagaccggttgagtgcactgcacaccgcattaaatgcggcgtggcgcgaccgctcgggtcgccataaatgtgggtaggtgggcacctgtaggcagacacctaacccaccgtacgtggtgacctaaagagggggccggaggagcccgacccctagtcacaggagggggcagtcgccacccgacctcgggcccgatcccccctcgggggagggccacgtggcgcctggggccgcctcctccgtccaacctctcggagggagtggccgccgccctacctcgggcccgactcccctcggggagggccacgtggcattggggggcagcctcctccgactagtctttgggaaggagtggccgccaccccacctcgggcctaactccccttgggggagggccacgtggcattagggggcagcctcctccgtccaatctctaggagggagtggccgctgccctaccttgggcccgactcccctcggggagggccacgcggcattggggggtaggctcctccctctaaacatgataccccgggacccatattaccgacaaataccttactcctatgttagtgttcattgtcctccctagatctggtaagtacaaaggaggccatttcaggctacaaagcaagagtactgctctaaagagtccaaccccttcatcagtatctggtccccttccttttatagtccaaggagctcacattattaccaatctactcttaatcttgtcttatcagccgtcttatcgctactagctggttcccaaacacagtcttgaagaaaccctttgagtcttgtgattcgtattaccccaggctcttgggctccgtctgagatagttgggtcttcgctagtgtgctcaccacgtggtgcgtggtgggccggatgagacccaacctgcctgaaatagcgccacggatgcttctctacctgtttggctaaattaggtggcgcagggcatgtgcgacgcgtgtccaaggcgccaccggtcctaagtgactcaacgctggcatcttgtccacatctttttgactccagacgggttggggatcctacacaaatttatttcatttatggcagggcatgctgcctcacagctagctgtggagcatgcctaacttctcgagttctgacaccgcgtttaaagaaatagtttagttattcttggatgagcttctcgaagatgtcgttaatgaaggaatattttaagattatgtatcatgtacatctcgatgctcctctaagcagagtgtcacgcccagaaattcactagtaatttctgaactaatttgtgcataaaatcctcgtccaggaatcagccgaggtacacaaattgataatttaatatacatattcatcatactaataacgttacaaacttacaaaagaaaagagaaaacaacagcggaattacggtctagcgaagctcccgctctactcccacaggcagctcaactggggtataagccaaacgtcttctccttctggatccttttttattccactgacgtttgattaattattgcaaggtgagtacaaggaatactccacaagccacacgataagtatgcaagtgcacaaggataccaaagaatggcataatatagggctcatctgcaaaagcagcatttagcaaacatttgagaattgtaaaacagtagagtaattaatcatcaatattaatcaacactgaacagcatacccatgctgcacaggcccaaccaaacctgaacaaccatactaggctgtacagatctatctccaaaccaggaatgtaccattccaaaccaggagctaatcaaattattaccatcaattaccacattattattaatgagtagtgtgggactaatcacgaaagacattgttagagccgcccataaccgcgggcacggatattcgaatagttttactctggccaaaggtgtaccactgtacccacaagacacaactccacaatatgtcaccatatcatcatgtgcccatgctgaacatgtcaccatttgtgtagttgtgacaagacccctcacatagctcaactcaaagcagcgcacctttcctggatcgtagtcaccgcctaaaaaaaaaccagaggcatggactccctagcgacccccgtggccttatctccgccacttctcagtctggcacaccacaatgagccttgctatacaaagtgtccagccgttacctattctggcttgtggttggcacggttaatgtttcacaaccggaactcgtgaaccggtccttaattgtcaagagcacgaccatcaaaaccatgtgctcacaacccaccattatcaagttttagttggcacattaattaattaaccaatcatgattgaccatcgtgagctacctttaccatgtacatcattaagtaatagtgaaatattagttatcccaatagtgtggtaatgtttctaagcatggctaagcaattatatctaatatatctagttgaaccaatatataaatccaactagtcaaattataacccgatgtaatcaagaaatagggtaatcaatgcaaattggccataacaaaggaattggttcacaccacctggtgacatttgaaaataaatgcactgttgaaataaatagagaatttaaatataggatcaacatgctcaaaggaattgtgtttgggatctatgtgacttgccttgcaataaagggtcttcaattaatcttcttgaatacttccgatgcactcacgaaccttcgaaacgacggaaacgacaagctaaaatgcaaagcaaggaaaaagactaataaaaaccaaataaacagtacatatatagtaaacaaacatgtagatcataattttagatgaattatgagacttgaacggcttcattctgacttcatatgaattagttcgaattttacaagatttaatctaattaaagcctatttaaaaaggattaaataaatttaacacaatttatggataatttaaatatatagatctttattttatacaacttttgcaacttgaaccacattaaaccgagttacaatgaattagttaagaatttctaaagattaaaccgcattaaagcatttatatggattttaattgaattatgatgcaataaagaattattctgaaaagaaaaaggaatttattgcgtcatcaaagacggtccacggtaaaccgggttcacagaagcggtccacggaaccaacgaccaagatctaattgacctaaaattgaccgaatcggacggccgagatcgatccggtctaccacgggtctacggctgacatcagcaatgacattagcgatgatgtcatcgccgacggcagcttggcacaccatgctcaccggcaaacgacggcgcggcggtgcaaacggagggcatctacgcgtaaagcgcgacgcgacaactcaccggtggcttggacgacgacggcagcgaggtcgaggcggcggcggtcttcgggtcgtcgatggcggcggcgctccggcagtctttggcagaaacggaggacgggatgaggacggtggcgaccttgcgaacctggcgatggccttccggagcgacggcggtgactggagcagcggcggcgcttggctggactcgcggcagcgacggcggcgcacgggctgacgcggaggcggcgctacaagcgacggcgggctagggcgaaggtggcagcgaaaagaggaggtcccaggggtccttttataggggctaagaggcggcgatggaggcccatggccggcggcaaggagatggaaggtctagggttagggaatccgaatcaaaatcgaatccgagctatttccaaacaaaattagctaaagtttctataggggaaaagatagaggagatcaaggggatcctttcccgtctatcaatttgatcggagaaggaaaggggtggcccgatttggaaggggtatcggcggctgcgtgacatggttggttgaagacaaccctgacaggtggaagaggagggagggcacggtggtctgggccggcttgggccgggcgcgagcaggccgaaaggaagggagagagagagacttgggcagactttcggcccaaagccaaaagagagatttaaaaccttattcatgaaatgatattccgtttattaaaaatacttcctttactcaaataaatcctagaaaaatctaggaactatagaaacaagagaagtatttaataaaattttatctagcccacttttatattgagatttattcaattaaaattagatattctcttttaggcttttaagataatttctaataataacttttaaacaacactttataatttaatgatttttaaacaagcaaatcatttaacttaattataattagatcattaatgattaattggctgattaactaattactaaaatattgtttgtattgttaaacttaggaattgagctctgaaaaattcgagaaaattccagagagtataattaatcatggagaatttaataaaaattaaatccagccatggtttatatttaggaaattttatttcccacatttaacttcacttgtaaattaatgaacatttaatataaattctattaataatttattaaataatttataaatcttgaaacgggaaatcaggctgtgacacagatagatgtgagctctacaaggaccaaggtgagctcgggacccaggacaagttcgggaccgaggaagaccttggctcataatcttgttggtataacttcatatgtcttcaccctccaccccatctagaaagtgtgacttatgaagactgaggtgtgccctatgaagactgaggtgtgctcggggccctgaacaaggccgggcctgaggcaaacctcaccttacatctttatgttttgtacatctcgacactcctctttctcgagtagtgtgtgacttgtgcagactaaggtgagcgcagggcccgggataaggccggactcgaagcagaccttagctcgttctcttaagatataaatcttgtaggtttctacgcccctcttgatgaggagcgtagagcaaacaaggactaaggtgagcccgggacccaggacagggtcgggtccgatgcagaccttaggctatattcttaagacgtatttgggtatgcttgggaccaaagcccagtgccaagctactttcatgcttggagttttgagtcattgtacatatcatacgatgttttcctccttacccagggataattccatatatgaaagcttaggtgggctcgggaccctagctacgtcaccctagggttatctttttatttttaaagatattctgagcatgctatttatttgataatgatcgttttgctggataaatgggtacccctgttctcatttcaccgacaattgatcaactttaaaatccatttactaagcatacacttgttttgcatttctaggttttggatttccaacccatcacatcccttaggtctgcacaatgaactccatttagctaacctatacttctttttatgctcatcacattgccaaaaaatccggatctgtaaaaatccagcttctttaaaattcctctagggatttcaaagaaagaaagcataaatgttgccagactactcaacactgaattaatgagcaccagccttcctcctgacgacaaaaacctttcctttccaaccgctgagtttctcctggaatctatcttatagatccttccaatctttgtttgacaatcttttgaagtggataggaaggcctaggtatctgaatggaaaagttcccatcctacatccaaacaaagtggtgtaatccttttccacctccttatctttcccaaaacaaaacatctcacttttatggaaattaattttcaagccagatatcttttcaaaggcagttggtaccaatttcaggttcttagctttaaccaaatcatgttccataaacaagatggtataatttgcttattgtaagattgagagaccattgtctaccaaatgaggaattactccatttagaatctcaaggtcacgtgccctattgatgagaatggcaagcatatctgctactaaattaaataaaattggtgagaggggatcccctgtctgaaaccctttttcattaggaaaaagtggcctatctcatcgttaaccttcacagctacgctacctccagacacaatttgatcaatccacttgaaccaaatgtagaaacttttcattctcaacgcttgttgaaggaaattccaattttccttatcataagatttctcaaaatagagtttcagaataactccatctgactttttcttacacatctcatgcaatgtctcatggtgaattatggccccttccataatatttctacctttaaaaaaagcagtctgagaaggtcttatgactttctgtgctactagagcaattctatttgccatgacctttgtgaataccttgaagcttacattaagtaaggaaatgggcttgtattgtgtctattttgcctctttattctttggaagcaaggtaatgataccaaaattcagtctatgtagggtaactcgccactgtgaaaatctctaaagatagccattaagtcttctttaattacttccctttatgttctattaactcagctgggaaaccatcaagccccggagctttcttatgttccatttggaaaacaacatgtttcacctcttcttctgtaaattcctttgttaagaaattattttcctccattgacactttagggatatcatccttttgggattcaaacatggagaaacaatttacatccggagctccaaaaagatccttatagtaattggtagcgtatttcttgagttgtgcatctcccttaatcaccccttcttcttgttctaattgaaaaatctgtctctccgtgttctccattcgcgatgatatggtagtatttggtgctcctgtccccttgtactattctttttgtttttgttcattgatactatttagcttcttcttctcttaacaactgggctaaggcatttttacatgatttttttagatccagttcttgactagtcaagatcagctaatttgtccaactcatctgcctttgctataagttgagctttctctttttgtatatgcactacttaaattctccacccatcctctcaggaattgacgaagcctgcatatcttattttgtcatctttctatattcgttgccccttgaatatcctttgaccaaatttctaccaaaagattttgaaagtcatcccttaataaccatcccaattgaaattcaaacaaaggttgagcatttctatgtgtcccttttcctgtgtctagcaccaatggtgtgtgatccaaaagatcgctacagaaagcatgtactgtccggatttcttatttcccactcggtacttaccaaaactctatccaactttttgtaagttgggctcggcatagagttggcccaagtaaatttgcgtccggagagcaagatctccctgaaattaaggctgtgtatgacagcattaaataagggccatctatcattgtaagttagggatgaacctaggaacctctagcgatgttgtttcagattccgtttattgtttaaagaagggtgaattagacaagttggggaggttagaggaaaatgagcggtacaatgatgaaaattgggaatatttgggaatggagaatgtagtttgctagtatgatgaaaattatgcttgtcataacttgtatacattatgctgtatgtgttggaaatttggtcataattcggcatattttaatccaaaatattaagacaataaacatgacatttgcaatatgagtagatctagtgatagtgctagatgtatacaacttgagcatgcttaatatgaaataagcatcaacatttacagagtaacacaatgctgccattgcgaagaacatcaataaagaaacatctaatagaatcaggagaatgaaagtataccctaagaacgtcccaccgctggattttgaggcagtattgcctccgttgatgtcgttcacctccttgtctccaatctccatcgacatgttgacgaaggcgtcgatgcaataatagtagtcgcgaagaacaggagcagtcgcacttgaagcgctacccaaaaacttgatcgcccgcctacccgtgcaagttctcaagcggacggagtttcggaggcacctgctcgtcccatacacctgtgcgcgcaggtgaacagaaccagggaaggattctgcagctcaggaacagaggaggaggaactcgaagtgcaagagtcgtgaagaacttcctcagtccttctggtcgctgcggagtatatatatgcgagcgcgagagtaacgttcagagtcatcaaccccggtgtttaatttcgtaaccgacgcgctcgttaatacggaatcaattcacgacgtttaattccgtaaccgacggaatcaattcacgacgtttaattccgtaaccgacgcgttcattgatacgaaatcaattctccatgtttattaccgtccgttacaaaacgagagagcgcagcagtagcagctgtctgcctcgcctcacctcgcctcgccccgcctggttgtccgcgcaccatctcaaccggtcaacagagactctccactagctccgtatttaagttaagacctcttcacttagatttccgaggtggtattattacccatagcacttaatgtgggccaatggaatatattaggatttaattgggcctagcccattaatttaacaatccctaccaaatttcatggctcacaggaaatgctctcgattctgatcctgtttgttataccagtgtttcggtggagactgttaggatgaacttccacctaggaaaagagctacaccagatcacaactgaacaatggactatgccttgaattgtcagtcttgtgcgattcaggtttcactcaaacccttaactggtactaggctgccgtttgcatcccctctgtttggagcgtataagtcatactcctgaccttttcatgagtatctagagatcacccagatctcatagactgtgactagcagtcagactcatataggtgtgttccttctaagataaaaatgggggatccact

SEQ ID NO: 62429 - DNA, 2426 bp, Oryza sativa
taagcccattttagggtctcttctctcagttacacaatagtttgtttcgccatccaaattcacgggatctccgatcacaatggacaggtttccatcattgtgcaactctaagtgggtctcaagcccatctccctcgatgcatagtctatcacattacgtggtagccccttggtaaactgatctgccaaatttttagccatctagatatagtccaatgctatcactccggagtttttctgctttctgacagacttcagtcttcttttaacatgcctggatgacttcatattgtccttcgaactgttcactttaataatcactgtttgattatcacagttcatcaggattgcgggtactggtttttcaaccaccggcaagtccatcaggagctcacgaagccattcggcctcaactgtggcagtatctaaagctgtgagttctgcttccattgttgaccttgttaagatggtctatttgcaagacttccaggaaacagcaccacctccaagtgtgaacacatacccacttgtggcctttatctcatcagcatcagatatccagtttgaatcactatagccctccagcacttttgggtacccggcgtagtgaattccatagctcattgtcccttttagatagcgcattactctttcaagagcatgccaatgatcatctcccggatttgaaacaaactagctcaacttgctcacagcaaatgagatgtcaggcctcgttgcactagctaagtacatcaatgaaccaatgatctgggagtatctcaattgatcccttgctattcttcggtttttccttaatagcacactaggatcataaggagtaggagctgccttgcagtcactataaccaaagcgactcaagaccttgtccacatagtgagattgcacaagtgtaatcccaccctcatctcctctcagtagtttaatgttaagaataacatcagccactctcaaatccgtcatttcaaagcttttggacaaaaagtccttgacctcctcaatcacattgaggctggtcccaaagatcaatatgtcatcgacatataaacacaagatcactccctctcccccaccacaacgatagtacacacatttgtcagcttcgttcacaacaaagccagcagatgtaagtgtattgtcaaacttctcatgccattgcttaggcgcttgtttgagaccatacaaagacttcaacagcttgcacaccattccctcctgactttctagtacatacccatctggttgatccatatagatctcctcctccaactctccattgaggaaagctgtcttaacatccatctgatggatgagtagaccatgagaggctgccagagcgagtagtactcgaatcgtggtcaagcgagcaaccggtgaataagtgtcgaaaaaatcctcgccttctttttgggtataacccttggccacaagccttgccttgtacttttcaattgtaccatcaggcctaagttttttcttgaaaacccatttgcatcctacaggcttgcacccatatggacgctcgacgacttcccaagtaccattagacataattgagtccatctcactgcgtaccgcttccttccaatagtcagtgtcaggagatgaatatgcctcttcaatggttcttggagtatcatccacaagatatacaatgtagtcatctccaaaagactttgcagtcctttgtctcttactctttcgagttgctacaatgttatcctcctcaggattttcctcaagcgtttgatcaatgtgttatatcgacacaaagtgctcaggggataaaataggttcttgactagaagtgctaggtgcatttttcataggaaattcattctcaaaaaatgtggcatctctggactcagtaattgtaccaacacgcatgtcgggtactccagaatttactattaagaacctatatcccacactgtggatagcataactaaggaacacacaatctatggtccttggtccaagtttacactttttgactataggtacatttaccttggccaaacagccccatgtgcgcaggtgagagagatttaatttcttcctttcctattcctcgaatggtgttacttccttatgcttagtaggaattctattcaggacatgacacgcaatcaatattgcctcaccccaccattccttggaaagtcctacagtgtctaacatggcattcaccatctcagttagagtgcggttctttctttcggctaccccgtttgactggggtgaatagggaggcgtcctctcatgaataattccatactcttcgcagaaagaagtaaactcgttggaaaaatactctccacccctatcagatcttaaccgtttgattttcctttccagttggttttctacctcagccttatagatcttaaagtaatgtaatgcttcatc

SEQ ID NO: 62430 - DNA, 2454 bp, Oryza sativa
gtaatgctctataacaataatctctccacctaagtattttcagtgttgtagaatgtagaagtcatcactatttatataatgaaattctgctgttctgcttctaggtctcaactctcagtatggagttacagaatcaaaatatgaattggtggctgtatgctttggattgcattgaacagaacaaggattctgctgatgagctcattaggaagattgatatttcttccaataaaagcaccactggcttgggttcaacagggatgtcttccaggtcagcagaaaattatgttcagtttgtccattcaatttgttgtccttcctgtttgcagtgatttaattgtttagaggttgtataaattaaaaccttttatggcaattgatggataacttggttgtcttgttctctgcttagggttcaaaccattgctgggttgaagtataccattcaaactggtattgattctctgcaaagttcaaggcaacaagtgatggacagacttttagaacttgacaaaacaatggatagcccaaaggatgaagacattgagtgtcagcgatattgtccaaattgctatgatggtaatggttctttatgcatccaatgtgaattggatgatctgtttcaggtagttttatatgctaatgttttttgaggtacctccctacttctgcttgttgatcatgcatttatttcatcaattcttgtaggggtatgaagcacgtctgtttcttgttaagaaatcaaataatgattctgttattgcctcagtagaggaagcaagggacttgcaaaggcgaaaatatgagttgaatcagttttttcgtaatactaaaactaacgagggatctgaacctggtgacgacaataagaatccaagatctgctcgagaaggttttctggtatcatcttgtcatgtcttttatattgaaatatagctaagcagatgtcacctttcaggctttcatttgattaatccatacctgtgcctgggggtcttatatttttgtttcttaaacttcccttcttagtctaaactactagagatctggtagttagaccacatcttatttgcttctggttcctggactttcgcccccaccactctgttcctgtaactaggttatttctatttatcaaattgaaatggttaatgacttatttctgtcaaaaaagactgtactgcactactgcctgtatagatcaactcgcttttgtatattatcaagtgtcagatatgatttcgttcaacttttcatttgtcggaaattactttgaaatggtttataaatttcttggattttctatggcaattaaaagtgcatatatagtgatccatttatgttttatctaccatttttatgtttttatatggttgctgtttacaggtctacaggcatccttctcgaattgagacttccttaagggttattctaacccactcaaagacaataatgggagagcaatctgctaaaattgctaaaaagaatttgctgctttttgaggtacagaaaatatttttaatgtcactgccttctcttctgacatgttttagctggtaattgcagttgctgaaataaattttatcaccgtagtatattaaaagcagataaaacattattatttgagttggaatgataaaacatgagtatcttatctctattttgctgtgtcttgatttttgtagtaaattaaaagcaaataaaacattattatttgagttggaatgataaaacatgagcatcttatctctattttgctgtgtcttgatttttgtagtaaattaaaagcaaacaaaacattattattgagtcggaatgataaaacatgagtatcttatctctattttactgtgtcttggtattttcccccctgcagcagaacttctttttgttatcattaacctgcatcaatgtaaaatttactattgtcttgttagatcacttgcatttgtaatgtctagagaacatatggaaagatggaggtgaatctaattaggaacctttccacatgtcaaaccttataatctttgtttactaagtgatccatatgttttagtctaaaatgtgaaggttcaaaaataccacgagataggatattgtctgaccattatgtgctaatgtaggctatgcgcaaggagttctctcaagcaaggaatctatcaatagcacagacccagttactgcgtgcccatgatgagatcaagatgtctctctcacgcctgcagctcaaggagaaagatgatgaacccagtgcagtcaatattgttactagagaagagcttataccatacaatgtgcagtttacaagtgaaaaattcttgtctttgtcatctttagctcgtataagaggccaactcagatacttaaaggtcaatacttgctatcatgggttgcactctgccgtgaatctcgatattctattttacatattctacattccatttatttctaaac

SEQ ID NO: 62431 - DNA, 26037 bp, Oryza sativa
ttatgttcggatgaaaggaggaaggtgagatactcgtaaccaaggctgagttttctcactatgctgagctgagtaatgatattgtatatctgtttatacacattttttgaaggtagcgcaaagtgcatacaagattatactcctctccattcaaaaatataaattgtattttgttcctttgttttgttaggacaaggatttgatcaacaattactctattaggatataatttttgtgacaaaattgatgttgttagattcgtattcagacttacttatgattatgcttttgtgtcgcataaataatgttcccttccgtcccataagaacttttagggttgggcacatatattaagaaataggtggaattaaatgggagaatgccgtgattagttaagaagatggagtaagtggagaaattcaatggggagggttttgattggttgagaagaagtaggtggaggagttgttttattttgggacaaattttgaatgctagaagttaatatattttgggatggagggagtatattagtaaagcaattgttagtcaaagccttatcctgatgaaacataatatgccttatatttctgaacggagggagtatttctttaagttaaaacttgattttttccccctactctgcttctagtcctattgctagatgattatcaccaaggagggtcctcttctatatgcttgaatcttgtggacaatgacaatggggttactgaaagtgtgttacttttcacagaaaatcgcaaacagcgcttgcccagttcaaaggtctggcaagtagtataagtggagagaaagcaaagaagtcattttccaagatgcaacctgctcaagtattgctaatgcttatccagcatggtgcaaatggtcttaatcttttggaagcacaacatgtaatattagtggagccgttgttaaaccctgcagctgaggcgcaagctatcagcaggatccatagagttgggcaagacaaaagcacgtttatccaccgttttattgtaagcaccaaatcctgagctacttcatctcatttaaaccatccatggagaaattcctaaagcattatattgtttttaggtgaagaatactattgaagagagcatctacaaattaaacaggggcagagctgtttgctccacgatacaccgtaaatcaaaaaatttcaaagatgagcttgttttgacactgaaggatattgagtctttatttcctgtggcaacacttgatcagccttcagaacaggagaataagaattacggtggggccggtgggcatatgagaagtttacctccatctgttgcagctggcttagctgctgaaaggaggttattggagcaacatgacaaccagcattaagttatcagctgacttattctttcaactgaactcggagaggcaatgaaagaggttgaaataattgatgctgtagatattttagttaattggatttatcgattgccttcttagttctaaattatgttaaaattacagaaggtagggatatactatggtctggagcttctcggatcattatattagaatctggcatcagtgatagaatgtttaggacacccccgagcatcgggtatgtacttaaggagatgttgtgaaatttagttagttagcctgacagaagcatgtgtatcattgtataaaacccgccgtcttattttccttttgatttttgataggtaataaatatccttaacatgtgtacatgtttatgaacattgctttagtaaatgaaagatcagttcagatcatttttggtcaagctattgttcttactggaagacagttgtcacatactcacatgccgagaagtgccatttcttttgtcatttgtggtccactatatgtttgtcttcatacatagatttatggacacatatactgtttctgttaccgatggggggtatttactttcattatttaggaagtggttggggtcctaattattcttctatgcctgtggtaagcctgtgtttcccatgtcggcttgcgtcgagtgctattcggctatgcaagttgacaggcagctgggcaatattttctcttctcctgcttcattgtttcccccgtttttttttaagttcagagcttctccttgaatatgtacttacagtagtcttacaagcatctaaaaaccgattctttttggaacgaaaaagtacgtgggagaaagtgtttcccacacatataataagaaatgaaactacaggcaggggcttttgccctagaataaactaatgtgggggtggtctccatgggtgtttccgttatccttgtttccagtcatcctacctagatggaaatgttttcgtaagaaaattgctttgagcagttgttgttttggcagatagcagatgctctccacttggacaatttgctgctgtgtgcacgtacagtgcacaaaatggatggagaaacattattttcagggagcaggggagagagtttatagttgctatgatcgatatattgcttatccctcaacgtcctgtaccggatgtgtgatgacttgtatgcatgaccagtgaaggagcaaaggtaacacgtgtatatcttctacttgtccttcagttagcttgcactgcatgctaagtgaaaacttctaatattcaagtgccaacatgccacttagaaaatgtatgagtgacaactatacatcaactaataacagctgtagtgctagcatcatcactaggcaagtagtagtgaaaaattgtctgccatcagatctacaagaagataggcatctaacgcatgcaatggcttgaaattaaacaactgctgcacttgcaatataactatgcattccatataccatatataaatgaaaagaaccaagcatgaatttctccaccacagttgggagctagctaggaccattccacattttcccagtgattaaacaatcatcttaattatatacgatttccagtactgccattttttttctcaggggttcactagcaccagccgggccgtgcatggagcatgaaccgaccgtccatgagctcacggcctcgtcacggcgatgacgtacaggcgacacacatccagctgggcccctccttccatgttccaagccatttcctttggtgagttgttcttcctcttccccccctcccgatcgccctcgtcgtctacttttcctctcaacttcccaccgagcacaccaataaaaactgcagctgctgcccaataacctatctactctagcagtctagctacggctgatgagcaggtgtcaatacaagagtagcaaagctgagaatatctagttcctactttgctagctttcctagtaatactagactgctagcagcagcaattagctatagtagcggctcctcccatggcgtctcctgatggtggcgttggagacggcggcgcggagccacatgaagttatggacgacctgctcgagatgcgcgagcaagcggcgatgctccacagcatgctacatgggacatcgccgtcgagctgtgcggcggcggcgagcaccaggcagctgaatcagctgatagacggggtgatgagcaggctgcagtccagctcgctgtcggtgatgtcgcctggaggaggaggaggaagaagaggatcgggcgggaggaagaagaaaggcgccaaggccgtggccgggccgcacaggcggagcagctccggtagaagaaggtgaagaaagttaaaacccttttttctcaataatcatctgcaactggatgcgcaactagctagctatgcttaccacatgcggtagtaatactattacccatatatatgatagcgattcacacatcatgctagctacctcctttatgcaacttggagagtacgttgggagtatattgccttgtctagcagtggggtttaatcttaactttacgtgccaatgatcaggggggaatttttactaccagtagctttcttctctcacaaaagatcatttcctgtttcttatattgaaaagaccaaaagctatgagcaactagctatatatatgacactcttgtatacgtacataccgtggtctgccgagcatgctagtggagatttgggtgtgtgtctctggatatgatagttgctcctatctgctgtaacatgtggcagatcgaaaagtccttttgtcaggatggtcacgaccaaggagctggaggacggcaggcaatggcgaaagtacgggcagaaacatatacaggactccccaaataatccaaggtatgtacgtatagattattcaactaattctgcagtaacatgaccagattcttcgcccttgtgcatggtagttagctagtacgtaatgatgattaacccagcaagaaattaaaggcccttgtaccggccgatcgaacacttgccaatgcaactggacaactcgcttagctactccagttaattggagaatagtgttccgatcttccggttccggccggatcatggttagcttcacatagttagatatatactactccaatacacatgtgcttaattcaattgaactgtattagttagttgttgcaattactaaaaagagtaggaaaatactgctcaacttgaactgtgtatttattattagatagcaacatagcatagttagcaccaaatcgttgctgtaacatgttatctattcaggagcatcatacgatgcaattttgcagcttgcattccttaattaaagatctagttgttgatctctctgcaggagctactacaggtgcacgcataggccagaccaaggttgtatggccacaaagcaagtacagacctccgagtctaactcgtcggagttcgtcatcagctactacggtgagcacacctgcagcgacccttccaccatcccgttcgtcgtcgaggccgaagctcccgctgcagactacgcgaacctcatcagcttcggatccagcggcggcgcgagcacaagcagagtcgaccctcttcgtcagagccgccatcgtttgatggcagaagccgttgatccgacgccgtcctgcagcttcgccaactgccactctccggtactgtcctcggagtgcgccagcgaggcggcggcgctcagcagcagcctgccgctctccgccgtggtgggatcggcggtgacaacgccgtcgacgtcgatcgtgggttcagcgcctgcggattacgactggccgtcagggctcgccggaggtgacatggccggcagcttcccgtcctctcccagcagcctcgggttcatgactggctcctttggaatcttcctggggatgacgacgacatgtttggcttcgatccttaacaagggctgtgcatgcatacattcttgccatgctaattattgctactactaatattcaagaaaaacaagtccgctatttgcatgcagaagtgtatgcatgcatgcataatactattgctgtgaggctatagcaaattagcaatacttgtagtacatgtgtgtactgctattggaggaaatccaatatatatacggtacgtagtaaatatgtgtattagttgatcgctgtactagtgagttgtgtgtatgtgattttgtaagtattgaaacataatttgaaattaatatatagtagtgaaagtaatatatactccgtgttaccttttgcgctacctatatataggtcatttaatgctccaaaaataactagatgaaagatctaatctaatttaatttagtttgtccaattggatttggaacataacaatcaatatataaaatgcaagaaagaatctagctagctagcggggaaattttacgcataaaccaactttaaattgaagtgtgtgtgctcaacgtacgctccctctgtacttataaaagaagtcgtttagaacaatgtttaagtcaaaccttgggaatataaatcataaataactctcaatttgttgagtttgaaaatgtaaaaattatatgaatagatttgtcttgaaaaatactttcataaaagtatacgtatatcaccttttcaataaatacttttatagaaacaagaagtcaaagttatgttttagagaccatatcgctgtccaaaacgactttctttacaagtatggagggagtatttgacaacaaatttatgtctagataaaaactccaataaactcatgctgttactttttttttgttcagagtggtcattttatagggagcaagatgtcccttgcatgcatatgttcctcaccccccaaaatataatgttattcaaacagattataaaagttgtggaaaagaatttacagctaaatttatcttttttttatttcgtgggtttgaattttcttagtgataaattaatgtgcatatgtgacaccatagatgtatggtgaaaagtttcatggtatatatatgtgtgtgagtaaattgcgtttagggccaccttttattaccaaagtttcactttggaccaccctttaacacattttttcactttgggctaggttactttacctttctttcactttggaccaccccataaactttttaggaatacataaatgaattttccaactttaaacacatcagcaacctgtaaaccggtaatctttttcaacttacacgggcaattctttacaatattatagagtagatgcagctacataaaatgactttgggtggttaaaagtgcaccaaaggtccaaagtgaaaatatgagttagaggatagcccaaaataaaactttggtaacaaaaggtggaccatagtgtaattaactctatatgtgtcattcctccttggattcgagggaaaaatctaccatatgcatggcatatggaacaagaatgttgctgctctgtcaattagttacgatcatgtatgcatagtatagcttgctgctgaatttgcagaattagattagcattattgcacatgtgtgaatcgaatcttaacagatttagtatcatgccaatgacaacgcctttctatatcttagaggaaatggcaagattttgataagattaatttgaaagcatagtttaatttaaagcatagtttagttaacaactatttgatgaagtagttatttattgtacatggttttgccggctggtatcaatccagttcgtggttagcctttaatttatgccctttaagctactgcacataatttataattttcttgaactacacataatattttttatatgtggctttgtttagattgtgcactcatgccactaacctcttgcaagctctaaaaggcctttctctgaatagatgcttgcctggacccatggatatccacgttgcccccccgtgacaacaaaagtttggaaaagctttttagttttttcagaattcagaagttgctgtcacaacaaactttcgtattagcggcccactactccctccgatccatccaagtccatttccacctatcaaagtctttcaccccgaagacttagactattgacttacattctacttaaaattactccttcagtttgtttttgttttatgttataaatcgttttaacttatttttcagtcaaactttatttagtttgattaagtttataaaaacttagtagcatctaaaaagctaaattagtttcattaaatctaacatttaacatattttgatagcatgtttgttttgagttgaaaatgctactatatttttctataaacttaattaaatttaaataaaattaactataaaaaatcaaaatgacttatgatatacaaacggagggagtagctagctagtgcatgcgtttataggtactgtcatgtacttgaaaaatggctcaatcaatcgacacatgcaaggagacaaaacacttcacatcggaaacaaattaagatcctgcggaagactgcgttaattaattactgcatatatccatcacgtacgtggcattcattcagcctcttgttacatgtgtctacctgcatccaatgtatggtcaagatgcatacagtgtatggtctcctgtacgtacgtgtaattgtagttttagaattatcaacataagttaattttaataaaagtattagatcaagttaattgctccattcatcctaaaataattcagataaatagctaaaaattactcctccatctcaaaatataataagttttggttggatgggacacatctagggtgatttttagattctgatacggacggagggagatattctgatacggaggtatatattagctcagtaactagttattggaactcaggaagcagttgatatttagataatggaatagatattgattggtcttttgtttttcacttgcgatgacttgatctacagttctagaccgtgcatatatatggattatttgcacgaacgattaattggaaaacatagaggaaatttaattctcaacttgcagcgcgtaagaacataagtcgaccctcatataaatatatctagagagtcaagttgagtctcttgtttgttgtatagtgcctacattaataggttgaagttgacattgtcgatcattaggtcgcatggctctagctacacatataatacacacactttgatcatttcaacagcggaagcaaggtagcacgtgcttgtatggaccccaacgacgaactattctttcggttagatagatcatatacaaaactcgtccatgtttttgtctcaattaagtcaacaaatccaataattctctccaagttatcgataaccatgtagctagcgagcgaaagcagtgaaaacttcgtgaccaagtcgtggtctgaagtcgatcgatcgatcgatctcgatctctttcacaaatagtttagaatattttttgtatccatttccagttttctatccatgaatttacacgtgtaaaattaaagccttggtgctttttttctttggcatgtgctagctagctagtgatcagtaaaaggacatgcatggttatcaacacactcaaggctaatgaaagtcgatctaaagatcataaagctgtttgatttggctaacagagattctgaaagcattccgaacattccctagatagtgcattactgttctgaactttggatccttctgcttttcctcgtaaatataaataatacgattcaagtgtatttcttacgtcgaaagcctgttctaatgatcactcccatgacctttacaattaaattaagcaacacatataatggaatcgttagttagttgtatatcataggttcctttcagtgaatctgccggtttggaactatggatatgcgagttagaacgatgtgctgtctacttgtttattctcaactaagagcatgctttttaggtcgagggattttacttgccgataaaaaccacctgccacgcaagtacactcagctagtgactgtgtgctgctgaattttcttcccttttttcacttcaccgactctgatccgtccacaaaaacaatgcaaaaaagttaagatcagctcgatcagattaaacatttctgtggcacgagctcaaagtatggctcaataattctgggcttgataggtatcgacactacgagagtttactactgaatttgtctttggtcgccaactgaatctgaatgcatgcgtgcatgtacgtttcattcaactcctttcactattgggtgtttttgtctcgattcaccttcatcgtcaagactcactacaacttgtaaggagaattgttgtaaagctaattcatactgtattgtcgtgatatatatactcaattccaaaaggcaacacattttaagacggcaagcgaagaagttcagttttcatatagcaagttggtgctcaattagaacctgtattaatttgattatgtttatctgagagtgcagcaacttttcctactttttataatccaattggacacaataatttacctacagttgcgaaagagcctgtagtctagtgcttataagagcctcagtagaaccttaggtctttccaggatttaacggctttaatttgtgctttcagtggtaggcgacgtatccgtcgacagcgaggcgtctgtggtgacttcgtcaatctccaagatggatttgccggcctagtcttcgaagatgctcataagggtagaatttgagtgcgtgcgttcataggggtgagtgtgcgtgcgttgtgagtgtctgcgttgtaccgtataattctcaaaaaaaaataatttacctacagttactttttcagagaaaaactgaacaaaatttgcctgaataaatgacaagagttattctgtcccccaataaggccagatgaacccaccacctaaggcctttaggcccgtactgtttcaggcccatagtgtatccggcccatctaccacgagctcttcagcccgtcggcccacttaggcccatatacacgcggaagaaggatgagaacaagcaacaaaattccgcaacccttgtcgtctccttcctctcgcattcctcctccttaccttgccctaggtcgagtcgacgcgacgagatttgcggcggcgatggctctcccggcgtcgagctccggcctcttccgcttcatctctccacggcgccgcccccagtccaccgacatcgccgccgccgccacctggggcgtcttcgccggcaccgccgccatctacctcgtccaggtcagggggttcgatccacgacgcctttttataccccccccccccagcttgtagggatgtcttgatccgtagatatgttttgccccatcgacgttagggtttggtttttgtaggtaggatctgtcatgtttgtttggcatgttgtcggtccctagatctgcgtggcgtgttggatcggtcgtagggctcctctgttcgatttgctaccttatgatttctgcgcgttacacggattacgtatatggtttgtaggttgcagtcaaatttgccgcttgatctgatagagaaattgatgggggaagaagaaatgattctgtggagactaaggccacaactttatctacaggaattgctgtttggctgtgtctaccatgccttatataactttgtgatgatattcataccattaaatattttgcctgatgattaataggcatatattagaagaaagtttagcaaaaacacaaactttgattgacagttaaactcggtacattgtacaattcggtaactaatgcaagtatacatcccattatttgaattttgcaacatttgatggataacataataaacttttagttatcgtagttgtgtaatataattttgctttcacgagatcctgctagttttctgctcactaccttgatttgctttaccctgatgggcttttttgtagtgaagatgtataatttcctgttctctcctaggaggaatatctgataaaatctttgacagttcaacataaccaatatatgcccataaactcaccataggagcccctagatacagccaaacaaattcgccattttggatcagtcaatttatttttacctgtactttgtgatatggcccttgggcaaggcaagagtctatgtttttgggtgagctttccccagcaattgctctttcaagacctctgtgcaaaccggttattgaattttaattgaccgacttatgtactacactattcctgattacttttactgagatttgattccttgctgtgtgactaacttgtgtagctaaatgtaccctacatggcctgttagcactgtcttgggttccaacacagttttctgtctgggtgctttatttctttatctgagagagcttcagcacatgatataacttgttcattatggttcatggaatatgttcctagttttttaagcctaagacgtggaattccgttgggctgaaacctgcactttgctccttgtagcgaataaaactttgttccttactttcctttagcctcttgtgattagaatctgggaggcctttgctgcattgttgaaacatgcgaatagaatattcgtttatacctatgtgatctgttatgtatggggttactctacctgttaacatgtaacttgagttacacaactggttacaagatacataatctgggatttccgctcttaactttgatctgtgttgaagttatagttttgcagttaatgtgttgtcttctacctttttgttgtgaacaattaaattcttaaatgtgatgatctttccggttctgaatattcttttgatttcttgtgcagccatttgactggattaagaaaactttctttgagaaacccgaaccagaggcataagtctgccaggcatatggaaggctgcaacttttgatacatttacgtttccgggatgatttctgagtgaagagaacttggatgaccctgcaaataatataaaagacagtcatgttcccttgtttgattttaatgtaggtttctcttgcatgtaaaccccaggaggggaatgatgattatattgagttatttctcatctcagcgaaacctttttcttggttttttctcatctcagcgaaacctttttcttggtttagcagtgatataaattcgtggtcctgatgattgtttgtcgtagatgcatgctttcagactgccgtatgcgtgctgactgccttcatatgaattgatccatcgatggatatatatcatatctagctcctgagtatcgaaccatttactgttttatcgtcttggcgtcgttttatctgttactgtcttcatttattgacgcaaattagtctccggttagttgttgaaaagaggctgaaaaaattggcaccttggatgctgagaattgggcacctggattgcctgacacttaccgtcggatggcgatcgtgctgtcgctgtcacctgccgttgaccatctaaaaaggtttatcctcgtactacacggcgagccattgactcatctaggctatccccgaatctatctatccgtaactatccgtagatcttatttctaaagtttaattatccgtcttatttattaaaatcataaaaaaattagaaaaataagccatatataaaatattattcatctaataactgtataaaaatattaataatttttttaattaaatggacgtaagcgttggacataaatccacaatcctacataaaaattaaaataaagtatatatttggacagacagcttttccagattaatgatatcttacatatcgattgcagggtgctgatcgtggcatattattgggccacctggcagcctgaaaaaattagctaaccatctccaaaaattgccacgtgtcaatctggtacaatttctagaaatttacctctctttgagaaacatagagaggtgatccttcctatctctctctatataatctttattgtcagctgattagttcccctctaattatttgacacgtatctatttggtgagaaaaaaaatccagaaaagtccagtggatcaatccatgcgatgatttttatttttgagaggaccctggtgatttctagaagaaacataagtgagtgtattactacttgcaggctggttggatgcagatttggttgacagagttcaccggtatggccataaaaaggaaaagacaacaaaatatatggcccggtctaaaatataaataatgtggttagaaatatgggcgctaacgatagattcgtgatttgtatcacatttgagatatatttttttccaagtgttcaaaaaatcatgtattatataatttagttcagtagacaattcaattataattttacacaaacaaaggagccttaaacagtttggatgaaaaatagtggaatttgaaggattccataataatatgatttacttcatgttttattaaaaactagcggattgttctgtaaattgcatgatgctaaattttaaaagtagaactatattcaatataaattctatttttaaaataaaattgtattttctaatcaaaagatttttaaaatatgattggatctcatatacaactgctagttttttgttttgaatctaatggtccaaatcttttttatttcttagtgactaatgtggaaatttctaccatctagagcgaaaatgataacctttttcgagccatcttagcaatacaaatatatatgttgtaaaaatatatttttaatttttttatatatttttttacatgtgttctataaaatgtatacgggttagatgcttatcgcgccataaggcgcgtcaattttctagcataaaggcgcccggtcgccgagccctcacgatatcgatactcacgctcacgaacacgagacgcaaaagcaaagaaaagacgagacgagcaagaagagaatagaacatgtacagtgacacatctgcattggaagcgttccaacttccaaccccaatgcccacgagcactcgccacgtacatactccctacttccctaaatgtttaatgccgttgatttttttaaacaaatttaaccgtttatcttatttaaatttttttttgaaatatgtaaatctatatatatacataaaagtatatttaacaataaatcaaatgattggaatagaattaataattacttaaattttttgaataagactaacggtcaaacattttttaaaaagtcaatggcgtcaaatattttggatggagggagtacatctctatctccggatctcatctcactccgctagctttagcaatcctagcaaattagcaatagcgataccgatagctcccggtcaaatccttcgtagggcaggcttcctttattgcactcctgctcccgcgaaagcctcgcctcgccttttctccctaccaagccaccacgccacccaaaccgcgatttctgatcgatcgatcgttagctcgatccaagaacccatcttttctttgatccccaatcctcttttgccgaggattaattgggagaagatgacgatgatggggtgtgccgtgctgctcgtggtggtggcgtccatggcgggggaggcggcggggaggttcgtggtggagaagaacagcctgcgggtgacgtcgccggcggggctccggggcgtctacgagtgcgccatcggcaacttcgggatgccgcagtacgggggcaccatgcacggggtcgtcgtctaccccaaggccaacaagaaggcctgcaggtccttcgacgacttcgacctctccttcaagcccaagcccggcggcctccccatcttcctcctcgtcgatcgcggaggtcctccccctttcttgatttattcgaacccgtttcagtttttatttattattgggggagatttattttccctctcgtgagtgattttaaatatcgcatcttttaatttattttatttattgaatgtggtcctagctaacagtcacttctagttctaggatatgagaaatttaataatgttactcgcattttttttctcattttgtcctaactagcagtttgcacctaatgtttttttttcttttgactgaaagtttgcacctaatgttaataacaacatgttcttgaattgttctactcttaactcctaacccaaacaaaatgatttggaacttggaagtctatgtactctgcagtccatttaaggaaaacgattcattttgtactctgtagccatattctgtcagtgaataagtttggcagaggggtgcactgtcattacaagctgctttagttcttttttattgtctaatggtttatcatggatttttccttaactaggataattcgatacacgctatttgtcatttcatatgcaattttgtcctaattagtagggtacctgatttggtagttggcatatagtgcagttctctatctgcttgtaagttcggtacatggtttgttggaattttgggtaagtagctgggttccatggtcaaatcttgtttagagaaagattgtgcacgcttacgtttagttgttgtgctttttgagtgagtcagggaataaaatcatgtgctttgactgtccaaattatttagcttttgcggctactgctatttcaaaaaggatttattttctttctttgcaatttcaaaggtcttgctctacaacttatgtcactgctttggctacagttttattggtagaaaagctgcacatagaaggcgatttagagctagaaatggacactatacatagaactgtatatatggccatcagtataaatatgtgaaccagcctagtggatttcattctgaatattaggttaaacaggaggtgaaagttctcaactctgcattatttgttggtaattacattttatggaagaagaaatatcagtatctttgtgttccataaaaataatgtagtcatgccatttgtatgtttggctgtaacttcttttctcctgtttcttaggcgtaatgtaactgttaaagcagattttattgttcaaagtggggatctttaattctttgtgatgtgcagactgctacttcacaacaaagggatggaatgctcaaaccgctggagctgcagctgttcttgttgccgatgatagattggagcctttgataacaatggactctccagagtctagtggcacagattacatagagaaaattactgttccttcagcacttgtaacgaagaagtttggggacgaccttaagaaagcactggaaaacggtgatatggtcaatgtccttctggattggagggaatctctccctcatcctgatgagcgtgtagagtatgaattctggacaaacagcaacgatgaatgtggtgccaaatgtgacatgcaaatgaattttgtgaggaacttcagaggaacagcacaggttcttgagaaaaggggttacactcagttcacccctcactacattacatggtattgtccggaagcttttgtcctgagcaagcagtgcagatctcagtgtatcaatcatgggagatactgcgctccagatccagagcaggatttcaacattggatatgatggaaaagatgttgtgcttcagaacctgattcagatttgcttgttcaaggttggcaatgaaactcacaaaccatgggtgtggtgggattatgtacacgatttttcaattaggtgcccaatgaaggagaagaaatacacgcgtgaatgcgctaatggtgttatcaagtcacttggttggtgtagttaactttgttcagcataattgctttattgtttgaaccaaatggttgatttgaaccatttgatatgtcatttcacaggattggaccttgagaggatcaacaagtgtgtgggagaccctgaagctgatgaagaaaatcccgtgcttaaagcggaacaagatgctcaagtaaagactattgattactaatcataatgtttttgttatgtagagtctgttcattcataaattattcaatagttctgtggtaggttgatctttgtggattttgtcctttcagattggtcaaggctctcgaggagatgtcactatattgccgacccttgtcgttaacaacaagcagtacagaggtgcactagtagtatctattgcgcaatttttctttagctcgatgctgtagcctgttatgtcatataatagtctctctttaggtaagctggagaaaagtgctgtgttaaaagcagtatgctcaggatttgaggagacaactgaacctgatgtttgtttgagtcaaggtttgtaaatttttatgtttcattttatgaagtttactgattttgatcgatgctgtactgatttttctctccttttattaccttgctctctcgtttatagagatccaaacaaatgaatgtttggagagcaatggagggtgctggcaggacaagactaataattttactgcgtgcaaggtataaaattttaatggaaaaatgctactccatccgtttcaggttataagacgttttaactttggacaaagtcaaactgtttcaagtttgactaagtttatagacaaatatagtaatatttataatactaaattagtgtcatcaaatcaataatttaatatattttgataataaatttgttttgggttgaaaatgtagagagaataggagggaacaccacactccccaaagagggggggtgaccatatattatagcctttccaatatacaggatcctcaattagaggagtatacaaggaaactaaggatacaaaagaatcctatacatatatggctatacattcctaatacccgcctgcagtcgcaacgggaggatcacgaacgcaaggactggacctgaaatcagtgaacaactgcacaggcagccccttggtcatgatatcgacgaactgatgggacgacggtacatggagcacacagacctgtccgagagccaccttctcccgaacgaagtgaatgtcgatctcgatgtgcttcgtgcgacggtgatgcactggattggccgtcatgtagacagcgctgacgttgtcacagtaaacaacggtcgcagaggcgatgggggcatgaagctcctggagaagctggcgaagccagcagcattcggcgacggcgtgggcaacagcgcggtactcagcctccgcactagaccgagagacagtcgtctgacgcttggaagaccaagagatcagattgtcgccgaggaaaacgcagtagccggaggtggagcgtcgtgagtcaggacagccggcccagtcagcatcagagtaagccgtcagagacttgacaggcccggtgccgatgtggagtccggcggagagagagcctttgacgtagcgcagaatgcgcgtgaccaaggcaaggtggggctcccgtggatcatgcatgaagaggcagacttgctggacagcataggcgagctccggccgagtgagagtgaggtactgtaaagctcctgcaaggctcctgtactcggtcggatccttgacgggggcgccatcggaggcggagagcttggcccgagcgtcaactggggtggcggtggggtggcattcagacatgccggctcgctgaagaagatcaatggcgtactgtcgctgggacaggaagaggccgtctgaggagcgccggacggagatgccgaggaagaagtgcaagtcgccgaggtccgtcatggcaaactcggagtgcagccgagtggtgatgaggcgaagtagatccgtggaggaggcagtgaggatgatgtcgtcgacgtagagcaggaggtaggcgatgcggtctcgatccttgtagacaaagagggacgtgtcggaggtcgaggcaacaaatccgagctgacggatgtaggtggcgaaccgctggtaccatgcgcgaggggcttgctttaagccatagagagaacgctgaagaagacaaacggcgtcgggcgcggccgggtcgacaaagccggagggctgctggcagtacaccgtctcgtccaacgtgccatgaaggaaggcgttcttggcatcgagctggtggatgggccatgatcgtgaggtcgcaatgctgaggacgactcggatcgtggacggcttgacgatggggctgaaggtctcgtcgtagtcgatgccgtgttgttgggagtagccgcgaaccacccaacaagctttgtaccgagcgagagagccgtcggagtgaaacttgtgcttgaagatccacttgcccatgacgatgttagcacccggggggcggggcaccaagcgccaagtgccgttgtcgatcaaggccttgtactcatccgccatggcagcacgccagttgggatcggcgagcgcgctgcggtagttggtcagaaccggggagatagcggagtgggaagccgccaggatgaggcggtcgacaggcctgagggagccggtctgggagcgcgtgaccatgcggcttggcgggggcggcacgactaggggaggtgccggtgcagcgtcgaggcgcggtggtggcgtggcctgtcgtcgtcgatagacgtgcgggaagggctcgaccagccgtgccgtagttggaagaagaggcccggtggccgtccgggtcgtgggcactgggtccccagcagccggccaagccaacccagcagccgggaccaccatcgtgtagggaagaagcggctgctcgacctcagccgagggagcagccaccaaagacgaccgcaccgggtcatccgtggcgcggggcagggagggccgcggttgctcgacacccgtgacgggtggagcgaccacggtgggagtagtcacttcctgtagcagaaaatcaaacgaagagacatcgaccgggtgacgagcaaacggaaaacaagtctcatcgaagacaacatggcgagaaatgatgatgcggcgagtggagaggtcgaagcagcggtaacctttgtgtgaggtgggatagcctaagaaaacgcatgcggcagagcgaggggcgagtttgtggctagcggtggcactaaggttagggtagcaaagacatccaaacacacgcaatagggagtagtccgggattttattgtggaggagctggaatgggatggagttctgtatggatgaggaaggacgtcggtttaggagatatgtggctgtggctaaaccttcggcccaataggcaggaggcatggaggcttgcaggagaagggtgcggactgagttgttaatggtgcgaagtacacgctcggctttgccattttgcggggatgtgtatgggcaggaaaggcggagcaggcagccgcggctagcaaggaaggaggtggtgctgcggttgacgaactcagcgccattgtctgcctgtatgcatttcaaatggcgaccaaactgtgtgtgtgtatatgcaacaaaatccacaatgtgctggtgaacatcagacttatgatgaagagggaatgtccaacaaaaatgactgaagtcatcgagaataaccaaataaaatttgtagccagaggtactcaaaacaggagatgtccatacatcgcaatgaactaattcaaaaggagaggaagtactggagcttgatctagtaaagggaagacgggtatgtttgcctaattgacatgcatgacaaagggaactatctggctttgacgagggtatggcagagaggcgctatagagcgaggatggctgcagatccgggatggccaaggcggcgatgccaaatggtggtggaggtggcgtggaagcagtgggcggcgatgggtggtgcggctgccggtagggtgtagagatcgccatgactattgcagcgaagaatcacgcgccgggtccggaggtccttgacagaaaaaccaaactcatcaaattcaatagaacaatggttgtcacgagtgaattggcgaacggaaagaagattgcgaaccaaggaaggagcaacaaggacatgtttgagatcaaatttggtggtgcctataggtagaaaggaagagccacgacataaaaccggaatagtgtgaccattgccgacagtaatataggtgtgagagttgggtaagcgggtaacgagtataccatcggtggatgacatgtgcgaggtcgcgccggtgtcgaggacccaagaattggggctgtggaccgtcatctggttgagggcagccaccagtctagcctgatcccaggccggttgcgctgcagaggtggtcggcgacgagtacgggccggcaaaggcggtgtgggcttgaggaaaaggcccgaggatgccgggggcgcgccactgctgctgctgctgctggccggcccattgggagacacagacccatggtccagttggggggcgcgggacagcaaaggagaaggtgccgccgccgccgccttgacgatttccaccaccgctgccgctgttgttgccgctgttgttaccgccgccattgcggttgtagttgcggccgccattcttcttcttgtttccacccttgccgccacctccagtggaggagcaggagcccgaggggcaagaggcagcagcgctgcttgccgcgacaagggcggtctctgtctgaactttggcgtcgttggccagacggagttccttgagaacaagggtgttccgcgcagaagcgaaagacgggaggacaggagcacttgcgatgttgtccgccgtactggtgaagttggagttgacgccgcgcagaaggttgagaaccagctgcgactccgtgacggggtgcccgacgtcgcgaagggcatcggctgccgtcttcatgcgctggcagtaggcagtgatggagagatcgccttggatcatggagcggaactcatgatgaagaaagattgcacgtggttccttgttcgcttgaaagaggtcggcgatggcgagccaaagggcgcgagccgtctgatccggttccatggcgaggtcgaggacgtcgtcggtgaccgagccgaatagccagctgcggatgcagaagtcggcttgctcccataggtgtcgggggctgcaggaggtgcggagtcgtcgaggtggtcgaggaggccgaacttgccgcacatcgagcggaagaaggtcttccacttgttgaagttggggttgcgaagctcgagggagatcgggacatgagtcttgacggagatggtcgcgtacgggttgacgaagacggtcgcgacggagttggtggaggccgatgctgtggagttgtcggtcgcagcagaggtggcagaagacgtcgacatggcgacgaggagggcggcgaccagcaggggacgtcgccggcgcaaggcgcaacacagaggggagatcaggggtgcggaaggaaggagtagaacctgaaatctgataccatgtagagagaataggagggaacaccacactccccaaagagggggggtgaccatatattatagcctttccaatatacagggtcctcaattagaggagtatacaaggaaactaaggatacaaaagaatcctatacatatatggctatacattcctaatagaaaatgttactacttttttttataaacttggttaaaattaaagcagtttgacattgaccaaagtcaaaacgttttataacctgaaacggaggtagtactacctattgataatctgatactggttacgacattcacctctattcagtttgaggtgcacattcttatttgctgtgttacatattgtaggacaccttccgtgggcgagtttgtgaatgccctattgcccgtggtgtgaagttcgttggtgacgggtacactcactgtgaaggtacacatttgcattttatttcgtcaagatgggttggcagcatttatttctttggaatcattttttcatttgtttgaaacaatactgtttccttgctatagactgtgctatgcataacacatcctaattgttttattatttcaactattagtattacattgtttggtttacggctggccctttggcagcttctggtgtcggtaggtgccaaatcaacaacggaggctgctggaaggaaactaaaaatgggaagacggtttctgcctgctcagtaagaatctcttccagaggtcttctagtttgcggctgttctatgaggtcagaactaatcatggaactctacagaatgaagaatctaaaggctgcaaatgcccaccaggtttcaagggtgatggtataaaaagttgtgaaggtaatattactccatgtggcaaaactttccttttaaatatagaaagattgatatttctgcttgagccaaccatcttgtaaaacccatacaaactagtactggcaaaccctgaatagtttgaaactgttaggtgattacttaacatatctctggttggcgttttcagatattgatgaatgcaaagacaagcttttctgccagtgcaaggactgctcttgtgagaatacatggggaagctatgagtgcagctgtggtggaagtaatatgttatacatgagagagcatgacacttgcatcagtgagtcccctaacctttttttttgttcccttgtagtcttatattgttcaattttctacttatcggcattctggaccttgtgatcatgttctgagattgttatcccaacatacacttgtatcatcccttgttactcagccttgaaacttctgtagaaatttcagatgttcctagttttgcttttgcgatagtccatctgctggcggcttgaaaatatgcaatgcaagtctgcttgactgcgccatgatctggatcattgtcatgtttgataacggactatcacaaccaaattccttttgaaagatatcacaattctttcatgcctcattcaaaatgttgtatgttatgttatgttgatttgatgcaaaacaggagtggaactttgatgcacacataatttcattcgctttagaacgttttatgtgacgcctttcgcaatcactgtgcaggcaaagttgcttcttcgtcagtgggctggggcttcctttgggttattttctttggcctcgctttggctggaattggagcatatgccgtatacaaatatcggctacgggtaaacaactcatccttctattctaatccatctccgaatgatcacgtaattttctagttcttcttatgtttgcaataatctacggctaactcatactttgtgttaccatcatgccaaaccagagttacatggattcagagattcgtgcgatcatggctcagtacatgcccctggagaatcaagaaacaccgaatcaacatcgtcctgtggagcatgctgatatctgaaattgcagcaagcttaactgggagctggcagcagtatcggtggtcgccatcttgacagagtggtaggcttggagctaccctttgtgcccagaagataaaaaaaaattcagtatagcttatgtttctgaaacgacaagatttttgcatatcctctttttctctttgctgaaacttgcaggacagattaggatctccccagaattaacacctcattggcctctagtcataattatgagcttctggtcttgttcttactctactcctacatgtttttttgtttttcagcgagatactcctatatgttaaaagcttgtaaatactgttgttcagacaatagtccttaataaagagaccggaagagcattctacacctaaacaagatttgagttgaggattccacgagcatagcaatgttcacttctgttgatgaggctttgtaagcatatgtatgttccttcttgctggggattgtactccatccgtttcacattttcaaataaccgactattttgcctttaacattgcactacaaaattgttagactaaattgagttaaagtttcatgtttatattaggacataatatgtttaaataatgtggaatccttttgtctttgtaaatattttgtaaaaaagacgagcgaacaaagtttaaaagtgaatagtatccacgacaggctttctgagttcatcgatcaggccacctaattggttgtgtactgctctccttttccaaaataaaggaatttctagattggtcttttagtaaaaactaatgcattgaaaaaagatcttctaaagtcatttcagtggtcaaattttaaactttgaatcgtttagattactttcccaagcatttcattggttgaaaatgtacaaattttcatgtattggaatcaataccttagaaatacttatatatatcgtagtagtacaattttgaattctagaaatgcttatttttagaaatggtaaagagtgctggtgttccttcttcgtctagttggtggctttctttggggctctgggctgagcagttgatgggccaaacaatattgggcttaatggtatcgtgtacggtaattgaaggcccaaacgcacccagggaagccctaactctgacgtcgtcaggccctcagagccagcgcaaaatggcggttcgctaccatcggcaacggtccgaaacaagggtccatttggaataatcgcgttgagtgctgcagctatatatggtgcgtgcatatggttgatgggtccagccttaactgtgcgacgatgatctatactgtaacctcttgtttccatccagagttggagtaattattattgctctgaccaagtgacctgcacacagggctccccaaactatttttgggtggttaccatcgtcccatagtttaacggttattgcgataactacgtggttattgtaaaaaccgtacggttaccgcgagatatatcgtaatgttaaaatttaagaaagttatcacacgtgataaccacgataatcgtgcggtaaaccttgccagtacatacagcaagg

SEQ ID NO: 62432 - DNA, 1156 bp, Oryza sativa
ctcggccccattttttttcccgttgaatcatggcgagttggcgactgtgttcaagacgaaggaccagctccgaataaccgcaacaattaggaacagagatgctctcaattagggcaaccccgcatggtccacaatccacatgcagcatcttcataaacaggtaaagagtttttattcgtggagagaacgtcctctcgtcttctcatgtcatctcaataattataaaaataacaagataaattaatacaaattataccagtgtataaatatgcaatatcaaatataaattaaactaaaactaatatacacattcatagtttattttgttacaactttgtataagttgaattgaaagtcacatgtttttgagacacataatctatctttgtttttcttttctaaactccacataggccatatgaaaaaaaaagtaattgtcctatctgtaagtctgtaacaatggcaatgaatcagagtttcatgcattagtcgagtgcgagcatgcaaaattattttagagtgtgactgaggattttcttatctcaagatgcaacggttaaacccaactacacggtcatgggatgcgttggatgcagatatcatgggcaaaagggagaggcaattacagtctctgtatgttctatcaatgaattaaaaaggtcatcacgtagacaggcctgcccaaccctgctctcattgcctccacttactactaactactaagagcaagcttcgtagtatagccaactactagctctaattcatctataatcaatctaatagttcatcaatacaatagttacatactacactattaatatttagtcccacctgtcatacacacactgcgtcttagagtccgtgctacagctagctaaaaatctgtagtccgctatttttatctcttcttattaatctccttaaaatatatttacaggtggcttagctattgtacctgctctaattcgtactgcacgaacgagcgttgtttagttggatgccatcgaaaataaatggtcgtcccatgatggcgtgatccatcatcatgatgtgtgcatgtactagtagtattatgggcacagaaagataataataccgctactatctagagtaccggattggagcatcatggagatgcaggcttagggcctgtttg

SEQ ID NO: 62433 - DNA, 21026 bp, Oryza sativa
  unsure (1)..(21026): unsure at all n locations
cctataatgctctatatgttacccctaaatatgccacattggattgagtgatgaggtggaggagagaagtgaggagagagatggtgaaccacccctaaatgaagagacaacctccacacaaatttcaagaggggtgtgagagtataagagacattggtatttatatactagagaagacatattgtataagttgcctcttaatttatgagtgtgatgtggataaatttagatgtggtagtcacatctaccataacacttgtcctaatggtgctcccctctagtggcccacacttgtcctaatggtgctcccctctagtggccgtgggccacaaggaggtgtaggagacaatgattagttccaaagctaaacaaaaagagcagttttggccgatcgatcgagatgaacatgaaatggcttggttaaatcataatctgaacattcagaatcatgttacatgtgatggttacattacataagattggctgaaggtttacgacccttttaatttatagggaaaatataaaaattttggaggactttaatcctataaaaaaaatttctacgaagactttaaaacaaaggattaaatcttatcttatcctttaaagtttctatggaatataaaattcctatagaaattttagaggaaatttagcaacaggtcctaatgtcttgaaaaaattcctttaagtgtatatttatcatctgatttctatgtttttcctgtagtctaattaaactatcatatgtttttttttgtgtgtttgtaaccctctgatttatatttatatttctttcaaaatcttactgctatgttttttctatttggctgcttactactactataatttgcagccatacgccgcgcagcgtggtgagcgatccatttcggcgcaggagcagcgactagcgcaacggtcatggagtagctttgctgcagctttccttttaccctcttcttttgcagggacaagagattaccccgtggtcttcggactagacaccaccatgacactccatttgcttttgtctcttgatgttttttactacgctttttacgcacggtcacaactcacgcaaaggcagtggtggattccggaattttgtcttggcaaaagcaaaacccagaacacaacccgatgtagattttccaaccactctttgttcgaaaaaaaaaaactgcctactcctccaagccgttggtggaacaatttgagaagcagtaaaagaaatcctatcgctgaagcttaacggctccccaatgtctccgtgctttcttgcaatttttagttgtttcttttaagaaaaaagcaagtcaccttatagtagatgtattagcaagtgataataccttaaattgcggttacagtataccgtgcaaaatcctcacaaaaataacacaatgcaatttgttttactaattaaatatactaccccattcagatttgatcgatgtatttgttcttgacagcagtaccaaggaggagtaaaatgacatgctactagaaaattattcactgccctgcctttgctgtggagaataaggcgaagccttgcatgcgagatgataagggagaggagcaataacttcgtatgaaaactgaactaccagcgcatccgtccgagataaaatcaacgcctgcaggcttttgcactaatttaccatttttgcgcaatatttttctagaaaggcatttaagttgtgctgaatttgcttttaatttaaccatcgaaagatctcatattcataccgaaaaaatacatttgtttcactggtcaatagtgcacaatatagtattctaagattgcaatcgtgacaggcaatcgtattctgagccatttttatccattcattcatttactttgtggcctgtagtatacgagtatgtcaagatttgtttaaccatcacttttaagcagcaccgattgatgtggattcttttttttctctctcttgcgttggtgattgatggggaatttatataaatccaccacaccacctccaactgtgtacaagggacttgtgagttatagcaagggcgttgtcgcatgaatgtacgatgtattataagcttgtattttcttatgataacatgtttttttctggaggtgaacgagcatacataaggaaaataaattacaaaaacttattttcctacacgtcaaataacttatacgtcaaacagagataggccgatagctacatcattataataaacaaaaactttaaagcattaaatattttgacgtgttttataaaaaacaatctagacgtgcatacataaggaaaataaattacacaaagggcagctaaccatgtcacacgatgagttggcaatatttttctgtgcttaagcgtaagttttgagacttttcgacatgacatacactaacaactagggggtttggttaattggcgcgccagcccctcccccacgcgatttttttcttttttttcatgaaattttttctttaccttttacactttttctgattatttttttaatcttcaacacacgtgttttcaaatgttttgaatttaaagcttgacttaaaaatttttaaatcttgacttaaaagtttttaaaccttgagttgaaaattttcaaaatttgtcttgcaaatttaaattttaagagaaaaatttcaaagtttgagttgaaagattttaaaatttgacttcaaagtttaaatcttaagtcaaaagttttcaaatctaatttaaaagttttcaatctattagtaaaaatatcccaacaaaaagataatcttctcctaattatgccattatccttaactaactagttagttaggttaactcactgaaacatgcgccggcggcgcgcacgcgctagctagctttcccgaacaactagtatatccagactaaaatggatcaatagtaatagtacagagttactccatccgtcgcgcgaaaaaaaaaatctagaactgaacgtgatatattttagtacaacaaatttagacagatatatgtctaaattcatagtactaagatgtcacatcatgtactatgttgatttgggatggagggtgtggagattatgggtaccccatacccacacggcatggttatccgactagttataggggataacttatatatatgaaatatgtaacagattatgacttgggtattacgtttccctgtatattatggaacggcctaaagtcctggtttgataagattgtaaagtagatttaggaaaccgataccgtgttggttaaggtttctatcttgtaatcatgccccccatcctatataaggtgggcaggaggccctctagggggcaggagacaacttgatcgtcagatctatactacacccggcggattcaaatccccaaacaggagtagggtattacctctcattgagagggcctgaacctgtctaaatcctttgtctctgcatccatccacttttaggtctcgtgcgctaccccgttttattattgccaaattcatgtttcgacagttggcgcgccaggtaggggccgcgtcgagttttccgtcgagaagtgcgatggaactttgtgccggcatcatcggtgctactcttgtctttggccgtgatcctctcaacaaaagggcagggtcttcgtcgccaaaaattctatctggatctggtcaatcaaccaggagattaatcaccgatcgaatcgatctacaaccagcttgttaccgtcaattttacctccgtcagtgagatcaaatccgtcgctacaatgctgccatatctgttggtccgtcggtttcgtcaccagggcatgatttgaagcaatcagcaagcagccgccgtcaaaatcatgcgaagatcaccgttggttgagcctgtacatcaccaagtcaatactactcggatacgtacggcaagacacaaagtccaggatacaaattaaatatacctggtcaaatctgtggtcaaggaaattaatccatacacaaatcagctattacatgcacaaagtggtctccaaactaatccgtgcatgtgctaccgacgattacatgtctacacggctgcatgacatggctgcatgctacggttcatccattgacaggcctcgaatcaaagttggatcacaaaccaggtttatcgttctaaattttcttatataaattagaattaattcacagatcactaattattatttgatctattattttatacatgtaccgccggccgccttcgtcgctgccgattggtttcatcgcctccacggttggtgtgcgccgctgccgttgcnnnnnnnnnnnnnnnnnnnnccgccggcctgcctccgtcgccgccgactggtgtcctcgcctatacggtcggttggtcacaccaccgttgatgggcatcgtcatctacaccgccggcctgcctccgtcgccgccgactggtgtttctgcctacacggctggcctattatgccaccgctgttgggcgtctacgacttcaccgccggcctgcctccgtcgccgccgactggtgtcctcgcctatacggttggttggtcacaccaccgttcatgggcgtctacgacttcactgccggcctgcctccgtcgccgccgactggtgtcctcgcctatacggttggttggtcacaccaccgttcatgggcgtctacgacttcaccgccggcctgcctccgtcgccgccgactagtgtttctgcctacacggctggcctattatgccgccgctgttgggcgtctacgacttcaccgccggcctgcctccgtcgccgccgactggtgtcctcgcctatacggttggttggtcacaccaccgttcatgggcgtctacgacttcaccgccggcttgcctccgtcgccgccgagtggtgcctccgcctacacggctggcctattatgccaccgctgttgggcgtctacgacttcaccgccggcctgcctccgtcgccgccgactggtgtcctcgcctatacggttggttggtcacaccaccgttcatgggcgtctacgacttcaccgccggcctgcctccgtcgccgccgagtggtgcccccgcctacacggctggcctattatgccgccgttgttggatgtctacatcctcaccgttggctcaccttcgttgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagaaaattctgatccgtaaaactttgttccattaatgacgaactcatgtcactcatatgcatgtttgggaagtgcctaggccgactcccggtgcttgatggttatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacgtcaccaccggctcgcctcgaccgccgccgactggtgtttccgcctgcacggccggcctattatgctgccgttgttgggcgtctacgtcttcaccgaccggccgcctcgtccgctgccgactggtgtttccgcctgcacggctggcctttatgccgccgttgttgggcgtctacgtcttcaccgaccggccgcctcgtccgccaccgactggtgtttccgcctgcacggctggcctttatgccgccgttgttgggcgtctacgtcttcaccgaccggccgcctcgaccgccgccgactggtgtttccgcctgcacggctggcctattatgctgccgttgttgggcgtctacgtcttcaccgaccggccgcctcgtccgctgccgactggtgtttccgcctgcacggctggcctttatgccgccgttgttgggcgtctacgtcttcaccgaccggccgcctcgaccgccgccgactggtgtttccgcctgcacggctggcctattatgctgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgtcatggctgccgactggtttcttcacttccatggctgcatgattctgccagtgttgattggccttaccatcttcatcgctggtcgtctcgtctgctgctgactagtgccctcgcctctacgtctggtttatacagctaccactactgatggacatcatcatcttccgtcgccgactgattatgccgccgccgactggagcttttatcttcacaactgcgcgtcttcactaccggtttgcttctgttgccgccgacttgtgttcacttcattacggcaatacaactttgtcatcatggtggagcgacttcatctttattatcttcggcaccggcaaactctattgttgctacttcgcaagttttactacttcaccacccacgacgtctttgtgaacctcgacatctcggcatgcaatgccatgttattttactacaacaagtggctctccaatattcaggatttctacttggacatcttcaacacatatcttcaatcaagtgatgactactcgacaacaagaagctataattctcgactctatgttcagttgtttcccaactaatcaaagagtcgggggctacacaaatacatggctcaaaatttgacaagctttatgtcaagatgaagcaatcaattaatcagccaacaagtcaactctgggagtcatcaattttgtcttcgcttcagagcagtaggtcaagattaaatttacatgtctgggagtttggagtcatcaaccaatcaactcatatcagattcaatgagttgaacaacagcatatactttcctccaagtgaagcatctacaacagtttgatggattattgtcactgacatcatcaccagcacatctgcttcatcagctctgacattccgccgttgctaatggatgactaagactttgctaacttgctattccgccttcacggttgacctactatgcaaacgctgatgagcgtcttcgtcattatcatcggctattacaccgctattgactggatcaccgacatcgtcatcttcatcaacatcctgtcaaacctctttatcatagcttactctactgctattgataggcaacttcgtcatcatgtttgatcatctctgttgatgcttatcatcattactgtcggttacgtttgtcgtcgccgactattttcctcatcttcatgattggtggatttcgtcatcgcctttgatctgcctcgtctgtcaccgactgattatttcgctgccatggctacacaactttatcgctgggcgccttcatcttcattgatggctgacctgactgttgccgactggtttcttcgcctccacggctgtgcaacttcatcacttttgattggtatcactatcttcactaccaccaatatttttgccacctctgttgggcaatattatctctatataggtcgtcttgtctctatgccaactgcgtcagctaccatcaatgaacaattgtgactacgtgctcaggggcttactagctcaaatacaagtattatatcttcaatttggacttgctccggatatatgcaacatgaattcatgatcatgggtctattttatatgctcaaagactggactatttattattccccgtaagggttatcaactgaatacttgcgccagtcgggattcaattgttatatctattttggagtatcccataagggataatcactcagatcacatggtctatatcacccgggagcatgttacatgtgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctggcttttttatatagtcatggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccaatactttggaaatttctttattcacaacatacaagcttctttatagctattttgctatgtgaattttcaatgatgtagccaactttaggttacactcatcatattttacaaagcagtcggtatatcacttggatcatattattcagggattcacaccgcatatgctacatattaatattaagtcgcttggttgactataattatcgaaaccactcggtgcatctagtcgatgcacctgactttatttttcagccctccacagtcttcagatttggtaaaaatactcgggagaccatggcaaagatgattgaagtactcggttttggagtaatctagttcgagagaagattatcttttcgactgtgaaggtctcaggggctactgtggagattatgggtaccccatacccacacggcatggttatccgactagttataggggataacttatatatatgaaatatgtaacagattatgacttgggtattacgtttccctgtatattatggaacggcctaaagtcctggtttgataagattgtaaagtagatttaggaaaccgataccgtgttggttaaggtttctatcttgtaatcctgccccccatcctatataaggtgggcaggaggccctctagggggcaggagacaacttgatcgtcagatctatactacacccggcggattcaaatccccaaacaggagtagggtattacctctcattgagagggtctgaacctgtctaaatcctttgtctctgcatccatccacttttaggtctcgtgcgctaccccgttttattattgccgaattcatgtttcgacagagggagtaggagacaattaagtactctctccgtcctgtaaaacggtaaaacccaatttaggattggaatgagatgtaatatagtataatgaatttgaacagaagtttgtccaaatttatggtacttatattacgtcacattctaatctccatgtgccgttgccgtgaccgtctgtgcggccgacggctaccagcccaccatttttaccccaaccaaaaatactaaaccgctcgaaccaagcacaaacccaacgggcgaggcgaggcgaccaatcaatcaacctgcctcctcactcccattgagcggaatacggagtaggagtatattattcccctcattccattcattcaactacctcatcattccttctcccccttcgtttccactcgtcccaccaacaccgtccactcgcttccacgtgggccccaacaacccgagctgtcatagtcgtgacggccaccgttgccgggtgcacgtaacctcgcgctcgcgtcgtttctctctctccctctctcacgctcacgggggattcgagtaggactctacctgggctttaccggtcccgggacattgacccgtggaccccaccccgcacccacgcccccgcgggacccacatgtcatcgatcgggctgatgacggcagcggcacgtatggcatggtgactcgcggggccggcacgggagctctctcccggtcgtggtcgcgcgcacgtcagcgaaagccgcgacgtgggagtggaggaggaaagaaacgagggcggttgcggcgtccacgtcgcgggcgcctccgccaccaccccgcctcgaccgcgacacaccgtgcgcttgggctcgcgtgcgtgcgtgcgtgctacgaggtgaggtgcgccgcgcgcgtggttgtgcgtgcgtgtgccgcgccgggtggagcagagcagagtaacgtgtggctcggcgcgggctcccacctgaaccgacggcgacgtttcatgggagatttggccgccggacatgcagcgcgcgcggtggccgcctgggttggcgacggtattcaaggctggactgcaacagtgcctctcctagtagtagttctagtactagtattggggattggtcgggtcgtggtagtggcattccttgtgcattcaattcggctcgtgctcgtgcagcgatcgatcgatttttttgctgctgctgcccccgttcgacatgcatgcagacgacgcagcggcagcgaatcatttcctctgttttcatcccagagaatatactagcagtactacaaattccagtgaaaaattcaactctgttcagcatgtgtatcctctcgcaaattttctgcattgaaactgtatagcggtgacttgaaccaggacgcagagacagagaggatcccgttgtttatacagtaacgcaggtgtcgctgtaacaactgggatggtggattggcatttgcggacacagactgagttcacccccatccagagaccagagagggcagatcgacagccaagtactgcacctgcactgcagacacctgacctgcgtgcaaagtcgtggagacgcgcaacgcgaacacaacaccacacccctgccaccgcagcataggacccggcccaagagagaaaaattaattaaaccagcagagcatgtcgtgcgtgcgtgcaactgtgcaatccttaaatatctccttttttttatgaaacaaaaaagagagagaaaagcttcctcactttgctcccaatctttaccttatagcaggtataatagagcagttatatatacatatcgagtagataaaaggagagagacgaacagcggtgctacataaacttcaaaacgtaatgtgtgtataacaatgtgactaaatattaatagtatagtagtatatatttagtgataaattatctattaaattaagatgatttagaacttttagttagctatactattaaacttgctgctatggagtgtaatatttatgtggaaaatcatgaaaatttcagtcacatcgtcccctcctccgtagtttgtactactacagtagtacagcacagggtgaaccgaataccttactgaagtatttactgcgccttggctgctgcagcatcagcagcaggagtaattcttcagtctcctcttcttgctccccccatctggttggttttccttttcttccccgcatccgcacccgagtcgccagcgatcgatcgttttggtttggtgccatctccacatccaccggaaaactacgcttcccctacccaccgcatcatcctcttgcctcgatctttactgctctctactaggctcgagctgtgtgggtggggtgatgcggtgagcttttctttttcttcttctattgatcggagtggccatggcggggatggctgcggcggcggcggcgttggtggcggcgaagaggtgcatgaacgccgcgtgcggggccccggccccgtccccggcgggaggggagtggaggaagggctggccgctgcgatccggtggcttcgccgtgctctgcgacaagtgcgggtacgcctccgcctcttcctctctcggttcctcctcctccgcgctagcttgctgtgcgcgcccatggtggtccacgcgccgcggctgaaatggctggctgcatgaattagctgctgtgctcttttttttttggttgtttcctgtatatcgtctcgatgatttcccctctttttctccctaaatttatttgtttttccaacggctacaacttgtgtttattacttgtttgatgtgatttttaccattaccatttgtggtgatctcgtattggcgcccaaattagttgatttatgaggaaactgtgccggggtagaagcaacagtgttgcgcgtgtagaatttttggaaagtggaaaatccggtgaaactttggaaggttgacttgatggctcgttgtgcgattagctagcagttaattgagtggacatcatgctcaactgggatttcgatgatcgttcagttacttgctgcacatgagcttctcacaattaaaattatatttgtggtgacttgtaactggattgctgtcccggatgacgtttcctgcgctttggtgtaaaaaggggggaatttgtttgccaaagctctatgagttgtcaaaattgctgcttggtaaaaaatagatgtattgtgaaattggtgtagttatgcaacctgatttttcttacaattgatttttggtgatggagaaaaacatatgcttagttgaacaacataaggttaaagagtgttttcttctgaaaaggaggttactttaatcccctataccaatttgaagtccaatttccttgatctatctattttgattatgccatttatgctttatgtaggttggcatatgagcagcttgtgttttgtgatatatttcaccaaaaagaatctggctggagggactgctcattttgtgggaaggtgagatggtgacctatgctgtgaaatgtatgcacatttttggtgctagattgttctgcaacagtaactctaaagaacttcactattccagcgtctccattgtggatgtattgcttcgaagaactcctttgatctacttgatagcggtggagttcaatgtgtcacttgcattaaaaattcagcagttcaatctgtaagtttgtttgttgcatatttgtatttcttttccaaattatctgattgttccttttttttgtaggttccaagtccagtcgtccccaagcttttttcatcccaaaataaccagagactttttggcaaaagcgatgatttattgtctggtagaccactggagacatcctcccttatggtcgatgccagaaacgatgatcttactattatcgctaagaacaaccttccattcatggtgaaaaacgtagaagctgggcaaagcagtaatattttgaggcaaaaagaactagagaatggtgcgaggcagattaaatgggaactacctacccttagtatcggggacatgggaaggatacctttcctaactagatctcaaagtgcattggagtctcgaagagatgaaaataaagacccaactacagaaagcacgacaagtgaatcactttctgaggcatgcctcaacatgagcttgggaattgctagtaatggaaacaagttggaggctacttcaactgtggaaagacctatgctatcaccaacaacaggatttcctgaaggaagagagcttaccactgcattatctccatttcagcatgcacaaagggctcgtcattttctgaccagaccgccaagggttggtgaaggtgctgtttttgatccaacgaaagatatgcttccgcatcttcgtgttgcaaggccacctgcagaaggtaggggccgcaatcaattacttcctcgatattggcctagaataacagaccaagagctacagcaaatttctggagagtatccttattatatttatcaacttcttggtgatattatgcataagtagctaacatactttgcgtataatacaatctctgtaactgatcaatcagggcgaattatttcatattgtgcatacctatttctgatctggatgctattttggttttccttaactatatttctcttcaagttcaaattccaccattgtccccctgtttgagaaggttctaagcgccagtgatgcaggccgcatagggcgccttgttctaccaaaagcctgtgcggaggtatttttttgttcacaaccttttgtggttctgcctcctgttaataaaattttagtgttgttacctcattactgatttatcgtttttgtatcatattccctattatttaaagatcctttgatacaaatgaggatcaggaacaccctcccatccacatgttacaaaaaacaataacctttattatgctttgacaagatctatgtgactatattatatagtagtatatgcacaagagttaggactagaaagaaatacagccgatgtggaacctaattttactacttcacgtaaacactgacatagaatacctgatcaacagagacctaggccattgttacacttgttagtattgttatgctacttgacattctttggttcccaacatgctcaataatcttatataaataatttatttaaatattttcatggttacagtattttgcaatagagcactgctactttacattctttgcaaaatggttgctaactactgggagtggggacaattgtttctcagcataactattttaacatatttcttttcatgtttgctgtcatcctgagttgccgagatacattttgtaggcatatttccctccaatttctcagccagaaggtcgtcctttgacaattcaagacgcaaaaggcaaagaatggcattttcagttcagattctggccaaataacaacagcagaatgtatgtcttggagggggttacaccatgcatacaatcattacaattacaggctggtgatacaggttaaatctccttggacatgatatcacctgttctttttttacaattttattactgatgcctgattacatataagcaatgattttcctattgcataccttcaaaggatctaacatagttcaaaagtacttcaaaactatttgggaaagcactcatggcagtaaagttgccagttgataggggaatctccttaagtattcacaaatgtctaaattgagtgtacagaatttgaaagaacaaattgacctacacatggaattgacagggacaaataggggtcctcccatagtcatttaattgtcacgtctaggtcaaaattcaatgcctgattaatatttcatggtcatatcttacttgttataggaattttgtgtggtaatatatttaaacatgctaagtagaattgttccatattaaatgtgatctcactgggaaggttttcatacttaatggtgattcttgttttcttttcagtgacttttagtcggatagaacctggagggaaacttgttatgggcttccggaaggccacaaacactgtcagtttgccagtaagttagattttcctaacattcttcctactaatttattttcctgcaaatgcttgtttcactttcctttttcccttcctttatcaatgtttttatgttacttctgtacaggactcacagatttcagctattgccaacggttccattcttggggatacattattttctagtacaaatgagaatttagcaatagtaagtggttattcaggatttcttcagtcaataaagggggctgcagatctccatacaagctctatatacgatcatcatgtgaactcagctgacggggatgttagttggcttaagacagataaattcggcagcaggccagatgaggggtctttgcagtttttaaagagaggccgcaatattggttccaaaagcaggaggctttcaatggatgctgaagaagcctgggaactaaagctttactgggatgaggttcaggagctgttgcgtcctgctccaactgcaaaacctactgtcgtgatgattgaggactacgaaattgaagagtatgatgtaagtttgctggccatttcattattcacgtttgtgggaaacatgaaattctgacttcttttttctcagccctcaggagaggccttggaatgattgaatttaatctaactatattatacatatgcagaaaccccctgtgtttgcaaagagatcaatttttaccatccgttctactgggtaagaaccttattcagaagataccgtttagtactctagttttcatcatgaggaaaaccataagtggtggaaataaaacaacaaaaatattaagcgattgtttagatttcaatagatattgccttggagctgtatggtattgatatcattttaaagggtttgccctctgcatagacaccatacaaatattctctgtgccagtgactaatttttgccaataccttactgtgtattttttagggaacaagatcaatggattcaatgtgatgattgctcaaaatggcgccggttaccacttaatgttattgttgcatccaagtggacatgtgctgacaacacaatcgactcaaaaaggtatgctgtttgtggaaaaacattctagccacactttcgtcatttgatagaactgttcattgtacatcatgattagctaactaaaattatttccaacatatttgcagctgttcctgctctgcacctgaagaattaacccccaaagaattgcacattgttcttcagcaatacgaaggtatccatgcttttcatatgcacgccttgatagcaagatgctctgggcatgccataatggacatttggaggctctgactttatttaaaaggaatttcgtgcatttcaggacatgttacatcattctaggaaaaaagaacctgcatatagcatatagcatgatagtgggcaaataaaacatggatagtctggtataataggcatctcttatcacaattgaaattgataacaagtatatagggactgggtagcacatactgcatcatttctggtgacaaacttgtaaaaaaaaaaaagaaaaatcaataacttgaatattaccacagatatgaggaggcgaaggaacagctttggttttaagcagaacatccccgaaatggatgcggtcagccttgatgcctttgccactgccgcagtctatggtgatgtcgggaaccaaggttccccttctgttgcgacaaccacaaagcacccccggcatcgccctggctgcacctgcatagtgtgtatccagccacctagcgggaagggcccgaagcacaacccagcttgcacctgcaatgtctgcatgaccgttaggcgtcgcttcaagacactgatgatgaggaagaagcaacggcagtcggagcgagaggaggccgaggcgagcaagaagatcgcttggatgaacagagatgagcctgagggaagcagcctgtcaagatccccacagacggttgacactacccgagacggagatgtgaccatgttcgacaaggttgacatcaacaagggccacatagacctgaacttccaccctactgccgtccgagacgaggagcggcatggcgggcagcctcgggtgagcatggtcagcctcctggaggtggccaaccggccactggagaactacatgaagcagaacggcctgacgagcttggctggggagcaagggagctccagcacatgtacaggtgcagccacggttccgcagccggctctggtggagagcgaagagcggacgtccaacaacgacggcgggcgtgtggcgacggcagagcagccggagagcatggccgtcgacgaggctggagataaccagccggacaaggctgccggtgactctgctgctgctttagcttgagcttgaggctgaccgtgttgagtgtgtggatggcaggatgggtattgaatttgttgtgtgtgcatcttatcggcttccccctttttttacaggaacagcagctggtgagttttgatgttgagaatctcatagggtttcattgtgttcttgtagtccttcacttgctttcttgtgtaaacacacgtgtagaaggctgtatgatactgactgtaccttgtaatttttaaccacgaggctcaccttatttgctcatacctcggtgggcagctagttgttgtatgtatccaaagccaagacatccagtaataactcacctgatttgccgctctaaaacccaaatggctctacagttctcgaaacttaggtcctgtttattggagcttctgcttaactctgagaaacgtctgatgtaaatttagaaaagctggtttccgctttctgacttaccgttcattttttttaaaaaaatgtataactacatattcgtagaatcagctgctcactctgacaaacgactgataagaatttagataaactaggcttcccaagtcccaacttctaacttatcgtttatttttctagaattgcataactacatattcctaaaatatagacaagaatttagatggtttggaaaatctaaaggttttgaaaaaagctatgttcagaggtgaaggttgagaactctgtctcctatatgtaaaacggaacggtctattcgtgcacgattaattaagcattagcttaaataaacttaaaaatacataaatatgacatttcaaaataacttttctataatttttttaaaaaacataccaccgtttagcaatttgggaaaacttgggaaactagtttactaaaaacgagaaatgataagttgagaaaggtgaatgccgggccgaagatgatcttggagatgaggtgaatgaagtcatgaaacggcttagaggctaccaaaaagcccacacaacatcagcccaaaatcggtcacaaaaggaataagttcatcttaggtcccttaacttgtcaatgaatccgatttttgtccctcaaccaaaaaaaccagacacaatggattcctcatcaatcgaaactagtgcagatgaggtccctcggtggttttggctgatatggcacttacgtggctattttgactcggtcttcatctgacatggcgcttacgtgacaattcgatccggaaaataataaaaccctatgggacccacatgtcagttccacacaaaataataaaaaatggtgggacccacgtgggccccacatgtcatccacgagcggctggccggcggatacgccgcacacgtcgtcgacatccccgaactccgccttctccctcgtcggccacggcggcggcatcatcctgctctggaatgcggtgaccgcgccgcgctcctccttgtacgttgtggcacggatgccgcagctctgcacccgggactggatcccggcggcggcgcccctctgcgcctccacctgcccttgccgccttgacggttgccgcttggcggctgctactgtgctacagaccgcaccccgcagctgctcccaggaccccggcgaccggcgaccggcgccccttggctgctccaacctgccgacttgctacttctgcctgccgccatgctctgtccggaggagtacgagaagggggtagggggtaggggcagagggccacacctcgccataccgagccatttgcccctgggctcaagacgaggcgcgcggcgaagacggaggagatcctcgccgccacggagaaggcccaacgccgacgatgccctcctccacggcgccgcttccaccctatggccccgcgcgccgacgccctcctcgacgccgccgccgcttgcgccctgtggccccgcgcgccgccgacgccctgctcccgcgtgcctccgccgccagtcacggccgcttgcgccctggggcccagcgcgccgccgccgccctgctcccgcgcagctgacacccaatcgctgcaccggtggcatcctcaaacccgtcgccatcggcgtcgtcgtattcggcggcggcggggaagcaggtggggaaacgggagctcgcccgccgccgcccatggaagaggccgcgccttatctccgccggtgatagagagagatgggggagagagatgaagacggcaggagatggcgcagagaggaggaagaagaggatgggtgatgatgacatgtggggcccacgttggccccacaattttttattaatttgtatgagaaactgacatgtgggtcccatagttttaattgtttttccggatcaaattgccacgtaagcgccacgtcaatgccatgtcagatgaagaccgagtcaaaatagccacgtaggcgccacgtcaatgccacgtcagatgaagaccgagtcaaaatagccacgtaggcgtcacgtcagctaaaaccgctctcaaaaccgccgagggatctcatctgcaccggttttggtagttgagggacccgttgtgtctggtttttcggttgagggacgaaaatcagattcgttggcaagttaagggacctcagatgaacttattccgtcacaaaaacaagcctgcaccgagaagccaaccagccagcccaatgcatgttgcatggcagtcacattccacatcacatgcttcaccaccatagccggaagcaagcaaccaaggaaggaataccagatcccgcactggcgtggcgtctcaaaaccaaggcgaccgaggcgagcaagcaagccccacactcgcacacacgccacgccaccccctcactctcctcctcttctcttcaaccactggtgtgtggtgtgtgtggttctcttctcacaggtagaaggaagcaatggcgatgccgcccaagcccggcgatcagccctccccggggcggagccccaaccccaacct

SEQ ID NO: 62434 - DNA, 2223 bp, Oryza sativa
ccgccgcaccaccggcgcgccagatctgaggtggccttccgcttcccggacgacctgggcctcgggggcggcgcggacggcgggggcttcgacgagatcggctccgaggacgacctcttctccaccttcatggacatggagaagatcgccggcgccgaccgcgaccgcgccgccgagacctcctcccctccccgccccaccaagcaccgccacagcgcctccttcgacggcttcgccttcggggccggtgcgggtggccccggccctggccttgggaagcagcaagacggagcaggaggcgtgttctccgaggttatggaggctaagaaggccatgtcctccgagcagctggccgagctcgccgccatcgaccccaagcgcgccaaaaggtgacgacacccttcggattctcatgctatcttagacttgatttgctggttggtaggattattggtacctcttgcttttgatgaccaaccaacgaaatatatatatatatatatatatatatatatatatatatatatatatatatatatatatatatatacatttattgtgtttactcttgaattagtgagactttattgtctagatatagcattagattttgcaagcaaagaaaggtggtagaaaaataaatgttaacagaaacaaatcatttcatagtctattgaggcccaatatatggtgctagtggtctggaatctctatggatagtgaaaggcagcttgtacgataggactgcagcaacctgaccaactgaattggatgtcctgaaggtctcgccttcctcgcttacgcgggcttctttttggaacgtaagcactcatagaggtggttgaaatgccaatttcttgtttggcaagttgctttcttggaccaaaaagccaatccatgttgttttgttccaaaataagaaggccttggagcgaacgacatatgttcgttatgtgcaataattttatatttactatgcaacacttattagctataaattctctacccaaaactgtttcttttatcaaactattgtgctgcaaccaagttatacaatatttttttttgcggggaagttatacagtatttaactgcgtatattcattatatagggtttaattcatgtcacttagtaaaacctttcctcatttggccccacattctcttctctcttcaacagtattttataacaaaatatgcttctgtatgtgatgaaactgcatataataattttacttattcaatgataacatggttgcaatgtcaacactgttctattttgtggtttgtcttagaacaaaaaactgcatcactttgtttagtctttaaataagctgtgagcgcaaggcgaacggggcagtagtgggaagcactttgcttttgtgtttcttaagcatgcactcttctgatactctttcccccttttctcaaggccttctttatttcatacctaagggccatatatgcagtgaacttagcatggtccactttcttaaatatgtttttctatttgaaaataacagagatatttttttccattagagaatcaccatgtagtggtcttttaatcaaaatgctgtactacaatcaagactgttaacgcacaggttcatggtgtacggtcatatatgcaactggtactataagagcaaacttttgtgcatagctctacaacttatgtagtaataatcattatattcaaagacagctctcctcgatttaattaaccatttgaactttataatgttaactaaatcatttttagcaagtgcattgtatcagctttctgcagctcatgagtaaatgtaaaatttctgagcttgctttggtgcagaattctagcaaacagacagtctgcagcccgatcaaaggaaaggaaggctcgatatataacagagttagagcggaaagttcaaactcttcaaactgaggctaccacactgtcagcacaactgacactatttcaggtaccttttatccatttgtttgtctcatgggttgcagtactactactatgtttagttcatcagtgcaaaaacaataatgtgcatagtaaatgtgccttttgaactgtattgaacaggcagttgtgccacttactagtacatgtgctaaccaaactgcaacttctttacaattaagtggatcatccattagtagaacaatttatttgaactgatgcatatgccatgataactacttcctccgtttcacaatgtaagt

SEQ ID NO: 62435 - DNA, 2659 bp, Oryza sativa
ttacattgtgaaacggagggagtataacacatgataggattatgtgactagctttatgctcatattggctatagcacatgttgtggaaaggtcgaattctcatccaaatatattctatatggttggccaataatttgttgagctgaatggtggtacctaacaatgaaaatgtatgctctctattgaccaggactattaggttctagtaacactgtattttttttttactctgttcactgttgaccagtattcaaagtttgtgatcatgcccatatttttgtattaaaagctgtgaatatccttttaagacgttttgtttttctgggcagagagacacaaccggactttctgcagaaaatgctgagctcaagattagattgcaagccatggagcaacaggctcagctgcgtgatggtgagcactctgcccgtacatctcaactcttgattttcgttatttccaataaacttgtgttgaaaggtagctcgttgctgtaggctggctgcatacttttagaagatatcttatcaacatttgctatttcttgtatgtaagacattgtgttatcgtcgttttttaatgcaagttttatcatgcgatctcaatcctttccattgtttactttggtaaatctaatcatttgtgagagctccaacacttagttaccgtttagcttcaatagaaatctttctgcattacttcacaatggaactagctaaaattttgcactgctggtaagtgccatgctctattgctgaacataaacttatactgaaaactgattcatcattttagaggataaagctctgtcatgtaaggaatattgagatttctcaagctattagtattgacattttgaacaacttgtgaacatctgaaacacagcatagattaggatacgtgttgtttttcctgctaatagaaataccatattgtttcgcagctctcaacgatgcactgaagcaggaagtggagaggcttaagattgctacgggtgagatggcaaagtcaaatgatgcgtataatacaggaatgcagcaggtcccgtacagcccttccttcttccagctatttgaccaacacgcagttcagcaccatgcaggcgttcagcagctgccacatcaattccaacaacctcatccaagtgtccctagccaccagatgctatcccacccaaattccctctctgatatgatgcagcaagactcgcttgggcggctccaagggctggacattggcaaaggaccagtggctgtgaaaaatgaggcagaggtagtggtgaagtctgagggtagttcaatatctgcaggtgaaagcaacagcacattctaattatagacctacatgtcaacaaattgctccgtccgtttagttttctttgttcatagtctgacatgccttcctgaactgcttccctctctcccactagtttttttttttcaattcaattctttcaattttagttacattgtttgtttgttgatcatcgtgtggctgatcatgtagagacttagatatgctcgtttggaaacatcgggtttatttcttgtgtgttgtgtgttgtttgatttagggggtgaggggcactgagtgggtttccagtgacttttatgtattcttttagttatgttgtagacttgttgtctttgaaaatatgtacatttttgtgttactatgctaattcttaatgggcccgtactatgaaagtgtggaacagtatcagctgttgagaaaatggcgtgttgtttcaactatttttatctttaaaagtggcttatacactttctgaaaaccaaacatggtctaaattggaagtacattatggcttaaaagtggcttatacactttttaaaaaccaacatggtttaaacttaaatacattatagctgaatgtgattagaacgtactggcaatgcgagctatgcatgcaaagtactctctctctctctctctctctggttctttattgtagtatagttatttgctatagagaagctacaataagaaaccacatcattacttatcttttagtatcttcgaagttcagattatcctatagtcttttctaccctgtattagtcttttgctgtccagtttcatattttgcaaagagaaatatatgaccgatctttaaacttggcagtggtgtatgatctttttgaatgaaccatagtatgttcgaacctctttttgaccaggttgatcgctgacgcggtaacgatatatgtaaatttttactaagatgtcatgagacttctagtaaccaagtaattagatcggagctaggatttgttttttcatgggacgatactcgtgtccgtcccataaaaaacaaatctagcactggatataacatatcttagtacaatgaaatatatcttactacaacgaatttgaacagactcttgtttagattcttgtactaggatatgtcacctatacattcctatgttttttttaaccgatggagtagattttttttgtccattcaaaaaaaaaaaactaaagtagattttcttgtagtgagtgcagttttatgtttggatccgcaaataaaaaatatataaatatcagtactgctgcctctttcatagtctaaaaaaatatacactttacacacaatcaattaggggagaagataaggtactcgcaaaatctt

SEQ ID NO: 62436 - DNA, 5210 bp, Oryza sativa
  unsure (1)..(5210): unsure at all n locations
tgaaattacacttaagttggcacaaatgtgttgaactcattttggcttgcaagatcacatatttttcagcattttaacatttctcatatatttgtcttccacaagttttttgttcttccatatatatattttttgtcaatgttgtattttgagaactgtagccatacccaaaacaacatgcttttgtgatcggacagagtacctattttattgtgccttattaaaaaaatccacacaatatataattcttgtgcaaatgtttacattccacttttagaaccctagtagagttattagcagtcctatacaatgtttagcctagtgatcacaatgccttactagcattccaatgttaagagtttgactacttcttgtgggatagatattttcggggctagattaaaagaaagaccccttaccaccatgttgctttcagtgttacacacctgcaggcgccttcgagtttttttctcgattctgcagcgagaagtttcctctactgcaaatacctcctaggaggtcctcccctaggactgagtttttttcccagtgtcatgcttaacaactatagcttctcgacaatgtgtgagactctgagattgacctaggggcctatggtctccactattgctaacattgaatctagataacaactaggagtataccctttctttggcattgctttcacccactctactttcacaacctttgttacaccaatatgatttagaaaattgtttcatgacttcactctttttccatcataatcacataggtagcaacacctatcattagtagcatggtccatattatcatggcatgaaatcatatgaataatccatgttaaataaaaaacatataattagaaatactttggactcagttagctttagttgctttaaaaattaaataattaatatatttagaattaaatataaatctatactaatcttggactctcaatttagtatacgctatttcattaatccaactctaaatttcaaaattaataattagctcgttataattgacatggactcttcttttagtttagaatgacataatccgagatataaccaacatttatagtgttaaaattttaatatctttaacatcattattactagcatgtgcaacatacatcgagtttcaactcgtaaaaactaacttgtttcaatgatagtttgccatttgtcatcgtcactctcgcaaggcggaaacccctagtaatgctagtacgaattaattaacaaacaccatgctttgttaggtgattcttaaccctagtaaggcacggctttgggcggaatggtgaaggaaagagaagatagagaagggaaggaggaggaagcctaaattgtattgattgcgcaccgacgcgccaatagggctaatgtggcgcgcatgcgtaatcttatccaaaccttttgacgtagtacaccagtagagctgatgtagcagggtatgtcataaccttacttaaactttttggatacaaccacatacatagtgtttccatgttgttggcatactagtagggctgatgtggcagattgagcatgcgacaaactcatccaaacttattggagccattgcatacacatggtggtgccatgttgttggcgcgcaatttgagctgatgttgcatgcatattgtaaccttacacatactttttagcgttgtcgcacatggaatagtaatccattttggtagtgtaagtagggatgatgtggctagacatgctttgactctaattgtccctttttttttgccgctatcacatgtgatttaacggtattattcggcaataccaactttgtcagagtagtcaaagctagtgttttaaaaataacatgataaggtgtttgttttctcaaatattattaaaaggagttttggaataaataattccaagaaacatatctacaccgcaaacaacagttttgaaatattttttatgtgatcacaccaaaactcttcaggaattaaaggattcattttcttatatttgaaactgaatgcctatctatccataccaaccatacatcctcgaatgacccccagttttggcatccatatccacttcaataaaggcagtagccataaagaatatatatatatatatatatatatatatatatatataactcatagacaaaaaaaaagaaaaagaaaaggcagatatcaaagtacactgtagcccctactgatctatataaaggcgagacaataggagagagcattgggccccaaatccagatctcttttgagttttgagacacaaaaccacaagagaaaactcaaaactccaccgagaaacggaagggatcgatcgaaaatgaaatcgtaagaagcaaataggtaataagattttgatctctcgctcttgcaaaaccccctttgatttcgctcttgtttgatgatctgatgattccccaaacatggcagcttgaaccagtagtagtagtagtaagctagcgatcgatggcggcgtaccgcggccggcgggactacggtggcgggtggtggtcggcgtcggccggctcggggaggatgacgctggcggcggtgatggcgacgagggcgccgcggccggcgtttatccggcgggaggcgatccgggcggcggaggcggccgcggacgaggtggtgttacgggtgcaacccacggaggaggcggagcggacgcggcagggcatcatcggctacctcaagctgctcttcggcaccgcgctcggctgcgaggttcgttcccccccaatctcatcgcgagcgttttctccggccggtgtcggcggcggcnganctactccgaccgccgccgccgcgccgcatgatccgccgctgattcacttttttttttccttttccttttcgcaaacaagtgccgtgccgcaaacaaaaaaaaaagtagaataagcactcgcttgtgggatgatgagttgatgggcgcttccgtttcggatgggatcgttttttcttcttctcgatcccaatcgcgggcggcgtctttggggtttggtgttagatgagttgatgagcgcgtgtgcgcttaattaatcgcttcgcgtccagttttgctgatgagctcatatgtcgctttcgtctttgctccgtttcggtgattgcgattaggactaactggtagttaatcggttcttattctcgtacccatcagctcatgcatcgagaggtctttttctaatgacatttgtttgactaaccagtcctattctattactcgagtggctccaaattgctgtgctgagcgagtgacatcatgtcgtcatgtcagtttttgttttataaaataagagaagctattatgctttggcctttttggtggtggctttttttactagcttagatgatctaataactttttacctttcaccttagcgtaaatacaggcttcttttcagcaaacatgaacggttaaacccttccttttcactgtggtttgtagctttttatttatttattttaatgacagcaaatgtatcatttctagctctattgaaggggaaaaggttggctatctagcttgctcgtaaatgtgcttgcatgcatgcaatcgggtgcggcgtggtttggtcaactgtgagctcgttacatttcttggtgactcatcagtcatcacatgcttgggctaagcaagcaatggatacttgtttatgccgccgtagtgaaatcctctctgcatgttgtacttgtagatacagcaggattttgattcttgagccggtgcagtcatagtgatcttgcactttacactatgttgcattcagcattctctaagatggtgtttctgtttgatgatttcaggtctttgcatttggatctgttcctttgaagacctacctccctgatggggatattgacataactatacttgggaacacagctccggacagcactttcattagtgaggttcgtggtatacttgagttagaggagcaggaagatggtgctgatgttgcaatcacgggtttgcaattcatcgatgctgaggtgcatttttgtatgacatacttctgttgagttatttattccagagatagtttgggtatagtatgatatggtcatatggagcagtaacaatgttttttacatttttccatgtctttacattagtatcatgcatgatctcttaagaaggcagagatttaactatgtagttcttacctctacatacgctactgatatatttttatacaccgttttaaaatactgctgttgcttttgcatccaggtaaagctcatcaaatgtgttattgacaatattgttgttgacatctcgttcaaccaaattggtggggtgaccacactctgtcttcttgagctggtaatacatggaaatctgaactatctgctccatttggaagtattcatcttgaatactgcccagtaatttcaacaaatatagcgtgcaaaattgataacaaagttgagtatatattccttcttcaggttgaccatgaagttgggaacgaccatctgttcaagaggagcattatgctaatcaaggcttggtgttaccatgaaagccacatactgggagctcatcgtggactaatatctacttatgccttggaagttcttgttctttacatattcaatatatttcacaaatcgctgcatagtcccttagaggtacttcttggtagcataacatttttcacaatttttatcagcctctttctgagatgggtggactaaactttttttttttggatgaaacacccaatggcttttcagcagtttagtaagggaatttacatagggactaaaatttttgcatggtaccttctttgttcaaacaggtcttgtataagtttttggaatattttagcaagtttgactgggataagtattgcataagtttaaatggtcctgttcctttgtcatccttgcccaacctaactggtgagtcatactcaggtattcttttgctttgtcaagtgatcgccaagcatgtacttactggtctaattattataatccctgtgacagttgaaccttcagggatacatgatgaattactgtttggccctaatggctcgtgtgatagacttattgtacttaaaaaggattctgatggatctaacatgaattttcgcccgaagtatctaaacataattgacccaataaagtccagtaataatcttggcagaagcgtcagcaaaggtcagaataacctggaggctac

SEQ ID NO: 62437 - DNA, 34030 bp, Oryza sativa
  unsure (1)..(34030): unsure at all n locations
tttttacaacaaggtctcaggagacagtttcagtagccactcaccattttcccaagagaagggcaacaacatgaaacgacactacgactgtgcaagagaggaatatttacccctcggtagatcatctatggagcaacatatttatgcgaacaaccagtcacaaatattgactccctctactcgtataaatactttggatatttccaattcttgcccagctgagacaaataggagcgatctccatgaagaaaaactgccactttctcatttttcaccatcaaatttgttggatctatcaggagatctggatttgcacttagaatgccttcgaaaagttcagtaccacctggagtccatgtttgattggttgattcaggaagcaagtttttctggcgcagtaaacaatgactccttcaatattccaacccagagcagcttctcaaatactgatggaagggctctaaggccattgttagtttcatctgcttatacccagagagggaacctatctcgagtttactgttcgcatagcacaagagaaatttctcagaaatcagtatcacgcactgaggtccaagtgaatgcggtttgtcagcagaatgtggcattgccctctggaacaaataacagattggcgttgcctccatctcctgtcgctgattctgagaaatctccagtttctccgctccataacacagtggatattgttgggacgcatggagctggcatgcatactctcaatgtaagaacctttgcagctttgttcattaactttttgttgtccactgtttcgaattagtttcgctttcaataaattgactcgattcttgtttgtccatatgcacagaatgtatcattgctttctggaacagatgtattatccaatgcattcgcacagctttcatttcctgcagttaattcagttgactataaatattgttggtcttataccacaacaaataatcgtgcgacatcaagtcaaaaaacaaaccgtgggaagggtggaactggcacatacattcccagaatggtgaggactcttgggacataatctactccctctgttccaaatataagcgtttctatgcattttatctggagttctggatggaaggatgtctagatacattttggaaaacgtgcagaaatgcttatattatggaatggaggtattatttcttgtgcatgctccatgtttttaaactttgaaaagtttttgtgttgtgtagatcaactaattattttattgttccttatgcttcaatattggcatggaaagctggaaatgagcttttgtttaggctacacacggaacctccatagtagtataaattataaatcatgtattggtgcattcttaataaatccatgtaatttagctattcacttgttacagaattatcatacttacaaggaacgcatattctattataatggaagaagccagagagaaatgttaccagatcggccgttcaagattaaaactaacccaattggctacattcgccggcgcagttcgcctgaaatgggatgttcaagttcaagcaatggcggtattacatttgaaaatacaagtcatacaccatcaaagaaacaggatcactcaagcaaaagtacagttacagctgaaggaagttttgctcaggagagagcaccagcaagccaggaatggaatatttgcacaaacatgaacatggttgacagccaaaaacctggtaatgatgaagaccttgtcagaccaaacaatgaatcaagggaactacggacactccatccatcagaagtgcaaaacagggaaatgacggcatcatcatcatctagtgtggagcttcctcattgtgttggcaatggtctccaagaatccaatacatctcagccatcctcacctgcaactgaggcttcttctccaatcaaaacatcactagtcgaaggtcttgagtttggatctttcgaacctatcttaggtactagttttctctgcgaaaagttttgcgaagaattcccacctctgcctgctagaaagtggcctgcagtagccgctgtttcaacgcctgtgactgtgagctcttcgcctgctgaaacaggaagcaagtacgtgattcttacattgcgatctcgtgttctttttgcatttcatgatacagtcgtgctgttgcattttttttctaattaaattgcatcatgtcgtgaataaatctgtaggccagaagggctctaccaactgagagatgaagctgacttccctcctctcaaggctggtgctcgcaatggatttaatcatagagttggaagatgaaggatgctttactagcttgcttcaggagaagtctgatatcgtacaaagcttggatgctattccaatcgtaatagcatgctttcagctgtctgaaactccaataatccttagtgatacaatcattaggtctttaagtgttaactcctggtaggagccttaattgtaaaagaactagctcatctttttagcttttataacccgaaaaaaatgtttaaaaaataaaataatacgaaaatgctcacaaaaaaagaactaccacctttgtagatccgtcgttttaactttttaagattaagagaagaaaaatgatggagtacagtgtttaggtgcacctattgtttctttgtgcttcatcgtgatatatttaccctttgcatggtatttgttgaagtactacctccttcaccaaatgtttgatgtttgaacttaccaaagtaaaaaaaaataaaaagaaaaaagaaaagaggagggagtataattttctctgataccttttactttgtacagtgtactgactagtgaaccgatagttgtatacaagtcaatatggcacagcgattataagtgcctcacttctactccatccgcatgaggctgatccctagacaagaggcagaatgtggtggaagtaaattatccatcttgcattacatcctgcagtgaattcttcaatgcgtcttgagatttctttccagtggagtctctcagatgctgaagtttgtcacctaacagtccagctttgaacacaacaaaagcctgcttcttcatttcccaaatcagagaagaaaaacagagaaaaagaagcagtgcacagaatggcgaagttctgcagaggccggtttaatgcattattaaaaaaaaaagccagcagaatacaattcccttaagataaaacaaaatcagccggacacatttaggtcctctttttcagggatgaaaagttttgatatgtcacatcagatatacggacacatatttaaagtattaattgtagtctaatgacaaaaacaaattatagatttcgtttgtaaactgcgagacgaatttattaagcctaattaattcgtcattagcaaatgtttactgtagcactacattatccaatcatgacgtaattaggcttaaaatatttgtctcgcaatttacacacaatctgtgtaattagtgttttttttgtctatatttaatacttcatgcatgtgtttaaacatttgatatgacaatgtgaaaagtttttttttttttgcatggaaactaaacagggccttagcttccgtacattttctacactatctattttcatagccactacgagtgaggtgaacaagatatgttatttgtttatttattgaaactaagtttaaaaaacatttttttttagtttatgtaccatctcattttcacagccgctggatggacagaataaattatttatttgcatcctgtacagcaaacggcgtcaagccaccaataaatttacaccacaagcttgcaagaaaaaccttacgtggtttgcttgcacgaacttccccatagaaacgggaaactgcattctccacaaagcaaatttcagtagacctgttgcctcgaccaaaatggtggacgattcatcaggtctaatttgagtagatactgggtgcttccaggaaagcatcaggcatgatgctcttcatgatcaacttgatgcaacggtgacgccgggagtgaaaatatacattttgcagtcatgcacgtcaacttgcgccccaaaagttccaacaacgttctctgatagagtttcatgctgcaaaaatgcagattcagaatgcagttaacatataataaacaaaatgctgacaagataaggttttgacaatggaatcttgataaactttgatctgtctttgttgcgtcagtagatactacactatgctcatgcttattctatgatgttaatttgctacacgttttggtggttggatgaaaaggatatatgtggtgaccatttttctcctctctctcccccaaatagtttaatatgataagcaacaccattttaacccctttgttttctccactcctctcttgtttcaacgggaaacagaggtaaattgaaccacttaaaccggaaattatttaacttaccttccacagatctctaacagaatagggagatgaaccatcaaggcctacagatggcaattttactataatattggcagactcctcacagcggttccataaaacaacagccagacggttaccagagagggggccagcccacacctgcaaacatgatatatcagtgaaaaggaatgccctgatgtgaagaacttcacaaacatgcatttgtaatagtttaattccacacagcagctaatctattctaaaagctcaagctgttagtgtggttgcatgcgttattcatgctccgacggcccaaatgagtatatgattaagatggcagaactgcagttccaactgaacaatgcccgaacactacaagtctattatctaccccaagtagcttctaactagcatacaaggccctgtctgaacaggattctcaaagggatgtcataggaaaacccatcaccagctagtggggtggctgctaccgtccctatgaaatttcgatggactctagagttaggcaagttggggaaatatcaaatatgttacaaaaacatgctctgttcaatatcaaattaaaacagttgctatactattgtgtgtgtaaattgctcatgcacaaaactgttatagttagtgtcttgcaattttggaaaagaaaaaaaggactgtggaagtaaaccatcagggcagaccacacagtaataattatatttgcatactataattactaatggacatgtatatcacctcttggcatccatttttcccttgacctaaaattcttcttccttgaactccaagaggatctgcagaaaacgaatgagtgcagtttaacgtgttaattaattattacaacagcatatacaaggagaaaaaaaaatttgttcgaataaaataatctactctaaaacagatatttacaatatgtagcgtaattagttctgtacagttttttcctgtcctcaggtggaacaaagcaagggaaacttgcgagctctcaggtccattggttcaagcatcttgttcaaaaaatatacatgatatgcagaaaactgaattccaaagagcaactatgatgctaattgtcttagtgcatgatgaaagttttgctgctgaaatcaaattcgctttcaaagttttaatgccattcatgatctttgagaacaatgacattgtagaaataatagaatggtttaatagaaaactatcttgaagtttacacatgtcaacataatagagagcgcaaacaaaaaagattcagtgtaataccttgatttacttgaattacttctttgttgctcaatatttccattgtttctttagtcatgtttctgacatcgcaaccaattaagagaggggcctgaaatataataatgcaggagccaaataattttaaatcacatcatttgcgctacacttctatccacagaacggtactgaaattcccctaacgtcaagtagcataaaatataaggacaaggaaaaacacttgaaaagaaactaactcctttttttcttttcagaaacccttttcactacttgatccagtaacagcacaaataagttggagtcatgaagaccaaatgcaacatactggaatataggtgccatcctagtgattacagaatgcacccaatgagtacttgccttcataagtgcccagatgctaaaatgtgcacgatactctgcaaaggtcatgccaccattcccgacttccagcatatccgggtctgataaaaaaaagtcagttgaatgatagtacgagtgttctcttgcagtatgaaaactggtggaaaacttgtgctctttgctacacagttaccattccatccaccgggtccagcatatgatgcccacttgttattcttatcagcaatatcagtcatgcttgttttcaaacagaagatcacaagtcagcttcacatcaatgtatagataggtttcacccaaccccaaacacttaacccgaaatacatgaatcaccttttccatgtatcctgtatgtcatctgttgtgcgccaactgttaccaactttgccagcccataaggctggatcatcctggcccctaagagaaaaaatagtataatagcacatcatatacatctaaaccaacatgatatacaacccctagcttctctcgtatgataaaggtgcataccattcacatagagagtagaatatttggcgtccagttgaatttaaagcatcacgcattggaggatacctaagaatatgacaccatgaaacgaattttaatgcgttatattcagttcacataactgtactcatgaaagaggcttacacaatgagaagacatttagtttacctgtccttgggctttattcccaaattgtagcagttgtcatacttcaggtaatcaacaccctggagaaatcaatttccatagaatatgctcttaaatcttaacatgttcatactgtgtagtatttcaaatcaataatttattgcttctagctcatacccatgaagcaaatattgcagcatcgtccttttcatgatggagcgatccaggtcgaacttgacatgtaaaaatcctgaaagctttagcttgttataatttttagttatttggaatattattcttcatggtgtattaacaacaaaaaccatctatagagggctgcttactcacccagcatcagagtagataccaagctttagacctttcccatgcacatagtccgcaagatctttgatgccagaagggaaagtttttgggtcaggtagcaattgatcctacatgcacaggaaacaatgtattaaaaactaaagaggtaaacttgtaatgcatgtatttatatggtcagtaatgcatttgtatttgtatcagtacaaccaaagaagactgttctgagtgacgtcctgtccaagctcgttaaaattatcaaaagaccaaagcattgacatatttaggaacaaagtaattggagaaatcacagcctaaattagcaaatgaaatgcattaccttttttcctctttttacattggaccaacaatcatctgaaaaggcaatgaacagcaagtaaattagaggataacaacatacttgcttcagccagtaatatataactcttgagccaagtaatgtaccgatatttacatagttgtagcccaaatcagccagccccgtcgagactagtgcgtcagctgtttcatcagatagaagaaaactttcattagaagtacatggctaaccaaactctactcttaagtctgaacaaccgaaaacgcattaggaacttgtcaattgttataaccaaacacgacatgagaacatgtcacttgaacagtgggtagtaacaattccattccaatatccaacctcaacagtgttctattctatcattgcactctgagcagtggaagtgtggaagatacaacactaattaaggaaatatgtatcctccaatttccagttcagacaaggacttccaccatatcaggggaggaaaaaaaaaactgcggtgcagaattgcagatttaaccatgaaaattaaggggatcccgcggctgaacctgtgtcgcggatgaccgtctcgttgatgttgcaggcgaagaaattccagctgttccatctgcgccacagaaccacaggcactaataaatcacgcactcaacgcagtgaacgacgatgaattacacgcgcacgcaacaggcgctggacaaagcagcagcggaaggggaacgaagcgaagaggcgaagcattgggccgattgattgaacttaccccatctgcggggtgagggcgaggccgttgttgagctgcagcttgccgtagttggaggtgtcgtagaggcggcgcagcgcggcggtggggaggggctcgatccgcattcggctcgccgccgcggcgaccgccggcggcgagacgacgagggccaccagtaggaggaacgggaggcggaggcgcggcgcctccatcccgcttcgcgaagcttaccgaacactccgattccttcctccctccctccgaattccgagcagccgtcgttgaaacagctgtgcaggcgatttccgagctcgttacggctgccgtttatatgcggcgaaattgtggggcccacatgtcagtgttctctgcactcttctgggacccacctgccattgaccgtaccataatgctgctttatccagtcacaagattatgtgttttgacgacgaaaaataatagtttctcgaggggacaattttataagtacacgtggcagcagagtccagagaaccctcctattggtgtcgacatggatgttgccaacacgacacatcagaatgtcgtcgtcagctataacaagataagtaattagcgcattgattaattaaactttaaaatagtttaatatttactttttaagtaattgttctgtaacaaaaacttttagaaagcgcatagcatttcgagaaacttacgtacgagagaaaaaaaaaagagaaatctaccgctgtcgaatgcaatctaagcactgattttatttgtttggtcgatgtgtaagcaacacacacgtcgcgtgacttgcgcgaccgtagcgtttcaggtcagagatcagtcgcagttgcaatcgtaaaatctattgctaatcgcgctatcagcgatcaggtgggcggattacgattacggaaggatacgtgaagcgggcacgcgaactgaaagcgacgggcatcgcagtcgcagcatccggggacgcattggggcgtgacgtgccaggcagcccaaccatgaaccaaccaactacactcgtgggtgcacagtagtctacctttgtgcatcgaccatatttcggggaatattcttaagtttatgccctgtacgttaaaaactcttctttgttttcgggtactaaggttgggactgaactttgctaatgggcctaatgcacctacgagggtgtagtttagataaaagtccccagttgggctgcatttggtttggattttcatttttttgcttagtagataaaagaccttgaggtttgcattgcacttaacaccctgtttagatcccacctcaaaatttttcaccctatcacatcgaacgtttgaacacttgcatgaagtattaatatagtctaaaaaataactaatttcacagattgcgtgtaaattacgagattaatcttttaagcctaattgctccatgatttgataatgtgatgctacagtaaacatttgttaatgactgattaattaggcttaataaatttgtctcgcggtttgtaggcggattttgtaatttgttttgttattagattgtgtttaatactttaaatacgtatacgtatatccgatgtaacacgccaaaaaaatttaccattggatccaaacaccccctaagcgaagtgagagcaaacatggttttggggtaaaatgagtatgggccaccgttgggttaagttatgggccttgcaaactcatggagactttgtgagaaaataaataagtccacttgactccctcattattggtataatatgattcgtatccctcaaccgtaataccaaatatcttaactccctaactattaaatcggtgcaaaataactctctttaattttgatagtggggggatttaaatatctagtattacgattgaaggatacgaattaaattggatctatattttaagagagtcaaagggcatattcggcagttgctttaatgccacgctctgacactaactatgtgcaaccgtagctgcagctggccctgccaaacgctctcaaagtggacttagggtgtgtttgaggagtagattggggagattagaaagatacgcaaaacgaggtgagccatttgcgcatgattaattgagtattaactattttaaatttcaaaaatagattaatatgactttttaaagcaactttcctatagaatttttttgcaaaaaacacaccgtttagtagtttgggaagtgtgcgcgcggaaaacgaggtgttttctcatcctatatcatacaaacgaacgcagccttattatatgagaacgaaacaaaggcccatattgtttacgacatgaacgattcgctgtacagcccactctacctcgttaccacttacctacttgcctctcctgatacaaaaatctactcagatttttaaaataaatatttaaaagggacatatataattatatcagtgttttgttctgcatagttcaccggtctaactcattcaatggaaattttaataatacatttcttaaaggtgaacagcacctcaatggaacatctcaaacgcttgtgtattctgaatttctgacgaaagagttgcagagtacttgacctttgttcatccccagttcgcccatgcctatgttggtttcacgtcttcacgatcatcacgagtggctgcgcaggactgcgaggaatctgacggggctctgaaaaatcagatggcgaaacctttgttcgttgctgttggtctcttcccaactgcagttctcgcatccatgaccatactgattactgaaacacacattgccctgcctgcctttctctttctccacccacgtaagcaatgcagcattgcctcggcgtcgatcgtctgagatgccgattgattgcaactttcaactgaacaacttattatagcacgtttgtactatgcaccgcactagcagaagaatttaattcttgaaactttaggttacagacacttttggctcataaatttctcccaagaatccattgagtacattcgattgcctttcagcgaaaaagaaagaaaagctctcaatatctattgaattttgacaagtggatgtcccaaagaaacaacaagaacacattcttggtgattgcatccactgggcacaagaaaggcagggtcccattggcaggaggatccatcttttctcctttctgcaactgggctcacctcagctccgaggagcccacgggtaggtacatccatcatccatgcagttaggcctgtgccctggaaaactgacagatcaatcttttacatggcagggaggtttttctgggcgtctgtttcttcagcctatttctgcataccctggccccctgcccagaatcgttgcacccttgtggaatggagtgtagcaatggtgaaaactgaaattgaacagtggtatgtcacagtgcgcctctggcctctgctgctgctctgcattctagtggcagtgaagtgaggtgaggtgtgtagtgaagcacgattactgaaggactgacgctaaggttgacaacgatgtttgtcctgttggattcttggtggattactgtttggttcacctctcagatgtttaacagccaaaataataataataaaaaagtctactcctactcctacgtgcaagaatttttgacttaagcagaaaatggcccgtgagatagcgagagtagacgtgactatcggtaagtacacagaaatttgtgccatgatcctatgcgtacggtagtcatttagtacgagtaaacaaaaaataatactcatacttaaaaaaaaataaatgatgagcctttccagaggagaggagagaaaaactctgacgcgaataggcctactccaatctgtaaagacagcatgcgtcgattcccttctgaaaaataaagcgcgatggatgcccccgtgacacacgcgcgtgcgctcatccatccttcacctttgcatccgcagcgaaatcacggcgaagcatagcacgatcgatcgagcaaacgaatcaaacattttttatcaaaccatcttgcgatcgatttgtgcaacgactatcatcttaatcataccgaattcgatcatcacatgcatggtcactctgtacagggcacgtagcaattaatcttgcgttttgctggtacgtacgtagtaataatctcgatcacttgatcgggctaggtgatggcggcgccgccgtggcggcggcggcgtgcagccacgcgcggcggaacgcgccgacgatggcgcggtggtgctcggcggcgttgagggcgaggtagcaagcgagaagctcctcgaggtcccgcggcgagcgcacgtcgttcgcggcgatcatctccgccatgctctccaggaagtcctcctccgggtcggccgactccttcaccaccaccaggctctcgtacagccaccggcaccgccgccgccgccgccgcctccggctggtagcgtcggccggcagcgccgccacccgccccttccgcctcccgctgctcggcttcgcgtggtggacgaaccgccgcacccttgacgtcggcgacgcggccgcgctcgtgccgctgtccagcgcgtcaccttcgtcgccgtcgttcttggcggtggcgcgcttggtgaggatgggccgcagcttgagctccggcatcgccttcatcccgtcgaactggccgcgcgccggcgacgccgagacggcgacgacgtcgaacacgatgtcgtcgttcggctgcgggctccgcgggaaccgggtgtcccggagcttgtggttgtccgtggcggcgcgagccggagggagacagcgttctctgctcgcgaagtagtacgacgccctgttcggcgacggcgagcacggcgccgctgccgccgccgccgccatgggaggttgctgcttcttgctcgccgcttcgacgacgtcgggttctcctctcgccgcgcttctcctccgccgcagcttgtggaacagccacgagctcagcaatggcatcgtagctgctgctgctgcagtgaggcagtgtggtcgtggactgtgggggtgagctgagctgcagtgcgtgcagcgaggttgcaccccactttttattacggaaaagtttgccgcgagtggcagcaaagagatgttgcggtggaaaagcggcagcggcatcttgcaagaatctgacatactatacaaattctctcttatatttgtgcttctgaatcataatcaatacgcttgtaaattgttggaacgaaaaagatatgttggtgcatgatacagagagttcagagttcagactgctctccagagcaaaataagaaatgtagaaattcaagtgtttgtcgacgctttgtccaccgatgaaacaccaattttactttgacagagattcatccttattagtagattgcatgcaacacgcatggcacaaagtcaaaatgtttgaaatggaggaagtgtgcgtaaaagctgtgggggactctctgacggcaagggaaaggatgcagagttgcagaccaagatggtgattcagcttttcgctagtggcattgtgagacaagcctgccgtaacaggcgtttctcattgtctctaatggccatcgctgcagctaaacctcgagtccaggacgatttggcacatgagctgcagcaggagagcccaactgcatgctggtgcttatggagtgtgaaccaagtcatttccagaggcagctgctaggtagagctatgatatggtccatggagggtttggaaggggacatgaacatttcaaaaggtcaaaatttggtctaccacgaatcactgtattgaaatcaaaagtgatttgctttgatcctcatgtgggggcaacttaattaatgcaattggcttacggttgtattagagaccacgtagtgcaggtgcagcccaaatggactctacagttgcatttgatttgtagcttgcttccatcttacagaagacaacatgcatgtacgcaggagaaaaatccaactacaaatgtactatcattcggtttttcagaacgtatttgaactctcaaaaacagtataccaccctttcttttaaaaaaaatataatacaaacacaaagcgctcacaacacgtgtatgcttaactctatagacgtatacacatacactctatctttataaacacctccaaaaaaaatataccgtcatatcttaaaattaatgaagacatcgtgaatgtctcgctatccaacgggtacaggggcgaagccaaaaattacataagactagagctaagataaagctcgactaatggagtattagttttctgaaaaaaaattacatagtgaatcaataaaatttaagcaagtttttggatgtatgccttgccctaggcctgcccccacccctgaacggatatgtcacctgtacggctgtacaattataaattggtactctaaattagtacgggaaaggttcacaaaaccaaactgtcgtaaaaaaatgccctagctaggaggatttttatgggttttacgaaaatcgtttgaaacccatcgactaccgacttaaaaaactctaatttattttggaacttgatcggtttactgaacagtttgtgatcttgagctggcccgaaacctcaatttctatacgaaaaccgagtgatttccgtctgttttttataccttggcacggggtgatccccgaaaaatccacataaacaatcagctatactgaggttgatcatgcggtggaagagacaaatgcatcttttttttcatcactgtagtgattccagaacatgtactgcaacagtaacagattatttcgaacctgcattttttttacacaaaacctacagaggctgttgttctcgatgtctacaatgcaccagtattgaactgctcatcagatgttcagacatgtgtgcacgcacagcaaccggtagacattttttttactgcagactagcagctagctagctccagtgacgaactagaactactgctcacccacgcttgtctgcaatggatcagtaaaacagctacagtactataggagctcctatgcagcgaacagttcacgtactataaaattcacgattctcgaatatataatctgtatacatgtgtcttctaaattcttctgctgaagcctgaagagatgatagttttgcgagagccaagattagcagatagaggaatcgtccgttcttaatttctcgatcgcatcctgagcaggatgagcaggaaggcatatgatcgcgctgatgatttcgctgcgcgttttgccggggcgacgacgacgaggctcacctcacggggggatcattctgccagtggttgcggggacacggcgagcttatttcaagagactggacaagcgcggatcagtgctgctcgtaccaaagtttagttcaattcgtgcggtgccaccattccatgccaaaattgtcgattacaagttgccgggagcaagcaaccaccgccctagcgagttagcttcgatacctagctatctatgatcgatgagatcaaaactcatagtagtagcatggggaactagtagaaacaaaaacagcaccctaaattcctctatcggagcgacagagtacagatgcagagtttggaggtatgcaagtagataatgaataattgagatggattgatagtgttcgggcgcggcccgttaggtaggaagagataaataattgttggagtaggtatagttgaaagacccgtgccatgattgtagctttgcaaatcttactcgaacgccatcatcattatcctttctagtgtatataactatagtgtgtgtacccagcggccggatggatgacaagtttatatgccaaagtaaagtttaagactttcagtcatggccggggtttatctatcattggtggtaatcatgcagcggataatcttatactctcctacatgcatatattatcttgctgacacacaccaccagctatagcactacgtagtgctagctttctgctggtttgatcgattagtaatacgtagcagaaatccagctagcactgttactacttgaatcttaataagcagtagtaattcaatcgatttctgctggattgatcgattggatgtgtaacaatgcaagacctgggttcctgaaggcgacttaaaaaggaaaacagagtctacctttgcggcggcgtgtggtgcatttctcgtactacatggtacttgtacagtggtgatgatgtgctgatcgatggagttaggagtaaatttgtggacagacgatgcaatagtacatgtgcagggccatgagttaatgtcgacattgaattccctgtccaacgacggtcggccgaagaagaacactgtctgtccagccatgcacatgtgactacatacatatatcaatcttctgtgtacatgtgtacacacagtacacgcgtatacgagtgtatgtgtgtaggaacgtatctatacgtgtcgtgtcgagtgatatacgtgtgctggttaattggctggtcaggaaatatcgtgcgtacgcatgcgtatatcaaattattcattcaagcatgcatgcatgcatgattccgagacgacggggaccgggcgatggatggatcgatggagcgagttttaggcggacagttgggtgcccgaccgcgttctcggctttaaaatctgccgctttccgcatgcatgcatgcgccgatccgccgatcgatcgaagccgtgtgtgcattgcaaccgcgcgcacgccatgcaaaccgcccgccgcttcaggcgtccgcgcgcggagacgatcgactcgatcggcctcgtttactccgcacgtacgagccgtctgcgtcgtcgcgcgaggaaataatatatattctccggtgtcgtgggcatgtgatgctcgatcgcgactcgcgagtggccggagatgtgggctttttccggtgtccttgggcgagacttgggcagtgggcaggcaacgacgtcgacgcatgcaccgatctggtcactgccatagaaaggaggttggccaacgcgcgcactgggcatgtatatatattcagtgtcacctagtgcacagtgatttctactctacgggccggctctacggcgtttgatgacttgatcgatcggccggccgtgccatgatggggcttctgctgcatgcagtgggcgcaacggcacacatcacatatggatctcgatcattcgagtctagagaacaaaagcacggaggattggaggaatgaaggcggtcgagagaggatttgggggagttcgagagcaataagtagctagtgccgacttgcatccggccaccgatgatgcgctagtatgtgtacgtactacggctgttttaccaccggttcgtatagtacgacgcgatcatgctcgaccctatggccgaaacaatcacgtcgttcgttggcgacccatgctaagtgatgctgccaaggacagtattattacgcgccgctgtgtgctgtccatccgccgcccgcaaggtcaacttttcacgccgcctccgcaacaaattgacccaccttttcttatgttccatggaacctgggccgtgtgagcttgtccctattttttttaaggctattagagtaggttaacgagtcacgttagtaaaaaccactgttaaaatagataacaattatttggttttgctagaaatttgtcgtcaaatttttttcttaatatttgtcgatttttctaacggtgcagcgcgccgttcgtacgtgatatcctcgttggtggcagcggttcgtgacatgcatgtaagtgatacatacatacgtacggggaagcagtgcatgtatgtgacccagtaatgtcttgcacgtatctttttatgtttttactatacaacaaaagcgattaaatgttaactctacttagatacggatgagagaaatcccgtgacctccactgagcacgagaagcgtacagttacgtgcaaattacaatgtaattacatataattatactgtattcacatttgaaactaaaatataaaattacagtcctatataactaaaattacatttgtaagttcagttgatatgatatgtaagtgcactgtaattacactatatttacactgtaactacactatagttacagtatagttacactgtaagtatactatagttacagtgtaactatagtgtagttacactgtaactatagtgtaattacacagtaacttttagtagatgagttggtgatattttttttgcgaagtaaagatctaataaataaaatatatgcaatatatataattaatatatgttgatacatatataaactcttctaatcaagtgatcaaatgagcctaatccaactatctaaaatctgtgtgatttggacccaaaaatctgtggcgcgatggatagctaggccccaattattttatattgattttaatagttgagatgagcgatacactcggtttttttttatggaggtataccagtcaaatcctacctaatttgagggagccacagtagactttttcctgcataagacatctccaaggcctacttagccctggaccaggtctgctttattcagaccagtccaattcatcagttccgaatgacgagccgcacttatgggccattgggcctacggtgaacatttcctatgacggaacatttcaaatgccgaaaactgtctgccacacatttaaatgtggggttcactttggcattttttttaacttttagagtacacagaagagaggacgtttaggatggtaataacgagctaatagttttttaaatagtctgcaaaaactatgatgcttcgaacaaagtacagatatacaaattctcaagctgtagttagctagctagagaaaaaaaataggcaaatataaacgagacagctttcacgctacatggaagcctcttacaatccgttcaatccgttcagcttgctagctaacatagatatgtaagttgatcaattattgatcgatcatcaggtcgttttaaactcccctaacgacaaataacattcaacgcaaaattttgcatttagatttgtcacatatacagcatggctcctgctggttaaatgttttaaattggtatatactgcatatgcacgtactcgatctgtctaattttgcattttaatttgctttgctttggccgtctgtgctagctatgaactcatttcatcgtgtcctcccactctgtcgctcgcctgctctgcctctacgtgaactccacctccacccgcaaatccactatgcattcgcctcatcataaaactcaaccgattcaatcaaatcaacaaccaaatcgatctcaaaaccagcaaccaacaaacgcacattgcgaatgcacaattggtggctagcccactagtccttgataatctactgcatgcaacgcccaagaacaagaagaagaagaagagatatggcgtaaagctcacgatcgagctgtgtcgttagtggcgtcgtatcattgcgtcgcatgcgctgcggttgatcgatcgatcgatgccgtcgccgtcgtgttgcttgcagtgcaatccatgcggtgggatgctcgcgctcttcaagaggcgcccgcgggcgctgctccgccgcgccgtgggcaagatgaacagcagccggcgccggcgccgccgcgcggcgggcagcttcagctccgtccgcgcggtgttctggccactcatgtccatgcgctccgacgccgaccgcaacgacgtcgccgccgctgaccggccgccggcatcgtcgtccactgacgacgacagcggcggcggcggcctgcgcgcgccgtcgccgtcgctcgacacgcccgcgtcgacgacggccgctcgggtgctggcgctgcaggcccagctcggcgaggccgcggcggcgtcgacgaagccgagcagcggtggcgacgacggcgtggaggaggcgtgcagaagcttcgagaagcatctgatggagatgctggtggaggagaggaaggtgagggacctcatggacgtcgaggagctcctgtgctgctgggagaagctcaggtcgccggtgttcgtccagctcgtcggccgcttctacggcgagctctgcatggacctcttctccggccgcgacaccgacgtgtcatccgactccgaggatttgtctctctgacatccacggacagaactggggtttctttccaactgacaggtggacccgggtgtggatatttttgtggtcgtttaagctgtttctgtgttttgtcaatccgtggaatgcctatcctacgtcaaaatcgtccatcaccatcataaaatccttcatcaccttgtcaaattacactttcggtgaaggatatggcacctttcaacttccagttcgaggggattttgtacctttacctttgacctttttaattcaaaattctgtctcagcacatttaagggggaaaaaaacttcttacgaaagcatgcgagtagtagattcatgggtgtacagctgttatcactattgttaaaatcctaatacacatgaatattatgcttttctataggatttaaatgaggtcaaggcctctattcctttaagcatatgttaagaaatgcactcgcactcacgtatgtgtatcataggcggatcaggagtggtactggtggttccgggaaaaaaaccctagcccaactgcccaatacacgtatataaatatgtgagaagaaacttttggaaaaagaaaaaaaatcccttattaatatgttatgatgcacatttgatcaatttatatctctaaccttgttatatttagggtatttaaaaatattatataagttgaaccacccatattaaaaatcctagatacgtaattgatatgtgagtgtacagtgcgtctttcaggtaaagaaataaaaatgatactacctccgttttttaataaatgacgccattgattttttctcacatgtttgaccattcgtcttatttaaaaaatttatgtaaatgtataagatataaatcacacttaaagtactatgagtgataaaacaacccataacaaaataaattataattacgtaaattttttgaataagacgaatggttaaacatgtgataaaaagtcaacggtgtcatctattaaaaaacgggagtagaacttttttttctgtgcctagtatcctcttaagctttgattggaccttggaatcagacttcagcaggtgtctgccttcgcgtggcccttgaactagagagcccaattattaactgggcctttgtttgggccttatacaatctacagttacataaccaaatcaccgcgaattgtacacatacgtagtgaccagtgaccacatgtttgatttgtacttgtcaactgacatcgacctaaccaatctaacgaagtaactatcactgattaagccatatgtgaccaaattaagaaagcttttatcttagagttgcagcagcagccgctatactggacctgtccgagagagtttctaccgattacaacttttctcataatcaaagactttatgaaatagtctaacttttttatctagattttaagacaatatagttatagaatttagaaaaataaactattagtcaaaaactgaattttctagtttattcatattctcataagttagactatctgtcaattctttctaagaatcacaatgaacatttaaaaaaaaattaggacagtctttttttccttgacctatggtggcttttgagcagcagcagagcggcggctaggttgtaccgttgtaccgttgcagcctaatatgccacagctatcgcaaatgataagccagcctgagaatcacatgcaggcttcagaagtactcctttcgttttcgttctaaattagttgtctttttaccatttaaattttatctcataatagttatcatttttaagtcaatcatatcttatttaaatttattcttattctaccctcaattatgcttatatgctcaaccatgcattatttgtattatagttttcgatcactcgttctcttcggtttcagtggagctgaagtccatctttccggaagaccgtttgtgatcatctgctggcattgctgcttttggggacttgctgggagtttagtggggctccgccctctcttgctctaggagtttttatcctctttaactagtccttaaacaattcttttccggttttttcttcctcgtcccctggcaatggctttctagccgtttatgttgtgtaaccaaaactctgctttcttctagtatattgacgcgtgaactttttgtgcgttcatgaaaaatttgataaaggcattataatattttactccaaatcttagcatgtagtaccaaaaaatctagaacgtcaactaatttgggaaggaggtagtagtatttgtaggtttggtgcagagcaaccggtggcaggttgcgtgcatcttcagaaaagaaaaaaaaaagctacttcctctatttcatatcataagactttctagcattgcccacattcatatatatatatatatatatgttaatgaatctattaacatatatataaatatgggtaatgataaaaaatcttataatataaaatggaaggaatactagctagtactgtacagtcgttcagattggcatctttagaaagccatgcgttcatagtggactcgagcatttctagtgcaatatgttgatggacgtcgatggatcgtagagacgtagacaaatggaggttagtacgtaccttacaatttattcagattggcatcttcgagaagacattttttcatcttggactcgagcatttctagtacaatcacgtcaatggatcgtactagagacgtagaaactagtgtcatatatggaggctgcctaatgattgagtgaacataatcatgcgtgatgagtgtgtgagtgacaagttggaaattaaaggatccatcaaatgtcttgaacgagattacatcttcgttaagtgcagtagacgacccaacggtagctgaacatggaggtggtaacacgaacaaacgctaccaatttcacccgtgcagaaacacagcaaagtatagccaagctggtgaacggatttgacccctaatctggtcgattcccaactgtacactgtacagaagaaacacaaaaatgatattccactagtacgcaggttagcaacgacacgtgagcatcacttgtcctctaggatcagggcaagtttccaaagcttcacatgcacatggatggacacacacgacacataggggtggacagaaaaagaccgaaccgaaaagatcgagaccgagaaattcggtcatcaattcgatcttaggcagtgaaataccgaattttgttcagtcaattcggttagtcttcttggttaatcgaatagaccgaataatgaaaaaaggcaaaattggttatatagcatcgaaagttcacgtttttggttttatagcactgaaagttaccggttcactttaatagcatccaaagttcaccctgctcccatttttagcacttccgtcaattttttcgtccgtcttaatcgttattgatccagccacacacatgatatgacatttctactcctcattaatatgcattatacttgtacttgtgaggggtacaaacgtcatatcgtgtgtggctagatcaagacggacggaaaactatcgagaattgacgtaagtgttaaaaatgggaacatggtgaactttgggtgctattaaagtgaaccggtaacttaaggtgctaaaaaaccaaaaacgtgaactttcgatgctatataaccaattttgcctaaaaaatgtctaaatgcaacctacaatccactatgtttaataggattaaactctttttttcatatccctacttcttctagtcatgcaacataataaaattctttactcataagcgcacacgaacttttgtgtggtttttgtgttaaaattttcattatttctttgcatatatgaaaatgttgttgaattttggtcaggaggaccgagaccgagatcgaatttgtcggtcctgacatttttacgctgaaattcggtcttcacttttcaaaaaccaaaaagaccgaaaaccgagaccgaaattttcggttagaccaaatgcccaccctaaccacacacactcgcatgcatctccacacgtggtcggccaaaccaaaaccacaacccgagctaccaaccccaacacgcgtagtacgatcgctgtggaccttagagactggcccatgctgtgtgtgactgtggatagcagcatgctgcaaatcgagcatgcatatagcgccgaaagtgtcattctgatcacgcatcgatgcatgttccttcttctgtgcagccatgtgagatgaagagcagagaggaaaatatacgacaaggttgttgtcatcaatgaagctagtactgctttcattcatgtccgggattgcgattttgccaatccggtccttaccgtcgacgagggacgagaggcacaggaaaacctggcgagttttcggggaccaaaagctgtaggattcgtttcagtcttgagagaaacgttatttacattgtcgttatcgttggaggcacgcgttgcgatgcagccggcggcaacggcaacatgcagacggagccatgtgctgcctctcgatctctttgagacgagcaggtaggcactccacgttgatagaaacaatggaaatggaaaggattggtccgatacggcgcggcgatgcaactgatgttaacgctctggtttctggaggactacccaacagcatccctcatcttaattctgctaactaaattggaccagtggatcggatagtccttgtcctttgaatgaaactgatgctaccctttttctcaaattttacaccttgttttctactaaacaatatgattttataaaaaataaattctatataaagattactttaaaataattctatatattaatcatttttttaaaatttttttaagctaataattaattaattaatcatgtattaatgagtcgtacgttttcatggtatagaggtgtttctaattggccagtccaaactcagtcttatagtatcctatcatgtaaaagtgttaatataccattatatttatattaagtttcataaaactacaaatacttttgttaaattatcacataactacaattttaagataatatatcataaaactacagatttaatactaactttattatagaactacagatttaaggttgagtgttgtaaaactataaatttactaacaaaattatcataaaaatacaaatttagcatcaatttagacaaaactcggatgtttataattcaaatataatattagtgctaaggatttaaaccccgaaatatgtaattatgtgataattttattgttaaatatgtagttttgtgatacttagtcttaaatatgtagttttctgataaaatctgtagttttgtgataatttgatcaaatatttataattttatgaaaattactcttgtgtatattcacagtatattacaaatgttaatgtttatatatccgtacaaaattcaaagagttgaaagataccatgatacgtgtcattggcatgtgggtctagaactcagatgtcattcggttattttcatatagtatgatggtattttgtaacctacgtatatctgcaatggtttttttaatatataaaaaaaatttagcatacaatctcctctaaaaaaaatattaccaagcctgggagtgccggatacgattcgcttcgcttttattcatatccatgtggcgtggaacggatcatcgatggcacatcgcgggatgctcgaggagatggccatgtgttcttggtacttgcttgattctttccatcttttctttatttgattgtagaaagaaagaaacagctcaaacttgtgtggccggcacggctgtattaatgttctccgttgcatcagagtcatattttgtcgattcttcaagtcctcttctggtcgtcgtcctaaaagattagtagtagctcgtttggcatttgagatgcagacatgggttgggtgcagaactaggggaatgcttttctgtcttctgctgcttctttgatttcttcagaagtttcttgcacaccaatgtgtatagtagagaagccaaaaatgggaatacgatctcttgggttttgtgctgttactagctccttgttcttgccctttcagcaagcaaatatgagatctttgcagctataattaatcaagaactgttctctgtaaaaataaataggagtccacttttggaccagtcactgcattagaatgtaaacaattctttcgctttcacaagtttacataaggttcggcatgagtaagatcacatttttctcgagacataagaagtggtaggagtccatctttcaaaaagaattggtgatccgttatcatctattcttttcgatttggacctatcctctcctccctgccaaactctgaactgaccaaaaaggtttggatctttttgcattggtttgaggcaagaagaagaagaggttggagtgcgaattccaccattaacgcaatagtgatgatctaggggaggcttccctggtctgcattacattctgaaagcaaaagctcattgagtcggcacttcctgtgctgtgatgcgagaatgtgagttcacatgcttttgtccttggacccacatggcctgccttggctgttccattcggtcatatgcccaaaaagctctcgttaaatcccctacctgctgcactttgccatccatcgatttgattttatatgatgcaacttggtgttatcccaactttgtaagtttagtgtgattatctctttgaagcttaggtagaggagtgagcactagtagttgattaataggatttgtattgtaagtgtgatactgctccaccacacgtgtctatatcgcttccttccattccatcacctcgcattcattccaattagtgatcttgaggggctccatctgcaacttttcaccttggatatatttgcatccttgcttttcccagctctcctcgccctttccccttcttagagctgattctctcgattgattacctagtactactgcaattcacattgtcagctcttgcttgttcccaggtgcgtcctctatctgtgttcaatcttgttcttggcctgcagaatctatacaagttatgacagtgtgttgtatctaattcatcttttcttggagcaggaggatcagtttcttgctgagcaatggatcctgagttcgggagaggcatggcgcctcgaaaggtgagagagctttttccagcttaagccgtggtaggtgatatcaatccggcagctaagctcgaaccaatgcagaagtgactgaggcagagtgacctttgctgttgctgcagagagagccatggcggacgacgctgctgctggcgtaccagagcctcggggtggtgtacggcgacctgagcatctcgcccctgtacgtgtacaagagcaccttcgcggaggacatcacccactcggagtccaacgaggagatcttcggcgtcctctccttcgtcttctggaccctcaccctcatccccctcatcaagtacgtctccatcgtcctccgcgccgacgacaacggcgaaggtaacctctctcaagctgctgctgttttgtttctgcctgcaagattctgaactctgcctctctgcagtctgcagaagattcttggtgagcttatgtgttgttgttgcgatttggatttggcaggagggacgtttgcgctctactctctgatctgcaggcacgccaatgtgagcctcctcccaaacaggcaggtcgccgacgaggagctctccacgtacaagctggagtacccgcctgaagtggctaacaggtctcgaatcaaggagtggcttgagaagcacaagactctgcagactgctctgctgatcatggtgatgattggaacctgtatggtcatcggggatggcgtcctcacgcccgcgatatctggtaatcttcagactgagcttttttttccccctttggttactgttcttcgaaaattgcgtaccttgtttggagaaaagagttgcttacatttggctctctgctatttgatttgtctgtttgcagtattctcagcggtttcagggcttgaactctccttgtccagggatcagcatgaatgtaaagtctcaactctgaattctgaagtgcaattgtttcagaacacctttatgagtagtactctagctgtagctagttcatgtagtacttcctaatgatataaacagcctagcaagactgttcagctttgggtagatctttgttggttgatataatgaaaaactgtaagaacagccccaaactatacaaactgctgataatgatcatgattggattaggaatttttttcataaactgaatctgagagagagtaaggtggaagctttaaatgcaaaagtactaatacattaattctacatcacctgtaaccttcacattttttagcttccttgccatgctcatttatgcgtttttctgtgcagatgccgtcattccgataacatgtgtcatattagtgttcctgtttgcactccagcattacggtacccatcgtgtcggatttctctttgcaccaatagtcctagcctggttgatttgcatgagcatgcttggcttgtacaatatcatccactggaaccctcaagtttatcgcgctcttaatccctattacatgctcaaattcttgaggaagactaagaagtctgggtggatgtccctggggggaattttgctctgcatgacaggtaaagtgaagtatgcgtatgctgagataaagttcatcctttccctttgtaagttctaaaattgtaaggaaatggattattggatgaagttagcaactctgaaatgtttggcattgcaggatctgaagcaatgtttgctgatcttggccatttctcctacagtgcaatccaggtaattcgcttgtcctgaattttcagtccatgtgttccatggtttcattccttcattgtttctgtaaatcacaactctgaaccttgatttttgcagcttgctttcactacattagtataccctgcactgattttgggatacatgggccaagctgcgtatttatcgaaacatcacactctgaactcaacctaccaaattggttactatatatcggttccaggtactgaaacatcatcactattcttctgaactgaacatgtgtagcagttgatggttctgaagaactgcacctatctagacacactgaagttacagcatttcttttggcttatgcaaaatgcagagagtgtaaggtggcctgtgcttgtgctggcaattttggcatcggtcgtcggaagccaagcaatcatcagtggaacattctccatcatcaaccagagccagtcactcagttgcttcccaagagtgaaagtggtgcacacatctgagaatatccatggccagatttacatccctgagatcaactggctgctcatggtcctctgcattgctgtgactgtcggttttcgcgataccaagcatatgggaaatgcatccggtgagtatccattaccatcctgtcagctatacttcactgtaatttcagctctttctgatcacttcaagtatatatttcatgattaaaacaatgttcataatccgatcaaacaaatgctctgaacttctgcaacagatatgcattagaatttcattgcgttgcttagaatgtgagttgttgtgcaggattggcagtgatcacggtgatgctggtgacgacatgcctgacatccttggtgatcatgctgtgttggcaccggagtccggcgctggcactcgtcttcttcctcttcttcggctccatcgaggtgctctacttctcggcgtcgctgatcaagttccgggagggggcgtggctgccgatcatgctggcgctcatcctcatggccgtcatgttcatctggcaccacaccaccatcaagaagtacgagttcgacctgcacaacaaggtgaccctggagtggctgctcgccctgggcgacaagctgggcatggtgcgcgtcccgggcatcggcctcgtctacaccgacctcacctccggcgtgccggccaacttctcccgcttcgtcaccaacctcccggcgttccaccgcgtgctggtgttcgtctgcgtcaagtccgtcccggtaccgcacgtgcttcccgccgagcgctacctcgtcggccgcgtcggcccggcggggcaccggtcgtaccggtgcatcgtgcggtacggctaccgcgacgtgcaccaggacgtggactcgttcgaggcggagctcgtcgagagcctcgccaccttcatcaagctggacgcgctgtaccaccgctgcagcgacgccggcagcgggagcgagcagctcgacgacggccgctacgagcgcgagaacgcgctcacggtgatcgggacgaaccctctccggcgatgcctcagctacgaggcctcccacgacggcgtgtcctcggtggacgccgcgcgcagcccgaacgggatagtggaggtcccggcggcggcggcggcggcgccggtgacgaagaaggtgaggttcgtggtggaggcggcgagcccggaggtggagaagggcgtggtggaggagctgcaggagctgtgcgaggcgagggaggccggcacggcgttcatcctggggcactcgcacgtgcagaccaagccgggctcgtcgctgctgaagaagctcgccgtcggcgtcgggtacaacttcctccggcgaaactgccgcggcccggacgtggtgctgcgcgtgccgccggcgtcgctgctcgaggtcggcatggtctacgtcctatgacgtcaccacgagatctcatcgatcaataccctgtaaaaaaaattcaaaatcaaatctctctgcttgtataagaattaagaagcagattggaagaaaattgggcgaattttctccgatttttcagctgcttttttggtccgtgatgaaaccggcgacggcgagacgccggtcaaacactcggaacgggcaacgtgggctgcgaatagaaatcggcccatttaatgtccggcccatgaacgtccacttgatgcagcctgttcgactcggctgacccatgggcttgaacggggatcttttgtggaataaccgtccctcaactttacaccgagtttgtgtgacatcccttatcctcaataccagaaatcttcacccctaaaatatactccctccgttttaaaatatttaataccgttgactttttagtatgtgtttgaccattcatcttattcaaaaaatttaagtaattatttattcttttcatataatttgaatcattgttaaatatactttcatgtacacatataattttacatatttcataaattttttttaataagacgaacgatcaaacatgtgctaaaaagtcaacggtgtcaaacattttaaaacggagggagtataaaaccgttcaatctagctcctatagcagtatagataagtggttttgctgacgtggcaatttgacccggtccactcgtgctgatgtggtaaaaacgaaagcatgccccacctgtcatcctcattcttcacggtatctcttcccctgctctctctctctctccctcctcccctctctcccctgctcttggtctctcctcggctcctccctcgacaaggtgatggtggcggcggtcgttgcagccggggcggcgaggaggtggcgtgggggcgtcggctggggaccacgccaacgacgagccgacgacggccgacggcttgggccggcgaggaggcgacgccaactaggggcggtaaggaggcggcgtcggcggcctcggctggggacgtctgcatctgctccgccgactccctagacctgcacgcctcgcagcgaacgtcgccgtcgtcattggcacgacgagcaaactcaagagggagtcgacggctcgacgcggagcggccgtcggcaacggttagcggcggctccggtgacctttaggctaggcgcccgcccccgcgaaccaccgccgggaagctgctgcttctggcaatctggccgcacgccgacgagatggagcagcagtataggggatgacggacgacggcttggaggtagaacagtggtttggttgccgccttgcctgagggaaataagcgacgagtttaccttgctctttccctcctcggtgaggcgctcctggaccgcggagcggcggcgtggcgaggaagttgtgcgcatggagcgcggtctgggcaggggcgacggcgatgagctcccatgccgcaaggtaaactcgttgattggttaattggtgtcagaaaatctgaattttcagtctttgattggttaatcgatgttttttagttcatatgtttgctctttgatcggttaattggtatcggaatctaaatgtgtacattttggtttgttaattgaggtgtctgtatccagagctgtgccgaatgtccatgtgaaatttacttctgctcttatcatggtatccgagtaaaattgtggaggtggagtttcgacgcggctgcggcgtcgtgcacgacgacggacagcgtcggcccgtctggaggaaggcgacgcctctcccctcccccatcttccgccggccgcctcccctctccacatttctctcctcccgtcgaggccatggttgccgccgctgtaggaactgccgtggtcgtggccgcagagcccaccgcccgcccgtggcccagcgccgctccgcccgctgcccgcccatcgtcgctccgctcgccggcccccggcctccctgaccaaagaagagaagagagaagagagaaaagagaagggagggagaagaaaagagaagagagagatatgtgcagctgacatgtggaccccatatacttttttaaattctttttttctgactaggatgccacgtgaaaccacccagatatactgccataggacctttagtgcacggtttatgtaagcttaggggtacacatttttgattttgtggttaagggactttaaataatctcgttgttaagttgagggacctccggtgaacttattccatcttttgtcgtgcgtgcggcccaataacgagactgggacctatgaatattaggccgaaatgggatttcgacgtacaagaggcccataccagttagtctaaacgggattttgattacgtgacggccattttgtgtgtacatgcgtcccattttgtttggtccatcgatttatgtcccaggagtttcagaaagatgaaaggaataacaccacttgccgtagcttatctttacattgagtttaattaacatctctttaaaacgtaaaactataaatcttcacatcacatcttggcaaaactgtttaagataggtcccatgacattacgaatggctggttttcactaacatgatatcctaaccagcaaaaataaatagaaaaacatatagggccacatgtcagtgtcccacttctttcttttatctttttctgcaaccgcgtaagctgtttaggggtggcggtgagggaggcaatgggtgagcctatccgtgctcgagctcacggcgcctctatgcaagggaagcgaaggcgggagagtcaggaagaggaagaggaaggcgaccagcgagcctgtccaagctcaagctcgcccggcctccatatgagagaggcagaggtggtgggcaagcccatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62438 - DNA, 1465 bp, Oryza sativa
ggcggcggccgggtcgtcctcgccgtcaagcgcctcaaccagcgcagcctgcaggtcagtacagtatcagttagctgtactcccatctctcctccctctgatttgcatttgctcctctcgaaaattcgccatggtgcatttgattttggctagatttgtcaaaacgtaccgaatttgttcatcaggacgattgaatggcaaaagaagaacttgaagattttgtcttttcagcttgggcactgaccacatggctgcatgttttttcagagtttcaaaaaagaacttcgcttttactttctctagactacattcaagactcgtagcgtacaatcttcacagaagattcagaaagacggcatgcacttaaatatatatttttcggattcacacattttggtatgctaacactacagatttactactgctgaaaatgttcttcaaccagcaatagttaccaacaagcgatcctgatttggatttggatcgagacctaaaatcaaactcaggatattgttcttttgcaccgaaatcatatgaaattcttagcctcgtgacaattccaacaaatagataaacacatcccgtaggacaaggacacccacacatgtcaacttcaaccacagatcacacaccaaaccacgtgaacaatggtccggacagcatcccaagtcaacctactaaattccagaattcagaatcacgttataaacaacgtaccaagcttaatcacgccaaaacttgatgccagattgccagtgcataggacaaaatccatgcaattttcaattgttaaatcaaagattgcatttttttttaaatatcaacagattgaaagttatgtttttctttttttttctgatttcaggggcacaagcaatggctggctgaggtccaattcctaggtgttcttgagcacccgaatctagtgaggcttgttggctattgtgcagtggattcagaaacaagcaagcacaggctgctggtctacgagttcatgcccaacaagagcctagatgatcatctgttcaaccgagctcatcctcccctctcgtggagattgaggctgcagatcatgatcggcgccgcgcggggcctagactacctccatgaaggcctgcaagaagttcaggtgccctccaaagcattgtcctcctctctgaatccataaaactcaaaatatagatgcctcacaggatacattgtctgaattctgaaactctgaactgaaccattagtttagcacctgcggtagctagtagtaagccttgtcctatctgaattctttaatgttcaagtatgatatgatcaatctggcatcttcccaatatctgaattttgaactctgaaactctgagctggaccattagtttagcacctgtagcagctagtagtagcattgtcctatctgaattctttattgttcaagaatgatatgatcaatctggtatctgtcccaatatctgaa

SEQ ID NO: 62439 - DNA, 1119 bp, Oryza sativa
aatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcaagcattgtggtccacagcatctctttctccgaatctgggacaaagctctcatgatctccgcgtgcccttgttcttcgccactacaccgtactgacaggcacgttatcccgcacaacccaaccgctgtgacgtacatagttcttggcggcttcggccggggcactaggacgtccatcttcttccacttctgt

SEQ ID NO: 62440 - DNA, 1550 bp, Oryza sativa
cgtagccgttgccgtgggcggcgaggtggaagccgggcgggatgaggctggagacgtcgtagcgggagccgatcttcatcaccaccttgccgtcgatctcggcgacgtaggcgtcggcgtcgtgcagcatgatcttgagcgagctcgtcgccgtcacgccgttccgctgcctcaccgccaccagcgccgcgatctgctcctttaacccccaatcgaagaaatggtcgtagaactacatgtacatatatacaggcacattattgtgcaattttagatgactgatgagtgtatatatatgtacacacgtgcattatgcaagtttagtagacaactgataaataagggcaaaaaagtattagacggctaataaatagcaaaaaattgatgaagtattcaatattaaactttgactacttccttacttggaaaaaattacaaataattataaatatgttttactactgaagtctgtagggtcacaaatatagctattaccaaagtgtgtttcttaaaaaaatatttatagtcaactgaaatgacaataatcaattaatagtgcatgttattcgagagtcaattaaccaaataatcaattaatttatgtaaatgtataacatataaatcatgcttaaagtactttgagtgataaaacaattcataacaaaataaattataattacattattttttaaataagacaatggccaaatatgtgataaaaaatcaacgacgtcatctatttaaaaacagaggtagcagtagtaggagtacttacgatgcatgggttgccgggatgggtgaggatgtaggcgtagccctgcatgaccttgtcggaggggaatggccacatctgttgcgtcgagccagtgtcgtggttgtcgacgaaggtgacagcctttgccggccaccacccgatcacccccggtgccttcccctgctggtcgatcagccgccacagctccccctccaccgccgtgttcatgatccccttcgtcgtgaagtcgaacaccatccccgccgacgccgtcccacccaccctgtccacccagtccaccaacgcctgccggtgtgcgtcctgattgtactccggcttcccgtctccgccgtacgccatcgagtcccacagctccgccaccgccaaccccaccggcgttgtcccctcaatgtacaccttggccacctccggcgagtacccccttgcgaagtcgagccgccacgcatcgaagccaacctcgtcagacttgagccagaggagccagtcggtgagctcccgctggacgacaccattgaggtggtcaatgtcgggggcagcggcgaagtcggcgccggtgtcgaggttgcctgtgccgtcggagaactgggtatcatcgcggcagatcatgtgggggccccagtcgaggcggccgtcaggtgtgccgccctcaaagatgcagtagatgccgcggctgtccttgtagtcggcgcagcggtggttgatcaccacgtcagcgatcgcctgaatgcccttgccgtggagcgcgctgatcaacgacttcaactccatcgacgtg

SEQ ID NO: 62441 - DNA, 1017 bp, Oryza sativa
catgatttttgcacatccagtttaaatgtttagaaatgatatgttttcgtacccacaggaagtacagtagtagtttttttttattgtttttagaaaataaaaacatgataataaagtggcatattagttacttcggaaagtgaaaaaaaaacatatttttttcctggaaggagcttaattactagtactcattattacactaattatatatcattaatctttttttctaactgctgacagcttacctttgtattgcatctgtataagattagaatggggttgcaagattgattgacccttacgcatgtcagtgtgatattatctagccaaaaattcctcaactaaatcagtgaaacatctcattccaacccaaatgaaataaaggccaaagtgacaatcattatccacacttcgcaatcagggtagcttagttagcgtgctgtccactccacgcttgcaggatcccaaatttcgccaactccaaaatgttcagagtttagtttcagacaaggaggagcagcaggagaaaccgaccttgcgtggagacggagtgcgacggcggcggcagccagacgtgcgtgacgccggcggcgacgatgtcgtcgaccttccccatcagcaggttgtaccaccctccgctctgcctccacgactcccagttgaacccctgaagagaacgcaacagcttgttcagaaactgaactgaaatcggtcacaacttcagttcagtccgtggctggctgcgtacctggaagagaatcttgtcgccggaagccaagccgagaaggaggaggaggaggatcatggagaggcgtcgtccggtcgccatggcagcagccaggctagctctatagctcgatctctctccttgcacagaagcagggacactctgctctgaactctgaattgatgaattcagaagatgattacaggtgttttgatgattgcagaagatggctacgcgtgtagggtatttataggacgcagctgcggcagggcagaattgatgaattcttt

SEQ ID NO: 62442 - DNA, 957 bp, Oryza sativa
atataactgcctacagagcctatctatgtgctagccaggtgtttcaggaagtagtggattagacactcccccgtttgtctactcttcttcaggattaaaaaagaaccagatctaggttttactttggacgtttgcggtaaggatacatgatatcatccatggtgtctttaatgtaggccccaactttatttaagttccttgctacaccattagccacaagtccagcattcctctgaaatctgcaggttcatcgggaaatccgtcattcattaaattttgatgccgatcttaagggatctaaacataatctaaaacagaagaggaactcacttggttaagaaatcatctcctctctgtgcaggcttatatcgccgtggttggggagctgcagtgttatcaagataagttaagtcttcaagaatagaaatgaaatgtagatactttggacagttactcataacaaactcaaagagattcatattaatgcaatttccgaagtgaccagattgtttcaccaataaagtcaggaccagtctgagatccagtaactccgattaatgagaaattggtcatacaagtagtggccaggaaacatttctacacaaccgtgataaaagtacagtgtgctaccatgtgtgcaggttggtcacaaagggtcaacaagtaagggcaaaattggtctatcatgataacatttggcggtttcaattttacacaggctcaccaaaaataatagggataatcaaggaggcaacattcgcactcgaccattgttgtgcactaacaatcctcattcaaagttttttctggagggaacaggcaggagctctgccatttcattgataggagggaaacatcagttacaacgctaaaaaaaaaggcatactgtgtagaattcaggtatatgtataataggtccaatatctaaaccaactagatgtgacaacaggcaaggct

SEQ ID NO: 62443 - DNA, 1136 bp, Oryza sativa
  unsure (1)..(1136): unsure at all n locations
tggatgatgccctggacgcggcggaagtggtcgacgccggaggggatggtgatggcgcccttctgctcgaacccgaactcctcctcggcctccttgaggagccccacgaacagcgggtgcttcagataacccaccggcaccacgaacctctctccctccgctcctcctccgccgccgcccacgccgccgggccccaccaccctcaccgccatgcaccccttcggcggcatccctccccccgccgacgagccccccgccgacgccgatgactgctgcctcttcagcaagtgcacacccatccttctacctatatagatatgactatatctaatcgaagaaacgctagcttggtcgatcgatctctagctccgacgacgagcaagaacgcgccgccgttagagcggcgggatctccatggcggccggtgaggtggcctcgctagcttgatggtttcttggctcgaggaggagttggtggaggaggagagcgtagggtgcgcgtgtatatgaggaggccggtgactgcgcccttttgtttctatctgtgaattttttttttactcttttttactatttatgatttattgatttcctttttcttctactgtttcttttcctgcagctgctgattttcctggtgagaaataaatgtcatatctctccccataaatattactccaccatttcaggagtgatattaattaatccagaaataattatttatcttagctttctctttgggatgtttaaaagaaatgtgttttttttttgtgtgtagctagctgttggagatagagcaaggcactaactctacagctttgtattagctacagcggagagggcatctgatccctccgtagagtgtagctggccagtatgccctggtgttgcntaggctttgtgtgcttacaagtgtcagtgagaacaccatgtgtttgagatttgagaatgtggtaccatacatattagaattagttagaatccgtttaccatgttgtatattaactctattattcaaagcaaaatatttatatctttttttactgtaggtaatatctatatcttatagcttcgttaattcgaagtaattcatacatttattatacccacctacacctacctcggcctggtagtaac

SEQ ID NO: 62444 - DNA, 1160 bp, Oryza sativa
tttagtatttttcacattatatatatttatatagatttattaacatcaagatgatttctaaaaaaaacattaagatgaatatggaaaatgctaaaatgacttacattgtgaaacagggaaagtaataacaatgataatatcatagtattaatgagattttagaaagctaaaccgatagtatatactttacgcatctgacaagcatatgcagtcctatttatagtaggagaacaatgacttttgtttgtgatcaaaggacacgtgcggtttttccattgacggtacctgcattaaggtcaaaattaagcgtgtttcggttttgaagaagccaaatccaattttcaactatgcacacataactaccatttcgttcggagactaaacccagcaatttagcatacgtggtctaatcctaccatcgacaataataatataaattaataataacagaggaaaaacattcagcaacagtattactcacagcaagactttttaatcttgctgtatctgtaacagtacacccttcatccaaaaaaaaataatttcaacaacaaatctaaatatagactatgtgtagatttataataaaaaaattgattcttttaattttgaatggaaggagtatgcagtagtagtaaaaatatctcctagagaatttttattctatgagaacaaattatatattaagctcttttttttgcctatgaacacacgcacgcaaaccctacccctatgagcatcttcaaagactgggccggactgggccggcaaatcctggagagattgacgaagtaaaccctacccctatgagcatcttcaaagactaggctggactgggccggcaaatcctggagagattgacgaagttaccacaggcgcctagctgttgacgggtacgtcgcctaccactgaaagcacaacgccgataaatcctggaaaattcgctcccatggggagtcgaacccaggaccttaggtgctactgaggctcttgtaaccactaggctacaggccgatattaagcttttgaaacaaaaaaattggttactattaatattttgaagtttctaaatgatggtcaagaagttaatcgacttaatttaccctattcattttcatattacaagttgttttgatttttctaatcaagtttgtaaaaaa

SEQ ID NO: 62445 - DNA, 723 bp, Oryza sativa
atctttctccacttcaaatgtctttagtacatgtcagcctgcagttgctgtgacactacctcccactgattgtgaattgtgactggcaaatggtgacacccaaaacctctctttcctatgatgtgcttttcgaaactaccgtctcatatggactaaaaataccgataattgatcactagaccagtgtattcatgtcagcttttccccagatgtgtcacatgaaaatccacctcaaaatcgacaatccttaactaaaagccaaaaaggacagataaaaaaggtaggttaggacatgtactgctgattggttagaatatcatttatcactagcaacgattggctaagtcaccaatttaatcaatgtactagctgcatccaaaagcctcttcacaccacaaattaagacttgggtaactgttcgtccctcacaaatgcaactatcttcccctactgtttccagtcaaaaaagaaaaacaaatgtaactctctaaaggaggaaaatgcagaaatatcctggttcaaccttactgtctatttctctgaaagacaaactcctcaaaaaaaatgaaattgaatgagataatcctactccagaaactgagcaagattaaccaatcgccaatgtagaactaatgtggcaaaatccgagattcgcaatcttccatttgtgccagtatccttggggggggggggataatataataagacaaaattcctaaatct

SEQ ID NO: 62446 - DNA, 815 bp, Oryza sativa
cctctcccattccaaacaggtggatgcaggcgacggagacagaggtggcagcaccggagcaactcacgagcaggatgtgacggtggcagcgctcgccggcgtgagcagcggctgctcggtagagagcaggtggtggctcagcgacgctgtagcaggggaaggggtggcttagcttggctcagcaacgctgtagcttgctgcgaacatcgttcagagtaggagcagcaacaaggacacacgacaagcaagctcatccacgaggccaatgcaagggatgctgcctcctgattttctttttttttccccatctcatagttgagagtatatatttgggagaattttgtttggtaaatattttttttcctgtgaatgcgatgaatccttggtgaattttttgcgccctgtgcaacttctgtaaaagtgatatccaaactctatcaaaatttgtcaagtttggtcaaatttgagagaaaatgtgaagggtatatatgtcttcttgcagctcatttgacactgttagttggtcttaacagagtaagggcaaattgaaacttcgtttgaaaaaagtaagggcaaaatcacaaaccctaaaaagaaggggtaaaatcacaattacaatccaaaataggggtaagaatgtaattgtccctttctttttccccttcctttttacagtttgaaatttcatattgttttgtatttgaagtaaggatgtgtaatctaaaaacggcaaatatacaaagacagtgtatgaaaaagagcactagattagaaatgtgcatcaaatcgtacagtagctctctccttttcagctt

SEQ ID NO: 62447 - DNA, 1527 bp, Oryza sativa
taccattcctttatcggatctttatctactacttaaaatgacaaattggtggtggtaattttgctatgtactccttcactttagatattccatagatggattcatgtagacttggttgatttgtttgctagaccttttgcaaaatgaatgcattatctgcacttgtggatatgtggttgctgattgatgtaacatgatttacatacacaacttagtaggcacttaggcttgagaataactatgtctgtgtttaaattgggagttacagtatatttatttgagacccactacaaaacaggaacactatgctagtcaaagttatgtgttagagatcatgttgatgttgaaataataatacttttgaacggagggagtaaaatcacataagtagcaactatcctacaaggtataaatgtttgtttcgttacactagagagatgacagaagtatagtttgcacttaattgcatatgaatgaatgatcattcacaaacctgtgacaaagcatctctccaccttcctttattgcagagacagcaagctagttcataataaacacttgcagctccaacaattcccctttgttccatgtccttaactgcttcaactgcttcatttactttcccttgttcccagtaggctcttactagaactgagcacataattaggaaaatgacatgaatctcaataccaaagaagtcaaatgaactttatctgaattgctacctttataagttattgctcttggaggtaccccacttttttgcatcttctgaaagaacttttggacaaagtcatacttcttggctttaagcatgacctaaagtaactccagtaagtatgatagaatgccatatcaaagtttagtaagaaagaacatgtctttattatgattgactgactgcgtatgcaataccacactatatacttgagattacaacccactggactacacggaggcacttaagggtatctttatgaactattaggctaaatctaccgacatttgacatgaatggaatgcacagaacaagaagacgacgatgagtgtgagctaatgcgggaaataaaggcatttagttcagagaagaggaaactttgcatcacctcttttttgcaagcttctttgacaaggaacgttggcagaaaaatggcgttacatgtagcagtacggtggatgctatgtttacggatataatcatcactggatggcatgtttgaaagagaaggaatggtacaaaaaaaatgctaagagggttaaagaggtagcgacaaactcagtctcaacactcctggctagctctttttggttttacatttcttcctagctcttctataaaataaaattaaaaactacttatattgtttatatcatggcaggagcatctcccaatatttcccaaaaagaaaaggagaatgtgatgatcagaggactacaataatatggtttcgatccccagacttctaaggcagatgcatgtaaaacaagacaggaatcataagctgatctaacctaatttccatcagg

SEQ ID NO: 62448 - DNA, 1414 bp, Oryza sativa
agtgcaggaaaacagaaataaaacaaaaacatcaggcgccatccttaccgagttataaatcagaacatctggctccaaggaaggatcccaatctttgcgacgcatcttcattacccttttcgaaggcttctgtctcatatactctataatcttgattagctcgtttagaaggccagctcgaccaagtgtaacagcaatactatggtatgcagccatatcagggtatatttgagcatcactctgatttaacgtaagatataatgcttataccattatgttttctcaattttaggctggaatataagagacaaatggagtaaattctaaatgggcaacaaataaattctacccgcatgatggtgaaaactcgaagtgcttcagttggcctccatgcttttccaaggattgatagtaattttgtatacacgaaccttgatatgttatattccattagtcaagcatcagtacttgagttcaatttcattagataacttgtgcttgcagcgatctgaaacctagtaaactaggatatacctgctttttcgatgcttgtagatgttctcattgtacacccactcagtaacagataaagcctgcctccaatttcctcttgcctcaagcccttccagtatttgtagcagattatcttcattatatattaggtcagcttttttcatcaatctagtaagcctccaatcacgcatacttagatcatcttcgttcagcctgacaaaaaaaacttacttatgcaatatggaacaaagacaacatttcacgcaattcaattcattgtgaacgatttaactcaataatggcattggcatttaggataatgaagagtgcaatgaagttaaatgcacataaggtgaatcctaaaccgctatctatctaaattctgccatatctcatattcttgtaaatgtgattattaaaatcataaagcaaccaccactactcgaaagcagtgaaaggccaagaacgcctgaaacagcaagagcacgaacagggagggattcttcgcttatacctcctcaccagcgactcaatcctcctctcctcatcccgaaaatccgaattccagccgacgccagcacgcccccgcctccccaccgccgcttcctcttcaccctcctctacgtcatcatcctccagtagccactcgaacttgccggccctcctcgccgcgagcatctcgcggaggccgtcgaggccctcgccttcgcctcggagggccccacgcgggggtgccgaggcgccgccgtgccacggccggcccatgagcgcgcggtactcggcgacggccgcgcggaagcgggcctcgtcgtcttcgcccaccaccgcggcgccgtcctcctccctgggcagcgcattgctggccgcctccgcggccgcggcggcggcggcggtgtccttc

SEQ ID NO: 62449 - DNA, 8195 bp, Oryza sativa
atggtgtctacaactccattgtcacactagtattgtttccccgctgcatttcatatgctcgattgtgaatctataattttatttattaaaacatacaaataattatatttaactcatctaaattcatctctttagggcagatccatgtatttacaacctaataactcaatattaataatgtattacttggcatgagtattaagttagactatacgataaaaggagatacatgagatacttggcatttttttcctgcatctgcctttttctaaggtgatggtatagttcaaggctatgttcctgaaattggagagaagtttagggaaagttggtagtttgaaaaaaaaagttgggagtttatgtgagtagaaaagttttggatgtgatgtgatgtgatggaaagttgggagtttgggggaagtttggtgtgaactaaacagggcccaattcaaaagccatagagcattcaatagagggaaaccacgtttttcaaagccttctttaatctccaattctccatcataaccttcataccatcagtgttgtgcagaattattctctcctaatctaacattggccattataaaaagggcattcacatgcttatcatgccaaagagagaagacattatatttcaaatacaggtaacaacaactacatcatcatcatgttacaagaagacattgtatccattggcatccatgagagtagattcctaagtcgatggcattgatgcccctgcttgaagagcgttggaagatggttggtggctatccatatctatccctagatttggcaaagccacataaggaaattttcataggttgattatggcgcattggcacctagttgagccgtgaaggattaattacggggtgtgtggatacatatttagctgccacaaccactcgcctctcttggctcgactctagtcataatgggcattgtcgaagggcaaaacctatcttccttattttgctatgagggaaagcacatttaccggtgtaacacacagccatagtattggtacttttctccataaatctatctcaagttcatagatctggctgatcaacaaaggcatttttcctactttagctttggtgggtctatttttttcaaacgacatatctcatcctaccaccgagtagactaactcactgcttttcttagaagatttctcaatttttttctacattcgaagctgatggtaatcaagcagtattagctatgcggacaacccctgattccctaatgaaatcattctacgagaagcttcatagatgtgttaggtgggttgtaggacagtaagggagtaagctatcaaaatgatatatgatatgttcaagttgtcttagtttttttttctttgctgttcttttctttattagttatggtaatatattaatataggtgtagaggccgaatgtaatttatcttcttgataaagtatatgtattctaaatatatacatgacatatatatatacaccttggtttgtccacctcaaccaaaataggatgtaaacaaaagtattagaagcgagtaaaacagaagatatcgtgcacgggaagtccataagaaggtcaaaagatcaatgcatatcatatggcactagtactacccaaatataatcccaagctacctcgctagatgcaggatatgagaaacaacattatgggtgtctatcttgatagggatggatatatatagaaaatgccagtttatgagtgtaactaacttaaatggagtgatattgctttaaggcttctttgaaatgcatgatttcaaaaaacacatggataaaaaaaatacagaatgttgagtatgttgaatcccattggatctataatcatatgatttctcaaaacatgtgtttacatggctcaaaggaaaatatatgatttttgagattatgtattacttagattaagattaaaagaagacagaaatggagatgttgctttggaattctcttaaaatatgggttggagctcatgtttaaagttctttagaattggggtatatgaataaattgcaaaggaattttgcaagcccaaatcccacaaaccaagcaacctccttatgatttttttttcctaagaatctaatccttcaatccaaagaaacataaatattatcataacatctttggttgtatatagaatatatgataaaatcatgaaaaccagattaaagaaaatctataaatcgtttggaggatgttatgaaaatgagattctgtggtacgaagatagtgtagcgagttatgataatttgaacgtattgtactatagggactactcgaaaacattggctacaacagcatagcctacagccatgtagcttggctatcttcaaggcaaccatccagactggctacagtagtataagtgtagcagcattgttgtacaatctaatagttgtttaagattatcatatatatatatatatatgacaatcactatttatatatatgatatctattttcagtatctacgtaagttagatctttctatgatacacgatgagccgtttgtttttgggatccttggaacttgtattgtgtgatgtccactggagtatagctgggtggggtagtaacccattcggaaaaccccactaatccagtccccaactcccaagccgcggccaagccatttttcaccgttcaccgtggattcgagttgactcgcagcgtgccgcgtccgagtccaaagccaaactgtcatccatccgcatcacctcaccggtataaaggcgcgcccctcccctcgccgccccgcgtcggatgccgccgccgcgaccgcgaccgccatggcgtaccgccggaagccgcagcctccgcagacgccgccgtccttggaccaccaccaccaccaccacaccccctccgtgggcccctcgtccccgccgcaggactccctcgccgcgcaggccatgcgcgcctccgccgcgcaccgcgacgcctcctccctctcctcggcctactcctcctcctccgcctccgcggccgccgccgccgccgcggctcgccggggccaccacgagccctccgtctccacgccttcccccgtaagcttccccgctgagactcccccccaccccttagatgtgtctgatgcgtggcccggatctggtccgctcggggcggtttgtctccccgtcctagccgcttcttgaaatccatggtggtgaatcgattagggatatcgatttagggccgcatctcttcgttttgattccagttaggttcgcgattaactaacttgtgatgcttgactacttctgtttagtggttttgccgccgcctctgctgttcttgggttgggtctccctgacatcatcggaccaaattgttgtatttcttgatttggggagcgaagattctatgtttatactgtcgcttttgttctgtgttgtagggttcttcgggttatgaatacacatccatgaagaacttgaatgaggctaagtacggattttggggggcccttgctcggaaagccaagtcttttctggacgaggatggttcaccagggcagtatgattccccggcgaggcagcagccgtcaagagatgcgccgccggttggtgtccaggtgggaactgctgtcctgacattctcttgcagttaattgaactggtagattctaatttttatttaatgcgtgtactgatcatttcttgaagagattagcagcacagtctaaacttttgacttttgctaatgatgttaacacttattctgtcatcatggtcagtacttgactacttgttcattcatgctataatctgcaccttgtaagtttgtgttgtgcttaactgccattattgtgtttaggcagtttactttcagatgttcttgtgtcaatgccaacatttttattgctattgcagtatacacgctcacaacaaccaccgtctgaaacatggaaatccgagacacctccatctcataagaggtccgaggccatagcttcctccctcaactatattggtggcacaataaaaagtgcacttgaagtaagttgctatacatcaactacttacctaatcctatttaaacgatcacgtgaaagtatatctcctttttccgttaatgttatttaagaactgttcaaataatttctattctaaaaatatcctggtagcattagcaaaccatgtgttagaagtatagcaccatggaaatacttttatctttcttcttttacctttgtctcaacttggaaaatatgaagcattttacgttgttgtctatttcatatcacaacagcactagaataatggtgatatgactggttaatttattttatgattgaggcatccttctgttatgcttttatgttatttacccatgctaacatgttttaaatcttctttccaggaaggccggacgattgtagaaaataaaacagccgacattattcatgaaacacgcaaattgaacataagaagaaaaggagctggctcaactacacaaggagaagctccacaaagatttactcaaaggaatcttccacaaaatccacttgactacgaaactcaattgaaggcatctcgcgacgtaaggtggccaatatgtgtcactagatatgttgcttagtgctacattttgcatcttggaatccacgtggtttccaaatttaatctggtggcatttttgataaacatcatttttacctgatagctgttcaagttttttttttgtgttgagcgtgatatctgtgtgattatattctttgcaaagtatttttcattaaacatagcctttcagtgcttatttcatcctgccctttattttttctctggttgacgaacagtggcatcagtttagtaatcttttgtctctcatcgccctttctgttggagtggattagtgacccatattttgcacttgcaggttgcaaatgccatggcagcaaaagcaaagctgctattacgtgagctgaagactgtgaaggccgatttagcttttgcaaaggaacgttgcgctcagcttgaagatgaaaataagattttgcgggaaagtcacgataagggtgataaccctgaagatgatgatctggttagtaatttttctttaaaacggacaagcaattatgaaaatcatcagattcttgattgctggagttatgtattaaaatgttttgggcttcttctgtgcatctaaagttttactaaataactactcttttgacttgaacacctgtagtccaactttctgaactaataataaatagctgttgagtctacaaattatagcttcacatgctcaattcaaacttatcttggaactgcctaaaaaaattatcatggattttgactcttatataatgtatgttcatcagtgtgaaatgtggccgactcatgcttatcttccatagtttattaaaaattgcccctgaggggtctaattacattttgtattatattccgagtttttttttgtcatattagttactacctctgtcccaaaataagttcatttttcacctaccccacacataccaatacaaaagcaaaaggactagaataccctccactttaccaaatctcaatggaattgtcccccactttatctactcccaatgtatttatccctactttcacaaactccgatgcaatgatcactaaacatgaacttgttttgggacaaacaggagggggcaatgaacttattttgggatggagagataatgttgatatcttttttgtgaatggaacctgtaattttctgtgccttagagcaagtttaatagtatagcccactactaactcaaaatcatctatagccaatgtaatagtcaattcatacaatagttgcttactatactattaatacctggtcccacctgtcatacatacattacgtcttggagtccgtgctgcagctggctacagatctgtagctcgctgctcttctctctcttcttttatctctttaaaatatgtttatagctggcttatagcctgctattgtacctgctcttaccaatatgacaggagtccagggtggtacctgttaccttccgctgtggttaatcatacttttttttttaaaatttgcagatccgcctccaactagagacactattagctgagaaggcacggctcgcacatgagaattcggtgtacgctcgagagaatagattcctacgagaaattgttgagtaccaccaacttactatgcaggatgttatatatgtggatgaaggcattgaagaggtcactgaggtctaccctacacaagtattaccacctgcaccttctcgggctggttcaggccttggtcgctctgtaaccccagctactcccaagactgccagctcatcaccttcatcaacatccattgttgtaccagaaacttgtccggtcgttccagcctccccaaagtcgctttctcggacttcatctaagcaatagatcaagcccggcaccaccaaccatgctgaagattaaaaggtggttagtggtgcgatacaatccggatgccattgcaaatgtaaaaccaaagctgcgccgttgctgtgccctgtatgttagtctctgatgagttgtgtcctggaaatgtgcggacaaatgatgttcatgcctgagatgtttgtatgatccggtgtaacttacacagtatttataattttactgcatcatcgatttggtactggcaaggtgtgcatgcaattggctttgttttgcccgtgtcaatttgcactctgaaacgaacacatgttgatgcaacccttcgtgattatcttggcagtttctttggttggcgaatcgaagtggttagctttcttgtgatagaaccaattcacctgtgattaagtcttagatttgacacaggtgctcatctttacagctaattattctttgtggtgcgatagcgaggtgcccgtggtgtctccatcaattttaaggtccattgtctagtcctccgaagatgcttataagggggtacatcgttccaatcttccgaagatacttataagggggtacatcgtctcaatcttccgaagatgcttaaaagggtagtatgtgcggggagtgtgcacgtgttgtgagcgtgtgtgtttctattgtgttatataaaatagttaattcaaaatttgggtgggggttttttgaatgggggtaatggtgttgttggcttcttgccctaattttatgttgcaattgtggatttacctacttctttctttgtagggtttatgatttgccctcacgtttttaaatgaagtggatgtttaccatgttttggatggtaattaggtaggcctggaactattgaatctaccttataattcaccaacaacagtcctacattctacatacttcatacttcattgatcggtcaggattgtttcactcaaatccgacgttccagatcgtaaacttaaaacatgcacaaacttataaaatgcataaaaaaaattcattacaattcaaaatgaagcaaactcaatttctacagaatcaccatcttatactcttttgaaaagtaaaataaaatagtatacatactttacatcaaaatgcccctaaaaatattatctacaaaataattagttttagataagctaaattttggaaattcatataaaatacatttcaactcatttttgagtaaactcaagctctggagaatgaccataatatgtacttacaagttatgaaataaaaaaatatacccagagtacaataaaagcccctaaatatttatataaggaataaacaacttagggtacactttaacttgtaaaatctgtagaaaattcattcttaatccaaatggagtgaactaaatttatatagaaccagcaagaggtgaactttcccattataaaataaaatgtacaaccttctgtaacagaaacatcactaaactttaattgaagtaatagtcacttaattatgaactatgaactatgcaatttatataaaaatgcaaccaagctaaaataaaccaaaataaaacttgttagaccagagaagtgataaatccatcctccaccactaaaacttgacacacttaagttatataaggattcataggataatacatcaagtcatcaacataaaacaccctctagttcatataaggtaaagcaacaataatacaatctttaaagttatgaactaaggttagattagttaaaaagatcattttctttattcatctcaaacaaagt

SEQ ID NO: 62450 - DNA, 4746 bp, Oryza sativa
cttagaaaacacaccactacacctctgtgaagtcaaatctaataaaaatcaaatagcaaaaatatttcataacactactcagtaaaaactactatataccaacataacttataaaatttgtaactcccaaataaaaagggataaaatggaaattcattaacctaaattcattttagaccagaacctacccaccttgcacaagtcatgcagtttagagcattttggatttttcgcctatttcggtgtttaattgcataacgtgtaaacaagatagatattgcaataacggcgaaggaatgacttaggtgctaacattttctaggaacaaggcaagtccttcctcccctcttctttgatcacattgaaacttatgtttttggagatgaaaagtgttgtttgcaaagttgcataatatttgattaaaacgatatttgaaaacttggtaaatggtagtcatgaccttattgctgcatgatctaccttgaataattgttgttatcactgtttgtttgtaaccttaagaatggttagagtactcttcttgtgctcaaatgggtctatgcttagagaagttttatggtgtttgcattccaaaaatagtaaagatccaacgctccacaattaaaggtatcatacaaaaggtatttaagtattgctatagatacttaggcaggaagggtaaaaagataattttcttaagagataaaaaaggatataattgtcataatattagtaggaggtacattgataccgcatcagtagttcattaccatcatatgctctaattctccattgcattatttgtgataagggatgtaagatcccggtcttctgataagtgttgataaacagtcgatttgggcggagtcgcgacacaactcgatccggcttctgaacgaacacgctactgagccccgcaattgcagcaccacgtctcctctggttatcaaccatgccgaaacccggttgacctcaccgagaaggctaatccctgcatgcgtatcgaagatcacaagtaagaacaagatagattgcaaccaaattgcatatgaatgattaagcactcgaatttggggttccacataccgatctagcggtgaaaccgttcttgacagaataatctaagcaaaacccgactctaaacgatgacatctactgaataaatatgactagggacattctaggttgcgcacacccccttgggctaagcccacgacataattacaagtccaaaacccaaatcagattcagactggatgaaatacgtggcttgttttccagattcctggtagcttggtaggaattttgacgtgggaccaaaaccatatgaaagtagactccataagctttccaaaaagtactcatgggccctggaattccttctatatcagcagctaggtccgtttgaaattgatgctgtcaggaggcccgaatccgaatccaaaacgtgtagaactttatctcttgtcttctatggaccaaaagtgacgcggtaagatggaagtgggcttggagaaggtcttggtttgttctccaatcaatttctttgatcatccatgaattcgttagctcggtctcttttccttcgcccaagcaagtacctctgcaaacaaaaacacacgaaacttattgtgtagcaccgtttgttcaaatatataacatgtaaatctaatatagaacatatgcaactttggttgattagtacataaggtggtcatggttatatccgagctagttgtgtcctcatcatcctccccttcttgattggaaaccgtccttggtttcaccttgtcatagagcgtattaaacttatttttatttatcacaacatctggtgaggaacatttcttgatgaccatatggttggatcctaaaatctttgtagtcgaaaactacaacactccccttcttgcaaaccaatctataactcatttaaacaactagaggaactagatagagaattacttatacgcatgcggtcctctagaccacatttcatcatgaaaaggaagtatagtcaaatttgaacaaatatatacttgatgcacattatattgtcatttactatcataattgtcaataatatgaaaattcacatcagaagggcatggcaattcaaatctagcaaataatttcttctctaaatagttgagtggataaagatcatcaaattgaatatgaccccaagtatttaaagaagatagcaatttaagctcttcattttcgctagcaatgtgaatacatgtttaaactcaacacatagtggttctactataaaattaacatgttcattcactagttgtggcatggatataagtgaagcatcgcacaaatcttctttatcactagaaacatcaggcaaattgttttgtgacaaaggtatttcaacaattgtttccactatgggttgctctaacgtagcataagtagtggacatagttggcacatcataactatgcataccttgagtagttgcagcaccattatcattaccttttttcttaggacatgactagatagctactggtagctggtttgtcttatccagctaccactccatcaagtataaatacaatagtgtgtgtctttttttaacatctttaataacttatatcttttaaatcacatattgttcttaaaatctatttgcaccattgtgctccactcaaaatatgcgataaaacaagacccatattgaatatatttaaacattttattaatttaaaagtaatttattatatgtagaagtaggaagtaacttttacatcttatacatgattaattctcattagttactccatcaatattatttacaatccatcaatggttttatcttcttttctcatactacatgaaaaacaaaagtgaaagggaaaaaacaatcaatgtttaaaacagatttacagatttatagaaagttacttcgaattaatatcgaagttacttttaaaagttgttaaacttacttgtgctaattaaatttaatttctatctcctacaacgaatttacttctaatgttgtgacaatgttactttctttttgttttaagttacttttataatttatctaaattagttttagactttactaaatttgcttttatatgtctaagaagtaatttagtgaaatctaatagtaatttagatatattataaaagtaatttataatttttcattaaaatataatcatgtgagatcttgttataaagatttaattgttacgaacacaacggtgtaatcggatcatagatcggatgagtagtttaagagaaaattttatttgaagcataggatgaatagtatatatttgaagcataggggagaaacttctctctctggcgtagcagagtgcgtcatgtggcttaagattcggactattctggccttcttggcaatgtcggcatgtggaacggacgactataccagcgtgcgtgggatcggacggctctagatgcgttgcgtgataagaccagatcgagaggcctttcgagatagattttacgtttttcttatctttagaaattataggcgcttggtcaattgaacattcttcaagcatgcatggagctatagataggtctttttgctcttcgtctttattctcttcctcctcatcgtcttcaacgtcggaggtgctgatgtagccatcttccgtagcaacgtatgcccgttgactagggcaaaccttctgcacatggccaaatccatggcagtggtggcactgaatcttgggcgtgcgtcccgtcgaaatgacagatgaggcactcttggtggatacctgcgaagaacctttacctaaaactgcaggtcgtgggggaggtggttttagcgctacagaaactccggacgtaactggtcgcttgctcgttggtgggggtgcccaaaaagagatgggcttggaaagcctcgaagatggcttcgcccgtggcgtgtacgtgctcgccttgttcttgatctgttgatcacgcccctgcaattccttctctgcaagcattgaaaactgaaacaactagttgacagtgttaaattccttattatctactatgtcccgaatatcgcacctcaatcccatgtaaaagtgacaaatagaatcctcggttccctctactatgctacatcgtatctatcccttttgtagctcaccatagtaatcctgtacatatttattcccttgttctaaatacatctgtttcttgtgtaaatctatatgatatgatggaggaacaaatttatcacgcatagctaccttaagttcttcccaagtagtaggcaaagcaccctctgcagctaacccagtcccccaaaggaaaaagtacgaaatacccccccgaactatagcggttgtctgaaataccccctaaagtcgaaaaccggacataattcaccctcaactatcaaaaccggttacttaacctcctaaggcagaattaggggtggttttgaccggtcttcgtacacgtggcagtacagcgtggcaaggggacgacacgttagcacggggtcactatataacagcggagcgctctctctctctctctcgcaaaatttcccctttctccccgaaaccctagaacgggcggcgattccggcgacttcggcgaggctgggtgcggcggggctaggcggcgctctaggcgggtgggggtagcgcgctccaaggcggccacggcgtcgaggccggcgagctccactgcgaccacagcggcgcattgcaaggcggctgggatgaactaggctgggctgca

SEQ ID NO: 62451 - DNA, 2143 bp, Oryza sativa
aagagtgcagacttgtctggttctgacaatgattacgttggtggggactcttgttcatcaggagaagatcaagaggttgaggaaattaggaaggcatacaaggagtttaagaagaagctaaaggatggtgaggtaggaaatttagatgatgtgatctatatggggtcttcaagacagattaatgatggagccttggttcagattcagggtgaggaagataatagcccatatgagaacagcagtgcagatggtgattcatatgaagaggatagtgatggacagttggtcagaaagaagtccaaataccccatatttaatgccaaccagccccatgttaggcttgctcttgggatgaaatttgatgggaaaaaagagtttaaggaggcagtggtccagctagccttgcagaacaaaagattcataaggttccccaaagatgaaggttacaggacaagggcaaagtgtgactgggcaacctgtccatggagttttttgctatcaaggaacagcaggacaaatagctggcaaatagcaagtcttgttgatgagcacaattgtcctccaaggaaggataacaacctggtcacatacaagagaattgctcagaaatatgagaagacgatcatagataacccaacttggagtattcagagcatgcagtcaactgtctctgagcaaatgtttgcaaatgtcagtgcatcttagtgcaagagagcaaaagcatatgtcctgaagaagatatatgagtctagaagggatgaatactccagaatttttgactatcaattggaattgttgaggagtaatcctgggagtatagttgttgtcaagcttgatactgaccagccaagcccagtgttcaaaaggatatatgtttgcctagctgcttgtaagaatgggttcctattgggatgtagaaaggttgttggtttggatggctgctttttcaaaggttcaaacaatggggagctattatgtgctgttggcagagatgccaacaactctatgtacccaattgcatgggctgtggtataaaaggaaacaaatgactcatgggattggttctgtgatttgctatgcaaggacttgggatttggtgaaggtgatggctgggtgtttatttcagaccagcagaaggtatactcttctaacatattttgttcagtgttatttactgtatttcttgatgtgttgttgttattaaatggcttctatgtggttgattgcagggaattgtaaatgcagttcagcactgggctccaagtgctgagcacagaaattgtgcaaggcatatttatgccaactggaagaagaaattcagcaagaaggagtggcagaagaagttttggaggtgtgccaaagctccaaatgtcatgctattcaacctagcaaaggcaagactggcacaagagactgttgaaggtgcaagggctatcatgaacacagatcctagccactggagcagggcttggttcaggtttggctcaaactatgattctgtagacaataatatttgtgagactttcaacaagtggatagttcaggctaggttcctacccattattagcatgttggaagctattagaaggaaggtgatggttaggatacatgagaaaataaccttgatggacaagtggctaggatcaatttgtccaaacatacataagaaacttaatgcatacatcatcgattcaggaaactgtcatgcaatctgcaatgggatggacaagtttgaagttaagcatcagaatcataggttcactgttgatcttgagaggaaaacttgttcatgcagaatttattccttcaaaaagacctacagctgttgtttggaacctgttgagggaatggaaagctggcctacatctgataggccaaggccaaaggctccaggttatgttagaatgccaggaaggccttccaagaaggaaatgagaagagagctacatgaaaagcccaaagcaacaagggtgtcaagggtagggtcagtgatgacttgcaggttgtgcaaactccttgggcacaacaaggcttcatgtcacaagaggagacagcaacagcagggcaatgtgcaggtactaacttgttcatgcagattttgcttaaatttattactagcacagcatcataactgatattttct

SEQ ID NO: 62452 - DNA, 1976 bp, Oryza sativa
ctaccacttgctgttgcagcatatggcaaatgcttcatcatctcgaaagaggcagctgaaagcttcaacatctgcaagggcagctggaatggttggggttgagcagccaagaaagaagttggaagttaggagatctcctcggctaaacagaggatgaataggatattaggttcataaaacgtttggacatgcttactggattagcaataggcagaagatcaccaccttttgtagagtaacatgtggtatgaaacttctgtaatgtgatagctgtggcatctaataggccatcttttgtgtaataactgaaggaattacagtgctctaaagtttgaagcaacctgtgacatttactgccaccactcttgtttacttgctgatgtaatcagatacaatgggttccagatgtggcaatatatgtcattatttatcatcacttttgctgtttccattatctccaactgccataacatgccttgattcccagtcacccaatatggctggtccatttgccagcacaggtcatcaaatcacctgatttttaactgtcatctcaaacaaaaccacaattttgcattcattccaatttgcaattacaaattctagtagaacagctgacaacacaacaattccattcattccagtacccattacagattataatagaacacctgacattttcttaactccacactgaccacatgaaccctaactttcatcacaacctacaattttagatacatagttccaaccaagagaacaacaacagctactaaaacatacaccaacatcatgatacatgtctgttgtttgttaatcctatcaactaaaacacaatttgcagcttccatcttctctacagcagctctcagaccctgaacctcattgctttctttcttgggggtagactgcaagttgtgctgggctactgtcctgtcccgaagtgcagcctccaggccattcacttgctcacgtgcagaccacacagcattcctcaaatcaagcaacagctgcttcatatatggttctgccttatcatcacaccactcccaaaatccgcagcccccagacttcacaaaaaaaggggaagtgaaagagtcaatcccttgaaaacaaatctaaaatgcaaaatcaatttaaaaggcacaaaatttaactcacacgcgcattgtagcatgtaaaatatctcctcccggggttatggggactccaagaaatccaccgagctgccttcactttacaatcacagaacacgggaggctcataatcaagaggcccctccctgtatggcaccggcggctgacgccttcctcgctcaccacctccagcccaagaagacgatggcgagccacgcgatgtacctgagctcggcatgccgtggtcgcagtggagctcgccggcctggacgccatggctgccttggagtgcgccgcccccgcctgcctagagtgccgcccagccccgccgcacccagcctcgccggagtcgccggaatcgccgcccgttttagggtttcggggagaaaggggaaattttgcgagagagagggagagagagagagagcgctccgttgttatatagtgaccccgtgctgacgggctgtccccttgccacgctgtactgccacgtgtatgaagaccggtcaaaaccgcccctaattctgccttagggggttaagtaaccggttttgatagttgagggtgaattatgtccggtttcgactttaggggggtatttcagacgaccgctatagttcggggggggtatttcgtactttttcctccaccaaatgatagcaaaatctttgaactccctactggcttgtcgaactctatattgctcaggcacaaggtgggcactaaacttctgctctattgccatctcccaatcaagatatttctcagcatcataataaccagaaaaagatggcattttaaacttaaccttagcataaggatcatcgggcacactattat

SEQ ID NO: 62453 - DNA, 10621 bp, Oryza sativa
gctcttacaattgtcttactagcaatgctaaggacagtacaaccggtggctggtttgtgacaccttgaaggacgtgatgtggcgattgcaaggatcaaagtggtgctgaccagaagtatatatgtggagcttgggaggcacaatatatagtagcaagaaacgcagttgtgctaatcagaaaatgcaaagttgaataatagttcaaagtactagtcaatgtgctggcctagcctagactcaactctagctcaagcaagcacccgacaacactaaggactagatatgaatcaatgcataactctgcactctgaaaacatactcaaaggatgaatgattttttttctttcttggtgcggctttttttaagcacctttctgcctttttttttctttttttaggtgaggctttttctttctttttctttgcacctttctgccttttctttttttctttatttttttactattttttggcaacaagatctagccactggcctcgaacagggactcaaatgtaaaatatagatattacagggactgaaacgcaaagtgcaaaattaaaattagatcacctttaaaatggaatgctcacattatataggttccgttttataaaaatatctcaagtccgctgaagatttttccttaaccagtgtaccaaatagaatgatctagaaggagagaagtcggatggatgggtgttcggcctgaacccaccatggtggattcggccacggcagactagaggagggagcccaactatgatggagaaaaacgataccaatctactaacagaaaccaatctatctcctcctgttcttcctcacgtgaacaagacacacacggtacggtacatgaaaccctaccccttcatgcaatcatgcaacttcacaaccgaccaacgaaaacttatgaaaactataaaaacggaaaccctgtgatgagtagattcgatttttcaagctcccggcaacaactgacgagatgcaaaactggaccccaaactgacgtagaactcacatacttgagtgatgaaccctagacctaagtgatgaacatatgcaatactcaaaacaaaaaattaaatctaaaactaaaccaacactcgacacgacgatgcaatctaaaattcaacatagcaaaatctaatagaacaatgcaacggctcaaattgtctaggtaaagaacaaatatttttgtgtggcaattttctggttatgggaagataatttacctaacgggcaaccacgctctgataccaactgatgagggatgtaaggtcccgatcttccgataggtattgataaacagtcgattcgggcggagtcgcgacaatactcgatctggcttctgaacgaacacgttactgagccccgcaatcgcagcaccacgtctcctttggttatcaaccatgccgaaacccggttgacctcgccaggaagactaatccctgcatgcgaatcgaagaacacaagcaagaataagatagattgcaaccaaattgcatatgaatgattaagcactcgaatttggggttccacgtaccgatctagcagtgaaactgttcttgacagaataatctaagcaaaacctgactctaaacgatgacagctactgaataaatatgactagggacatcctaggattgcgcacacccccttgggctaagcccacgacacaattacaaggccaaaatccaaatcagattcggactggatgagatacgtggcttgttttccagattcctggcagctcggtaggaattttgacgtgagaccaagaccatctaaaagtagactccataatctttctaacaagtactcatgggccctggaattctttctagatcagcagctaggtccgtttgaagttgatgttgtcaggaggcccgaatctgaatccaaaacgtgtagaactttatctcttgtcttctatggaccaaaagtgacgtggtaagatggaagtggacttggagaaggttggtctaaaatcaacttctttgatcatccatgaatttgttacgctcgatctcttttgcttcacccaagcaagtacctctgcaaacaaaaacacatgaaactcattgtgtagcaacgttgttcaaatatataacatgtaaatctaatgtagaacatatgtacctttggttgattaatacataaggttgtcatggttatatccgagctagttgtgtcctcatcaatttgcgtgctttttttgtgatttacatattgtttctaagaacatggtcgattaaaatatcagcaaattattgtgtggtttcatgaactttgcagttagttaaggtatccaatcggagatatttacgaactaagtaaataaacaatcaaccatgtaaaaaggtagtgagatcttatccatgcgtttgagcctataggcgtcaaatagatcttttgcctccaattcaatcactcgaccatggcggcttttctccctttatctctttctaatgcaatagtttaaaccctagaataattgaatgaggagaaaaaagtggatcttgatatttttccctaacgaggagaaaaaagcggatcttgatatttttccatagcgatgatcatattatcgtatagatgggaaatgtaccgattcaactaagaaaggtattcacataaaacaaaattgcctctaatttattagttaattactccaatgccatcggttacactaattttattccgtaccttgcccctttcttaatcaacggttcatattgctccacctcttactacctctacgtacctcgcaaaaaccgtaaaacatctcataagcttataagtatgcccattgcttagccattgaagcatctaggcccccgttgttagttttggtaattaatgaaagcgctaattgtggactaaccattcctctttgagttatatattttgtgttagtgccacgtgatatgtgagcatggaggattaccgaaggactaaaatttgatggcgcaaagcaaaggatagatgatggtaaactagtggttgaattctaaattgatcaaggtgttgggcaatcaaaattgtgctagtttaattatagctttgccatactattaatggggggtaatgacctagcaaagagatgattaaattgccaccctaggtcatttgcatttagacttgtgctctttttaataactcaaatcttgctatctttgggctgtctgaccagggccggtctgactgtgggctgttggccagtccgaccggtgggtagcggccggtctgaccgccggctatatgccggtctgaccagcccccctggtggctgggatggtgtgctctaggatcgccgatcaagagccgccagagccgaggtcggtcagaccgagctgatggcggtttgaccgagccaaggtcggtctgaccggccaccccatggcggtctgactggccgggccaatggggcccaaacggctagaaaactagttgttgtagagtagcatggtctgaccggccacacacctccggtcagaccggcagtacactgagttgggtgatttcgcccccaacggctggttttggtgggtgggagtataaatactcccccaccagcagcaaggggactctcttggcactcacttcaattgcatacaccccttgcacctctcccacacttatttgagcttagtgttcatccattgtagtggttgagggttgatttagccaagagtcaagtgcattgcttcattgtagagctagtgtagcacttgatcatctctgagccacgtcattgcttgttactcttggaggttgccgcctcctagatggcttgtggaggagttgcccggtgaccactcggagaagattgtggtggaggcccggcaccggttgtgagtgggttggagttcaccacctttggagtgaaggaagaacttccccgagtgatcgaggcttgggtagtcctctccgtgggccggctcccgccttgcccaccccttgacgaagggggcgtgtggtggcttcgtggttgagcggtggagttgggctcgcctcaacggggattaggaaaccagcgagtttctgaacctcagtgaaaaattccttgtctattgtctcatttactttgtgcatttacatttgtccaatttacatttcataaagacatacttgagccactttgaccctaggattgcaaaacataacttagttgcttagttagtcttgtccctcaccgagcctagcaacttaggttagttttgattacgtgacattatcgacatcttgatcctgcagccatgcttagaattaagcaaaatctcaattaaactctttacatgatgaagttgggaatttaatcattgctggacagatttggaaatgctacttatttgtgaactaaaggtgttagaatgtggttttagacttgggcggcaagtggtatgcatatgatgttagttgcataccgatagggggagtgtttgcccaagagcgtaaggaccgaacttgtgtcaccaacttaaagttattcgtacatccacatgtgctttttatggggagccttagttgattaagttacttagcatctaaccttgcatatggggccgtagtagaatgaattagtctgagcgatgattcataggaacttcctatttaccgcgaggtataggtgactaagtctgtctaattcaatggtatagtgccacgtggtggggatcgtttgttgtttgccatcctggccttaagtttaaggcatgggcccgccacttaatagttctaggtcatatgcctaggatggagtcacttatcgtcgctgatgcaaggctaggtattaagtaatgtaaaggcttcgttatgacatctagaccacattcaacgtgtagaatgtggtggacaggtggagtcttgcaaactcaaaacaaactagagtgttcatatcatgtgggtaaagctgtacaaactctgtagagttctaaaaactaatcgattagtcgtgctcacggtcatgagcgctttggtgaggtcacatgagtatagacttgtgttttaaattgtgtttgtgaaacttgggattgaaatggatgatttgtgttgagttgtgtgagtatgattatgattatatgacttgttgccaaggaagacaacaagggtatgtttatgatgatatgatgttatttatgatgaatttacaaatttgttttgttaattgaatcaactcctttgcaaaagtattgtgaaccaaaacttgctttatgctgaaatttaactacatgttgccatcctttgaatatgtcttacatgtagtatgataggattgatttttggcttgacagtacattatttttaataatgtaccgactcttattattctggaatccatttttgttggttgtacgtttagattaatttgagtgatgagggtttcgcgtgcttcttctaggacttgaacttaatgggttaacccccctagtcggagtgcttgtgtttgggtagtcaagcttccgctgttctctgataaatctatatttggccggtcggcccatgtaactataaggtagttgtaatttgagatcactttcgtcttaaatgtatttgctatgtatatctatgcttaagatgaaagtgtgaatctggtgcacatcctgggaactagattcacatgaatacaagttaagtatatttgagatgtcgtatatcttaaaccatttttgtcaagtctcctgaatgtgtaacacatcttatcaccaccttcgtggggtttaacgggtacatctcaggctgaagttgactggcaggctaaagggccagcaatgtctccaatatccttctctcgaggcatcggatatttcattatgtttgtttgatgacttgaattattcacttcatccctcaaatataatgagaggttcggactgcctccgtcaagctgtgtgcatgataaaataatgaaaatagttgtgtgtggtcctgtgtggacgaaatattctttttggttggttggttggttggttaaaactatagtgatgttggttggttggttaaaactaagtgatggcaaatgttgtttaaattcaatttatatcaatttattgtatttaaatctgcgaatgcatttatgcaaattaaccctaaccttcctttgaagccttatatcatatattgtatattcccgtacaattgtgagtactttatgtgctcactctcgttgtctcaccaaaatttcagagaatgcctgctgtttccagaagtttctgttgtggaggaagttgaatagtttgcgtgccctagtcaactgcccgtggtgtgttgttgatgctctgcgcttctttttcggttgtttatctctgtgcttcatactctcatcactagacgcgttcgggatctcatcaaatagttctgaagcgtagatcagcatgtttgagaaaaccttatccaaaatttaaaaacttttaagtcaatgtttgaaattacgtatgcggatgcgtgtgagacttgctactcgtttctctctcgcgcacgtgcatattaggaagccccatgagtatatgatggaacccgtgataatttctcggtcgagattgatatgaacatatcgatctacgaagtcatgacaatcacatccagcagtcgtgtgatcagaacctttcaaaactcaaacacatgcatgcggaatgttcaacttcatcgcacgaattcttatttgggacaacaagagacgttgccggcggcttaattaattaattgatcgttccaaattaatataaactggccacaagaccaaagactaattattcggacaatcagttcttttccatctacaccaccccgttggagactttgaaatggacaagggattgatcagacactggaagttcctttttgtgaatactgaataactacatatgcatttgcagcatgcatgcatcgcctaattacttgattaagaagtcagcaaatgagatcatgattaggtcagtattatccccgatttcttaattttggatgttttgaacaagattaaaatcaaactactatcgatgactttaaaaatatttagcttaaaatatattaaaacaacatttatagatttatcttataaaatactataataaaaataaaaaaaatatttatttattgtatatactataatagaaaacttagtccatgttattatctaaaagttaagaataatagaactcgagggagtagctcgtacgttccgaccatgtaatgatcatctcaccaatccagttagatatagccttgctgtgttctggagggcaagttcccaaccttgtctcccgacacgaaaaacaaatcacgtgattatagtgagattaattaaatattagcctaaaaaacttgaaaaataaattaatatgattttttaaagtaactttcatatagaaatttttttaaaaaatataccgtttagcagtttaaaaagtgtgcgcgcggaaaacgaggaaagtgagttggaaagaggggaaaataacacagcctaaaaataccacttgagaccacttgataaataaattcattgatgcatgctgcaagtctacgatatgagacaacttgccatattattcaagattagagaaatttaacttacagaatgaacaaataccttctgaaacggagaaagtacgcgtcaacttctttgttcaaagtgtatagaattgattgagcgagagggattgagcgagagagaattatacacaagaatgtagagaatgaatgagcggatcctttattgataacagtgttacaatatataggggggagagaggcggcaaccagaagacacgatggtttgggaaccatcgtgtccgttgctagaatcgccgtgaggcgataagaggtgtggggcacgaccaaccgtcgtgtcccagaattggttgctgctctatccatatagatggatgagatcacccaaatatttcataacactcccccttgatcgaatccagcttttatcattgctcatttagggtttgtcacgcccggaatttctatccaaaatttcaaatgcttacatgtgcgttaaatcctcgtccaggaatcaatcgaggtacacaataacaaattgacaatagagtactattaaacagctaattaatattcgcaaaataataaattattacagagatggatagttcctctcaaagaataaaattctacacagcggaaaaaaaacaaaaacgaaacagctatggcgactccactccacaagcaacttgacccgaacaaagcctaatcctccagatcatcaccttcactgaaatactcctcctctgatgaatgaatattgcaagaatgagcatatgacatactcaacaagccatacaacaaatatgcaagtgcaaaggataacaaaggatggcatagtaaagctcatttgcataaacagaatttagtaaacattttaaagaataataaatcaattgaataattaatcagtattaaataaacaccatacaacacacctatcttgcataggcccaacctcatttgaacaaccaaccccggttgtacaaatcaaacctccataccaggaatataccattccaaaccaggagtcatattaattatcacaatattatcattaataaatagtgtgagactaatcacgaaaaacattgtcaaactcacccataaccgcgggcacggctattcgaatagttttactctggccagagatgtaccactgtacccacaagacatagttccacaacatgtcaccatgcgcctcagtaccaccacgataccttggaaaagaactatgacaatacctctcacacaacacaactcaccacagtgcaccgttcctggatcataatctccccctctaaactagaggcaaatagactccccagcgacccccacggacttctcgccgctttacagtctagcaccccataatgaatcatgctatacaaaaggtaaagccgttgcccatactggcttgtggttggcacggttaatgtttcacaacagtagctcccgaaccggtccttaattatcacgagcgccaccatcaaaaccatatactcacaacccacctttaatcaggttttaattatcaattaattatcataacacgattagccatcgtgagctaccattgaatataaccataattaataatgtagtatgattcatccctttaatgagctaatgtttttaagcatggctaagcaattatacatatagcatttagctgaaccaaaccaatatataaggttctagctaatcgaattataacccataggaaaataaagtcatcttcggccattaattaattaggaaaagcttaccacccgatgacattcgaaaataatgcataagttgaaataaaacattagctttaaacgggttcaacatgctcaaagggttgtttgggatctgtgtgacttgccttgagcttccgcaaacgcttccgaaccttcctcaacgaaaacgctctcctccggaacgtcggaaactaaagcaaaagaaaaaaaatcaacaaaacagtacaaaaacaagcataaacattacatgtggatatttttaacatgtagatctcgattttggatgaatttagcaacttgaaccactcgaatcggagtggcgaatgccgaggtactcctcctccgtgcgcacccgacggcggtcacggacggcaacggcgacggcgctagcggcggcgcgacgcgaccggagtgtcgccggcgacggtggcgactagggcaacgtggcggcggcgctatgggcgacggctcggcttgggacttgaagcaaacggaagaggacgactaggggatgctatttattggcttggattagagagatcggactccaaccgagaggaatcgagccgggaaaaactagggttaggtagagagataaactcgaaaacgagtttgatttggcttatccaggcaaaattgatctccgaaaccttaggggaaaggaagaggataaggaggagatgatttcccctcaagcaatcgggactcgggggcgaccggttgaggtggaatcggaggagaggcggcggcgctcgggctcggctcggcccggccagaggtaggggacgatcccgacatgtgggccccacatgtcggcggctaggggagaggaggggcggcggctcggcttgggccgcacggccgcgcgtgaggtgggagagatgtttggccgaaaacggcccaacggcttaggaaaggattttaaaaacttttccaattaaaataattcgtgaaatgatgtttcatttattaaaaatactttccttgctcaaataattcctagaaaaaatctagaaaatggataaacaagaaaagtatttaatgaaattttatctagctcaattttatgttaaaatttttcctagattattagagtttaacttgtaggcttttaaaataatttctaaaaatgatttaaagatggattattaatttaggcgattttcagggcatgacaaacctaccccccttaaacggaatctcgtcctcgagattcagaagaactagcaaaaagatgaggatgagctgactttagtaagcctgtcaaccactacccaaatagaatcatgtcctgccgacgttctggataggccggtgataaagtccattcctatttcctcccatttccactctggaatcttcaacg

SEQ ID NO: 62454 - DNA, 9108 bp, Oryza sativa
cgtatacatctccgtacggttaccaaaaaggtaatgacgccaaatcttcaatacatgaaccacagctgccaactctaggacatgcgttgggtagttattctcatgagggcgtaactgcctagatgcataggcaaccaccttcccatcttgcatcaaaacacaacccaaaccaagtctagatgcatcacaatacacctggaaacctttccttggatcaggcaagacgaatacaggcgcagtcactagccttttcttcagttcttgaaaactctgctcacattcttccgtccacttatacttcacatccttctgaagcagtcgagtcattggtctagcaatcttggagaagttctcaataaacctgcggtagtaccccgcaagaccaaggaaactacgaatctctaaaatcgtcttgggttgcttccaatttagcactgactccacattgcttgggtccacggccactcctccagctgagatgacatgaccaaggaacttcacttcgggcaaccaaaattcacatttactaaacttcgcatagagctggtgctcacgtagtttctctaaagcaagacgaagatgctcttcatgctcttcttttgtcttggagtaaataaggatgtcatcaataaacaccacgacaaacttatccagatattccataaacactttgttcatcaagttcatgaaaaaggccggggaattagtgagtccaaacgacataacagtgcattcgaacaaaccataccgtgttgtaaaggcggtctttggtatatcctcctcacggattcgaagttggtgatatccggaacggagatctatcttggagaaaactgtagcaccttccagttgatcaaacaagtcatcaatcctaggtagaggatacttattcttgatagtgacctcattcaacgcatgataatccacacacattctttgagtatgatctttattttccacgaagatgactggtgctccccacggcgaagtactgggtctggtatatcctttctgaagcaaatcatccacctggctctttacctctgctaacttattagctgccattctgtatggtctcttatggatagggttggttccaggtactaagtctatccggaactctatgtctctcttaggtggcatacctggcaaatcctcggggaacacatctggatagtctcgtactattgggatctcttgcaaagcaacttgatttaatgtcaaaccatgaggtttaggggatgacacaaagaaagacactgtttgcccattgctacttgttaaagtcaccttacggttagcacaatctataactcctctgtgacgggttaaccaatccatccctaagataacatcaagatctttggattctagcgagataagtgaggataggaaaggaatttcttctatttctatagtaacggaagtacagtactgcgttgaggatacttgattgcctagggtattaactagtaaaggtctcccaagactaataacttccatcccgtgatcgctcgcaaaaattttagacaaaaaggaatgtgtagcaccggaatcaaaaagcacatatgcgggtatagagttaacaggaaacgtacccaaaaccagcttaggtgcattctgggcctctgcagctgcaacgtgattaacatgagccttcggtgctggagcattggagttgttctggaccggagcattcttcacacgtcgaggctttggacacttatcagcataatgtcatggatcaccacaattgaaacacacccctggcttgcttccctgttccttcctgataggttgattctgtgttggagctgctacaggtcgtgtgaacacattatgattgtcgttgctgcgattaccagtgttgttgttgtagaactggcgttgagggcgagcaactgaagaggatcctccctgtgggtatggtgcagcttgaggtcccaaaacaatgtgcggcctctggctactaccctgttgagccttgaattgagcagccctacgcttcttctgttccatcctattgtacttgtcttcttggcgaatcgccttgtccaccaactgctggaaatcccggtaatccgtagccatcaatgcataagacaactcatcattcagtccctctaaaaacttctcctgacgttcttcatcagtgtgaacatcttctgggcataacgatctaagcgattaaagtcatggaggtactctgtgacagaacgggatccctgattgagtgctctgaactctctcttcttaagggccacaacacctgatggtatatgcgtcttcttgaaagcagcagtaaactcccaccaagtgataggctctcccgcagctctgttttgacgaaagtgatcccaccactcagcagcaggaccatgcaactgatgcgaagcaaaagaaaccttctcctgctcagtgcactgaatcaaatctaacttcttttcaacagcatgcagccaatcacctgcctctactgggttagtggtgcttgagaaggtaggtggtctcacacgtagaaaatctgccaacttgttctgtggaggtggtggttgattgttgttatttgcctgctggttctacgcttgctgcactagtaaattaatcaactgggtttgctgagccaaaacttgggcaagtgtgggacctccttcattgtgaccacttccacttccacttccacttccagtgcgggtgttcaccatctgaagaaaagcacgggcaagaggaaagaacgacagagagatacccttagaacggagaactttaattaatttaaattgtatattgctcttaactgtatatgattacatttgaattgagttaacactatctcaccaactaacttactctctgacaagcaaaagaactaaactcatgtagttacatcccaccaatgatgtaagcaacacgctaaacccacacacacacaagcaaacttaagcaagcaaactaacacagcgaactacggcaacggtccaactaggcaactaatcccgccttgcgttggaacgaagagacggatcttcttcctctggagtagctagctctctttcttctaagtcttcctcttcttcctcatcacttaagacatggatgacaggttcagcacaatcaggcacagcgtctcccaccacacgagtctttgaagctaactggagacgaggtggtggacgggttctcttccttgcggtgaggcgaagcttgggtgctggcggtggtgcttctcccttaagctcagctagttccttctgcaaacggtacaccttgctctccaacttgcaaatcctgccatggttctagttttccctatcatgagctgctttctcccgctccacgcctactgcatccatggcgctaagcatatacacagcatgtgtcagtgtggcgcttccttcgccttcaggacagttgtaagttccatagtcttgaccatgaggcttgtgtggatgatactggaaagctgatgactctaactcctcataaaagcaatgacgtagctctccaatggccaccaaggctgcttcctgacaagcatggctatactttcttcccccagcttcaaactttatcgacggaaggtcttcacgatcactagccaacgtcacgcgaacacgacacttctcctcgttgggatcatggggaatctagcgatactcgggggcaacctcatagcctacttcaaataccatcaatctcagctccctgacgaatcctagcaccttgatcaagtttttcggcggatgggcggcatctaaagaaacatagaaaggaggaattaatgcatatattttttttaagttagctgtacaaactagacttaatttatttgacccaaaaaggaagaaaaataaaagaaaaggaacaaacagaactaaacaaatttttttttttggaaattaaatcagctttggacagagacaaatagctttagacaaatgaataaaataaaactaaaatacttaagatctactataagcacggtacagtgtcaccattaagagggatgagtagtactagtgctatcttgattgaatcgataccataatagatgtacagtgccgaccaaccactgaaattcaaaaaactatttaataccctgaacagtaaaggaaaaagaaaaattagaaaagaacagctttctgttttgtaaagtaggatttagaaaattttgtgcttgaccttgcatgtgctgccaacttaattagtttgtaagagaatagggaagagcagtcctattttttcaaaatattttaaatgctacttaaggtttaccatttggcttgtcctaaggtcaaggtagctctgataccaacttgtcacgcctggaatttctatccaaaattccaaacgcttacatgtgcattaaatcctcgtccaggaatcagccgaggcacacaataacaaattgataatagagtactattaaacaactaattaatattcgcaaaacaatatattattacagaggtggatagttcctctcaaagaataaaattctacacagaaaaaaaaacaaaaatggaacagctatggcgactccactccacaagcaacttgacccgaacaaagcctaatcctccagatcatcaccttcactgaaatactcctcctttgatgaatgaatattgcaagaatgagcatatgtcatactcaacaagccacacagcaaatatgcaagtgcacaagataacaaaggatggcatagtaaagctcatttgcataaacaacatttagtaaacattttaaagaataataaaacagttgaataattaatcagtattaaataaacactatacaacacacctatgttgcataggcccaacctcatctgaacaatcaaccccggttgtacaaatcaaacctccataccaggaatataccattccaaaccaggagtcatattaattatcacaatattatcattaatgaatagtgtgagactaatcacgaaaaacattgtcaaactcacccataaccgcgggcacggctattcgaatagttttactctggccagagatgtaccactgtacccacaaaacacagttccacaacatgtcaccatgcgccttagtaccaccacgataccttggaaaagaactgtgacaatacctctcacacaacacaactcaccacagtgcaccgttcctggatcataatctccccctctaaaccagaggcaaatagactccccagcgacccccacggacttctcaccgctttacagtctgacaccccgtaatgaatcatattatacaaaaggtaaagccgttgcccacgctggcttgtggttggcacggttaatgtttcacaacagtagctcgcgaaccggtccttaattgtcacgagcaccaccatcaaaaccatatgctcacaacccacctttaattaggttttaattatcaattaattatcataacatgattaaccatcgtgagctaccattgaatataaccataattaataatgtagtatgattcatccctttaatgagctaatgtttttaagcatggctaagcaattatacatatagcatttagctgaaccaaaccaatatataaggttctagctaatcgaattataacccataggaaaataaagtcatcttcggccattaattaattaggaaaagcttaccacccgatgtcattcgaaaataatgcataagttgaaataaaacattagctttaaatgggttcaacatgctcaaagggttgtttgggatctgtgtgacttgccttgagcttccgcaaacgcttccgaaccttcctcaacgaaaacgctctcctccggaacgtcggaaactaaagcaaaagaaaaaaatcaacaaaacagtaaaaaaacaagcataaacagtgcatgtggatatttttaacatgtagatctcgattttagatgaatttagcaacttgaaccactcgaatcggagttacgatgatttagttatgaatttatgaagtttaatcgattttcatctaataaagaaactaagaaaaagagatttatgacgtcatcgctgacgtcatcgccagccatggcacggctccacgtgaccaccggtgctagagagctcggtttgcctaaccgaggacacgtacgcgtagaagacggcgacgcgaactcaccggtgcaataaactacgacggaccacgacaaacggcggccggcgacaaggtccaatggcggctcggctcggctcgacggcggtgacggcgctccggtggcttgcgacagcggcgaaggggtggccgaggtactcctcctccgtgcgcacccgacggcggtgacggacggcaacggcgacggcgctagcggcggcgcgacgtgaccggagtgtcgccggcgacggcggcggctagggcaacgtggcggcggcgctacgggcgacggctcggcttgggacttgaagcaaacgaaagaggacgactaggggatgctatttataggcttgaattagagagatcggactccaaccgagaggaatcgagccgggaaaaactagggttaggtggagagataaactcgaaaacgagtttgatttgacttatccgggcaaaattgatctccgaaaccttaggggaaaggaagaggataaggaggagatgatttccccttaagcaatcggactcgggggcgaccggttgaggcggaatcggaggagaggcggcggcgctcgggctcggcttggcccggccggaggtaggggaagaccccgacatgtgggccccacatgtcggcggctaggggagaggaggggcggcggctcggcttgggccgcacggccgcgcgcgaggagggagagatgttgggtcgaaaatggcccattggcttaggagaggattttaaaaacttttccaattaaaataattcgtgaaatgatgtttcatttattaaaatactttccttgctcaaataattcccagaaaaaatctagaaaatagataaacaagcaaagtatttaatgaaattttatctagctcaattttatgctgaaatttttcctaaattattggagtttaacttgtaggcttttaaaataatttctaaaaatgatttaaaagatggattattaatttaggcgattttcatggcgtgacagtgttctagatatctgtaaagataatcttagaaataattatagtcagtatattaaatacatcacgtaaaactcctcgaaaacccagtgggaaaaataaggagagaaccgtgatatattattgactagttttagatcttaatgagtaaagctcatagtatgatccaaaaatagtataatgtctgtagttatcatttagtaaaaatcccagtggggaaaagccaaatgataagacatataacttatgttgatattacctcgttaaaaactttggatgagaaaacctatagggtaaaactcatacaaaggaaaaagagtataatatgacgaaaatatgttattttccagaggaagatactccccctgaatcctgtaaatttttaagtcgtctcatactaattcctttgacacatttaaagaatgtggagtatggcagagattttgtgaataaatcatcaagattatcacatgacttagtttgcaaggtgtttatctctccatgttgctgaagctcatgaggataaaataatttaggagcaatatgcttagttatgttgctcttaatataaacagtttccatctgaacaacacaagcagcattatcttcatagataatggtaggtgattccaatgaaccaataccacaagatgttaatatgtagttaaccattctgcgaagccatacacattcacgtgatgcctcatataatgcaattatttcagaatgatttgtggaagtggctaccagagtctgtttagaagacttccatgaaatagcagttccaccttgtaaaagtacaaatcctatttgtgatctggcattgtggggatcagataaatagccagcatcagtatacccaataaaagtcgaatcatggttctttttaaagaaaagtccaagatctcttgtgccattaagataccgaaagacactttaactccagtccaatggcgtttggtaggagcagcgctgtatcttgctaatagatttaccaagaaagcaatatctggcctcgtactatttgcaaggtacataagtgccccaatagcactaagatatggaaaatcaggaccaagcacatcctcaccatcttcctttggtctaaatggatctttctccacgtctagagatcgaaccaccataggggttttggaaggatatgacttgtccatattaaatttctccaaaattttctgggtatatgcactttggtgcacaaggattccaaaaggtaaatgctcaagttgtagacctaagcaaaatttggtttgacccaaatccttcatctcaaattctgtctttaaatgatgacgtgcttcattaatatcttgtgtattgccaatgatgttgagatcatcgacatataccgagataatacaaaatcctgtgggggaccttttgataaagacgcacgggcaatcatcatttttagtgtatccttttagtgaaaggaattcacttaatcggttgtaccacatcctgcccgattattttaagccataaagtgacttctgcaacttaacacaatacatgttatgatttaccttctgattcgggatatcgattccgtcaggaaccttgatgtaaatatcaaaatcaagtgacccataaagatatgctgtcactacgtccatcaactgcataaatagacgattttgtattgccaatgatattaaatatcgaaagttataccactcataactagagagtaagtttcgttgaaatcaacgccaggtttttgcgtaaaaccttgtgctacaagccttgctttatatctcaccacctcgttgttttcattccgtttccggacgaaaacctatttgtatcccataggaaagataccacgaggagtaggcattacagccgagaatacttctcttttgtaaagcgaggctaattctgcgtcaattgcgtccttccatttgttccagtcagagcacttttggcactcttttatagacctaggttctggatcaacttggaggcaatcagcaatttgttcagaaaaatt

SEQ ID NO: 62455 - DNA, 11575 bp, Oryza sativa
ttagcaattgtttctcgctgagtggccatacttcttcctctctttttagtgagtggaagttgagttgttttatttggtacctccactctttctggcgcattctgagcaggaatgaaagatttagttacacctttataattagtaaatgcatatggcaggttatttgcaagtctttgcaaatgtataattttctgaacttgaagttcagtttcagtagtacgtgggtttgaggctggaataccctaggcatcccagtcaatttcctggcattctttctggtacttgaagtctccccctaatgctaggaaatgttcctcatcaaagatagagtcagtgaaccgggcagtaaatagatcacctgttaagggttctaaatactttatgatcgagggagatttgaatcccatatagatccacactttcttgtgtgggcccatagcggtatgctgtggtggtgagatcggtatgtatatagcacaaccgaacttacgcaaatgggaaatacttagaggatttccatgtactaactgcattggggaagtttcatgatatgcagttggtcgtagttggacaaggtcagcagcgtgcagaactgcatgaccccaacacgacgaaggtaatttgcaattcatcaataatggtcgagcaataagcttaattcttttgatcaacgattcagccagaccattttgtgtgtggacatatggaacatagtgctgaacctgaattcccaatgccatacaataatcatcaaaagcatgggatgtaaatttggcagcattgtccatacggattgattgaatcctatgttcagggtaatttgccttcagccttataatttgagacattagtttgtcaaaggtatggtttcatgtcgatagaagacacacatgagaccatctagtagatgcgtcaatcaaaaccataaagtacctgaacggtccagatcttggcacaatagggccacagatatctccttgaatgcgttcaaggaatttaggtggttcagctctgattttgagataagatggtctcaaaaatcagttcccagtagcacatgcagtgcatacgaaatcagaggatttgagaaatttatcagtgatcaaatgatgaccaatagagttgccaatatttttttctcatcatcccggtactggggtgcccaagtcgatcatgccaagtgtggaatgcatcaacattttgaaaaattacttagtacgcaacatgtgcaatgggcttaatatatgtatagtacaatcccaatgtgagagatggaattttctcgcaaatgcgtttgccatatctgttttatttggttaagagaagaaattcttctcgattatccatatgggtttcaatgtgaaatccattttgacggatatctccataacttagtagagtacgggttgaatcaggatacaataaagcatcctcgattataatttgtgtacccattgggagtgtaatagttgctcgtcctgagccaactatcacagtatcgcgcccagcgatagtcaaaactttgccttctctctttttgagagtttgaaagtatttgatctccctaagtatagagtttgtggtaccactgtccacaagacataattcctctccaattggggcgatatccttagacatctatagtgaaagaagaattgcttagtgaagaattctttatccacaatatatacatacatataataatgaaaacatcaaatacatagtatgacgtttacataggttaatagtacatactctaatgactagcaggtcttataaccttacaatgtaagggagtttgtacgtatctacttattacaaccaatattgttttgacaaactataggatatcaatataatgtctcaaacacactgagattaaagcagctttatctctaagtgggacgcactgagattacagtaaatctccaagtgggtccgttgagcagtattcgatgagcatgtcatccactacagaaagtgcagcggtatcctctgggaaaagaacgaggttgttctctggttcaataggagccaggtgagaactttcaacctcaggtctttcttttgtaagattgaagtgagcttcaaatctgagttcctcataagactttttctcctttagggatttctgatacaggagaacaagatgttgttgggatgcggcaatttttagcgacatgatagtcagatccacacctgttgcaatgcttgttgctattgccactaggttgtggtgccttacccttcccttttcctttctaatcgaccatttcatttgcgccgttgttgcatttgcgttttccagtcagattcttagggttattcgaggaatttcccttgaatcctttgagtgtgatactgttggttcaatatcatgtcctctggaaacatagttgatagagttttctctatctcctctgcttccgttggctctttttcataaaacttcaacttggagcaaatgttatgaacatcatgattgtattctgccacagttttttttaaaatcctttaaaatcctataagcgtaaatgaattcactcataattagcctcaggccaaatgagttccttttgcttatcataacgctcttttagagctttccataggttgagagggctcgactccaacatgtactcatgtttgagatctttatagatgtagagcctcagaaggaaaagggcaatatatagatttctgttctcaactggtggatcccaatcattgggttcctaatttgtatgtgaaatcccactagaagaaaaatttattttgatatcggaagcccaaattgggtagttactcccatcgagggcgagttcgtcgagctctatagttgccatgtccctataatcatgattaacattattaatttacagaggtaaattaataaaaacatgatattgaggttgtaatctcaatgcgtaatgtaagacttcatattttgtaatgtttcgaaaagatgtaggctatagacctgacaatttgagttagaattcaaaattaggtggcacaatgtggataatctccaaataattaaatagtggagtagatatcttaatagtgggcaagtaatacttgctgcctaaaacacggtctccaggcaaatatattctggtgaatataccgcagccgatgtttaggactccactaccttgtgctcaaccaaatttcaaataatctcatttttcaaaacatattctcggaaagtaacacatgtgggtaatcatcgtgagatgttgacctctgtgagatgggcgagatgctcgctgcctaggttatgaccagtgcggccaatttgtaggactccatcgggtaatcatctcaaaatgtagatcacttgatgatgggcgagatactcgctgcctaagttatggtcaatatgaccaaagtataggactccatctacatgtgattaatgtccgagtcaaaatgtgaagtggaacatgcattaaatcctccattaatcatgttgtacataattaagagaatttgctaaatcaaagtacaaaacttatagaattttgtaaattaatgaagcgagaaagtagagtgtgtcttgaaatagtatgcaaaaggcatattattaagacaacaaataaatttagtgaagcagggtatttaaataaacacctatgttaagtaacatataacatcagtggtctacaggaccagtacatagtaatttgtacaactgatgaactgcttgtactaaattatcaaagatataggaactaataagaaaatgctgctaaattagaaaataaaaactaaaaaaaataaacggtaaatgggtggtgagccgaaatcaataggattcggcccaccaccgctactgtgcggctggcccatcgggtccgaggggaaaagggcgcaggggggcgtgggggtgttagggttagaaccctaaccgttcccctcgcggtgtgcaccgccgccgccgccgattggccacgcctcctccacctcttctgcagccgccgccatttcgccgcctcctcctccatcactttagccgtcgtttccaccgccacctttctcatccaatgccgatccaatttccgccgccaccttctccccctgaaacgccaccactgttgcctctatttccgccgccgcccaccaccgccgtttctactgcccgccgccgccatccaccgtccgccgccgccgcatcccccatgtcgaccggcggttgctggctagagttaggccgacggccccaactcctcatcggagtcggagaccggttgagcccttacaccgttccccatcccgccatttgagagcgtgcgggagccatggggaacggcgagccatgtggagcggaggctgggacggcgagcagtggcttcaccggcatgacagtgagacgacgatgggttgaagtaggccggctcccccgtgcgcgctaccatggttccgttccggccggactccggtggcgcgggagtgggggagcagcgttggtgtggcgtcggcgacgtcgtggcgcgggtggtggcggggttggagtagcagcaatggtgatgcggcgccgagggttgtggcggtggccactaaccctaggccggcgcctggcatggtgatggtagcagtggtggcgactcctcgttgtacgatggaggaggtggtgcagatggcgggctcggtcatggcgaggaataccaagaacggtgtcgataagtaattgaaggtagacatctcgtacctttcctgttgattctttcgcttttccttgagatcaaaagcgatgtagtttcttctttcacttcacgatcttcttcgcgagaacggcgtcgataagtaattgaaggtagacatctcgtacctttcctgttgattctttcgcttttcattgagatcaaaagtgatgtagtttcttctttcacttcgcgatctccatcgcgagagcgaaagtgctgataacgtattgattccagcctcagacccacgtactactgaaactgaacttcaagttcagaaaattatacatttgcaaagacttgcaaataacctgccagatgcatttaccaattataaaggtgtgactaaatctttcattcccgctcagaatgcgccagaaagagtggaggtaccaaataaaaccactcaacttccgctcactaaaaagagaggaagaagtatggccactcagcgagaaacaattgctaataagcaaagaaagacggtaaatgcaaaccaacctttagttggtacacaccaaattgatactatatatcaagcagatcgtgatagtctgcaacctagctcggtggtgcacaatgctgataacgtgttgaaagtgtatagaattaactgagcgaaagggattgagcgagagagagaattgcactcaagaatgtcgagaatgaatgagcggatcctttattgataacagtgttacaatatatagggagagagagaggtggcaaccagaagacgtgatggtttgggaaccatcgtgtccgttgctagaatcgccgtgacgtgataagaggtgtggggcacgaccaaccgtcgtgtcccagaattggttgctgctctatccatatagatggatgggatcacccaaatatttcataacattcttgatgtacactcatattcgagtgcgcgtttcgcaattttcctcttgctggtgacctcgagtcgtacgtttcgtaggttgttaattttttttccagtcagcagtttaccaagtttataaaaaagcataacaatacttttaatgaaaacgaacatactaccaaaatatacccaatgcaatatttaataacactaattttttttgccaattaataacactaatttaatgttgtggatgttactaaattctcttataaatttaattaaacttaaaataattaattaaaaaaattatagcatgttataatatgaaatggagaatgtggccaatagtcgtgtagcatccgtagaccatgacatcgtcgtcatggcgttcatattcccatgaccaggcgccacgagggaacacgccacacatgctgaaatttttacattttagtcctttttaaaacttattttatgaatagattattgaaaaacttatttcagaaatagtcttttctggtgcgctagagtggctcgcgccgtcgtcgaacagggtggcaccatcacatctggcgtcgtccccataccattgtggcaccacgtggctggcctgcactgacctgacaggaggacggcgcagtggcatggggacggcaccagattactggcaccgacccacccccctcgacggtgccaacacctgtggcgtgctcctcccaggggtgggtggcacttaacccatacccacatggaccccaccccgctccccctccccacccattcgtcccctcctcccccgcccgagcctgagcagagctcttgctctctctctctctctctctctttctccctcctcacctctcctcttcaaatccactcattgtgaagcagtttttcacgagattttttaggggaatcgaagagcaaggaattctccatcaatgcccctatttttttcgttttaattgataaaatttgtagatggtagggtaacactagaacccaaatttgtgattttgaacattgaaattggggattcgttgattatagtgttacatgtgtgcaatgtgcatattggcgccacaattttttggagtatatatgtggtaatgttgatttttaggtgagacattaatgaatggttggatggaaaaagttgctttaggttagatttgtacttatgtggtatattttggttactttaatatagtgattaacatttttggcattgtgggatgcttaggaaggatcatgtgggctattccctggatcagctgccaacaccgggcgtaatgcgctgtcacgtcctgataaattcatcccaaaataaaaatcattctctaaaaggaataatagaattaattaaaattcgaaaagaaattggttaacactaaaatacatacaagaaaaattcgaatgtggcccggagaattttacttggtctaaaaagagccctcaaattttacttgaattttcagagcaccggaaatatttattaagcaacaaaaacaattaacaaagtttatttaaaagaaaaggctaaaaataatccccctcctccctttgggccaagtcaggcccaaagtcccctctctctctctcggcccgctgccaaagtcctctcttcctccctctctttctctccctctccttctctccctccttctcttgggcctcccattcccctcctggcccactccctcctctcctcctccttctgggccgcccctcccctccctccttccctctcggcccagccacccgacccaaaccaggccgagccaagccagccgcgtgcacgcgcgccgcacgcgcgctgacgacgcgcgccccgcgtgggtcccacgcgccgggtcgtcgtcgtcctcccgcccggcctcctctctctctcccagaaacctagcgccattcctccccaaaatccacgcgattcaaaccgggaattccaaaattgattagggggaattaatcccctttccttcctcttcaattccccccaatttcccccttgattcgtgccctctaacgcccggaacagccgcgccattcccggccgccttccatggccgccggccacaaactccaccgccgttccccgctcctcccgttgccggctccctccccgcgcctataaaatggaatccccatcctccgttctatcgttttagcctcatcccgagcctccccgtggtcgtatcacccctccccgccgtcacccttctctttcccccgcgccgaccgcctccagccgcctctaccgcctcgcccgcgcgccagtcggctgtgccgtcgcctccctcggcatcgcagcagcctcctctcccccggcctgccctccgtttcgcgcggagacccccggaggtgcgcccccgccggcaacagtggcgttgtcgccactgttctgcctccggccgcctctgccgcgtctcctgtgcgccgaccgacgtcgccgtctcctccgtcgatgtcgcagcgtcgtcctctcctccggctgctcctctgtttcgccggaacgctgtcgcccgcaccgcctctccctcggtctcgtcgacacccactccggcagccccttccgccgtgccagtccaccggccgacgtcgccgtctccacctccggcatcgcagcggcaaggtcgccctcggcctcacctcccctccacccgaacaccgccggtgtccgtcatcgtcttcaccgttcgtcctcgccgatcgacgtcccatcgttcgcccggctcgtcgtctcacggcgccgcctccgtcgtcggattcacagcagcgtgttccacgccgtcctcgcctctgtgcagctgctgccggctgccatcgtcgtctcctcatcggccccggtcgtcgtcgtcgtcgtcctctcgtcgttcccggtttcgctcgtcgtggcgttcgtccctccgtcaagccgttctcgttcgtcgtcctcgcctccgcgtagtgccgcagccccgtcatcgtcttcgtcctcgcctccgcgtcaccaagcgttgcgccggccgcgtctcgccttcgtgcaaggatcgccgccgaagtcgttccctcgccgttcgcctccgtcgtccccgagccgtctccgccgcgctcgttcgtcgttgtcgttcccacgcctcgtcgcgtggtggtaaggatctctccctcgtcgccctcgtcctcgtccttttggtatcgcccgtgcccgttgtgcggttgtcgaccccagtacccgtgtactggtgtcggtagtcgttcgcttgtgcgtgtggtgaccgtgttagtgtgcccgctcggtagcctcgtggtttccacgtgtgcagcccgtgtggtgtctagtggagtccgtttgtcgaccacttgcctcggttgacacacgggatccgcttccgtcgacccgtggaccatctctgtgtactcggtctaccgtggtcctttaggttgacatgtggggtctgcatgtcaacggcgcagccttcctgtcttttccaggctagcgcttacacatgttttataattgcaaaacctaatcacaataatccgtaaatctccattgtcacgaccggaaataacccaacgggcgttccttacgtgcgtgcattattccttgtcccaggaggcaaggtataccaaaagttgatacaattcagagttcaacaagcggaagcgtaaatagttaatttattacatgggcagcgaaggcccaacacacacaaagacaaacgagaaacagcggaagactagggcgacgaccacaggcgcttgacggcaggcacaagctagacaccaaaaccttcatcttccagagactcctcttctgggtttgggaaaaattgagcaagactgagtacaaccaccgtactcaacaagacacacccacaagtgcataataaatgcaagggagtacaagggagttataatataaagggttagggttgcagtaaacagcatttaaagatacttagttgctcaaagctattttgtaaacacgattctagaactatacaatattatttatcaaggccgtgaacccacacgaacctgccttaacccaaggcctacgatgattcagaccaaaccggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggtaggcaggactgagcccccagcagcaggacaccggccctgtgccatgacatctcgactaccgggccgcagctcgtgtagccttcatttgccctggagatgtccatcgacccccgacttcgtccatctctatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccatgaatagagtacacactagttggggttttgtttatcctagggtgaacaaggtaataataacaatagcaataataatgtcttaacaaaggtaaataggcatggctaaataaaacagtgataacgcgggaatttaaataaagcggtaatgcattaatttaaattaaaataattttataaactgggattcaatatgctcaaggatgatgtgacttgccttgctcgctttcccaaacgccggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaatggatttattgcgtcagccgaggggaggggcgcgcggaccgggtccacgggggtggggcccacgcggcagccccacggcccacggtggaccgggcgcacccgggctcgcaccggccggcgccgtgggtcccacgcgtcagccgcacctaagggcgcgggcggctgacagccgggccccacacggcagccgcggggcgcgcccgaaggcggccacgccggcgcagcggcgggaggcggcgcgcccgtgcccctatggtcgccggcggcggccataggcaccggcggagcggcggccgagagaggggaagggaagggggaaaacaagcggcggtccacggctcaccccgggtcggcggcgacgacagaaacggcgaccagagcggaggggtggacgaggtcgccggggatgcggtgaagccgaaggtggcgacgccgaggcgggaggtggtccggggcgacgacggcggagagagagagcgacggcggagagagagacgcgacggcgcgagctcgattccgacggggagagagggcggcgagtggcggaaacggtggagggaggcacggggaaggtttatataggattcccaggccgagggagctgccggacgagggggaaacgggcgcggaagatccggtcgccattga

SEQ ID NO: 62456 - DNA, 5219 bp, Oryza sativa
gggcggcgggagcggcgggaggaaggggatgacgggtgggccccacccgtcagcgagggaggcgggcgggcccgcccgtcagcggcacgcgcgcggggtgggggccgaatgggccgcgggaaagaggagagagagggagagagatgggccgagccggcccaagagggggggaaaggactttttagggtttttctttttataaaacctttttaactttgtttatttcttcttaattattatttgtgctccgaaaattccactaaaatttatttacgcattttaggcttttaggaaatatacaaaaatcctccaagccttatttgacttttaactttgcacattttaattgttggaggctttcacacggattttaattattctaggcataatttcgaggatgtattttagagtcgttttgggacgcgacatccatgtaacagcattaaacttcggatgatcatatcttggtcatacgaaccccgaatcgacccgttcaagtctcctaatgtttgttataacctaaagaaccgtgtgctttctttttatgtattgttattgcttctttataggcttgtagctttgcttgtgtgcttcgcgtagcttctgtcgttccgaaggttctcgaagcatggtttgcggtcgtcgccaaaggttcggaaggccgttctctctgagcaaggcaagtcacatcatccttgagcataatgaatcccagtttataaaattattttgatttaaattaatgcattaccgctttatttaaattcccgcgttatcactgttttacttagccatgcctatttacctttgttatgaccttattattattgctattgttattattaccttgttcaccctaggataaacaaaaccccaactagtgggtactctatttatggttccactagtatgaatttaggtagatgcttcgctgattaattaggtaacaataggtggttttataactttagactttaggaattctcatatcacttggatactatggaatggttggcttatggtggaattggacatacccctctcttcctatttcaaaacccctaaaacctgttttctggtggggtttgggtgcatgccagttgtgggaagtagcaccccggacaatataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaagctacatgagctgcggctcggtaatcgagatgtctaggcaaatgaagactacacgggtcggtgcccgttagtcgagatgccatggcactggactagtacgcgggtggtctcatccctatgcgtgtggtgcacccggtctagatcctgttgctaggggctcaatcctggcctgcctgtcccgggataccggccgtaggcagggttgggtcggtacttttgttcacggctaggatgggtgaagggttatgtcacatgtttacgacgggttccaaggccatggaatgcggagtaaagatgtgtcttgtgggtaaagatgtacacctctgatcagagtaaatctattcgaatagccgtgccctcggatatgggcaagcctagcaatgtacccaagttagtggtttaattcttaaaatttgcttaacaactaaaatatggaatggttggcctgggttggcttgggacgagctgggacccaggtcgggttgccagttcggtctgaatcatcgtaggccttgggttaaggcaggttcgtgtgggtccacggcctcgattaataatactgtgtagctctaggatcgtatttataaaatagctttgggcaactaattgacttttaaatgctctttactgcaaaacctaaccctattattattaccccatgtactcccttgcattaatcatgcatctctcggtgtgacttgctgagtactgtggttgtactcattcttgctctatctttcccccccttcagtaagagaagctttggagaagaagtcttaggtggagtcctggcttataccccagttgagcgcctgtgaagatggagccgtaggcccgctagtccgctactgtttatttttgattgtcaggcctgaagtgcctttgtaataatgtaaatattatcgatataataaagatgtgcggtttgtatcatgtttgtgtggtgtaccccggcttttcctgggacggggattaatacactagcggtcgggaaaatgcaaattttctcggtcacgacatgcgccctatgggttggtgcggggatgaatattgttttcagattagtgatgacggagatacctacgtctagaggtattggatgtgccagaactatgcgtatagtccagagaaggctaagcctgtgcctaaggaaagaagggaaaggcgaagaagccagtggaggtaaatttatttattttatatggtaccaccttgaatctatgcaactctgccatcaacatataatgtgttgcaatgtgcaggcaatgaagatcccgcctcctttttgtgacttttgtggaatggattgacaaggagatgaatgagtttcatacgagtttgattcgacattggcgcgagtggaaggaagaacctaagaagcgccaacgcgagtgtgctgcaatacagaaggctgagagggagagggagttggcaatagagaactgggagaaggaagagggtgatgttgattgggtgaggaaggtggctagggcgcagcgtgtgaaggaggcggggacggaagtgccaaggaagggcgagtaccctcgtgcacccaatagtgcgatggaagttctaacccaaaattcgattccctaaggcatgtaataccgatactttgaaatgtcttgcattgaactatatgcgtgtatgccatagacctttggaattcatcggaatctttagttcgtcatgtcggtcattggacgtcattggacttcatctcctccgacactgttccaggctcctctcatgcgttcgctgaccggcgccaccttcccttgtttctttggttgcaaccaccctcccttcagcccatgtagtggcagtcacccaccccgacgacatggcgccaatcatcatgtgatgcctgaccgacgctgatgaaccttgagttccactcgacactcaaggttgttgttggctcgatctttcggtgagttatagataactacgatttgggagaagcgttgacgatccgactacaaccgtacaagacgttgcgttgcgccttagtgatcgatacacctctccgtgggttgttgatcttgtcggtgcagatcaaccctattcctgcaagaaaatcgaagaaataagcaaaaaaacaagataaaaacgatatgatattgcaaataaaaattgaatgcaaatgataagttggggtttcgaatacaagcagacagacggtctagccgacacgcgcactacaagaaagtagcaatggctaagctttcatctaaacaaaacccaagaaaccctgaaggggtacctacctatttataggggtgggaggacgaccaagggatgccaagggttgttctccacctggttggggcgcaccccacatgggcccactagggccggggtcccaaacaaagttacaagcccataggcccaagacacgtgatgtagcaccttgtttatgtgattgcagccaaacgacaaggaatttggcaatgaggctagatctgttggaaagagggcttcgagagctttccatcaagtactcatgggccgaaaacggaggtcgtatgcaaattcggcggccgtttgaagtcagcagtgtagctggtggccgaatcggattacagcacttggaggacttgatctttatatcttcttgttcatctatgatgtgagcaatggttgtatccgtagcagccaaggtcacatcatcctccccttcttcatgaaaaatcgttctcggtttttccatatggtgctcattgcgtggtcgatttaaaacaacctgtttcatccaatcaaaacaagagaaactcgaagtaatatgattataaatagcatgtctctctggcttgaaagttttatacacatgtacaggaggttctaaatccgaacatatgtaaactgtatacaccaaatatatttctctatcattatattcaccaaagatatgaaaaatagcattagttggacatggcaaataatatttagcaaataatttctccttcaaactatcgagctcacaaaaatcatcacactgaacatagcccaaagtatttaaagaagatgtcaattcacgttgttgtacttcattagcaaaatgaataacatgcttaaaattatcacataaagaactgacattagaaatagcatgttcattcactagttgtggcattgatataagtgaagcattatcacacaactcttctttatcacaaggaacaacaaacaaatcaacttgtgacaaaggaatctcatcagttggttggttccactaatggttgctctactatagcatgaaaagtgaacaaattcaattcattaacaacacactcaccttgaataatttcagcaccattaagtttacctttaatgccctcttcatatgatggaggtgccttgactttgagtgtgaacaatgggactggtggctctttcatgtctctatcctccatttcatgattatgtacttcctgcaaatggttagtaatagaagacaaaaacatagcatgttgcttcttcatatcctctattttactttcagcattacaagcaagttgtaacaaatgagaaagatatgtatatctttaacaatcaagcatgtcttgaatttctttgttaagcccacgtaaaaagctcaattctatagcttcttcgcattcatctaaatcacaacataataaataagcatgcatatcatgatagtatgaagtaacagttctggtatcttgtttggaacattgccgtttgttgaacagaatgtcagcataatacatgggaacataaacatctctcaaatatcatttcatgtctttccaagattgttgtattttattatgcctacaaagatgtttccaatcatcatatgtaattaaaacactagaggcacacataatcttttgtttctcagacaatccatgctttttaaattcgctatcaaccgctagctcccaattaatgtaagcatgagg

SEQ ID NO: 62457 - DNA, 3833 bp, Oryza sativa
  unsure (1)..(3833): unsure at all n locations
tcgcttgattaatcttgtcattgttagtagaaaacaagaaacatacacaagaatatgcacgctcctatcaactactaggtagtggcaactcaaatatcacacacactcaaagcttttaccgagctcttacaagttcttaccaatgcaagcggaaaggtgacatacaccgactcaaccaagcacccaaatggaggttggatgtatcgatgccttggcaaacacttgtcgtacggctgcaatcaaatctgtggagctctggataggcttaagtatgtagcaaatgaatagcaaatgctcaaatcagataatgcaaagttgagcaattgttcaaagtcgagtaccatgctggtcctaggctagaacgtactagagacgcgagcctagacacaaacataacacaaaatagcactagaaacaactcaagcacactctgatatatcaaattcagctcaaaaatacaactgatttttttttctttcttacttcttcttccttcttttcttctttttttctttttttttgatgcggcttttcttttatttttttcttttttatgcaccttcctgcctttttcttactttttttatttatttttttctgcaaaaatgactcaaggacctcaatgcaagattacatggactcaattgtaaatataaaatatacagggactcaagtgtaaaagtcngaatccaaaaaatgaaattataaaaaaaaatggaatgctgaatttatgctggttatgtttttccaaacggatctcgaaaccgacaccaaacaaaaattcaccaagctgtacggcaagtcacggtgtagattgaaatgaggaagggagtcggataggtgggaaaccgactatctcggctgaaagtttgggtatctcgcatgaaaggaaacaaaatcaatctcaacagaaaccggtacctcccatgaaaggaaacaaaatccgatcttaacacaaaccgatctgctatcctttctttctccttaactgcgcgcaacagcgatctactatccttcctttctccttaaccgcgcacatcagatcttcttccttgcgtgaagagaacaagcatggtcgaatgcagatggcaaaccctagatgcaactcagcaactccaagaccaaacgataaaaacttctgaaaactagaaaaatggaaccctgacgacaagacaattcaagttttgtaggtcccagcgacaacaatcacacggtggcggcgatgacagtggtactaaccgtgactagaactcgaaactctaaacggactagacactacgaccagcaacacgactcaacgatgcaacacaaaactcaacaaagcaaaaactgaaatgaacaatgcaatggcacaaatatggccaggtacaggatgcaatttttttgtaaagcagttttctggttataggtagataaaaaaaactctccgagcaacgaaagctctaataccacctaatgaaccctgagttccactcgacactcaaggctgttgctggcctgatcttttggtgagttgtagataactacgatttgggagaaacgttgatgatccgactacaaccgtacaagacattgcgttgcaccttagtgatcgatacacctcttcgtgggttgttgatcttgccggtgcagatcaaccctattcttgcaaacaaatcacagaaacaagcaagaacaacataaaagcaatctgatattgcaaatagaaattgaatacaaatgataagttggggtttcgaatacaagtagaacgacggtctagcaggacacgcgcgctgcaaggaagtagcaatggctaaacttttatctaaacaaaacccaagaaaccctgaaggggtatctacctatttataggggtgggaggacgaccaaggggtgccaagggttgttctccacctggttggggcgcactccacatgagccccactagggccggggtcctaaacaaagttacaagcctataggcccaagacaggtgacgcagcaccttgtttatgtgattgtggccaaacatcatggaatttggcaatgaggctggatccgttggaaagagggctccgagagctttccatcaagtactcacgggccaaaatcggaggtcatatgcaaattcggcagccatttgaagtcagcagtgtagcaggtggccgaatcggattccagcacttggaagacttgatcttgatatcttcttcttcatccatgatgtgagcaatggttgtatctgtagtagccatggtcacatcagatgctgccgcccaccacatccccgccagctcgctcctgcctccatcgtggggctggcactgccctcccccctaccccaccaccacaacgcaacccaggcgccgcccccttccaccccccccccacccggctcgctcctacctcgcgtagctagatagcgacccctcccctctctgaccatagcgccaacaatactggcatcctcccatcccgaacttgtaaagtagcaaattgacgcgcataagccaataatttacacaattcgatattgtatcaaatgcaaacatttcaaccaactcgcaatgagcatattaatcaattattcgcacatgacataattgttaacctccacacatgacccaattccatcgaacaagtccacaagttcaaaaaatgcatatcacacatgacatacaaaagttcattcatcacattggaccatgcatcaccaaagttcatcaaacaagttcacaagcccatacatcaccgaagtccatcaaataagttcacaagtccatatatacatcaccgaagtccatcaaataagttcacaacttcatacataacccaagtccatcacacaagttaaaaaatggtctaaacatgagaagtactagtacgtcatcaaactcacatcttccgttgacatcaaagagcccatgactcgggagtgtaccaacatttcaaaatacaatgtgaggcaataacacatcatggataatagtaagtgcactgtatcattgaagtacggagtacctcttttccctctgctgagtgggacataagttgtatgtagtgggctacgacgcctgagggcgcatcgggcagctgtgccatgccgatctcatcagcatccggtccgatgtatagtcatcgtcaccggcattgtcatcatcatcattcgatccatcatcatcaaaatcctctagacattatcaatatttgataacaaactaaatatatctacatgtttgttatttttaccaaaaaaaaattgatatagctaaaaatagcccttataatgacaaagctaatggcgccgagctaatataataactcttaaaacattacaacatattatgggacagttggatgggcgtggtgtagttgtcaatgtatttgttgttgcatcttggagagctagctggttcggactcatcttccttgctaggaccagcggaagttttttttttctaaagtaattaagcaaacagttaatacgttaattcatgactgaaaggaatgaagaaaaggaaaggaacaaaagaaagaaaaattgaccgaatttctgacctttgtgccaaatttattttttttagataatggaatgaaatagcatcccggcctttactcgaaagagctacagccaattattacaaactagcactctgtaatagtgaagttcaaatagaagcaaacacaccaaccaaactagacaaaataacattattccagtctattggtaaatctccatccatgattggcaaacagttgcataaccgtcgtttcaaccttacgacatgcaacaattaagaaatctgcatcttcatcacacttttgtaactgtgcccatagacgaagccaat

SEQ ID NO: 62458 - DNA, 1008 bp, Oryza sativa
atcttgatcttaagcggcatcttgagtttccaaattaacttatttctgtcaatgtaaccattattaattaaggctaagtacattgatctaactgagaattggccattctgatgatagttccatctaaaataatcagaagtattattcaattgaatatgaacaatagatgcacacaattcatgccaaagtgttaaattctgaccaactaaagctctcctaaaagaaacattgagcggaacagaagtcatcacactagcaacagaagaacttctcctactgacaatagcatataaagatggatacttttctctaaaggccgtatttcctaaccatctatcttcccaaaatcttatgtgttccccattattcacaatccaagaacccatagttaagaaagttttttttgactttcatgagtcctgaccaaaaatgggagtcaccttgtttcctgtcaacttgggttataaacttattataaagatactttctcttcaataagtcttgccaaacaccattttcatttattaacttgaacaaccatttactcaaaagacatctattttgaatctctaaattatgaaccctcaaacccccctattctttgggttggcaaataatatcccatctagtaagtctatactttttcttatggtcatctccttgccaaaagaaacgagatctataataatcaatcttttgaagaacccctttcggaatctcaaagaaagatatcataaacatagctaaacttgaaaggacagaattaatcaaaaccagtctacccccaacagacatatgttttcctttctagctgctaagttttttctctattctttgttcgataactttccaatcattattacacagctttctaaaatgcattggaataccgagatatttaactggaaaagaccctaacttacaaccaaagatattagaatattgctcataacactcctttgcctgaccaaagcaaattaactcacttttgtgaaaattaattttcaa

SEQ ID NO: 62459 - DNA, 1780 bp, Oryza sativa
ttgtaaacgagcaacatcataccttctagtaaagttcataaacggtatatcgatctccttctctatctctggtgagttatggtatgtagttccataaacggctgtgttgctaaggtaaagaccttgttgtggcaattaacaggtcgtgagagatcgattaaacccgtacaatcctgtttttttttctatttgttagctaagcagttacataaatcttaaagcaaatctagctaaatagcacgatctaatctagttaaatattagcacaaatcctggagcaactcatgagaccaaaaaatcgtgtgatttcttaacgaaaatcacccctgtgatttatagcaaaaaaaccgttcacattatgtttagttcccaacatagatcattctctcggcttatggggaattattctactctcgcgaggaaacatcctttatcgtttccatgttactcaaacggatatatttttaaaaaaaaatcaataagattaatataaataaaatcatcactccataaacatgcgatgtcaaatttaacatgttgtaataaaaaaacaaattttaatgtgaatatacgttaagtatttatttatttttaatttgtagaagttgaatattaacatgtatgtttatgaggtgatataacacatattaatatatcctctaatttttgttaagatatgatatgcaaataattagaaagtttaaaatccaggctaatagtctcgagttatttagttgtgaccatcatttcgccaacttatacttttcgtctgtccacgtcgaatatggatcagaatctatccactctctgtaggctcacacgccgcgccacgtctatatagagagagagcaaaattaacgtgactccataccaacgaatgctgttttagaatcaagtagtccccacgcacctgatcattgtctaagtacgtagttagggtgcaaatggccggagcaccgacgagcttagggttctccgtcaggcgccgcgagcgcgagctggtggcgccggcgagaccgacgccgtacgagttcaagatgctgtcggacatcgacgaccaggacatcctccgcttcaaccgctccggcatcagcttctaccgccacaaccccaatcaggacggcgtcgatcctgtcacggtgatcagggcggcgctctctgaggcgctcgtacacttctacccgctcgccggccggctccgcgagctgcggcccaccaggaagctcgtggtggagtgcaccggcgagggcgtcgtgttcgtcgaggccgacgccagcttccgcatggatgacctcggggacggcacgtcgacgtcgtcgccgctgcttgcgccgccggtgccgtgctacgacatgctgctgtgcgaggcggagagcccgacggcagatgtcgtcgaccgccccctgctgtttgttcagatgactcggctggcgtgcggcggcttcgtgttcgggatgcacatatgccactgcatggcggacggctccgggatggtgcagttcctgacggcggtgaccgagttcgcccgtggcgtgccgggcgccccgacggtgccgccggtgtgggagcgcgaggcgctcaccacccgatcgtggccgccgaccgtcacgcgcgaccacgtggagtacgcgcccctgcccgtcgacgacgacgacgacgacgtgctgctctccctctccccgtcgaccaacgcgtacgcgcaccacgtcttcttcttcggagatcgggagatcgcggcgctccggtcgcaggtagtggcggtctgctcgcggttcgacct

SEQ ID NO: 62460 - DNA, 15466 bp, Oryza sativa
aaggggctcaatgccggagctgctgccgtgctagacgacgcaaaagcaagggtggtgcctgatgaaggctacgttctagcaaaattgtaggtctcatctcgacggagtacgaaccacggactgcatgtacgccacgaccacagcagctctcaataataataataataataataataataataataataataataataataataataataataattgtattgttgataattgggggcaactatgactagatgcccgatatttgttaaatagcggccggtgttgcatcccatggttataaccgtttcagatgtttcattacttagtacaaaatgtttcagcacttggtaaaatgtatttactttaacaaggagagaatctactccatgccactgaacttgtcagttgtcacagttcaatgatttgtcgctaacattgtctctttctctaatataccagtgattttatcaattgttttacaatatacattgggttggactttttttaaaaaaaatacccaaaatacccttagagacatacaagattaacaattattttttctcattagaagtttcataaaaaatatgaaatttttaatgtagcttccttacaaaacatggaaacttgtatataagtttcaagtttttctaacatatttattttctagaaaaattatttttgtgtggtatatgagagagagtttgcttacacaaatgatgatttatattaaaaacaccaaaaaaatattttatatagcatattacagataagttatatttttgaaaaatgtagaaatacaaacttcatattgtgtaaggaggccatatgaaaattttcatagtttttcgaaacttctaatgagataaatcaattgttaatcttgtatctataagggtatttttgaattttttaaaagaatgtccgatccaatggtgcattgtaaaacaattgataaagtcgtcggtatattataaaaagagataacgtcaatggcaaattattgaactcgaataaactcaatggtatagaatagattctctctttaaaaagttggttgcaacaccgttatatatgttgttgtgcatacatatatagtttcttaattaaaatataatctagtaagatcttgttctaaaatttaattataacaaatatataaccacatcatgtaatagaatctaaaatttctcaaattgatcatcatataaccatatggatacggatttcgtcagaatacaattaatggagtatgggagaatgtgtgtatgctagggtataattggcatgaggttttaatccatgcatgcattgtgggagaatatatgcatggtgtcttgattgatgtaatttaaattgtccttagtcttggtgtataaacttatatgatgatcaatttgggaaggagagagtaatttagaagaaaacaaatcatttcaagccattcaatatttaaaactacactctattggatgctcgcatgtgcatcccttcatatgtgagactgatggctgtttcatacacattgggtaggcaccgtctgattttatttttcggcgtcgtaggggatcgattttcgcaggcgggcatgtaattcggagccaaaaccccgccggcaaaaaaagtacccggggtggagtgtacggtccgcctgcgaagatcgatcttcgcaggcgtcgcttatatggcccgcctgcaaagatgcccctatatagtcttctttctccccgagccctgttcattctccccgacgtttctctctcctaaagtgacttaaatatagggggaggttttgaacttcaaatcttcgggggatttttctacagtacttagatctactcatttccacactaggtatgcaattttttaagcttttagatcttaatttgtgatggatttatgcatccaaaattgtgaaggaagagctccatgttttttaattttatttcttttgatatgttgatgttagatgtatgtgtaatacttgatgcctcttgttgtagtggtttaatgtggtaacataaattctcgattttttttatttttgctatcacatccaccacctagttctagatctagatctagatcttgtcatatatagagagagaataaaattttaaatgtctatttattcggtgcaatcaaaaaatagttatagtattttgtaatatgccgatgatatgattttgttagattttcctaatgtactgatttggcatgtctatgtaaaaaaaattgaaataaactttgatttttttattaatttacacttaaccttaacctttagttaattagttttgaatagcgataatttttttcaataaaccctacaaatttggtattaattgtgcaaatattttacgtgtatttttttagagatatggaaagtcaggaatggatgtatcattggccgaggtttttgtctccatatagaatcgaagtggctaaatttattggtattgccaaggcacacgctgagaagaataatatgaggaagataatttgtccatgtgctgactgtaagaatgaaatagcctgggactttgacgatgcttttaaagtaaaggagcacttagtaactcgtggatttatggacaattacgaaatatagacacgtcatggcgaagaacaagtggacgggccagaaaatgtagttccgacacaagttgaagacatggtgcatgacgatggttctgttgaggacaaaatcgacctagagtaaatgttacgtcatgcagaacccgaggtgctgatggggtcggctagagggttaaataactttgaagctttacagaaggcagcaaaggaagttttgtacgatgagtcgaagggctgtgatagtgagttcacaacactccggtcagttcttgaacttttgaggttaaaggcgagacatggatggtctgataccagtttcgacagtctgttagaacttctgcagaaaatgctcccgaggcctaactcactaccatccagcacatatcaagcaaagaaactcatatgccccctttcacttggtgtggaaaagattcatgcgtgcgtaaatcactgcatactgtacaggaaagagtacgcttctttagatgaatgtccaacatgcggtgcaagccggtacaagtcgaatagcaatactggcctagaaccctctaaagcaactgagggacgatagagaaaaatcccgcagcttgtgatgtggtaccttcttgtcaaagaccgcattaaacggatatactcaaacccgcgagatgcggaactaatgcgctggcatgaagaagggcgcaagaaggatgggatgattcgacacccgacagatgctcgtcagtggataaactttgatactcagtatagagagtttgctaaagacccacagaacattagatttgccctgagtactgatggagttaatccttttggagacatgagcagctcacatagtacttggccagtgcttctcaccatgtataatcttcctacctggctttgtcaaaagcgaaaatacgtactactctgtatcctcatacagggaccccgtcagcctggtattgatattgacgtatttcttgaaccattgttggaagatatggttgatttatggaaagagggattgaaagtgtgggatgagtacttaagggaatacttcacagtaaaggccatcatcttcgtgaccattaacgattatccagcaatgttttcagtttcaggtcaaattaaaggtaaaataggatgtgtgatctgcttgaatggaacgtactataggtatctcctgggttccaacaagcttgtgtacatgcggcaccggcggttcctacgcacaaatcacaagtaccgcaagatgaaggcggagttcgatggtactgaaaagactgatcctgcaccaaaaactacatcgggagaaaaggtgtgtgcaatgacagagaaaattgtttgcgagtttggaaaaatgactaagaaaccatcaaaggggacagcgcaagaaacccgagaagaatacgaagggaggggatagtaagaagcaagatgacagttcgaagccagatgataaactccctaccccattcaagaagcattccatattttttaagtacctctcgtactggaaagatctagaggttcggcatgccatagacgtcatgcatctagagaagaatgtgtttgacaacatagttggaacattgttggacatgccgaagaagactaaagatggtctgcaatcaagaatggacctagtcgagatgggaatcagggaagagttacaccctcaagaaggagaaaagaatggcaaagtatatcttccaccagcctgtttcacactgacacctgaggagaagaagtcattttgcaactcactccgtgatgtcagagtgcccataggtttctcatcaaacatcagtcgactagtttcaatgaaagatttgtcggtatctggttataattcacacgactgccatgtcttgctcaccgtgtttcttgcaattgcaataagggccataaaaccggagcatttaaaggttgctatcacaaggttgtgctactttttcaacgcagtgtcatagaaggtcattagtctcgaagagttaggaaatctccgtatattcgcacatgagacacagtgccaacttgagatgtgtttccctccgtcatttttttgatatgatggagcacctcattgttcacatagtgccacagatggttgcacttggcccattgtacctccatcaaatgtggtcatacgagcgttacatggcggttctgaagtgttacgtctgaaatagtgcacatccagagggatcaatggttgagggttatagtactgaagaggttgtcgagtgttgtatcgattacctcaaatatggatatgcaattggagtacctgtgccccgacacgagggcagattgagtggcaggggaacgataggaaagaagagattcttcacccatgatcacaaatcattccaagaagctcacttcagcgtgcttcatcagtttgctatcgtcgagccgtacatcgatcaacatatcgaactaatacgagctaacaataagggtcgcaccaccaagtggataatgaaataacacaagcgtctcttcatagattggttgcgagacctagacttacctgagggacaaactaccgatgaaataactatgaagcggttggcttgtggtccatcacctacagtaaattcttggcagggatatgacattaatggatactcgtttagcacaagagcccgagataataagacctgtacgcaaaacagcagtgtctgtgtgaaggcaattaatgaagccagggaaaaacaattatacttcgggtttattgaagaaatatgggaaatcgactatgggcacacaatgcaattccccatatttaagtgccagtgggtaaaatacccgaacggggtcaatgttgataagttcggtcttactattgttgacctggcgagtgtgggtcacaaggatgacccttgggtactcgccaatcatgtggcacaagtgttttatgtgaaagacccttcaaatttgaagaaagatatagtgctaccagggaaacaaaagatattgggagtggatggggttgaagatgtcgaagattacaaccaatacgatagtatgccactttatagtcagtttgtacagaagattaagaatgtcgagacatctactcagaagaccatgaagccttacatacgcacggacggtgtgggcaaaaatgttaaagggtaatgattgttgagtggcatgtaagcatctaagaagttagtagttatgtaatggtggtatgtaaggtgatgtgtgatcatatcgcaaattgacgaacaattgtactcaacattttgcatattaattagtttgtactaatttttatgtgcaattaccatttgtagtgtaaaaattttgttaaaaaaattaaaattagtaatatttgaaaagtgtaattatttttatgtgcaattaccatttatacatttgaaaagtaataatactaaggtttgtacattttgtaataatattaagatttgtatattttggaataaatatattcaactctgtacaaattttttcagtcggacggcccgcttgcgaagataggaaaaaagatcttcgcaggcagacggcccgcttgcgaagatagtaaaaaagatcttcgcatcttcccaggcggaccgcccgcctgcgaagatcgttgcccaatataagggcaagcccgcggcgccaaaatttctaagtccaggcgggaaccctagaaattttggcaccgtcaggctgccgaaatttttcgccgccgcacgccttcgccgtcctccgccgccgcccgcctgcgaccttcactctccgaccgtcgtcctccgccgccaccgaccgtcattgtccacgcgctgtcaccgagaccgccgccccttgccgccgctccaccgcgcgcgacctccaccactctgccgccgccgccgccgacccctccaccgcgcgcccgctccaccgccgccagctcctccaccgccaccggcccctccaccgccgtcggccacccctccaccgccgccggccgccacctctccctctatctcgctcgcggccgaacggcttaatcggccgatcgttgtccacgagcgaagtcgtcctcggccgaacgacgtcttcgaccggtcgtcgtccacggccgaacctcgtcttcggccgttcgtcgtccacgaccgaagccggtcgtcgtccacggccgaacctcgtcgccggcccttccttcgtcgtccacgaccgaagctcgtcgtcggccgttcgtcgaacacggacgtgtgtgcatgtgggtgtttctttttatatgtgtgtgcatgtgggtgtgaatgggcatgaggggtggctgatatgtgaatgagggcttatgttgattgtgaatgtgaatttgggaatgtgggtgatatgtgaatgaaattgggagggtacgttcaattttgcaagatatgtgaatttgtcaaattttttaaataacatgttggagggtatgttaacatttttttaaaaaaatgtggaggatatgtttgccttttccattttttttaatcaacatgttgatgaaataaggaagtcaattagtgcactacttgataataacatatcaaattttgtacaaatttgtttgtagtaattaatttagcataatagtaagtagtcattagtttcgcaatttaaatttgtttgtattaattaatttagcataatagtaagtactaattaataatatttcgcaatttaaattagtttgtactaattaatttagtataatagttaaatttggaaatctcagagaatttaaatttgttcatacgacatattgttaatatacagtttatttttgtacaaagttgtttatactaatttgagtaatttaaaatgtggacgataactctttttttttatattagaggtttgaaacgatggccgatagtactaaagggactgaagagaagggtttaggggagcaggagctgtcccttgctgttgtggttgctccggaaccaacggtcccaccgaaaggtagttccaactgcgacgttggtgatgaagacgaggattactcgtcgccaagcgatccttgtccaagcccaagcccgaagagaaggaaaaagggcaacagtgaagaagacgacaaggactacattccccctaaagaaggggtaagtaaacttaatatgtaaaatgttcaccgtgataactattagcccgagctaattcgaaacttccatgtataccttctcgtaggaaacggcgccacggcgatcaaaacggcagccgaagaaaaaagttccgtccaaagacgacgacgtaccagctaacacaaccggcacaaagaaaatcgaacggttagcaatcacgaagaaaaggaagggcgagagaagcgtgaatagaaaggatgaagggttccatgttgttacccatgtttcgcctaaaggagagccgctcgcccctaagacggcacgtgcgaaattcagttcacagtgtggcataatagtaagggaaaagatccccatcacggtcaagtactgggattatgtatcgaatggggataaggaagtcctatggaaagagttgaagaaaatcttccagttcccggatggatcaaaggcagcagtaagaaattgtgcactgcaaacaatggccaagtcttggcgtggttggaaaaccaccttgaacaagaaatttgtgaagactggacgcacaccattttcgacgtatgccaacataacccccaatcagtgggacgactttctgaccttgaagaactccccagaagaaattcaaaggagccaaaagtatgcagagttggccaagaagaacaaatttcctcatcgcttaggctccgcgggatacgcgtggtgagtggaatggtttagaagctttgattcttcaagaatgtccttacggatataatgttcattgtttagcccaccaaaactaggtacgaaatgaaatccactcctaaacttagttgtattggtattggcctgccactggtggagcagtggacaaaagaggaggaggaaatgaggaagaaggggcaaccggtaccaatggaggagtagacacagagatcaaggaactgggtaagagctagaactccaaagatcacggatgaaggaaaagtatcgtttgaaaatccggagctgcagagcgttgccgataaaatagaaaatttatccagttcacaaaagaaaggatatttcaagcttgaaagggagaaagatgtgctaagtacggcgctgggtactcctgagcatgggggaagggttcaaggtgcgtcgagtaagatgagttggaaggaagggttcaaaaatgacccctacaagaagcgtgaagcgtacaaggataaacttagagacgaagggactgcggagtttgaaaggcaaatgatggatttctgcgtcaagcacatgattttgcctcgccccgaaaccaaagaacctgagccagattaccccttcgataacctcaaggagaatacaccctgcagattgcacgttcccattggacgctccgggaaaactcttgaagccgctacagccattgctatccctgggagaacatacaatgaagagttcatacccgctgtgtatgccaaggtgcagccgcaagtggtccacgaagggtttgagtcctacgacattgacttcccgactgcagatggtgtatccgtacttggggatgcagtcgatcttgtaattctctggcacaagaatgacatatcctttggattgggcaccgacgccacgcaaaaacctgtggtgcctaaaccggggttgggaaaacctccgaggcctcctaagaggaaggtgactgataaggcggaggaaccagagatgtaaaaggaaaatccagtgccgaaagtgccaccggagattgcattgccggaggcagccatggagattgcaccgccggaggcagccatggagattgcaccaccggatgtgcccatggagattacagtggcagaaccagaggtgcaatttgtggcatcagtcgggtcagacaaagaagaagtaccaggattggaatgggacggtacagagccagaaatatttgaagacccttctcctgcgaaagaccccgaggtgccacgagtgcttaggagccacgactccaagtccaaagatgagaacaaggagaagttcatggtaaccgtcttcagagggggtaaagaacgtgccaagctcagagatgacgacccccagaaagctgctgaactagccgggccaacatacttcgcaaccgatgattgcccggaaaagtacgaacatgggaaagcactcttgccggaatgggcactgaaagaagcaccatgggagatgagaaggttacataacttctacatggaggccagcaagaaaggcttaggcaatataacagctcgatcaccggcagattgtttcagcgaagaaggttacgtatggctagatttctcatatctccactccatatatcgtcgggataagatggacgtcaactgcgtcggtgtttggtgcatgtgagtatgagttttaattaattagatgaaaaatatgtacaatacaaatccatctgattgttactaacaaacttcttctgtaggatgcaatacatggatgctaagaagaaaaaagaacccatcggcttcttggatccaactcggatctgccaaacacagcatgccgtgacgctagcaccagggtcaaaccagctgaagggcaagaatccaaaagagatagcagaatacaagaagggcttgcataaggagaaattgattactgtcgcacagtacattggacgagccttcttgcactttcaaaataagagagtcgtcatggccacttataattttaagtaagtccaatacatttatcttgtacacatatatcttattttagctagtactaactaactataatgttgttaatatgtagcgatcattatatctgtttactcatccaccctaaagacggaaccgtggtagtcttggaccctctcgattacagtcacaagcaatacaaagaatttctaacaatcttacagtagtaagttattatgactcttgcatttgtatatgaatgtattataaataaatatcctccttactgtgaaacggtacgacatccatacagtgcataccaatactacaagttcaagggtggagaacagacccgaacacgggagaagctgctagtacgtacctattggccggtaatactccactcacttaatgtattccaattgtttcactaattgcaaattttaactacttttttctataatatgtcctgaagtgtcacaagcaaccgcgaggaacggtcctttgcgggtattatgcgtgcgaattccttagggttaatggacggtacaggactaacgcggaggatgtaagtctctatactatgtactagacagctccacatatttatgatactaatatattgattaatttcaatgcatgcagttgccaagattagaatgtcgaacaagctttgacgatacaggtatcacaaatgtccagcgtgatctgtgccacttcatccaccatgagtgctgtcatgtgaaaggagacttcttcgacccagagggtgccctagcggcaagtgacgaatttaaggatcttcgagagtagaacactgctatgccataatgtaactagatgacgttatttgaagtgacaatgtaaaaaaatattgtaatatatatattttggcaacacttttgagttatgcaatatatgtagatttcttagtaccaaatgcttgataatcttccaatatatgtacataaaaatctacctgcaagaatttctattaaataatttaaaagtaatttacgggcaaattattattaaatttcaatattttctacctatcttcgcaggcgaaagtttttttgttttcaagcggacgattcctattttcgcaggcagaccggactagccaacgtccgcctgcgaaaattatctttgcaggtggacggccgccccgcctgcgaagattggagatcttcacagacgttggcttacaggcggacggtcgccccgcctgcgaagaccctttttggccgcttgcgataatgctttttttaagtagtatttcagtcaattcctaattaaaaaattttcactttgactgccttaaaatagaccaaatctaattcgtacccctcacccacataaccggatatgacaactcctcaaactattaaaaccagtgcaatttgactcccttgacggttttgctgatgtggcagtgttgacctggtgtttgtctcacgtggcgcttatgtgacattagaattaaaaaatatatgtgggactcatctgtcattcacataaaaaaatatattgtaggacccactgactgtgggtccacgtgtcatcctctctcccccttgtcccagcgtgtgggaaggagctcgccggccgaccaacgttcgtgctgggaaggatctcgctgggaggccgtgcgctaggaagcgtcgtcagctgggcaagcgggagaggagctcgctggccggacgtgcacggagtaggagtccgcgacaccattgtgagcggggttcatcagccactgcctttttgtgcttgttcagggacagcatgtccacgccgcgcctgctttgcggttccgcgttttcgatccacgggttaggtatatttttgctaaatccccctctatctatacacacacacacacaaattattaaggaaaagaatatatcaaagatctatccggtcgtggttgaacctctgcaagcagttcatctcccaacatttaggatacatacaaactgcatttcgcaccgatgatgaactggcagccttatgatttctgaccagtgagcatatgtattttgcgagatcccgcgaactgcattttcaagttgtttttgggctgtttaaatgtatgcaactcgtctgcatttctggatctctttcgtccatgcaaaggctttagttctttcacaaggataggaaatcagggggctcctaaaggcttgctcgcgcagccgcgcgcggggccctcatgcctagcgctaatagcgttgattagggctaatgacgctaattagtgttaatggtaattttaggagtttttcttaaaaaatacataagtaattcagttaaaagtttttaaaaaatagttcagttcagttttcaaaactttcacgtctaaattttttgaaaactttcaacccgaatttaaaatttttcaacccaaggtttgaaactttcaacttaaatttgaaaactttcatcttaaaattaaaaacgttcaacttaaattttaaaaactttcaaacttaactttgactcaaaattcacgcatattaaaaatatcaacaaaataatcacgcgaaaaatttttaaaaatcgggtaaaaaagctatatacacatatgattaaaaaaatcacccggagaatagcctgtcacacaaggaagccacacgcgcgtgtactgattttcactagcaacgtgggttcacatcctctaccataatggtactatcatggtatctacgtgtgggacaagaaggttgagatccacgtaccggtgatgataatgacattatggtagaagatcctcaccctagttacatgtgggacaagaaggttgagatccacgtaccggtgatgataataacattatggtagaggatcctcaccctaatggcacatacgcgcgaattatcttttccgaagaaatcaaccgtgccaaaaaaactgcattgcaatgtagtgtaccaccctggatctctttcggccgtgcaaagcaagagattgtcttctgggcgcagcacagggctgcaacttactcaggtgaatttttttttaggagtgcgactaaaaatactaaaaataatgatagcattataagggagaaaataaagcatttactgtagttgtaactactataataaaaacggcaataagaatcagtgtcatacaaaatgaatgtcaaacaaaatgctgacgcttaccatttaaacggcaaaactgactaatattgtaccaggaagcagcaaatggttgagttgctgcaaaatttaatcactccataaaacgatgggacccaattccgcttttttttccggaagaaaaagtgacagaccatctcattccattgcttaaatgaaacataaaacctgagttatttctcaaatgaagcgttataaaactgtacaataacatacaagacatgttaacattgcggtctggtactatttactgtttagtaaaaagtacattttatatatggtttcaacattttgacgtatcaaagctttacaggttacaattttaccactgccttccctcgtcttgctaagaagcaaaacttgttcactccagttgcgccggggtacatatacttttgcaaaaattccaaatttttacattatgcaagccaatagcgtggcggggatcacacacaccagggctttgcactaggattgatcattcctccagaaaccgaccaggcccataaagatttgctgcaaatctatgctaacgtcgcaactgaccacagaccagttctctaaactatttctcgaacatatagatgaatcagacatattgcgctcacataatctctgcgaatcttctcactttgacatcagtgcaggggaagacggcatgacatgataaagaaaaaaaggattcacttggattttcataagcaattgcttgtccattgttatatgttagcagtttcccatttggtgtctaaaacaactggaagaaaagacttgtagaaccatcaccaaatgaccgaatatcagcaggctttaccaatgctctacacagggggcaagtccgttctcgctcaaacctaaaacagaaccaggaaaaagctgtcatttcttgatacttgctcaaattaaggggaaaaaaaggaaaagctaagcattgaggcacttcatctgataaggaatttatgttcatgcaactgaattctcattagtcattttaggaatatatcttctgcagcatcaccaaaagcagtagtcatataaaaggcaagactgtgacaagatgccacagaaatatcactccacatcctcttctcatactataaaatctaattgccattcttagattgcttcacgccaatgttaagaataaacatgaatatgttgccatatccaacaagataccttgctcaattcaaaacaaaggcccaaagaaccaaataaagcatgtaaaaaagtataaaataagaaaagaatttaccattcagagacacagtcctcacagaaaatatgtttacagcggaggaggacaggaacatgcatcttttcctggcagatggcacacatatcaccagcagcaattacctgcaccaggttccagcaaaaaacaagttctttaaacaagatagagtgagagttcaagggggtatcctgctaccaagtaccaactagcgaatacgtgttaaatggacagttggctccacaaataagcctgatggctgaaagctgtatggtttatcgataaaatgatagtatcttattgtactattacaaaatcctacaaatgcttacgatttatcaatagttatggcatattgcatttttaagttgagcaacttgccagtagatgaacgtttacctgttctgctgtcgcataagacccataatgcacatctttacgtgacaatgctttcactgcagccaagaatgactgaacctggaacatacagtcaacaatgagaaaataagcatgcatggaatggaaaaaatatatattttataggttcacagcactaattttgtatgtgagctacagtaactagtaaaagtagtaccttttcaactactgaagttaacttgaaggtcaggtacagtccagtggttaaagatgagaaaagactcccatattccttgttcagaaagaaacggtaccaaacaggagttggcaacaaggcacgatataggagcagaaggtattccacaagggttagcattt

SEQ ID NO: 62461 - DNA, 2586 bp, Oryza sativa
tacgacctctgctattcttatagtacataagtagcatgcacttaatggccattgctgcctggcgaaccattgtatctgcaagtggcatttggttagaaatgccaactgcaacatgaaataaattgtgctaacagataacttaaaatgtttttccctgcaatcctagaaaacatacttctttaagtaaatgaagatagtgccatacagctaatatgaaccttttttggctaaaacaaatctatgttgcctgtgtaattttagcagtttgaaactatgaattgaacaccataaattttgtgccattcaggcattcaaaaatttctagcacatttaatgatctaagtgtacaaataaatttattaaatgattagttttcatcacacatttaactgaagagcatctttaaatttgctgggaattcgaaaggctaatacaaaccgagaaactaatgagttcaacacaaagccttgaattaaaaagcagcagaaagtgaagtaaaaaaaggtcattttgaatgatttttcatgatatgaaaaacgagacaaaattgctcattgtacatacatttacaaagggcaataaattttaatctagcaggtcaataaaggtacttctatgtatatggtcagagttcactatcagataatggagaaatgcatgcgagcaaattcaagaaaccctttaaggaagcatcagtaccattgaccatgatgataaaaatcgcatgccaaaatggcggtatttcttttggcggaagcatgaacagaggtctgagaagatcatcattcctgtaccaccaatagacaccaaacacatgaatcatgaagattactgtaatcccgacaagcacagcaatttttctctcgccctgcaaaaagagttggaaatatgaaaaatttgctattgacaagtattttagcaatttaacaagtagcttcaactagtttcacaacaaatatggtacataggttgacctaactgttactagagataggatgactaacctgctactagattaattaatggtaaatgtgatccaggaaaagctaagagtagataaaaatgttattctctttactactttccaaactgggtaataaagtgctgtgtagttcaggaaattcatcatttcacaatgatgtgatgttcactgcattagtacaatgcatgattatattgttatgtagtcattggcattcaaatttatgacaccagaaggaaaggtctggccagtagtcttctgattctgttatactaaaataatttcattgcaaaattggaaagtgatgcatcaagaaataagaccttcaaagcagtttgcttccgcaatatatcatttgacttgaacattacagcagcaatccaaattgtgacaaagaaacctgcacaacaacccttcctttagtgtgtattgaaatgcttacatggcaatcattgcacaagcaaaaatagatatgcaattgaaagatggatttatatgttaactcaatccattgacctttcttgacaggaaaaaaacaatttggttgtagtggcagaaatgatagagggcatgcactttgaaaagtaaaggatagtatgaatggataaggcaagatgaatataacatccaagattgtgaactgcaagtaattgaagcggtgcataattggatacaactagctgctggaatattaatgtatcatcattaggccttgccaaaaaaatggttggcacataaacacataaattatgagttgattggtgcggcctccaaaggaataaatgttaaaagctaagaacctgatatgatatatgcgtcttaatcatcatttcaagaccactaggagataatcatgtagcagaaaattcatgtcatggtaaacaactaaacgcagatatgtcatctgatccataacttaggagttaggactggtacccaaccacaatatcctccagataatgtagcacaaagagaagttccaacctaatataagaagccgggcttgagcaagtcctgtttaaagttagggcagctaactagcaataccaagctataaatatctccccattaggttcatctaataaagcaggctaaaacccactatatgagataagtcgactataatcaagtgatcatattatcctctaaaccataatgataaaaaaaataacaaacaaaatagtatcccaggaactcaaatggttaacatagatgttaagttaacacataataataatatagaccagcctaatcacaaacattaactcgcctaagtcaaggtgttttactcacaaaatcactttccttttttggttaaacatttgtaataaacaatatatggacatcaacatgaaggaaaatcgattttgttttggacaagtcacaccgcttataatcacacaatggcacgagcacaagagaatgagtattagaccttggagatgctgccgtatgaagacgacgagcagcagcagcgagaatggcagtatctgctcgatccacctcgcgacatggtgcacgtcataccgctggtaggcgcggtccccacccccgttcccggacgcgccgtccgcgcccccaccactcgcctccgcgtcggcgcc

SEQ ID NO: 62462 - DNA, 1417 bp, Oryza sativa
ggcccgacggcgaggcggccccaccggcgcccgcgccggtcccggcaccccggcgatgatcggaggagcctcccgccggtggctccatcgccggcggcagcggcggcggcgaaaccctacaaggcggaggcggaggaggaggagacgaggcccctggaatggggagattcgagagatccccttgcttgggttggtttactttgcctgccttccttttggtttctttggcttttttttttcttgcttctctcgccccggtgccggtggtggcctcggcctgtatttctgttcttaattcttatgctagttttattttgatttagaccctctttgtttaggcttagggttattggtttagttttttaagtcagcttattggcttatatgatttataaggcagtgaatttaatatcctaagtttagtagtagagtcatacatctaactcatataagtcaaaaaagcttctccaacctagcttttggcttaatagtgtaaaagtggcttatggcttcaaaaaggccaaacgaaaacgctgcttatttgtttaggcttagactttttgacttataagttggcttataagcctaaaaaagaggaccttagtgatttagaattagtcttctggttatatacgtaaccgtaacacatatcactactaagacacatcacatgtgcatgtaacatcatgtacatgtaccgtatacggatatttataacctcttaacattttctaaggacgaagatcatcggtaaatcttcggcctcatgtttaacaagtaaaataaagataagtgacataatagctaggatattattaagcaattgcgctatttgcatgctaaatgccattggaaaaaaattcaaacattttcattagacgatatcctcagatcatgactaaagaaattttgaataattatacatttagattgaaatgtgcatttgatctctttttttaactagtatatgataccccctccctcctcatctttcacccttttctaatcatgatttgattattcagagcctatcctttttctcatcacacgtttaacaacaataaataccctactactctctccttccctaaaaaaccaacatagtactggatgtgacacagcctacgtatgtccaaattcgtattattaagatatgtcatattcagttctagattccttttttagagacgaatgaagtatgctagaagagtaaatctcaataaccaactcctaatacctctttagtcttgaatcctaattggtgttgtccccatcccttttttttctcctaaagttatttcacattatgtattattgagaaagtagaatggtattccctatatgcatctaataaagtgtacattaactagcatgaatataaggatattactgttatgaaaatatgacttaggcatcc

SEQ ID NO: 62463 - DNA, 2778 bp, Oryza sativa
gttggcaacaatccacggtttcaggacgaacaggtgaaaagacaaaaattaaaccggtatatattccatgcctatttccctttgatttgttcatacaagggaattcctcaacctgaacggtaataatttttccattcctgtatcatcattacactgatattacatgttctacaactgtaccagcaaagaaaagaaaggttatgtgactgcttctggagctgagttgcagtagggagtgtgcaagcaaatgaatctggtcgacatcaggcatacagaggcaaaggcgaaacctatcaaaagcccacagatgctcttccgcatgtccaaccttagcgagcgtttgaagactcggccaaagcttggaatcaaagcaccacaggcaatgaccatccagtagtctagtccactgtagtcaatcttcgcgaggattgcactgatggcagcgcttggccctgcaaagccggtcaaagcagcggctgccaaggctgcccgccaactatcagtggcaccatatatgcagctcgcaacagcagcacctcgtggtagaccatgaagggaaactggaagaaccatgtagcgccctagaccataagccttgcgcgcagccacaccaagttgaagaccttcagcatatgcgtgaaggaagacagaaccgcaagcaaggagcgattgcagtgtgaggacactaagtgagaggcctgaggatgatgtaattacattaacagaagatttcttgcggttaactagctgaaggatgtttgatgtggcgacatggtaaatgagagaacctccaattaggaggaataaggtggtaaatagacccatcttcgatgacattagaagttgtaaaggtctccatgctgcgagacggaaggctatgcctgatgctacaccagtcaaaagagggtgtggcatgctgaaagtaagagagaatgcaacaagtacaattcctccaaaaagaggacctagtccaaatacaagtgataccaaaaagcctgctgtatcttctgagctgcagatcagaagaaattaataacatcaatcagaaattcaaagtacccacatagtactccggaattgtatagaggaaacttacttgtggccatcagtaaatccctgaagcactgtacccaatgtttccatgaaagcaacagcaagcgttccggcagaagcaacttgagatggagcagcttcctgcatgaaaaggaaaagatgagcaaaactgcatttacaaatcaatggaacagaagattcagccattaacagatcttctaactaaatgattagagttcaccttaaaagcatcaggaagaacctcagcaattacaatccatatcatgcatccagcagcaaaaccagtacaaaagggaagcaccttttgaaatgcatcggcacaaaggaatgcagggacagcaacaattggctgtattaaccaagaaaaatgaacacatggtcagagtagtgtggaaggcaaaagaatgtcagcaccaaaatgtagcttgaaaccaagttggtatgctgttgcatacaagtagacaaacatttcgctcacaatgaaatactgacaggaagttgcactattggcaagtaaaaggaaaataatagtggcaatccccattaagggcttgttcggttgggccgttctcggccgggatcggagcccaatccccgtggaaaatcccggcgtggaaaggataccggcccacgcaagtataggcgttcggttaagcccaggcgagattttatcccggcccaccccggtgttttcccctcgtcataggccgggaaatattcagcttctctggtggcgaggaaaaaaatcctctcgacgcagcgacacaaagagagggggcgctgcagcggggacagctgcacagcgcagcgcgactccgacgcgacggcgacggcacgctctctcctccggcagttgactcctccggtggccaccttctccccggtgagttccttcacttcctatctcccctagcctcctcttctagtgttagggtttcttgcgcccgtggcctcgtgctactgcggcggcgcacgacggtggcaggcatggcgggggacgccgcagcatcacaccccctcaccatggcgccactgaagctctaagcgctatggcaaggagaagcaggaagacatggatctgttctttgttcctcacaaggtttcttgatttattcttctttctcccttgatttgttctgagtaatattcctaacttagtctgaagctctgatcatgtccttcctggatctgatcctctgtttgtagtgccctagtgagaatatgctgattctcctggtagttgagtagttgaaagaccacgttttctgattcttattgtgagttgttttaaatttgtacataaaggttatgaaaatggtttattctaaaaattagttggcaggtaatagtaatgccacaaaaacatgcagtgcgtaataatattgaggcatcagaagtgaatgctgttcatttttcagaaatactagacaactgttgttcatcagaagtgattccaacaagttgtctgctcttgtaatctcacccatacttgacagtgcccataatacaagtagatcaatgagccattccacatgccatattttctgaacaaagtacaaagttcaaattgaagtagtaagaaaaatgagtcatgtgcagctttagttcaggcctgtaaaaagctcttggcagtcggcagaatacaacttacttaaactgaactattttggtacatggttcaaatggtctaaaaattttcctagg

SEQ ID NO: 62464 - DNA, 2735 bp, Oryza sativa
gtcaaactgaaaacttggtaaaaatgttgcccaggatcaatagttggctggtttcaggaaatttgagacaattgctcactgcacgaaagcattgcctaaattattgcattttacaactgaaaactgaaggaaacttctttcttctgtacaggctttgggaggaagtctgagaggatggtagttcagatacagagtgaatgagcagacatgtacaagatgatggctttttgcaggagcaacaaatgttgatctctgaaccattgtatattgctgatgtaaccatttggtctaggagtcctggtgtggcagctcacatttatttttatagctcaagtgaatcatgacatagtttcatctttttccttttttattgtcaaatttcacttctatgactgtatttagttgtctctgtattgtcaagtgacctcaagctttgttgggtgatgcctccttgccttaaaccggatacaggccttgatgatactgcaatatttttgttttaatgattaatcaatgtggttttcgcgtaattgatgaggttactgcaatatttttttactgaagtgtaatttcattcatgttgcacttttcacttatacaaaaatatcggtttgcaatatttttttgctattctaaactgccaacctgaaaatcaattttgctattctaaactcaatggacagcgtgcaacgttgaagcaggaaagcaccagtccttctgttgttgctgttgcctattgctgccttgacacgggatttaagcaggcgcaccaagccaaaaccgaacaaacgttttgaagacagggattaggaaaatcaagggaattcatcctacagggattaagtgacatgggagggatccactcaatccctccctggataggttccccttgggggtttaatcccaaggaaccgaacatagcctaagtgattatctatggctttgttattttccacaatatggtcgtgatatttcatttaacacttgagatcctttgtgatgcgccaatattatctctaattttgcttctttgtgatgttactgagctaaatttcctaaaatctacagaagtatgcataacgagctagtgataagtttgatggcttctcacaagtttacaacctcccattttcaattagatgacactttagaatgcgtgcaatcaaatctcaaactcttaattcaatgatatatgcaaaaacattaagatttaatatgttaaaatgacattaatagatttgtcacaaaaaagtactttcatgtagttatttttaaaataattctcatgcatatatgatttgaaaaggcaacaatcagacatgtgtattggagaagtgttgatgccctgaactgcaactgaaaaagaatggaaggagcggtagagaggcattcagcaaaagtttctaagtcttaaatgctgattttactcgaacaaatgttaggaccttggagatggccatgttttcttatttatcaggttagggcgtttaagtcctagcatgtccagcttcacagatggccaccaaacataaatgaggaactaccagatatgcaagcaagataggaaattgtgaagagtatgccaccacaaagaatgctcccttcccttgctaccattattataattgcactaataagtaacgatcatagcaatggaagaattccaatttaaaaaatcagtggacaaagatcatcatatattattcataaaagtaactccatttcacaaatgcgcatgcatgcaccaatgtgctatgctgcacaaaagaaacatgagtaaattacattggtggtacacgaacttgtcaggtgggtgcaaactaatgcataaacttgtacaatgtttgtgttggtgcatgaacttgtctggtgcgtgcaaaccaaggccaaaaggacaccataaggctaatctcatcgatttaagtggtgattaggatgcgatgtaaacatgcaagtgagaagacgcaatatagacatatatatgttcaataaaaggtaaaataaggcatgattgttgttagagaaagacataaaaaacctgagtaatgatgcaagggtgtaaacaaaaagaaggttaatgtaggaaccgagtttataaatatagcatatctcatacccatctcatatgtgcatatcacgtcctaatcaacgtccaacttggtaaaattagccttgctatgttattttggccttggttcacaaccaccaggcaagtccgtacaccaaaacgagcattttacaagtttatgcactagattgcactcacctaacaaattcgtgtaccgccaatgcaatttactgaaagaatagcacatgtacacacagacacaaaagtgaaatagtatagtaactaaatttatagaaaaggaaattcagattgtagcccctttgcaaaaggaaaaaaactgatttcactttttctggctacaaaacatgaaccactataagtctataactaaaaaatagagaactcttcatgttgactcaagaacaaggacatttatcaggtaactcatatttcagttcaaggatagagcaagtgcacctgtggtaaagatgttatgatactccatatcattgccttttgtggggatacacccctggatgatagcaacatgcttacagctaagccttcaggtatgttgtgtacagcaatggctatagtaactaaaagaccttgagagaatccttttgagccagcaaaggaaacacccacaccagagccctccccaaaa

SEQ ID NO: 62465 - DNA, 1147 bp, Oryza sativa
ctgtctaattatttactttttgctttactagtaagaggaatgatgtactaccgcagagcacttgagattcagtgtattcaagacaaaactgatattggttcgtttaattctctgtttttattcctatctttgtaaatctatatatttgttgactcaactttaacattttgcagttaaactggaacatcgtagaacagtagagtcttctcaacaggggtgggccagtttcgatatggcacgggcaattgctgatatcaaatttacctatgttgtctcttgtcaagtctatggaatgcaaaagacatccaaggatcccaaagacaaagcttgctatttaaacatccttaatctcatgttaatgtataaaaaccaagtgcttgtgacctaataaagctatatcataaataataatgttactacaacccatctgacatttaaattggacaggtacccatcgttacgtgttgcttatattgatgaagtagaagctccagctggtaatgggacaacagagaagacttattattctgttcttgtcaaaggaggtgaaaagtatgatgaggtacccccattgaacagagagctttacgcgtttgtggaactatgtttacaaagattatgttcaattaaaattttcagaaggtagaagacttcatattgatgtcccttttctagatgagcaccatatataaagtttttcacttctattgaagtttgtagtttcatgcgcacttcttaagttgttaatacctactcgtcatttttcaacagctcactatatctgttctgtgtgtttagttctatggcataattcatacatggtgctttaaacctgatttaggaaatttatcgcatcaagcttcctggcaaacctacagatattggagagggaaaacctgaaaatcaaaaccatgccattgttttcaccaggggagaggcactccaggccattgatatgaatcaggtatactcatttccgcattttatttttcaagaccctttatgttgactatttcactgaagttgttgagaaatgtaaacaaatagtcataaatacagcccctcacgcccaggctcaactcagccatatggacaaagtatgtatattgggatcatacatggtcttcccctatgacccactttggat

SEQ ID NO: 62466 - DNA, 3547 bp, Oryza sativa
acattgtggtgtcttgaaattttgctagcttaattttgaactcaatatgttgattttcttactatattagatatgggggagaaacactagtagtcttagtcatggatcaaatgatcaatatatacatgtacaaactgtacaaaactgcgttggaccagctgggactgacctaaactatttctagcacacatttttacatgtacaatacaaaaataatattgttcctttactcgtaggataattacctcgaagaggcatttaaaatgagaaatgtgctggaggagtttgagagtgaaaagtatggaaagagaaaacccactatattaggcctccgtgagcacatttttactgggaggtatgtgtatctatccaaaattctggtcaattatatcttgtttatgccatctattagtaacccttttctgtattttgttttctattttagtgtttcatcacttgcttggtttatgtccaaccaagagaccagttttgttaccattgggcaacgagtcttggctaatcctctcaagtatgtaaatcttcattttaacattgtgttagaaggattttttaaggatttttttttctgatgcatttcatcagaatggtaacctatttgaattgggtgcgtcatccatttaaaagttaaaaagtatttgatgatattttttccttttacctaactagtactgtgagaaccattttaaaatcatttcagctttatcttgaggcaatcatgcataaaaggccattatatccttacataagtattttacaaaacagatcaattatggataagtactatgcccaattcttaatatgtcaaaagtaattgtaacctagtatggatggaatactctgttgatacaaaatgtcaaatggtaaggaaaaaaaatacaatttacaaccttgaactgtcacggcagtctgagaaacaaccctgaactatcaacaccgtgcatttcttaaacttttctcggtcaggcgggacatgatgtaaagctaaaactacttttgatttctgaatttcaacgactaatgaatgacttcaaaagaaattctcatttgctctatggggtaattataacattgataaatttgatccaagtgaattaaagtataattctatggcaataaatagtgtttaatgattaaaaaaataattttacctcagctaaatagactttattttttcctttgcaatggctgaatttgttttggctctaaataatctatggtgcaactgagaattcgcctagaattgatctgaatcatttaatagttttacatatgcaaatatcttgttagccttggggtatgttttgagttttaaaaattagtaaatgatatcaaaatattctaaaaatctaaatttacaatggaatatatagaacctgggtacatttgttgtagaggtcaataaaatttaattatctcataaacagtggcttctttttgtttagaaatactcttttggcagttcaattatattttatttcagttgtagcaaatttatctaagtaacaaataatccatagatcaaataaaaaaaaagtcattagctagtttgaaaagttgtttcagcctcagtcacatgaccacatcactatgcccacagcagtcaccagaaaccactatctttttatgaacagttttgatagttctaatattattgttttaaattttgtcagtttttatggcccttcattcattgatagacaccactaacaggatagccaggtggtgctagcatgtgaagagggaatactataaattgggatgagtgatttgagcatgtaactagattagttcattctttgcttaatgtgaatagttgatgtggctcgtctctaacttttataggggtttatcccctaacaactttctccaataggaagtaataaatcatatctctaactctatccttaaaccaaacatctcaaactcttatatctaaaaaatctatttttttctcgaaaaaacaagagaattgcgtatcatttcattaaggggaagaaataaagaaaaaaatatacaaagtaggagatccaaagccctcctaccgaaaaaacacacccacacgccccagccaacaccagcaagctctagctgcttaggtttgccgacctattaagaaacttttggagggcaggcgcccccgctaaacaccaaagattaccctcattctctaccacctgcaagaccgtcgcaatactaggattggcgcccattgaaaacacagtcattgcgatgcttccaaatctcccaagccactaagatgaccaaggagttgagccattttcgcacgtcctttggccggtcttttgtagcttggctcaccacctaaaaaaatgatcggctgaaggttgaggcactgcatcagagaaccctagcttcaagaacagtgccatccacacttggcgagaaaagacacgaaatcaaaatgtgttggacggattcttcactttgatcacaaaagggacaggccgtggggtgctgcagtccgcgcttagcaagccggtcggctgtccaacacctcttattgacggccaaccaaatgaagaacttacagcgaagaggagcccaactcttccaaatgtttttccatggagcaaacttgatcgatcccaggaaataagcttcatagatagatttacaagtatacatccatcggcggttagcttccaaacatgctgatcttgtacatcttgtagcagaaccacctcttctaccaaaacccaaatggtcaagtacttatagatggccatatggcccgaggcccaatggcccggcccaaggcacgacaatttggcccgacccaagcatggcacggcccgactagggtcatgcccgtgccggcccggcccgacagccgtgccgtgcctaggctgcttcctcggcacgatgggccggcacggcctggcgcgaatgaagaaaaaaagtaagagagacccaaaatagacttaatcaaccatataaggtaaggcccaaagagaataggaatacaaaatagacttattttccagccatatagacacagcccaatgagttgaggagcaaaaatagacttattctgtgaagaagaatgatgggttgtcgtgctttcggacggctcggcacggcccgagtcttattgggccgtgcctgggccgtgtgcagcccgtgggttggcacggcacggctcgacatgtaggtctggctgtgccagcccgacttacctcagcccaggcacggtcgtgcctgggccatgctgggccgggcagcccatttggccatctatgcaagtactcattaagaacctgaacagatagcccccatttatgtcagccgcccatcttctgttctccaaagcctgcgccacagtacgttgcttgcttgtgctcttagagatcaaggcaaagagattaggcgccagctctgctactgttttcccttgcagccacctatcactccaaattcagtattttctccatttccaactatagttttgacagccacattgaaaagagaacgtacattgagacacatgaatagataaaccgcccca

SEQ ID NO: 62467 - DNA, 4784 bp, Oryza sativa
ccgagataagagcaagggaagctcgccacttcacaagacaactcattagaaatcacttccagatcatcttccaagcagtgaataggagtgcaagagctcttgatcatattggtccttagtccagaaatctaaccaaaaaactccaaaatctgcttgataagagataggtccccacttgtaggacacaaaaacatgaccacatcatccgcatacagagaaacctggtgtgctgtcgcgggatagtgagaggctccaggagatttccacgatccgcacacgccacaactaagttcaacgcgtccataacctagataaaaaggataggagacaaggggtcaccttgccggaggcctctacagtgagcaatgtcctggccgggctctccattcaccaaaactcttgtggaagaggttgacagcaaaaggcatagcaaattacaccatcgtctcccaaaacccaaatggcacaaaacttcaagaagaaaggaccagtcgtcttatttctagccacttacctcctaaagctaaataaacaactaaccatcattgtaatttctgcacatggcagccttattcaaaaagaatgtatatcctgtgctgtgaaaaaatccaaaggatttttgaactgggaagctcattattctaattaaaacaaaacttgtgaagtgttgttagtaataagttgaccaaataaaaagagctagtcgtgagcccatgactgttatacccatgagaccatgaccagtattcaagttccacatcttcctagacagagtagacttttggcctaattgctaactgcaatttatctgaaaattgttttaaaatcttttattgtttccataaaacactgataagtatctggagttactcttactttgatcgcaaatagctttgtcaattggttcacacaatccttattgcatgtttggaaatcataagtggctcatgcccgtgttagtatgaactggaaaaggaaactaccaaatatgctttgataatttgttacacaactataaaaataaagtcagacctagctttctggaaatcattctacaaatgtaactaaacagttatgacatggagcggggttcactaagatttgagtagtttccacatggttagatattgtttcatttaacattgatttatgactgtatattttttatcatgttgtgcttttatgtctacaactcattattgcaagatgaatacagggttcggttccattatggtcatcctgatattttcgatagactcttccatattactagaggtggcataagtaaagcctcaaagactataaatctaagtgaagatatattttcaggtaagccgtgcatctcatacatgtttacaaatccattacctagcatgcagttactgaaacgcaattttcttataggttttaattcaacaatgagagaagggaatgtcacacatcatgagtatatgcaagttggtaaggggcgtgatgtgggaatgaatcaaatttcaagctttgaagctaaggtggcaaatggcaatggtgaacaaacattgagtcgtgatatctatcggctggggcgcagattcgatttttatagaatgctatccttctactttactacagttgggttttactttagtagcatggtaagaatattaattgaacatgttcatttggaagtttatattattgatagctcctaaaaaggtatttctgtcttgtataacactactaaacataatcttccttgagaatcaaccctactaaaaattgtataacactaaaattgtagaaagttacttacaaaagaacaaaaaggacatctttcctctaccagatggtctaacgtggagccatttgtttcttcatggaccagtcaccagtatattgaaaatcatcaagatttggaaagtctttcatgtaaagaaaatattttgtttggccattcttgctgtagttccttagtatataaatatgaagtatattttggtcagcctgagagtataggcatggttttacaatgtgtttcactttggcatttgggatactgacatccttcttcctttatccaggttacagtacttacagtttatgtgtttctatatgggaggttatatctagttatgagtggtctggaaaggtctattttgctggatccacgtatcgagcagaacattaagcctcttgaaaacgcactggcctcgcagtcttttttccagctaggtttgctgcttgttctccctatggtaatggaagttggcttagaaaagggattccgcacagcattaggagagtttgttatcatgcagcttcagctggcatctgtgtttttcacattccagcttggcaccaaaacgcactactacggaagaacaatactgcatggcggggctaaatacagacctacaggtcgtggatttgttgtctaccatgcaaagtttgctgacaattaccgcatgtactcccgcagccactttgttaaaggacttgaactgttgatacttctggtggtttatttagtgtatggaagttcctaccgcagctcaagcatgtacctatttgtcaccttctccatatggttcctggttgcatcttggctcttcgcaccctttatcttcaatccgtcatgcttcgaatggcagaagacagttgatgactggacagattggaggaagtggatggggaaccgtgggggtatcggcatgtctgtggatcaaagctgggaggcttggtggataagtgagcaggagcaccttaggaagactagcattcgctctctcctcttggaaatcattctttcgctccgcttcttgatctatcagtacggtattgtgtaccatctgaacatagcacgccgcagcaaaagcattctggtacctcatctaaacacaatctgttctgcttgctactttcatagttcctactattgcaggatatataccttaatttactggcctcttttcaatatctaggtatatggattgtcatggctggttatgctctcagtcctagtagttctaaaggtaaagctacagcatgtcaggtggtatactacctcagatgattaataatcttacctgttgtttgttgtttcttccatacagatggtttcgattgggcgacagaagtttggaacagatctgcagcttatgttccgcattctcaagggcctcctgttccttggttttgtctctgtgatggctgtattattcgtcgtttgtaacctcacaatttcggatgtttttgctagtattcttgggttcatgcctactggttggtgcattcttctggtgagtgaaacccttctgcaccacttatttgtttttttttgtaagcataaaacttaattccaagaacaaatataaaaccctgtccattttctcaataaaaagataaattttagcgttcatcgtaatctggacccaaatgatttgtatgatcttgtcattcatccacagattgggcaggcatgttcgccgttggtgaagaaggcaatgctgtgggattccatcatggagctcgggaggtcgtacgagaacctgatgggactcgtcctcttcctccccatcggcctcttgtcatggttccccttcgtgtccgagttccagacacgactgctcttcaaccaggccttcagccgtggcctccagatctcaaggatcctcgccgggcaaaaggacattggagaggaatgaatgaatggatgaatggcccctcctggcctcgtctcctccggtgaactcgcttggacgaaaaaaccatcgattttgggcggctagttcgttgatagggccttttttaaatagttctgaacaaacaaatagtagccggtacatctgaactgtagtataaatgtttgttcctctttagaacaaggcatatatatgtagtaagcaattaacataaatgcagtacgttggtatatttccaagggtcggcatgtcaggatatattaattagttagtgactggctagacatcagtttccttctgttctcgaacgtgtgttcttctgttcagccgttctggatgtagcatgtcaatctttcattttgtttgacgtttagaaatgtcatagttcgtgttttcgaaggacaagcaacctcaccagcaagattgtgtgcgactatcgaggtcgaggatgaacgggaaacttggaagatggtgggcctgctcgccacgctttgaaatgcatcggggcagctttcatttgtgtgtacctagaaagctatctttgatataagcaaggtttacaaaaccgtacagttatcgtaattatcacgtgcggtaaccttctaagtttttaaaaacacgatttaccttgtggtaaccacatggttttcacgataaccgctaaatcgtgggatgctggtaacctcaccttataccctataaggtttggtaaaccctggatataagttgtaggtgctctgttgttcagtgctctaagcaaaactgtaaattcctgctcctcttaatatacttaggccagcggttggttataaaaaaaaatatactccatccaattaagaatatttgatatataaaataagatttggttcaacttttaaaatttaaactattaataatttctcaaatagttagtttagaaataaaagagatgttacaggcacatttgcctcgaaaagtcctagtacatcatgaagtaattagatcttgtaaatttgttctatataaaattgatgtacttaatttacattttcctttatttttcttccctaatgaaatgaaatgcaattctcttacgttttcgagaaaaaaaataaaattgatgta

SEQ ID NO: 62468 - DNA, 22033 bp, Oryza sativa
aaaaaataaaattgatgtacagatttaaccaaattttatcacaaacatcaaatagtgatgattggagtactgtcacaaaggaatcaccttggcaaaacaaccattttctctactttatatttttatatatagttcattaggtcaactagagtaaatgataggttacctatatattagcttagcgcaatccaataatctgctgctcattacataatacataatcttcaacatacaaggcaatctaataatacaccgagaacgagaagtccctaaccaacaaaaaataaaacaaacatgcacaacatattgaactacaggattacttcacgagagatgaagcaggaatgtatatgtcaatttcatccaatgttggacgatcacgtaaggtcaagctgtgctcatttgccaaatgcaagaggcaaatgaaatataggtgcggtgaaatttctgttgctgcagcatcagggttgcagcttggaagatcttgcaatactttcgataggcacaggggtgattctgtgtccttgtcttcctgctgaacaaattttaaccgagtacaatattgttaacatattaatatagaacaacagaaattagggagaaaggttcagttcgaatttcagagtatcaagtctatcatattgatgtttcgatatattcaaagaaaattacacagatattcctttttttaaagcaaatttttcatgtttgttagtatcacagttcacaaatatcctcctagacactcttcatgaaaattttccaaggcaaattaaactaggataacaaagcaataaagggctcttgaaacatttcaatttgcaacaaacttattttcagcaaacagatacaggtattagttttgaattatcaaaatattaaccaagttccaaacttgtgtctggtgggtgggcacaatgttattagttatacttgaggaaagccagaaactagcaaaaaactggcttgactttcaagtttcaagtataaataataatcatttcctcattatccatgtcctggcagttgcaactggtaattaatttctacccattttatatattacaaaaaatatcaaacacgacatcaaaaataaactttaccaaaagaatataaacaaatagtttccagaaagctggttgtggcagtatggatgataacagcatagttgttaatattccgttttaagtccctagatgttgtaaagcatatgccagtatgccacgtgtaaaccctgtactatataatgtagcacaataaaaccttaagttttgtcaatcatatatgtcacgggtaagattaaccaaataacaaacatacgtgttttattgattacattttaagctattctatttacgaaaatgaaaacaatattgtattagtgttattcagatagcaatttttagcaataacagaagatattaccaggtcatcagtgtcagcagatgtattgatgtgattccagagcacttctttcaaggcatgaacatcgacttgttttgataccttgtcatattgtatatcaatcttgttgacctttgatttaggaaggaaacaggtattaattcagactttaccaggccaagtaagttagtaacattaaaaaaaaaacaaggtcatcttaaaaactcaaacacattacaataatttattcagatcactagttttttcatgtaagtcctctggcagagcactctgtcgaaaggtcagcaattctaagctcacaagaatagaagctcctgagtataggtaaggtgtaaatgcataataaatttgcaagatacacttttatcgtttgtttggatacatttattgtgccataaaaatcagcagcatagatgtccaccactacgaacagccaactcatgtcaagccagatcaggcatgtaaaccctatacatttgcaaaaagtcaaaacgccctccttttttttggaggggagtcaaaacaccatttgtcgtacagaaaatataacagaactctagggactgttcagtacccaaagtataagagttaaatctgcactgacttggcataaatttaacatatattgatgggcatgtgattctgctttctaggaggccacaaattaaagtttatgggacagacatcaatatacataatgttaaagcttgaattaattactccctccatcccaaaatatagctacctgtctagttcaagaactagaaaactagaaaggtagctattatctctgcattctgtttacacaatttcttttgtgtaaagttattctgatgttatagtgctttttagttactacattcagatctaaccagctttagtatttcaaatggtgtcaattgcaactttgtacgagcgcccatcgaaatatcaatacagaaccagactccaatataagcacacaaaaccaaaatgtctaacaagggaaggcaaaagaaaaaaggagcgcacctgtcttggtttggtaataagatctactgcatcctctacatcggtatcaccatttccttcatcgacatgatcattacaaaaatcatcaccatcccaaggttcagatgggatgaagtcatcagtattctcccttgaaccacctactagagaacaaaggtgttctgtggttaacaaatgtaggaaaacaattctatataaatagaaaggcattaacaagaacaaaggctgtccatacatacatcaacttgccacacattagcaaacagacataatctagtatgagaatagtaaagttcttctctgaaaagggaaagtcaatttgctacctaatagccaacataagtatcacattaccacctttcttggagttgtgcagagcattctctataaataaacccagtcctgaactttatacttatttgcattccacagtttcagataataatactctaacatcatacgattcacagattgtttcgtttaagtatttaagtagcaatatgaacttaccaatatatcaagggttaattggatccatgccattacaaatttgttgtattagaaaaatgccactattattcgtcatatcggctggtggtggtcaccgctcatgccttggcctcttggggaggagcagcagcagtagcaatagcagtggagagagatggggaagatgagctgctgctggtggtggtcgctgtccacgtcctgggcaggagcaggagcagtggcagaaatagcagtggaagggagaagaaggagcaggtagaggaagaagaggaagaaaaaggagaggagaagaaaggaaggagagtctgacagaaaatataacggtgatggcatagatctaattttacaaaattataatggcactcagccgatatcacgaatagtagtggtatttttctaatacggtaaatttgcaatggcatgaatccaattaacccatatatcaaataccaaaaggagctggaggaaagtaacacaggtaatatgaacagggaagatgtgataaataatttaagaaccttcagaatttacaacaggacttcaagatataataacaaggcaacaagaaaacttcatgtgaaatacacaatgcaagaacatagaaaacttaccaagtggttttttccttctccgagccagacactacaaaaagatccatagttactataaccaccccagatccatatcaagaaaaaaattataagaaattgccattaccaaaacatccggaagaaggaataatttaacaaggctttcaggtctataatggcaatcctctggaagtttgttattgctggtagccctatttgccggcagcagcaatgattttgaattcttaggaggtgcaaagatatttggcatatcatgttccaatgctttgctgaaatcaatgtcaggttcatccttgcctcttttcttctttgtcttttttggggcgtctgaatcatcaggtttagttgggacagggtccaaatctagttgaatgtaagcccaaaggttagattaaacaagcctgcctgaaacaaaactaaaacaggactatgtacccatagtacctttagcttttcgatatttccaatgctcaggtcctgcccaggcatttgtttttgcagagaatcccatgccaaatgacaagaaatctgcaattttgtcaattctttcatttacatcaagaccttcagcagactcaaaagtgtactcatcagtttcctgcaaaaaaatataccctcagatatttatacttcagaaaacaaacaaataaaccataatttgaactgagtacttcagacatttcaatcaaagaaatgtcattggatggtgaatgaatggataagtaataggcatcaaattgcatcctacaaagttactcaatttgacttttatcttaaaaaaatattaattgataccatgattaatcaatgttttctcacattcatttaatgtcaattctcatagatttttaaactgcgcagaaaactccagtaattggaaacattgggaaataaaaagaagaaaagaacaaaagctgtcaacccccaaaaaatgcatgctctaaccacacacaaaatgtgtctaggttttactgtttgcaggaagtacctcttgaccgttcatggagctatgatccattgggtcacagtgttcatcatacacgctctcttgatcatcacaacctccaaaatcccaagttccacaatcattttgcatatcattttgtgtgatgtcatcattcgccacatcattaccgtcaaccacctgatcttccatcactggaatttgcctagaaattgcttcatgaggtggtcttcggttttcatcatcaaactgataaactatattgctcaaggtaggagaaatatcattgcagaggggcatatgaattatcatctgctcgatttgctctgtttaagagtagaccattacaaaaccttaaatggaaataaaaaaatgcagagcatagacagcagaatagaaacagattgacaatcatacctttagcaaatgaaagaccaatcaactcagccatctcagtttgcatatcacttaagatgcacttgtcaggtgcttcaaacgaatcaaagagcacacggcaactgtcatatactccgaggttatatgacaagagaccctttgccccaccctcatcaaattgcgcggtagtttgatggtacaaaggatcaaccgtgaaggcaactagcagaaagtgcaataaattaatattatactctacaattttaaacttttggtcctatgatagtaatcccgacagaagcacaaagcaaaaaagtttttaaaagatctgcttggagcttaccatcaaacttctttacattaagcgaatcaaatgaggactccaaagttgatgtgggtgatatctgcacatatgaaacagcactaggctattagaaaaaaaaccaagcagaacttaagtggaaaaacgaacagtaaccaattcagataggcataccctcctatctgcatcctttttgtttgtaccttcttgtgaatgctttggattgctaccttcttctgaatcttaagtaaaataaaacaccaaatcaggacatcataatgaagcagcatgcatttaccaagggaaagctataggcacaacaaaggtgtatttatgataatttgcagaattactgcctaacttttaccttaagggtgtctttagttcctgaaaaaagttggaagtttgaagaaagttgggagtttggaaaaaaagttagaagtttatgtgtgtaggaaagtttttgatgtgatatgatgtgatggaaagttgggaataggggggaaactaaacacggcctaacaaataaaacaaatgatcaaatgcaattcaactaatcctcgtgcatcatttatcatctaaggttttgagatacagtagtagcatgatcgtgaaaactgaagagtgctccaatgaaccaaaagtcagaaaaggccatttctcacagggacttgatttcttaaaaaaaatcttaaaacatctttctatttattgttcgatcaatttatagatggacattttttttggtacaaagccaaatttctatcatgtaagttgacttagtttgaatttaactgaaacagtttagtggtgcccagaatactaataatacttttgcaactcgaagctgactcacatgaataaaatcgaattacaatcgaatggctacagtaaaaattggaaagcgctatgaaactctagtgggtatttaccagcctcatcgcctcttccagcacggttgatgcctccaagcaccttgtacgcctcagagtgcactgaatctacacgcaaagagtaaatcttcacgcccgcctcgagcgtgcagctagcctggtcacaagaaaatggttaaaaaaaaatttctcaatcgaagtcagaagaggtcacaaatctcctcccacggtagtagtagaaagaaggtcgaaaatggaagaaatcagcacagccgcaccttctggaaattggtctcgtcgtcgtcctcctccccggcctggatgatctcgctgaggtggtcgatgagccccagctcccacgtgttcttctggttaattttctgctcaaattccccatcggaaaagagggggaaaaaacaaaaacacaaagaaggcgaactcaatacgaggcgcgcgcaagtggccctagggtttcggcgcggcggtggggaagaacaacgacgagggggggtaaggtacagaaggcgcgtacgttttcggaggcgagcttgatgcagttgtggaagaggtccatgacctggtcgcggttagaaggtcgtggcgcttttggcttgcgcccgccccgccccttggggggcggaaaggggaacgccggccgaaggtgaagccggcggcccggacggaggccgcgcgggcggcggcgcgggcccgggcgcgctcgagctggtcgtcgttggagccgagcgggaaggcgggcggcggcgactgcagcagcagcagccgcggccccgccgccgtcccgcgcgccggcggcggggtcggcgccggcgccagcgcggtggcggggtcggcggctggcatcttcgcggccgatcgatccgcggagaggaatgtcgatttgggggattttttttttttttgagtcggtttcgtttttgggggggttttcggcggcgatttcaaattttcggggagagccgccggaatgggaaggggtttgagggagttggaacgatggggggaatctgtctaacgggcggaaagaagtgcatctctctctctctctctctatgccacgtgggcccactggtcagataaggacatgtggtcgtgcacaattcagtatatgtatgctcatcatttcatgatttttttttttagattttcccttgctttcgtcaagattcataataatctgctcttgtttttctgcattttctagttttttcttttacttcttctttttttactcctgccgcatctaccacatgagggcatgtttatccgatgaagtaggaaccgaaccaaatatccacatttttttaaaagtaacatgggtgaatctactccacaaaatacaaagggtgcagttacttttttaaaactccaaaactctagcttcatatctgaaatataagtattttttgctgcattaatctgtatcaatatttttggcaacgttatctcgtgatggtggtggttctatgtacatgaagccaatgttgatttttataagttatgtttatgcttgcgatttggctaaatgaggagagaggattgctatctagcgtgtacgtgccagcaggtgctcctaccctgcgcatttttccttttttattgctgtttttgcacgctccccaactttccggtgcgttttccttttttcatgatttttttaatctccagcgcatgtttttcctttttctgttttttaatgtattttacaatttagatcttttatctcaaatttaaaaacttctatttgaaactttcagcttaaaatttgaactcaaactgcaaaacttacatctcaaatttcgaaactctcaactcgaattttaaaaacattaactcaaagattaaataaatcttgagtcaaaagtttttaaatccgagttaaaagttttaaaatcttgatttgaaagttttccaatccgagtaaaaagtttcaaatattgagttaatgggatggaagtgttgaattgtaatccaaattcatttgcacacgaataaaggccagctttaaatggagcgaagcggaggcccgtcgccggaggtttgggataccgtggttttttctctcctactttagaagggttttccatgttaaatcttatgtctttatgattgatttattgttttttatggtttatgtgtctatcattttctaacatgatggagttgggagagccgctcgacaccgtcgtgtgatggagcccactcccgtcaaaggagaaattcaagtacaagtgcacaacagaaacattgacatgatcacttgagcatatcgcttcgatcagatgaatcatcataaaagagattagtaattgctcgcccatcttcatacgccataatcttcagttttgagatgaaccacccaaattatcttattactagaggaggttgaaacaagggctttatactgtgacacgacgattattgttgctgctgtcgacgagagagatgagatagatgaggcaggtgtacatgtcaatctcgtgctgcgcggagctcgtcggccatccgggcgctgaggagcaggtagtggaggtagtcgcagtcctcctggcatgccgttacgagcgcgtagcaccgccacaccttggagccgttacgagctcaagctcccgtagcaggccgccgctgagatccacgtgctgccccatgcggcggaaggtgaaggagagggcagcaacaggcggcagcacggcgcagctcggtggcaggcagcgatgcgaccgatcgaaagagagagaaagatacagacagagaagggagagagcgaggaggaagaaggatcgaggagaggatgacaagggggccacatgccagtgggccccacattttttcttttttaatgacaaatatgtcccattttaattgtagtgccacctaagcgtcatgtcaatatcataaagccaagtcaatactggcacatagacaccacgtcagcgaaatcattctccaaagctatcgagggagttaaattacaccgattttaatagttagagggtcaagatatccggtattgtaattaaagaatacggatcagattcagtcactagttaagaggttcaaagtgaacttattcccatccagaactcctattcctcgaatctgtcccagtttaggcccactcactctctgtcatactttaccttgtctgtccaagtgtcgagtggagattaggccggatggggcgagggagaaaggacaaaaaagaaaaaagaaaaggaaaaaaaaagaaaagatcaaatcaaatcaaatcccccgtcgaggccaaaccctaatcgccgcctggcgatggatggccgacggcggcgcagcgggaggccggatgtttcctacggcaattcggatggaatcgcccacaaccgatccgtgattttgggcaccatccacggctactacaaggaggcgctcgccgtgctgccgctcgacgacttgccggagcttgccccgcgcctcgttggcgccggcgtctgcttcggcttcggcgaccctaccaccaacatcatcgccaacaccctctcctccttcctccccgacaagcctgatcccgatcaccgggccaagaagcacaagcgcaaggcaagcatcaagacgccatcggcagcagcgaggtcggatgccgccggcgacgccccctcccctccgccggagacacgaaccatcgccgagcgatcgctggagggcctcatcaccttcctcacatcttacttccgctacctccccacctgggatgcgctccgctacctgtgcctcgccaacgccgacctcctcgtcgccgtccgcctcatcgagcttgatcgctgctacaacaccaaggatgaacggttccacatctcctcctacgctgccagggctgcccttacatgcgcagcatcatcggcgaggcagcctgacgtcgacggcttcattgctggttcgttttcgctggcgtctcatcttgaattcgtcacccagaccgtgctagcagatcgcagctatgtattgtctgttgagaagatcttgttgctgtctggaatgctgaagaagaagccgcgcatgcttgacaagtctgacaatccaatgatttttgctgatgaacggcggcttcgtaactgccataccgatgctaatgctagtggtgatgctaattgtgagaaggtgccaggtggtttgacaatatcacttcgggctgttctacttgacaagattcatgccaagtacctcaaggcaatctctcgattacctatgcaagatgttcgggctcgttaccacttaccaccgtgcccttgtcaacggtggttactgctatggcccattcagttgtgtgaccaacatcatcgtcaacactctctggtatgactctactttccctgctatggagaaacttgaggtggacatgatctgcacctccacctttgttcgtgtggagtcccggtcccttcgtggccttatcaagctattgcttacatgcattcctgagatttctgagcatgatgccatgatatatctgctaaagaataatctgaaagttcgcaaagcaattgaaatggcaggagcggaagggtggaaatccagctgggatgtcagtgcctacaaggctgcagcggatgcatcgtttcatcctgagcccgaagcttatgtacagttttccactcaatctctacctaaggtgcaggctgccgttaaatcactattgcgtgcttctaccccactttcctcgaatgatgttcttcagctagctacgttgttgccatcttcaaactgcatctctgctaaatctttggagacaattgttgatctgtctacagatgcattggatatgtttatagcgttcaaggaaaaatttgtcactcaacagggtttttttcatagaaagattgaagctgcactaaggaaaagggttagtactttccattccatattatgtgctactttcaaagtattgctctctagttagactattgatttggataatgaaaatatatatttagtgcagaattatctatttcatattgtcattataactgctcttctctgcatattcaattcttacctgatgattgagataatgaaaggatctgttatcgccgaattatcatttcataatgtcattataaattaataattgcagttttatgcaagttcacttctttcctggttttagtatctatttagcatggaattatccatttcatgatgtcattatggttgcacttttctgcaagttcacttattccctaatgatttgattaggataatgatgaaaggatttgttcggtgtggaattacccatttcataatgccattgtagtttattttttttgcaagttcacttcttccctattgattaggataacaagagtatatgtttagtgtgtaattgtccttttcataatgtcattataattgccatttttctacaagttcacttctttcatggttgtagggatatctatatgatcttcaagtaatctgtgttgcaaatgagcgtgtgggcagccagatgaacttcttggacttcaaatgtccatattcacatgtaaactttttggcaagaccaaaagttggaagtggacttaagttattctttgctgaattcagtaatgatgatgatgatgtatccttttgctgtaccgtctcaagaaaatcaaaacacggtatgtttgatatatgattgtgtccttttcttaaatataatttatagaatgattctttcttgtattttgatgctaacctttttttggtattgtcttttttggagaagctcgttgttgttattgtgaatatgaagggaccaggattatgcatcctgcgcatccgattgaaaattattgtggtggcgacatggacttcatagaaatggcgcatggcactcataagctgaccaatgcaagaatcattagttgtgggaagtgcgcaggcaatagagtaggcatgtgtggggacgattatatctatttcgatcctacccgagatgctaagttcgcccaatgcatgaaccggactgcttcaagggcgaatataagctggagtgacattttaaaggtgaatacaagctagagtgacattgagaggcatgaaccagaactgctttatgggtgaatgcaagctagagtgatattgatagtataggtgatgtgtattccgatgtcttattttaatgaagatatctttttttattataattttatgtggacttgatggttatttataatatactgcagtgatggcttaaaatgagtttcaggatgtgtaccgatgccctttgatgctttccatgcttgtagttttgcatgagttgtggtgttcatatcgttttggtacagtgggggtttgctttcacaaagttagcttcttcccttttgcttgcagtctgtggatactttggttgttgttttttagggattggttgttatttttaggataccacaatgatcttatcagagtttgttaggttctatttctttattattttatttcttgctgtaaatagtgatattatagctgattatgattcatctttattatagtatactccttatattcagtactagttccttgaggggaatggtttatgagatttctgggatcttttcaaacatatgcagatagatatatacaatcacagattgcttgttttttttttcattttgatgcgacactggtttctggacgaataaacagattcatcttggctgaagcaatatataccatgtgaccatcaccatgacattatgatttctgtcaaagttcatatgtaattgtgcagcagcaattataggacaattcattttcgtatgcactaagcttcactactctacaagtcacgtgtgtcaaattttctttatatatttaagagcatgacgcccattgtatcaggatgttgcaagagatttgagatcattttatctcttggtgttcatcagcataattccagcatgatgaacaccaattgttttcttaatacaaaaatagatgctttaaagccagagctgccttgcccacatataaaaaacgccaacaagcgactgatgttggcaagaagaagctcaacttggtttgcagaagatgactagcatttaccatgaatgcattcgtagcaagtttcagaacttcagaagcattggtagatatgttgttcattcacttgttctcatctatcaattcatttgagaacatgttcccccctgttcatcgtctagatacttgcatgcaacatgatcctggctgtgattgatcagttaaattaatgtaatttactaattgatataataaaggttaaagggggagaaatgtgctcttttttaatccattaaatttttaagaaaaggaggggcttttttcactgtctgcatttgtgaaaaattgcaggaattgcaacggcgccgtctgttcgccggcggcgagctccggtgcggcactcccgcgaagggcatcaccctccgccgccgccgccgccagtggtaagtgcgccgtcgccgatcattgaaatttgaacataggggcagatcatagttgagggcatccatttttcttttctttttttttgatgggatggtacactgcattcttgattcttgcagaacatcgatcgcatactgatcgcttctgatcatcatcacctagttcgtgcgcttgtggaatcctttgagttgagcctcccgcagagcattgcaagaacaagaatcagtttccctggttcactccaccaccccgagaagttgtacgccttctcatggcaggcaatcccctcctggtgctgcagctgcctcgagcagctgtagccagtggacaacccaatgttcccgtaggcactgtgtgcagaagcaatgggtgatgaataactcaaaatagtcatggaggtgagcaagaacattatgagaagaattgtgtgtgtgcaagtgttatttgttaccttatcacctcaaagatgatgttaaatgtggataaattgagagggtcagtggagagtgatctcctttcagtgatgcagaccagcattatcactgtggtgttgaagccgagtggtgaaaatgccatcatcttcaggaatggtttccccttgcttgttctatcgtcgctttctgggccgattcgtttgtgatcttgacatgctgagaacaactttgtcaaggatggagtgtacctaagaaatgtaagcaaccatgttatgttatctcttctgattgttgcctgagactgtgaagaacttgaaagagaggaactcacatcatgaccatgaatagtactaaagccgctggcgcaacaagggaacaatcaatggaattttctcctgcctgccttgcattcactgccatgaacaatgcattggttatcttctggagggagctgagccctgcaaacactacagaatcccagttcaagcagcagaagaggatgactgtcatggctacaaaagcaacctccacaactgcaagaaatattgtctgcaagttaggcagcaggtgactgaaacctactgcgctgctgttgttcatcatgaagtcaggctcttcagcttttgctaatcttagtcctctcaatgcccatatcaccaacctcagaaacacagggaacagtgtgctgcctgcaagaatctggccaatgagtagcaacaggaggccattgtttgaggagaatacaaccatactctcatttgtcggcaataaccctccatttgtgaatgaggagactgtgaccgatatcgagaagagagctttgttgatgcttttccttgttagcacatctctagcacttgaaacatgagctatgtacatgaacaccaatagagaaccagtgacaagaataatgatcatgtatgccagcaccacaaacactaagtatttgaggcatctcttcttgatatcaatggagttcatggatggagtttggggagtcgcctcttctagctgtgattgcttgcacacagtaactgaactgactctacggttttcaggatcatgcttgttttgcttgcttgactcaaggacaaggccaagaaaggaaaggaacatcttactgtctaagaacatcaagagagtcaggatagctatctgagagctggaaagatcctccatttgtatggtggctaatcctatgactgtaactgcagatgtcgataggaaaaacatatcaacatagcgaggattgtacttgtggttgcttggcctgagcaccaccaaggaaacaaaaccaagtatatcaatgataagaaaataggataagtgaatcaaaagcgggctaagatggtatgcgatgaaccgacaaatgaatgccgatgagttgatggcatgccttgcagaattgacaaagatatgcagccgaataggcattggagatagagggcagagcctctagctcctgattgtgtttgtcttgattcaagatggaactgcaaactgctgtgttgaaatataaaggggacaaccaatctcagtgagagtatatatactgtgatagtatatctgtctattggttaatattagtggagaggaggaagacatgtgcaacatggttgaggtgcctttcagaacatgatgttaagttgcagagcatgcaggtagatacacgaatgcttatataaaaagcatagaaagaagtgctcgactgcttgcatgcgtgctgaatttttgttcctctatttgccatactggtaaggcaactatgactggataagcaagtgtaaagggtgaaaacagcaactgtttgagcaagatgacatgttagtgaaagagcaggcaggcatgctcctcaaccaattgactgaaattcttggcaattggtatgatattgccgacatccgaaagtattaacaattgatatcatctctgaatttttatggagaataattagagtacttctgagatgatatggaaagcttttatggatgtcgaagaatctctgcattttgcattctgaacaagaaagttaatagaattattacagtacttccacttaatgtcatttaggtaagtctatccaccttactctcttttggtgcaagttattttgaatttggttattgccttgagtatgtcttgcactgatgatccagaaagagattgcagctactactgatcgatagcactggagcatgtttagctgttaccaaattcatggctaggatgcattctgatgccatgcttcaaagggcatgtacagaaaccactggacagaaatcgttcctctagcagccactgctctattcagttccttgctgaccatggtacaccataaatgcaagcatgctgttacaacccaactcatccagacaaaggacgattgttcgagtggacaagcatttctggactgaaactggaggtaaactcgtgatctattatatactaaaattccattaaacgtcctataaacacttctaagccaccacatggactcctacaaacactcctcattcgctacatggcacaccattaaattaagaaaatcctataaattctgagaaaaaaaaagcaaaacatcacatccttaattttcacttaaaacggtggactcattatcgtagactattagatgtatatctatctattaaaaaataaatctgcgaatccttagccctcgcatgtcacatgccctatgcataccatcgggctttccttgcgcctctcctcttttttaactaagggttgggttaattggatcaatagatccatgccactgcaaatatggaaaattagaaaaatgccaatactattcgcgatatcgactaggtgccactaaaattttgaaaaattgaatccatgccactccatcgcgtttcccgtcattcttcccgtccttcccgtcactctttccaggaggccaagggcatggaggccagcgtcatgggcgggggacggcggagccgatgggtcgaggaggcggagcgacggagttgccggagccgccgctttctccgacgcattccgtcgatgaagctgttggaattaatagatgggctaaggcccattcaagaattaattctttggaaaatcacaaaagcccatctcatgggatggcatgcatgtggagtttagtaccaccttgcttattctaggagagggggacctccttaaaagggaggatgccctcttagtttacatgtgtagatctaatgatgcgttcatgctagtttacatctgcaatgtcatgatttatttatggaatatattaaatcattatatgcatataatctcaacaatccaaaaaccttattataggcgctgtgattttactatggctggtattgccgatgcactgaggccggataaattcaccggtgtgcactttaagagatggcagatcagggtcactatgtggctgacagctatgaaatgcttctgggtgagtactggcaaacctgaaggaattcttactgctcaacagcaccggtgtgcactttaagagatggcagatcagggtcactatgtggctgacagctatgaaatgcttctgggtgagtactggcaaacctgaaggaattcttactgctcaacagcagaagcaattcgaggaagccactactctctttgtgggatgcattcttagcgttcttggcgatcgtctggaacgaggtgtatatgcacatgaccgacgctaaggagttgtgggatgcactgaatactaaatttggtgctactgatgctagcaatgatctgtacatcatggaggagtttcatgactacaggatggttgacaaccgttctgtagtcgaacaggctcatgagatacaaaccatggctaaggaactcgaactccttaagtgtgtcttacccgacaaatttgtggcagggtgcattattgcgaaactacctccatcttgaagaagtttcggtactgcactcaaacacaagagacaggaatactccattgaggggttgatagcgtctcttgatgttgaggagaaagctcgggaaaaggacgccgcgtctaagggcgatggtgggcagtccagtgccaatgttgtgcacaaggcccagaacaagagcaaggggaaatacaaagctcaacagaccaccaacttcaagaagcagaagaagaacaacaacaatcctaatcaggatgagaggacttgctttgtgtgtggccaacctagtcatctagctaggaagtgtccacagcgcaaggggatgaaggcacctgcagggcagacttctaagtctgctaatgtgaccattggcaatactggagatggaagcgggtatggtaatttacctactgttttttcagttaatcagtctactaattggtgggttgatactggggccaatgtacatgtttgtgctgacatcccattgttttcttcttatcaggttgcacggggttccaccgtcctaatggggaatgggtcacatgctcctgttcatggtgttggcacggtagatctgaagtttacttcgggaaagatcgtgcaactgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcttgttccgcttttccctttctgatttctacaataagtctgtgaaccatatttgtggcagtgtggatgatgaggctaatgtttggcactcacgtttatgtcatattaattttggcttgatgtctcggctttccagcatgtgtttaatttctaagttttccattgtcaaaggttttaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacgttgattgatgatgctactagattttgctatgtgtacttgttaaaaatgaaagacgaggctctagactattttaaaatttataaggcagaagttgaaaatcaaattgacagaaagataaaaaaactcaggtctgatcgtggtggagagtttttctcaaacgagtttgacttattctgtgaggaacatggcatcatacatgagaggacgcctccctattctcccgagtctaatgggattgctgaaaggaagaaccgcacactgactgacttggtgaatgccatgttggacaccgcgggactacctaaggcatggtggggggaggcattgttgacctcgaatcatgtgttaaacagagttcctaacagaaataaggacaaaacaccatatgagatatggattgggagaaaaccatcactttgttatttgcgcacatgggggtgcttggcgaaagtcaatgtaccaataacgaagaagcgcaaacttggacctaagactgtggactgtgtctttctgggatatgctcatcatagcattgcctatagatttttaatagttaaatctgaggtacctgacatgcatgttggtacaattatggagactcgtgatgctaccttctttgagagctttttcccaatgaaggatacacatagtagttctagccaaccttctgaaataattcccagttcaatcacaccaccagaacaaactgaatatacacatgaacatgtcactgaggaggatggcagtgaagctcctcgaaggagtaagagacaaaggacggctaagtcctttggtgatgatttcactgtgtacttcgtggatgacactcctaagtcaatttcagaagcatatgcatctcctgatgcagactactggaaggaggctgtccctagtgaaatggattccattatcgctaacgggacttgggaggtgacagagcgaccctatgggtgtaaacctctggggtgcaagtgggtgttcaagaagaagcttaggcctgatggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacaacttttcttaatggagagctggatgaggagatctatatggatcaacctgatgggtttgtagttgaaggtcaagaaggcaaagtgtgcaaattattgaagtctttgtatggtctgaaacaagctcctaagcaatggcatgagaaatttgacaaaacattgacatccgtaggctttgcagtcaatgagacagataaatgtgtgtactatcgccatggtgggggtgagggagttattatgtgcttgtatgttaatgacatactgatatttgggacaaacctttaggtgataaatgaggttaaatcattcttgtctcaaaattttgatatgaaggatttgggagtagctgatgttatcctaaacattaagctaattagaggtgagaatgggattacactcttgcaatcccattatgtggagaagatcttgaatcgctttggctacattgatagtaagccttctccagcaccttatgatcctagcttgttgcttcgcaagaacaagagaattgctaggaatcaactggaatattcccaaatcattggctcgctgatgtacctggctagtgcaactaggcctgatatctcctttgctgtgagcaagttgagccggtttacctctaatctaggagatgatcactggcgtgcgcttgagcgagtaatgcgctatctgaaaggtactatggcattggggcttcactatactggatatcctgcgatactggagggttatagtgattctaactggatctctgatgtggatgagatcaaagccactagtggatatgtcttcacactgggtggtggtgctgtttcgtggaggtcttgcaaacagaccattttgacgaggtcaaccatggaagcagagttgacggcactgcatactgctactgttgaggcagaatggctgcgtgatctattaatggatttgcctattgttgaaaaaatggtgccggctatcttttgaactgtgacaatcaaacggtaattgtcaaagtgaatagttctaaggataatatgaaatcgtctagacatgtgaaaagacgattaaagtctgtcaggaaattgagaaactctggagttataacgttggattacatccaaacagctagaaacctggcagatcccttcacaaagggactatcacgaaatgtgatagacaatgcatcgaaggagatgggtttgagacccatgtgagttatactatggtggtaacccattctatgtgattggagatcctgtgaattagaacctgggaagaacaaaccatcagtaaactagaggagagtaccaatatataccctctctaagtgaagatgcatatactctcgtgagctgcaaggcaggttggctatgctttaatgagttctgttggctttaattagcaaagatgttgtcctgcagagcatttttgaaagaactcacctttgtgagcttgttggtcgcagtctatgaagattttgggtgaatcttctaggaagcttactaaagacctaggagtatgacttatacactccacccgaggggtagtctacagacggtctagtaccagataagactctgagtgaaacttgcttgcacaagacttgcaattcaaggcgtagtccattgttcaagttgtgagtaagtgtagcttgaagttctagatggatgttcaaccttaatcggtctccatcgaaccgctggtatataaacagtacattggaaaaggcaaatctcagtgggattttgagatttggtgggggattgttggaattaatagatgggctaaggcccattcaagtattaattctttggaaaatcacaaaagcccacctcatgggatggcatgcatgtggagtttagtaccacctt

SEQ ID NO: 62469 - DNA, 2232 bp, Oryza sativa
tcaaagatgggctgatctggcgtagtggctggtggacacgtacctcgccgagctccttcgccaccgctcggccgaagttggaaaacggcacggagttaggaaattaatggggagtgaatgaaaaacgtgacggagtggcatggatctaatttttcgaaattccagtggcacctagccgatatcatgaatagtagtggcgttttcctaatttgatatatttgtagtggtatatggatccaattaacccttgtttaaaatagagagaatctaatctataccaccgagtttgtttgagttcaacaatttgccatcgacattgtcattttgtataatatagtgacgactttattaattttcctacaatacgccattaggttaggtatttttttcaaaaatacccgaaatacccttatggacatacaaagttaacaattgatttatctaatttaaagttttaaaaaatgaaaacttttatgaggactgcttacacaacatgaaagtttgaatacaagtttcaatttttttggtatatttagtttttagaaaaaaatatttttatgtggtatgtgggagagaatctggttatacaagacataatagcattaaaatatcttatgtagcgtatgaaagaagtttcaagctttttatatttctatttttttaaaaaaatataacttatttattatatgctatataaatacgtttttcttgttgtttttattatgaatcatctttcatacactacataagatattttaatgctattatgtcttgtataagcagattctctctcataccacataaaaaaatattatttctaaaaactaaatataccagaaaaaatttgaaacttgtattcaaacttccatgttgtgtaaggaggccacataaaaaaattatatttttttgaaacttctgataagataaatcaattgttaatcttgtatgtttctaagggtattttggttatttttgaaaagaaggtctagcccaatggcatattgtagaacaattgataaagtcgccggtatattatagaaagagacaatatcgataacaaatcgttgaacttgaataaggctgtgtttagttcacaccaaaattgaaagtttggttgaaattggaacaatgtgacggaaaagttggaagtttatgtatgtaggaaagttttgatgtgatggaaaagttggaagtttgaagaaaaattttgcaactaaacacgggctaaacttagtggtatagaatagattctctctttaaaatatggttgcatgaattgttagtgctacttaatctagatccatactgcgctgaaaaatgtgatcatgagaccacaagaatcatatgtagcaccaatagtcttctcgtgttcacattgagttcattcaaggacaagtttaccaagcttctcatgagaaaagaatggttgacaaatctaaaagaaaaattttcagaaatttatttgtctgttgatattgccaatgacataacaaaaacttgttgagcttgtcgaaggattttgaggatttatgtcatgggaggttacgcgacaaacgtgtccagtggacatttggattaagttcagttccttctaaactgaattatttaaggctgcaatgcgtggatttcattcgaagtttcagaagctcactcaaattaccaaagtttgtggaaaggaagtttcttgaggacttctgcatcaaacatgctaaagtcatcatttctacaacttagtcaacttttcggctccatgaagcagctatggaaccaatcaatttattaatagtagatgatgcagccaaaatcaacgaatgcgacctcattattccattgcgcctgctggtgacacacattttgatgctaggcgacgacttcaatttgcagccaagcaaggtaatcttttctttctgattttctagtgtattcgtttacatgactagacagtaaactagacaatattaatgctggctgatgcaaatgatatatcttattgatgaaatggttaggtacgggaaaatgccaggtttactatgagtcctttcaaaagattgctcaatttgggttttcggaagcatatgctcactgagcaatatgcaattcatccatcaatctggcagttccgcaatgagaaattttatgaagggagaatcacaaatggtgcgactgtatttctcctgaatacaacaaaaaattcaaaggtcttaaatttcccaattattgctttattgatgt

SEQ ID NO: 62470 - DNA, 19578 bp, Oryza sativa
tttacaaacaccagtatgcttgtttggaaccaccacaggacttcagttggattttatccactgataatttgatggaagaatacaaggaagttgttggaaaagaaattagaatcatcgacttgctactgtactgcaaattctagaagaatgtggtgtcctaggcagaagaaagcaacaacctgaggtaatatctgttttagatgtatcatgtcatgtgttgtttgataggctaaagtgtgcctttatagtcattttattttagttgttacttcaaaaattacaggcgctcttggatcaagcacagtagcactacttcatctgtttatgttcataaattttgcaaatagaaaatatgcactagttgatggctatattcctgcaaagtgattgtattttgcatattcctatgccctgctttctgagttacaagccacaccatgattttcagaaacaaaaggaataaggcctaaaaggaggatcatatgtaaggtttagtgaggttaccaagctgcaattcatgattttaattagttggtatgcaatcatccatttgtttatctcctggacaaaaataactcacaagaatatcctgcacataatcctattgtaaccacaattccatattttgttagtaaaaatacacatttccggtgttcttgaaacaattaattaatatcatatcaggaagatgcaacaccttgtatgagcaattgcattctgtcacaccaagatgcccttctttgtcgactttcttatcaatatcataagtatcggacgcttcagtggccattcctcatggttgtcctggaaatttcagtggaattaaagtttaaaccttcaagactggactagtgttccagaaaggtttggaagcataatatgatgtgcatctatttttaaactgtcctcctagtcatatattagtgaatctgccataacaaagtagccttagaaactatttaaacattattttcattttcatatctagtgtttgcgctttggtcaaggaattgaggttgtagtacctctttgatccagttctcaattgtttacttgtttcttcccacaaaggcacaaactgcatttcttgctacacttcttgtccataattccatatagatatggaatcaatagggtatttccatcaaaatccagtagtccacttttcgttccctgtctttcaaaattaacattcctttattaattttcctcatgatcaattcttaggcctgacaatattgttcattattttaccttgactctaagttttgactcttttgcaggttgcaagtaatttcagaatcaaatcccaacctcaacttcccatcaagaaggaccaagagataaaaaccgtcttcaatactgtcaagaatggaaaatttccagtggcacatttccgcatgtcggaaaacttcttctccttaaggccaggggagattggccactatgactaccagaagccctaccttcatcccgtgtgttctttactagcttctcatgcagtgatgataattggctcagcgatgaccatgacagaggtgaataagagaagagaaaacagtgcgctatccatctgagcctacagaatagcgcgggcagtctgtttggcgagaatggtagtggttacgttgggttggaatctatacgaggcctgtatcaactcgatctttgaaactgtgctacttctctagctagctgctgctcctgctacttttaatacgttgccaacttgcaatgtagcccgattcaggcatctttttgtgcccaggttttgatgcttttactggagtttaatttgtatatgtatcacatttgcagtgaacttgcatcgttcctgggtcaacctgtcaaatgcccaaattggttgcccattggcctccttccaacttaacttacaatcatgtcaataacccttaagaagatttgtgtctaccgctcgcagcttcaagaggtcatagagattgtcgaagcctattaaaatatagccagatggcccaagaaatggctctgggccataaaaacccaatatctatgtctctctattctttctccttgagttcgacttctctatgtagtacccgtgcaactctcagtaagtttgatccatcttggtaagctcgtggtctccaaccaatggcatgcctaactggagctgctctgagctaggctcttaggacaatctgatacctccttgcctatatctagcttcttgggagccaatgttgagttgtgatccaaattcatttacacacatataaaggccaacttcggtcggagcaagcggaggcccgtcgccgaaggctacaacaagtaatacttaagaagttttgtgtccaccgctcgcagcttcaagaggtcatagagattgtcgaagcctattaaaatatagccaaatggcccaagaaatggctctgggccatgaaaacccaatatctatatctctctattctttctccttgagttcgacctctctatgtagtacccgtgtaactctcggtacgttggacccatcttggtaagctcgtggtctccaaccaatggcatgcctaactgtagctgctctgagctaggctcttaggacaaactgatacctccttgcctatatctagcttcttgggagcaaatgttgagtttatatagtgaagatttgctggctggcgcccgtggttttttctctcgtgccttaggagggttgtccacgataaatctcgtgtcttctgtgattgatctgtcgttcttcatcgtttatctgccgatcatttcctaacagccaagagtgaggttgtcacctttcctttcctttccctctactggcttttttgctagataccgctggtggagaagaatgtgccttgctctttttctgaggaggggagaatgttagccatatcgtcagcttccacaaaatcaaacccaaaatcaatatcatcttgtggtgcgccttcgatggtaggaggggctgaacgagctggagtggagataggcgatggagctcgtggtgcatttgacttaggaaccatccttatgacaatttgatccttaggccattggataaaggtcccacgtgtagctcccagtttcaaaatttagtcgttttgtgggatctctagaggtcagttgacttgatcatgtcaacttggactttggcatgcccagccaccaaatccaccccgtgcactttggtttttggggtaggcttgaaaactgaaagggcattgatgttgcctagagggggaggggggtgacgtgcgctaagatcttagggggtgtgttcctagacatttgcctatgtggctgggtaagttgggccgacggggacgtcgggtcctttgatggggagtgtatgtgacatcctggcccaattaggatgaggcctgtgtggcccatgtgagctgtgtgcgcatgtttattaccatcttgctagtttagcacgagtggaaccaacttataaggcctcttccctccaaccatgttactcccgggttaacccttttacacgaagcgaggacgaaagtgtaagtggggtggtatgtgtaagtgggcccgcccgtcggttgggctggctacgtggttctggagggagtactattacaaagtatgtaaagaaacttaaagtctaaacaatcaagtaattaaccactttttaggatggtagatgcctttgctatagtcgatatcagtgagaaccctaaagcgagaaccagccgatagggcaaccactttttagggtggtagattcctttgctaatctaatctagcaagatgatttagtcgatatcagtgagaaccctaaagcgagaaccagtcgatagggctaaatcgggatactaagactagattacttaagacatatgatagcaaatggtcatgatagaaggactaaaatatctaaatcgacataatagctccaatagcacaagtcatcgagacaagttacctcttatcgagagaactcgccgaaaagaagaacaaaaagggtggcgatgcgccaaagttgtattgcatttgtcgtcccttttttacaatgatctcgggttcatatttataccccgagtacaaacttagtccattatagacacgactcaaactttcctaaagataaaatacaaacaagaccacacggtggtctcttaccatatctctaacaaaaaccgacataaatatcctaattaatagatacaattgccttaatcaagctccaattgcggttatcttagtctaggcccaaaccaagccccaagtcataccatatcggttgcttgccatatcggctaggctaagcatttgctctgtttttagccgatatgatgtccaaccgatgcacagtctgactctgaattcaactcgattctgcaccaaatccgcttcgaactttcttctacctctccgagtctgatgcaaaattccgttgttatcaatacccgagcctctcaaaactagccgttggaggccaagattccatttttcggaatttccgaaatgcatttcgggcaaatccaaaaatcaacagaagacaatctcaatatcgcagccatttttggaatttccgaaatattttcggactttccggaattttttcggattttccgaaaaacacatggcaaaacggccataactttttgctcgtaagtccgtttgatgatcttggactctatggaaagctcacaaagagaactactcaaatcaaccaaaaggaatgtctaaaaccactcaaaggatgggtcactttgagcaatgagacatacacaaacacatcgacgttacatccctcttaatagtacaacattcctatactcaaattgatggagcttggggctcctcaccgggagaccgcgcaggtccccctttgccggttcggccgggggccctgggtgaggttctaagctcctggtctgtgtgtggaaggttcgcgagaatggaaaaagcacaagacacgggcgatgtatacaggttcgggccgctgagaagtgtaataccctactcctgtgttttggtggatctgtgtatggagaagctacaaagtgccagccagcccccgatcgttctgggatcgtttttttttttcttttctaagtgggcaaggtcctccttttatatctcaaggggataccacatgccccatctctctcttttttgtggggacttatcctatcttttcataaacagacggagacttgtatggttgccgtccgaatgaccttctgatgggacggcccacacctacctccacttccgccggaacaggcgcgacgtgggaacatggctgtctgctgacgacatgaccagtgtcagaccggtcacaaatcggtcattcttgtcgaccacgtgtcagtttatcaatctgcatttcgcccttcttcatacaatatcttgcctgtaatggttaggatgaagcctggcatatatctgaccggaaccaacgtgccatctccaggagctaacacgccggctccggctagggacgagtgcttggaggctctcgtcctgacgggatggggcgaggcgtgcgtcagaccgcctgtcgccacctaacccacgatctgaccggtctggtcacagaccggataaacgagtgcgctgcactgcgttacatgcggcgtgatgcgctcgtccaaaccgcaataaatgtggttaggtgagccccgctatgctcacctaccccatatacgcggcgcaaaacccacaaggggtcggggcgccttggccctcggggccgagacaggagcggtccgacccctcgggaagacaaagagaagggcggccgtatcaccctcgggcccgaccccccccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggtgtgacgccacttcctaaggcctggtgacaggtgggaccggtctccacagttgggcagaaacccaacggtcgcaaatcacgcacatcggcaatggttactcggctgtcaataatgagcggtctcttcaagactgccacattactcgagtaacacgggaatcgggacaagccggttcgtttttcctggagatatgatgatggcgcttcggtcggcgagcgtgattaacgcgcgcacgagatgttccatctcgactgccacagccgcatatccacctcatgcaccgcaaacgggcgaatgggattagtggaagcgtgggcgcgagaaacgagggggcagatagtgggcgcgagaaacgaggagccgggcatagcgttggcaagggtataaagtcgccgaggaagagatttgcttccttcctttcgccattattccccttgtcttcgccgcttacgccctgactccttgtttcctgtgccctaccttcgccacacgcgctcgctctcaaacatctcttcttccggcgtcatggcacggggctccgctccgcttgacggtagcgtgctgccgccttcccgcatcgtgagcgagagacaggccgggctgccgcgccgcttcatgccggaatctgccaccggccgggagatagtctcgctgggcgagggatgcccggcgccacgctacccggggcggtctgtcttcttcctcccttttgctatggcagggctggttccgctattttcttctttcttcatggatgttctggagttttacgatctccagatggcgcacctcacccccaacgcggtaatgaccttggccatcttcgcgcacctgtgcgagatgttcatcggggtgcgcccatcccttcggctgttccggtggttcttcatcgtacagccggtgtcgccgccgtcggtggttggtggttgctacttccagccgcgggggccggtgctaaaccgctacattccctgcgtcctttgcaagaagtgggatgactggaagagcgactggttctacacccccctcgccgacgaagcgcgcctccgacttccgagccagcctccagcgcaggcctccaactggcgggcgccggtagatctgggagatggctatgacgccgtcctcgatcgcctggcgggcctgcgatcctaggggctcacaggggccatggtgttcggcgactatcttcgtcgccggatcgcgccactccagcggcgcgcccggggcgcctgggagtacaccgggtccgaggactgtatgaggacccaccagggggtcagatgggactgggctcctgaggacttcaagatagtggtccaacgggtgctgaatctcagctccgtggaggcatccctcattcctcaaggagtcctccccctctgtagcgatccagaccgcgcctccatcctgaccatcatgcaggcggtcggggcgtcggaggagcgggctcctcgaggccacgatggcgcgggtgggagccgcaggggggaacaatctaccccgggagggggtcgtgcttctgggccccgcgtcgggggcccggggagcggccgccctgccgacgcccgggggaagaggaagcaggaaggaacccctcccccatctcctccccgagggggcggggcggcccgtgccagcagcaggcgcccggagggggccacgccgacgtcgcatcccgagggggagcggaagaaaaaatgactccgcaagacgggggggacagaaccatcccggggaaacctcatttcccctccaaggtggttgtttaaccgaccccctcgcaggttcgtcccacgcccattgcggccgtattcattccctcaacacgagttttcactcatccatcttgtttgtcttctggtatttcttctgtttcagcgagatcccgtcgcgtccctcccgccattccaagtccggccagtctgaggccgaggacccggcgaccacagaggcccggaggcgggaatccgaccggcgagaagccgcggatcgccttcgggaagccgaggaggccgctcgggaggccgcccgggctcgtcagaccgaggaagccgttcgggaggaggccggactccgccaggccgaggcgacgacatcctccgaggcgacccgtgaaactgaccggcaagaggccgcggatcgccttcgagaagccgaggaagctgcccaggtggccgtccgagctcgccaagctgaagaagccgctcgggaggaggccagacttcgccaggccgaggcggcgatgacttccgaggcaactcgcgacgaggccgcgggcgcatcgcttgggcccacttcctcgggcaacgctcaggacaagccaggtctgggggacatccctgagtccggcacgtccatcggcgggccgagccgcgcggcatcctcttcgaggcggctcttccccacgccttccgttgctccactgagcgcagaaccccttctgcaggccttagccgtcgcaaacaccacggtgttggacgggttaagtgcccaggtggaggccctgcaagcagagcgggcggagctcaacgccgcatgggcgcgtgtcgaagaggggcgacgctcggtggaggccatggtggaggtgggccgcaaggcacaccgccggcacgtctcagagctcgaagcccgtcggaaggtgctgggggagatcgccaaggaggtggaggaggagcggggggctgccctcatcgccaccaccgtgatgaacgaggcgcaggacaccctccgccttcaatacgggagctgggaggcggagctaggaaaaaagctcgacgccgcccggggggtccttgacgctgccgctgcccgagaactgcgggtggcggagaccgaggtggcatcccggcagcgcgaggaagcccttgaggcccgtgccatggcgctagaagagcgtgcctgcgccgtggagagggacctggcggatcgcgaggccgccgttgctattcgggaggtcacactggcggtgcacgaagccgcctgcgccgaagaagagtccgcgctccgcctccgcgaggacgcgctcaccgagcgggagcgagctctcgaggaggccgaggccgcggcgcaacggctggcggacagcctgtccctccgcgaggctgcgcaagaggaacaagcgcgtcgcaatctggaaagtgcctgcgccgagagggccgcactgaaccagcgggccgctgaactcgaggcgcaggcaagggagctggatgcaagggcacgcagcggcggggtggccatgggcgacagcgacttaaccgcccgcctcgcagctgccgaacacaccatcgccgatctgcagggcgcgctagactcatccgccggggaggtcgaggccctccgcttggcaggcgaggtagggcccggcatgcttcgggacgccgtctcccgtctagaccgcgccggccggcaggtgggcctctggggcgggcgaactgcgaagtacgccgccaaccaggggggcctcgcccagcgcctctcggagatagccgggactctccaacggctccccgaggagcttgagaggacgattaagtcatcttcgagggacctcgcccgaggagcggtggagctcgtactggcgagttaccaagccagggatcccgacttctccccatggacggcgctggacgagttccctcccgggaccgaggatggcgcgcgcgcgcaggtccgggacgccgccgaccatatcgtccacagcttcgagggttcggcccctcggctcgcgttcgcccccaactccgacgaggaggacgatgacggcggagtgggcgatagtggcgacgaggctggcgacccgggtgcatcggagtgagcgcccaggcccccgccaatctttaaatagtttcttcttttcttcttccgaggccttcgggcccccttcttgtatagactaatttaatctgcaatcaaataaagaggaaattttttgtgtcaattctatttgttgtgtgtatgagacgaggatatctgtgccgcgatcctttcgtgtcttggcttgaacaagggctcgtgcccaggtcctagtcctcaaatggctcgggtcggggctagtgcctggggagatccacatgtcgagactggccaggccgggagcgcggtgactgagggttatgggtgacccgattgtgggtttttgccgattcccccccggagttcaccacgccccggggcacggctcggttctgggccccgtttggcggttttagccgacccgagcccccgagggcaagattgaacacgagtgacctatttcaagtcaagatccttcaaaaggaaacaacagcacagatacagcccttaggaaatcgaaaatgcttttattgaaatacagatataagagaaacaagaatatgcatatgtggtagcccccggccaaccctgcacgcccgatgggggtgcggggttggcccgagcccgaaacctgacacccgattcccctttaggggtagaagcgacgaaggtgttcgatgttccacgggttaggcagctctatgccgtcgcccgtggccagccgaacggagcccggccgggggacgccgatcactcgatacggaccctcccatattggtgagagcttgctcaatccagcacgcgtttggacgcggcgtaggacgaggtcgtcgacgcagagtgatcgggcccggacgtggcgctgatggtagcgccgcaggctctgctggtagcgtgcggctcggagggccgcgcgtcgccttcgctcttccaagtaatcgaggtcatctctgcgaagctgatcttgatcagcctcgcagtacatggtggcccgaggggacttcagggtgagctcggatgggagaaccgcttccgcgccgtagacgaggaagaaaggcgtttccccggttgctcggcttggcgtggttcggttcgcccagagcaccgctggcaactcctcgatccacgaattgccgtgcttcttgaggatgttgaaggtcttggttttaaggcttttgaggatttccgcattggcgcgctccacttggccgttgcttctggggtgggcaggcgaggcgaagcagagcttgatgcccatgtcttcgcagtaatcgccgaaaagttcactagtgaattaggtgccgttatccataataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaatggccatgaaagtggtatgatctgtagggcctgggccggctgatggatttgcttggcgtggaattgacacgctctgcatcgcctgaccaggtcgaccgcatcattgagagctgtcggccaatagaaaccttgtcgaaaggctttgccaaccaaggtgcgcgaggcggagtgggctccgcattcgccttcatggatatcggcaagaagctcaacgccttgttcccgaggaatgcacttcaggaggattccgttagccgcgcgccgatagagggtcccttctaccagcacgtagcgtttggagatgcgctggacgcgttcactcccttcacggtcctcgggtagagtcttatctgtgaggtatgcttggatctcagcgatccaagcaatcaatctaagggagctgggagcgctcccctcgggtcccgaggcctggactccgacgggcctcgggggcctgtcaggcgcgtccgtctcccctaaggggtcgggtcgcgccgacggctgggcaagcctttcttcaaaggcgcccggtggggtctgggctcgcgaggaagcgagccgtgagagttcgtcggcaaccgtgttatctcgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacaccaggaggcggcggatccccagtccagctgccaccctgagtcccgcaaggagtccctcgtactctgccatattattggtcgcccgaaagtcaaggcgaaccaaatatctgaggacgtctccgctcggcgaggtcaacgtgacccccgcaccggcgccctgaagagacagggagccgtcgaactgcatcacccagtgggcggtgtgaggcagctgcgaggggcccgagctggcctcggggactgagacgggctcgggagctggggtccactctgccacaaaatcggcgagggcttggctcttgatagcgtggtgtgtttcaaagtgcaaatcaaactcagaaagttcgattgcccatttcaccacccgtccagtaccctctcgattatgcaagatttggccgagggggtaagacgtaaccaccgtgacccgatgcgcctggaaataatggcgcagtttcctcgaagccatcagaatagcgtaaagcatcttctgggcctgagggtatcgggtcttggcgtcccggagggcctcactaacaaagtagacgggccgctgcacctttcggtggggccgatcctcttcgctaggggccacatccctggggtgctctttgtccaagcggcctcgcggggtgcactcttcttctgtgccgatgacctcggggtcggaggacgacaggggcggccttcccacagtggcctcggggccgtcctgggggtcggaggctcctggcgtcgtcggacaagcgggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcgggccaccttgggggtcgggggcacctggcatcgtctgacaagcggggagagggcctgctccggtcgtcgggggccttgggccatcgttcggctcgggggcctctcctccctgctttctcccgggccaagccggcacagggtgggggtgcgcggaatgaggattgtcctcatcgcgctccacaaccaacgccgcactaaccacttgcggggtcgccgctaagtagagtagcgagggttcatttggctccggggcgaccagaactgggggagagctgagatacgccttcaactgagtgagagcacgttcagcttcctccgtccaagtaaacggcccggagcgtttgaggagcttaaataagggtagcgccttctctcccagcctcgatatgaaccgacttagggcggccatgtgtcacaccctgaaaatttaaaatttataaattgttgtttaaatggaatttttagaaataattttaaaagtcttgaagagaaaatctaattttaattaataaattccaatataaaatgtggccagataaaatttcattaaatactttgcttaattctataattcctagatttttctgggatttatttgagctaaggaagtatttttaataaatggaattgcatttaaggaataatttaaattgaaaaaggttttaaaaagtctcttttggctttgggccgaaagtcggcccaaaacctctcttctctctcctcgacccagccggcccagtccgccgcgcgcgagcgcgcgtccgcccgctgacaggtggggcccacctgtcgggatcgtcgtcctcctcgggccgaaaccctagcgcgccgccgccgccgccgctttccaaatccggccgctcctttccttctccggccgaattgaaagaggggaaatgatctccgggatctcctctaccttttctcctttggaatcttcggctaaatcggtttggaatgagtttgattcgagttcgaatcggatcggctttcttctctccaagtccgagctttccttcgccgttgccgccgccgtgggctttcgccgtcgcctccgagcccctttaaaaggacccccggtgtctcctctacccgtcgccacccttgccttcgcctctcgtcgccggaatcgctctagcgccgtgtgccctagctttgccgtcgtcgccgccgctccagccgtgcgccgccgtcgtttcagccgtcgccgtcgctcgggaaggccaccgttgtgctcgccaagtcgtcgccgtcctcgtccgccccttcgccgtcgccggagatcgccggagcttcgtcgccgtcgacaacccgaaggtttccgccgtttcctcctcgtcgccgtcgtcgttcgttgttcttccgccgccgttttggtcaccggtgtgttcgccgcgtcgtcctctacgtgctggtgccctccgtttgcgtcctagcgccgccgttcgccggcaagcgtgcgccgcccgagccgtccgctccgccgagccgccgccgctgtcggtgacgtcattgccgacgtcatcggggtcgtccgccgtgagccggtcgtggaccgttcgatctcggccgtccgttttggattggatcgatctcggccgtccgttcgcgtgaaccgtcgcccgtgcgcccggtccaccgaaaccctagcccgctgacgcaataatccttcttttccttttcaaaaataattcattattgcgtcataattcaattttaaccgatataagtgttttaatccgatttaatctttaaaaattcataactaattcatcttagctccgatttagttggttcaagtctctaaatttttctaaaattgagatttacactttaaaaatatccacatgtactgttcatgcttgtttatgtgctgttttggtgattttgctcttttctgcttatattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattgtttgctatagcccttttgttcttgattaccttattccttgataccttgggatattataatttgactagttgagctttatttatattggttcaactagatattagatataattgcttagccttgcttagaaacattagctcacttatgggataactaatgattcactattatttaatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggctgtgtcttgtgggtacagtggtacacctctgatcagagtaaaactattcgaatagccgtgcccgcggttatgggtgggtctaacaatgtctttcgtgattagtctcacacctctcatcattgtaaaagatgcttaaactggtaataatttgattagctcctggtttggaatggtatattcctggtttggagatagaactgtgcagccggggtggttgttcagaatggttgggcctatacaacagggtatgttgtatagcgttggattaaaattgtttaattacttaactgctttatcaaattctcaaatgtttgctaaatgctgcttttgcaaatgcaaccctattatgctatcctttgttatcctgtgcacttgcatatttgctgcgtggctggctgagtatgtcatatactcaccttgcaatcattcatcagaggaagagttctacaatgaggctgatggtgtggaggattaggtgtagccttggtcaagctgcctgtggagtggagccgtctgcgccgtttatttatttttccgctgcttagatctttattgattgagaggaactatctacctctgtaatgacagtttattcgcttattaattagagtaatatttgtactctattatcaatttgttattgtgtgcctcggctgattcctggacgagggttcacacacatgtaagcgtttggaattttggatagaaattccgggcgtgacaccatgcaaccggtgacgcattgcacatccctaagcttgctgggggggcgcatccgctctatagctcgtatcttctcggggttggcctcgatgcctcgggcagagaccaaaaacccgagaagcttgcccgcaggtacaccgaacacgcacttatcggggttcagttttatgcgggcggagcggagactctcaaaagtttccgctagatccgagagtaaggtctcttggttgcgcgtctttacaaccaagtcatcgacataagcctcaacattacgtcctatttggctacccaaagaaattcgagtagtacgctgaaaagtaggacctgcattctttaacccgaagggcattgtcgtataacaataagttcctataggggtaatgaatgcagttttttcctcatcctcccttgccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaatgaccaccgggttcgccagccactccggatggatgacctcgcagatgaatccggcctccagaagtcgcgccacctcctcgcggatgaaggcttgacgttccggggcctgccgccgtactttctgccggaccggccttgcgcccgaccgcacggcaagacggtgctcaaccacctccctggggaccccgggcatatccgccggtctccatgcgaagacgtcagcgtttgcccgcaggaaagagacgagcgcgtcttcctatttgccgtccagaagaccaccgatccgtgtggtcttggacgggccgtcgcccagggcaacctccttgaccgggacctcgtcgcatgtgactatccgctgcctcggggcagcgggggcggatgtgctaagcctctcgtcgccaccctcgggcttggacgcggcggcgaggtggtccgcgcgctgctccatacaagcaagcgcgactttgaggtcgccatggacagagatggggccaccggggcccggcatcttcatctggaggtaggcgtagtggaccgtcgccatgaacttcaccaacgcgggcctccctaagaccgcgttgtagggcagattgaggtccgccacatcaaagttcacccgctccgtgcggaagttggcggatccaccgaaggtgaccgggaggtcgatatgacctagcggccaagtgtgccccggcgtcacaccgataatcggttgggacggccggagcaccatccccggggccttgatggcgtcaaaggctgcgggggaaaggatgttgagggctgctcctccatcaatgaggacacgccccagctttacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgtggccagaagctctcgcttcatggccttgaggctccggcgagaaacgtgagcacacgctcccccatcgacagtggcaatggtggccccaggctcttggacacctaggtcatcatcgccgtcatcgatgtcctcggcgggggccttctgcttggcctcacttcgccgattgccggaaggaaccgccggggacttaccctctcggcgctcctgcctcctctcctcctcccacttcctcgtccgctcagccaaacttttgactgcgcggcagtccgcgaggtcgtgaagggaagtgttgtggacgatgcaccacttgccggttgggcgctccttgctgggagcgccggcctccttctttttgtcgcccgcaggcctcccctttcgggtggcccgcgaagcgccctcgacggcgaggacatgaccctcgtcgtcggtatgggctgacctcttcttcctcctcctgtcacgccgccctgtctgagcagtggatccgggggcggccgaagctgccacaccggaaccggaggggttccaggtccatgcctcctccttacgagccactcggtccgcgagctgaaaaagctccgcggtagtctggggctctttggaggcgatctttttgagcatgcggttgtgccgcacaccccccctgaatgcgtagatcaccgcgtgtgcagggatgcatggaatggtgttgcggacttgacagaaccgctgaatgtatgagcgaagtgactcatcatcccttcgctggactgcatgtaagtccgcttcttcacctgggcgcggatatgtgccttgaaagttcatggagaactgttgacacaaatcctcccaagagtggacggacgcgggtggcaagttcattagccaaccccgcgcctgtcccttcagggccatgggaaagaaattcgccatgaccctgtcatcacccccagcggcttcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgaggtgacactccggacgaggaggcgccctccgttgcgtggggagcacgccgaccattacgccggcgctcgatatcgatgcgggcatctggccccccacgctgatcttcctgggtcggaggcgctgacgaaggagtggcggcagaatgacgagcaactgtcgccgctcgccgcgccctccgcctcgacgacacggagccagtggtagcggcgccagaggtcttggtggcggaggaccgcccaccagcacctaggcgctgccgtgccgtcatgaccaagttagccacgtcgtccagccaacgttgggctggagactccgggtcagggacaacgggcgggtgacgtaggagcgcgcccgcagcttggaatgcgccctggggcgtgctgccgtcgccgtagacgaggaggcgacgctccccatctcgccatccttccccatcacccgtggatgtcgaagtcgcggatccttcgaccctctcgagcgcctcctcccgcctaggactttggcgtggagggggcgatggagtacgagctcgacggcgtgggttcggctccccgtcgtcaccgctaacactcggagagaggttgtgcgcctttgcttgttcggccattgggctgaacaggaaaagcttggcgcacacgaaaaagtgcgagagcttagaagaa

SEQ ID NO: 62471 - DNA, 2317 bp, Oryza sativa
  unsure (1)..(2317): unsure at all n locations
ttgtcttaagcgacgtcaacgccaaaaccgtttcaccatatattcttcaaatgattgatgcggttacttgtagcttcaaatggcctcacacggtccatcgtgacaaagtcgtcactcgctcttcaccgctagatttggtttttcgacaccaagccccttgcttacccttcacgatgcatggtccatcccgaccaagcatcgcttgcctttcaccattttgccatagtagccacttcatattccacatcttcaatatcttcacttggtcatccttagtatatttaggtgtaatgatatcacttgagcatcagcacctttgcaatccttgggacctatttctctcattcaactcaataaaattattagtcccaatgatccagttgtcaaccttcacatgttgactaaccgatcgagtatataaaaggatatgaataagtggtgagtattaatcaacaccacaagtgtcatatactcgattgtatacttaaatgtagagatcccaattaaatgaaagtgaataacttggatcaaatacatgcataactaacgtatagggtttgctccccctaaatgtatgcatacggaatatttgtgtgaagcaagagtatacataaaaagctatgaaacattgagagcttatcctatacaagaatagaaggcattcatcaaatatagacattaaaataaaaacataccttcatcatctccatgtcttcaatgtaaagagattaaacaagatatggctcaatcaaaacattagtctcacatgcttacgtaatcacatgaaaaatattatatatgaatatatcaatatgtgcacgaagaaaaagagtgatacatatagcttgatctccatgcatttcatccttgtgatttaggtccaccatcactgaatgtttctatctcaactcatatgaagtccaggaatcacctctcacaaattccactttcatatccacatgagactagtagacaaagaaatgcttataacaatattagtctcatgtaattggatttatcattaatcaccaaaaccaaattaatggcacttgaactttcaaaacgctcccctcggcggtgatggaccaaaatgtttgtgtcaccctgacttcttgggtgcacgatctgggtccctgcgatgaattcatccacgttcttataattgggtataactctactttcttaagattagcaaagattttcttgaaacgatcaacgataggtagattgatcgtatttcttatgatcacagataaatccgtaagcgcaaggaataccgttgtagcacttcccccttagagtattccaagggtatcgaacacaaggaacgtgtgtgtataatatacgatcaagattcaatccaaggacaacaacttaagataaattggctagaaatgattcctatgtcttttaattagttaattaagttaaagataaaactctatcgaatgcttcgggtaccggctctcccctggtctgctaggatgagtccggccttgagctatatgatgtacccgaacgtggagagatacgaaggacggacatggctgtcaccacctgccacctaccttactttccatggagcacgcaacaaatgaagttaatttctaacctagacaccacgtctaagttattaattactattctaaccttgtgtaggaacttccttctttatccagagtcctagtgctagagcactcagttgcacactaagcgacgaacccacaccgataagaatacttatctcagttaaataaactaattaagggacataaataaacccgaacacttacttgataaagaaagcatnntcttcgaggggtacaanngcgagaagaaaagaaaggcncnnaacaaattcccgggcttttcctcncgnaaaaaactccgttggaagaatgccgacactccggcactcctcctaaaattctcgaaggaactccgatatttcgagccactccttccggagcttcccgtcactctctaccaaactaacatactaaatataaaactacaagtgaattgtactctacttgagctcaagagttgtgtgttgagaagtttgatggagtcctccttttatagtgtccaatgatggttgagtatggcggtttctggccatcgacctcccataaccgccatcaggaaccaatcagggagtgacacatggaaggtgacagttagcggcgccagcaggggtttggccgaaccacctcaaccgtctttctcctccgactttggtcggtggatgacaggtgggccccttagtcggttcccgggtggttggcctcaccttgagtcggtttaagttgacttg

SEQ ID NO: 62472 - DNA, 14797 bp, Oryza sativa
  unsure (1)..(14797): unsure at all n locations
tgtgttttgacttgcattcaacgtatagaggtgtcttagaatcactagctaacctggtaacaataaaataaataacatctctaatttatacaacaataacttgataagtgatatggtaagtaagctatacatatagtaaaaggatttgggattaaaaatgaataattatatttacatgtgggtttcttaggggaatggccatgaacacatacaattgtgggatctcctacaaattgatgatataaatgttggagatattgatctaaaaaaacgagcgatatctcttccttattaaggaaactcaatttgaggggatttttatataccgacaaatgttcgttgtcttatttgttccgtatctgtattcgataatattcgatttcatttccacatccaggtttttaattctgattttgattccgaaaaaaattatgaaaacaaatatgataaaggtaatttccgttcgtttccgatctgttttcatccatagttcacgatgaccagttatgtactagtgtcgtattctagcataggtggacctcgaactaatattttcctcctagacaataaaaaagaaataggttgttgaggcaacaagtgaatataaaagaaagtatgtgtgttcggacgaacaagtgtgcgcgtatttatgtgagcagaaaaccaacagcttgagcatatttatgtgagcaaaaaaccaacagcttgtgcactgcatgcatgatgtacacattcttattcagttgaacacgtacccctccgtaaaaaaaaaaagaccaatcctacctacgactacgaatctggacacatgtgtgtccaagttcgtaggtaggaattcgttttttagacagagtagtaagcgctaggcagctagctaatacacatacacggacctatagctacccaatggtgaacctatgtactatttaccgggatcacaggcacctggtaaattactcaatgctagctgattcatattatataattagtatattagttaataattagataattaatatgtatagaacctccaataatttttattatgagttgctcactctagctaccagatcatctattgacgagaccgactggccggccggtcataccgggcgaagaaacgggtcgcgtccgtgactccatatatgcatgcatgcatggtgtcatctaccacttcggtctcttgcagatgctaagtacgtcggtcacgtacatacgccacaaaaaagtacgtgtgtctctgtggtcgatcgctgcgtgcacactgtgcctcgacgcctacctgcggcaaaaacaccctcgcatcgtcatatatcctttttccggtctccggccgcccttttctactgatctcagccaaaagataagatcgggcgacgacgcagcactgctgcgtatattccccgtccactctgctgctaaaggctaaagcgcgatttttcttcccagacatttttctgggatgggcttaattatataagtcaatttttgacagatacaacgggaaaatgagtttagaatatctaagacttttacgattctatcttcagcagtttaaaacttaagtccgagtgtgatgacgacaaaaataacaaggaaagaccataaattaattccaaaacttataatccgtagttcaaaattggaactggtctataagacgtagctcaaacaaataaggctttaatcggcactcaccgtgaaatgtacaaaactaaattaaatgtgcccgtagatgtagcggtcactaatatctgtacctagagatggttttctaatggatagggtgctcgattattatgtgctacctttaaaaagacggtgtttgtacaacgtggtgtatccatcaggcggtaaaggaaccttcttgtgctttttctcattcttccagctcagctagtgagcagctttttatccagtctctcctaaagtagtggaatacgaacccggccacggaatgaacgtttgccctgagatcttcttcgatattttattcatccttttccttttcggaaaatttgtatattaattcttcacgaccttttgatgaaagggctagctataatagttctgctaattaatctactgatcatatatataaagattactattctgtatttatgctatgctggcatcaataataaagattactacactcatataaactgaaggacagcgatctctacgcaaagaagagaataaaccgcccatgttcatacgcacttctggatggataagaggataaaaagctacttgtgcccagaaagtataaaggataggtatctttatcggagcctaattcaaattctcaaatatacctgtggcttaatttatttggatgtgacacagtatactgtctccagctgctatagttggctttggtttctttacgaatgaggagtcaatgagatcacctggcgaaaatactcggtagatactggatatatgatatgtcttagtttaagactacatcatgtcggcatgaaaccagagctgaatacatgaacaatattgtattttaattggtatagagtttcattggttgtactattaattagttggcagttatcagttaatttctttcaagatattttacaaaaatatttactcgtgaaggaatatcaattctcaaaggttttgctagctcacaattgcatgaaacctagctaaatactccctccgtcccataatataagaaattttgagtttttacttgcactgtttgaccactcatcttatttaaaaaaattgtgtaaatataaaaaaaatgaaaagttgtgcttaaagtactttgtataataaagtaagttacaaaaaataaataataattctaattttttttaataagacgagtggtcaaaacagtgcaagcaaaaactcaaaatcccttatattatgggacgaaggaagtattatggataagctagctaggcacccctcatagttaattggttaatgatgactaggcacatctgtgaggtgatcacccatatttacatataatagaatgcagcttccctgttccgatccgtgtcccataagtgatcaccggtggatgtcatcagtggtgggcccacacgtcacattcgtcttctcgattggtttcctcgtccttctcttattgcctcctctctctcatggtgttaaacacgggatcaattaaatcaaaatagaataactatgtaaaaaccagttcaatcattgttttatgtgatttcacaaccaaaccatgttgtttaaagcgaagttgaaaactagagattactgaatgaaaccaatctggaattatttttctccctgaagttgctttgcctggtgtactttcagcggctgtggctcgtgttcctcactaaaatcgctaaagcggctgtggctcgtgttactcacgaagtgaagcacccaatagaaatcactcgtaggattgcaagagattggaacaaggaagaatgaaatctctgtggttccttcattgtttgttctccaatatgtaccaatcaaatatcatggcctgtcaatggagccataaagcggagaagggagaagacaaaaggaaaaggatgggtgattaggacttaatttgggatgggggttgggggggggggggaagagggaggaggggtnaataatntnagtcgtagatgagttgggaaacatggatcggaacaacaacaagggaatatccatacctatgacagttcatcctctatcgaacctactgaaccataggtgatttttctaaaaaatagtaaataaataaattcccattaacccccccccccctccaccccacaaaaaaagagcaccgtggccggccacctccgccctctgcatgcatcccaagcaccactgccagccccctccaaatcctccccccatgaggttagggcagttagatccaatgaactggttccgttcttttctccagcaagagttagatgaaaattaagattttcgtggcacgcttttcaaactgctagatggtgtgtttcgtgcgaaaactttgtatataaaagttgctctaaaaatatcatattaatctattttttaagtttgtaataattaaaactcaatcaatcatacgttaatattatctcgttttgtgtaaaaaacttaatcttcatcttcatcttcatcttcaggagaaaagaacaccacaacctcagggatgctgaatctagagggtatacagtggtaacttgggagacaacgcatggttggagtttaaagggaaggcgatggatccaccgccagaccaccatcccctcgccagtgcctttgtcattagttcgtaggatggtagaattggtgaggcatgaatagaaatgcagatattaggccctgtttctttcagcttgggattattataatccagattattaggagtaagctgaaagaaacagacaacttattgaagtagcttattataatctggagcccagcttattataatctgaagcccagcttattataatctgataagctcatttaggtgagctttttccagattattgggtgaaaatttacccaccatgccaccactccctctttagacttgcaaacccaataatttaggctctaataatctaggaaagaaacaactaatcacttattctactacagattataacaatctaacttatagtaatctgactcaataatctagattataataatttcaaactgaaagaaacagggccttaattgcatcactctagcggaaccatgaagcaaagggcaaagaagattgcaggaccctcttcctagaactgcaaagggcaaagaagattgcaacaccctcttcctgtaactcaagaagaaccaccatcatttctgatagttttgatgaagctcaaactcaagaacaagaggcacctcttgctcctatcaatctaaattatctttgtaaattttgaccttgctagttgaattagtcgattagtgatggtataagatataattctatcgcttttaaactaattaaatttctatttgtttatgggatttgcaatgttagaaaattttggtacgttgatgtgaatgaaatttctacttcttcaccggtacttgtgaaatagaactacccaaccaaaaattcttggccactatatatcatgatggtatttcttaaatagtactattagttgtttgaactatcgtaatacaaaatgttcatgggagtttctcttctacttcctccgtttcagattataaaactctttagcattgcccatatttatatatatgttaatgaatcttgacacatatataataaaccgtgaaagtcttataacctaaaacggaggtggtatataataagccgtgagtgctgcccacttatttttcctttacgcaacaacagaggagccaagatgcaatcgacaaaaaacacaccgagttagccaattaggcaccaggggttgcgtgtctattatactacgtcatagcgaccgccaaaatatcgaatgcgggtggaaaataaatttttcacgcaactgatgactagatggagaacctctttttttttaaaaaaaaagttacagtttttgacaaaatgcttcagttattcgtccctgacaaccatattccagacttccagtcatgtgtccagtccaattgaccaattgtccatgcacctccaggcagcatatccagagatatccctccgcaacagcaagtgggagccgcgcgcgagccgtcggcccgccgccggtcacgcgcaagcgcatatgcatgcatggcagggaataaaattaagcagaagggggatggacgatcccaccgggagatctcccacatggccaccaccctccccctcaccgaaccacggcgagaaacgcctgcccctgctcatgaaaacgaccggaatattctcaccgaccttgccccacaactccacacacacacacaagattagatactttctcaaacaaattcctcttctttctttctttctttcttgtgcgtcatctctatcaccgatctctatccccctcctaccacctacgctacgcaagcttatctatttgccgcctttttcaattaattccaaaaggaaaatagtatattaaaagcttgtgtcctgcacagtagagcacacgggcacagtagacactactgcacgtgtatatataggtgaccaagctacaccctgatcgatcccctcctactctctctctgatctctcctagactctagtagccttagctagctacaaatggtgatggccatggagaagaagaggtttccaacgctggcccaggtggccaagatggcgtccctcctcctcctcttcctcctcctccccttggtgccttcctccctcaggcagccctacctctacctcctcttcaacgccctcgtcgtcgccctcggcgtcgaggccggcttcctcgccgccatctccagcggcccgcgcgacgacaagctgctgcccaagccggccgccgccgccgcagctctgaggctgagccacagcaatagaccaggtgaagtcgacgtcgctgcggcggcgaccaacggtcgtcatcaccatgtcaacggtagtagcagtagcagcgctgtaattgtggccgcttcaccatccttgacaccgaaggcggcggcgttagaggctgcagccggcagcagggacgtcgtcgtcatcgccggcggtgccatgccggcggcagcggcggccaagaagtccaagaagatgaggaggtgcccgtcgagggcgagcctcttcttcatcgggggcggggacggcgaggacgtcgtcgtccacgaggaggaggaagggtgctggacgaagggcggcggcgggggcggcggcgagcagatgatgagcaagcaagagctgttcaccaaggcggaggcgttcatcggcaacttctacaagcagctcaagatgcagagggaggagtcgtggaagaagttgcaggatctgtaccaccaccaccaccaccactacaagaccacggccttgtagctttgctagggctctcatcagttggtcacaactccaagtctgatcatactccaagtatatagtacacaactgatcaaaaggcatgcatgcatgatgcatgtgccttaccgatcataacttaattaattctacatctagtatatatatagggagaacatatatgtcatgcagatgtttgcatttgttggtaggggggatatgatatgtgtctacaggtgcaggattggagcaggggaggaagcaacagatattatgttgttgtgtttctcattctttccttcatccatagattaactactttgatttggatggccagttggctagtcttggggttaaatatttcaaggttataggagaggttgatttctcctaaagtaagaaatgttatggaaaggagttgttctggtcttccatcttgatgacatatatatgcatgcataatggttttctacgcgcaatatatatgcatgagcatcgatcgccaataaaattgcatatcgttattcatctgatcaagtgttacttcctctgactcgagcaaatctgagttaaatgcatgcaaaaacaaatatacatgtataggagagggaaggttcctactctatatttgaccatgaccatgaggtgttgctaccaagtttcaaatcagtcatcagaaaggatcggagtgctagccaatctttgagcacaataatccccacatatccgcttctctctatgttgtactctttccaccaaactcacctagcaagtaatgccacctctattactgccctaggcaaataacttcaagcatttactagtaacatgctcatataattgggttgcactgacccatataattgggaatgggttgggagtatagatcgagcttaaagcaccgaattcaagcgtttcttttcttttttttctctcatcttgcgcatgtgcagtacggtcagagggaatggaaggagaacggctccactattatagtagtagagaaaatacaaagtggccggtcttgtggaatggcatcgggtgagtgtactctttgagatcctacttcacaatgcgcagtggttttgattaggcgtaaataatttagcatttcagctcacaaaatttggtaaaatgtgattttacagaaatacatgtgcaaaatagcccctagaaccataaaaaaatcatcaagatcctttgcccatttgccaaacatgtacttacatttatatctccctacctaccttttattccacatttgttgccaaccaccatcacaaagaaattgactaacacctacacccatggggacgacaaccactactcttccctctactagatccaaccaccgccacttcttcccctctatatctaatatcttcttattttgccatatctgcttttccaatcattggtgccattgcttccccctatattttcaaattccagcaaactaggccatcgatcttcttaggtcgtggcctaggcagtggatctaacaagggcgatgacggagggtggggggagggggaggggttgtgtggtctaggatgatgaagcggcctagtcgatggtgcttgtagtggaggcagtgtggcggacaagccaaaacaaaaacctcaagcacaaaagtacaattacatcttaaattatccgaatgtagtacaattagttcaaattaaattaagtcttaaattattaaaacacaatgcaaatagtccaaaataagtcttacatagcagaaacaatgcaatctaatgccgtttatcactacgacgctttttcatagcatagaagcgctccattacagcatcattactaatattcaagaaaatatctctctcaataaatgtgaccaaacaatcattcaagacttgattgcccatactatttttcaacttggtcttcacaagattcatggtagagaacaccctttcaacacttgctgtagccacctgtagttggtaataccagtttgagcaagtataccaatttatagagttcatgttttttagtttcaacaagcttcatagaagaaagggtgacgcaactgtcatcccacaccggaaatcctctcttccagcgcatagcccctgtccatctctccctcctccgagtcttctctcctcttaacaaatccctcttcctccgcttcctcctctaccttcccaagcctgagaaggtgggagaggttatggaagaagagttagagtactactacttggaaagcaaggagttgggagcaaacacgatagaggctgatccctatacgagaaggcgaaatcgacccaaccactgattaatcgagtttaattgccatatataggagctgactgaagaagacattattcaaggatggagagccctagccctgacacccaccaccggcgactgcgaccccctccatatactctggtaccaacaatctccataccatgcaaattccgtagtcgtgatctaaaacatcgacaatattattatagtttatctatgtgtgattaggtttgtatattattaataatcatatggatgcgtaaaataagatgttagtgataattgttgtttgcaacacgaaacactttctttaagggattaaaacaataaatgataataggagatgaccatcacaagcaaaaaaaaggttattttccatcatgtattaagttcttaatcaacatctcacataatgaactctagcagctacacgatacacagaattccccttcattgtccttttccatcaaccatataaaaaaattacttggaaactagaaagacaaaagaatataaaatagaagagcaaatttattcatatttgaagttatttacgtatagcatagcatatggctgttcataattgaatgaaataagtagctagcctaaaatgaagaacatatgctatgttgctgtcgtgcttgatgcctcctcatctaaatcgaactagtctttggccttctttcttatttgcgcatccatgcggttatgtgtcaaaatcttgttaaacttttattttcttgttacacatgaccctagacttggccttttatgaaatatgttttttaatcaaaatatgtttgtcctcaaaattgtgataagcttcgaggacatgtgtacttgataagtatatgttgactgtgtctaaattgatcaagtgccataccaagacatgaataaatggatgttgctcaaatgtacatgtgagtcatgcatggggttaattaatacatggacacacaaggaatggtgaggaatccttggtgtttgcgatgggtatacttgcaagcataggaagacatgtatttagtggtcttgttacgtgaaatattagacaatgttgtaggatgatgtggagctgataatggtgaatagtgtcgaagggcacacaaacaactatagcaaagtgaagaacaatggctaggatgttaactatatatgtagtatgtctaaaagtgctatactatcacgagcctaccgccatatcctcatgtgatgctccaacaaagtagattggtagataatgatttgttagcttctttcatgaatttccacaatatgtttatggcaatggcaaccgactaacacccctaagcaacatcacgcaaggaagattttgtgaagaaataactattgttccacatgagagagagatagatagagagagagagagctacctttaatgggtgtgcttattgttttgatatgctttattagggtatttaaggtgtatttgatactatatttaagttattgaccgagaaaccaccagactctaacttgaccctttatttgctatgtttagcataactcctatcttgaaaataatataataaggaaatttccggtaagctcaatcaattctcatcttataagctcttacattcctattcttgtattcttttttctcctcgaaccaaacttctatacgttgtactagttatttcatgatatttgtcatcaccacaaagtctatatatttatgcctcttcctcttatttccctccaactaaccttgttgcagttagtggtggttggccttcattcatgatatgcaataggtagtggtaggagaatgattatgaaccaacaactacaatgatcataaatttgatatcctccaaccacaatattaactatttaaacatctgatatgattattgactttagcatataatgcgactattggcaaagggtgacaacgtgttaatatatcatttgatctagctaggtttgcatcaacctagctcatttgttagaagggagcactgaagtgacatgatggctagacgaacatgttccaaatgggatgtatttaacacactactgcaaaagacaaaaagtcaaatgccataggaggagctcctcctacccatttgatgttcatattattcgctacggtgcaaaagctactccattataaatcaactagccttgctaaaaaaaattctacaacattatgcgtcagttaccatagcagactcacaatattgtaagcttgttgctacatggctctatgtggtactgctgatctgcattcaacatcttgcacttgcacttacttcacatgttttgcatcacttacaaccatagcagctccaacaagtatttttccatggatgcctagtgaactcacaaaggcttacgggctacgaggttagcgatgacaatgcccccctccccccgagtctagtagggctagaacctgacgagttatttttcaccctgggaatgcttagcatgctaagatcatcctcagttgagcccagtggagtgcgctccattcccattcaccaccagatagcccgttacaatatggcaagtgtgctaaaggacatagcacatatactaaacccatttaaccatcctgttcaccattagatggcccattagtaagataaaatttatatatactaagcccatttaatcatctaaattcatcctagatggcctgttaagatttggcaagttggcaccagcacatgcactaaggccttctttgtttaggtttaggtttattggcttagacttttaagttagcttattggcttatatgatttataagccgatggatttaatgtcccaagtttagtagtggagtaatacatctacctcacataagtcaaaaaagcttctccaacctagctttttgcatagtgttagagtggcttatggctttaaaaaagccaaatgaaaaagctgcttgtttgtttaggcttagacttttaggcttataagttgacttataaggccctctttgtttaggcttagacttttaagtcagcttattggcttatatgatttataagtcggtggattaatgtcctaagtttagtggcggagccatacatctacctcacataagccaaaaaagcttctctaatctagcttttggcttaatagtgttagagtggcttatggcttttaaaaagccaaatgaaaaggttgctcgtttgtttaggcttagatttttcggcttataagttaacttataagcctaaacaaagagggtctaagcctaaacaaagagggcctaagcctgctcaaaccctaatctcggtccagtccacaccatatattctcattatctctttctaggagggagtaagttcaatttagatcccttaatttgttgtcgggtcagaaatttgtcccaaaacctaaataccaggtatatccttcaactcacaataccgtgtcaactttagtcccccagcagtataatggccggttttggctgacgcggcgagtgacaccgacgtgggccccacatgttagccatgaagggtgtctgccatgagtgggagctcatggcgacgggcatgtaggcacggccgggctccttgtaccgctgccaaactccctgtgggtgcctgtggcacacgcactgctatcaccatcttgccgtcgccgccaagcaaccgctgctagagctgtcaaaaatgctcgaggctcgtgagctactcgagcttgatttgttatgagctcgattcgagctcggctcgtctaagaatcaaaccgagctcgagcttgactttaagctcacgagcctaccaacacgagctcgaataactcggcgagcctcaacatctggctcatgttctttctcctaggtatttcctccccttctctctctttcttactcggtcaaattctctagtagtactggagtagcacaactgcacaagtactggcagtgccagggcagagggagcactatgcatttgttgtcccatttcccaacaagagagtaggagtactagtgtgcggcttgcacagttgcattagtatacataggagcactagtattacttttaggccctgtttctttcagcttgggattattataatccagattattgggagtaagctgaaagaaacagacaacttattgaagtagcttattataatctggagcccagcttattataatctgataagctcatttaggtgagtttttttccagattattgggtgaaaaattacccaccatgccaccccactctctctttagacttgcaaacccaataatctaggaaagaaacaactaaccgcttattctactatagattataacagtctagcttatagtaatctgactcagtaatctagattataataatcccaagctgaaagaaacagggccttagccgtctaatcatgcatcacagtgtcagctttttctttgaatggaatgaattgttccagtattccaccgcaccaaacaggcttgagaaaagctcgaagctcgaacgagccgagctcgagctcaacttcaagctcgtggcaaacctagactcggctcgagctcgactcgagtctatagtgagttcgagcctacacatggaagctcgctcgagctcggctcgttgacagccctaaccgctgcccaacctcagttgtgagtcaccctgccgacgtcatccgttgtttgtcaccaaaccgaaccaccatgggcaaccaataggaagacgaagccggcgtcgctttcttccatctcaagccgccactaccgtgtcctcatcagcgaattccattgcaaccacctttcgctgcctataagagacaacgatgtctccattttcccccacaaccaaactcttagagctcttgtcttctctctctaccatgtctggccaccacgctgccgccggtcgatctccctcaccggagccccgttggccaaacctcgcgccaccaactccacctcgtcaaggtgaacccattcctccaccttttcctatcccttttctcacacattaagcccctaccaaagtcctctatctcctgacgcatcaccaccctgtcctgcatctcccttagctcggctgcctacgtcacggaccgcggtttgtcgtatagctcctccgcgcgtgacttgagcacgccatgacgcttttcgaggacggcaacaaccagcttgaagttgctctgctcggtggcggtgcgcatgaccaccatgtcctccgtggcctagacatggtgcagctcctactcgaccttcggtaacacgtcgtagttcacggggtccaccatgagagggacgatccccgtgtcgcctcccatgtggacggtctccatggtgaccatgctctgataggtgcagctcagcatgatcagggtggactccccgtgcacagtcggggcgcgcatgatgatgaggaagtccctccccttcaccactacagatcgtatgtgaccccctcctcaccgactaccctgctcgatgcttgagtatctgagaaatgggaagagacggaaaagggaaagggacagggagacgagttggctgctgacaagcccacttgggtcccactcatcacgtcagctaaaaacaactactttactgccgag

SEQ ID NO: 62473 - DNA, 5122 bp, Oryza sativa
ctcgctactggtctctcgccccgcgccgccgcgcggcaaccgtaatctcgcagggggggcgccgaggccgggctccttgccgccctcgccccgcgccgccggaacccgctccgccctctaggtctccttccgccgaggcgctcctgccaccccgaatcgaaggggggttacttctctcgggtgggtcttctcccgtggttgagacggcgtcgtcgtcgtcctccgttctactggaagtggcgcggatccggacctggattgatttccttccccgcggtaagagtaacgaaaccctagctctgcttttctagttctgttcgtttcgctgttctcgttgataggcaccaatcgcccttatccatcatatagatttgctcccggtagttgttttagggtttagcggaatcatctgtccctgccctagtttttttcagaacacgagacgtggttttgttctgataattcgatcctcccttagttttttttttttgggggggggggtcgtgcttagataaaatttgaaatctgttttcatggatatgtatatgagggcatgtggtttaggagaccagttgtgttcaaatgtctaatctatacccgctagtaggtcactggactgatatctagttttagctcattggctatgtatataagacatgtttgtttttatggtaacggtaagttctcttctttcgcttctgtcgctgagagagggagggagaggaaggatccaaaagccggtatccgttaccctgtttactaaatactaacacagcgttatttgtgtctaaatactgtgccaaagtgcagctggcagagcaagtttgttattgagtttagttaaatattgcagttatcttcggaagaggatcgatccgtaagcatttaatgtcctaacccgtcattttcttcctttccttgtcacttggcagccactgtattaggaaaaacttgtttcctctttttcgcatcacattttgatgtgctttgatggcaagtaatatgcaaccttctgggccaccgcaggtaaatgttgtctggttgttttaaggatggcagttttcagtgtgaagttttgatttttgtcgtgtgatgtgctaattttttaccattctttctctctttctctctctctcaagcagcaatctaggccccctatgatgggctctagtgtcccaccacaaaatctgggacctccgatgcctatgcaggtaaactggaagattgaattttccccttgtatccacagcatggaccattttaatcatattttacattcctaatatgtcatctcgttctctaatttcagtttaggccggtgattcatcagcaacaacctcctcagttcatgcaaccggggcagcagtttcgacctgttggtcaggccatgccaggagctaatattggcatgccaggtcagatgccacattttcagcaacctacacagcacttgcctcactctggtcaagttccacctgcatcacaagcagttcctatggcttatcagccagctagacctatgtcatctgggcctctgcagccgccagcgacattctctggaggccatatgcccaccatgggaggccctataccgcctccatcctatacggcaagtcctatttttccttgcactttgtggattctatttgttcatttgatatatgtatttaatttcacaaagctattgccggatcttgaatgccaccccttgccgataagttactgatactagtataggctacactgcagtatcaaccatcatctgttcctcctcccatagtgcaatcttggggtacagctccaggtcagaatgtacctcttgtgcagcctgggcatcagccgatgtcatcttccgctacaatgccttcagtaaatatcactgatctcttctgaatcagtttatttttctgtattaagtttactactgtgctttatcaaatatgacatccttaccttgcaataattgagtttgcaaatgaacagatcaattccagcgaaactagctcttcagactggcaagagcacacttcagctgatgggaaaaagtaagttgaatcattttacctacttaccttttgttattaactttctggtggtgctcagtatcttttgttgtgttgcaagttttcacctttattcttatttggttgctttctctatttctctcctttttaaggtactactataataagaagacaaggcaatcaagttgggagaaacctgctgagttgatgacaccgttggaggttagttgtgctgtgtgcttatgtgtcatctacacttacctttttgtagatatattcttcggttaccttaattttttatatgctaaacatgtcatgacttgttacatttcccttagggtgttctgtctatctcttaaaatttatggaatggtctgttctacttccatctactttacaatagtccatatcctaacacgcactacaaaactgcttactgactcatctccactttgaaaggaagtactaaacactcttcggttgtggtttcctaagcaactgtcatgttggtcacatacatggcatcttggtcttgttaagtttaagttgctaaattaattggtaatccatctaatagaaagaggagagatataggaggaatagtcaaagagagatttgtgtttatttttacatgaatttcctgaatatgtgcaatgacttcctttcatggcttatgggcttttgctgacttgtctgatatagccaccatttggattggtattgctactaccaattccaccatcaggttgtaaactgcactggattttaaagttgaggggcttattcaatttggaccatcttgaaagtctaaagggggtgaattggaattcatcactatattgactacttctatttccagaatgaactctttactctttccacgagaggacaatgcatgttcttagtttcttactgaaatgatgtatggaacgtttagcgtattacaacttcaactttatctttgattctgcatctttgctatgctaaaagttacgtgttcttaattatttattttttgatgtaacagagagctgatgcctctactgaatggaaagaatttactacacaagagggtcgaaagtaagttcttgatggaacacatgctatcacatctgtatgaagttaaacaaatcactttcttgccggttcttattattctgtcattccaggtactattacaataaggtgacaaagcaatccaaatggacgattccagatgagttaaaggtttcccagccttctttgatgtttgattttatatttgtttattgaatattgttgtatatctataaacaattttttcttcccttttagattgcgcgtgaattagcagagaaggcgtcaaatccacgccctgatcaagaaacggaaacaactgctggtgctccttctggacccacttcaaactctgtggaaccttcttctgtacctgctaaccagtcctccacaacgattatgggtgctccaagtacacttgatgcagcagcgaactctgttcctcctggtgctggcccttcgcacaatatggagaacacctccagttcatctaatactgccatgcaaaatggtggtccaagtaccgttgttactcctgttataagcacagaaattccatcagttgcaagtgatgcagggattagcaggtaactgtcgatggtttactcaatgcttcctcaccagtcaccacttaaatgttgctaatatagttgttatatgatttgttcagagccaataacgaatacccatctctagctagcactgctgacactcaaaatggagcatctgctgaagaattggaggtacatgtggtgtcctctcacagggttctagacttatagtttgagttcttaatatttgcaagtgtatgataattgagttatgacctcttctgcctggagctatgttgttgaatgatgggcaggggagagtagacactagagaaaatgggagttaggcgatagattagcttgtctttcattgatttcaaaactgtgccaaatcctcatgaaaagagatgagagaagcactaacagtcttatttaatctcaaatatttgaaagaaacaaaatcttatctgaacaagtaatctcgtgaaagaaactaaagatcccctaggatagctcaagctggtttggtgcttcaaaattaatgtgaaacatatgttctggtccttcaaaattactgtgaacttacgtctgataaatcctgtactctggtaacaccgatacttctatgggagtcaatagtcatttaagaacctaataaagtatgagattgtaagaaaaatgtaccacttattttctcatgccattgcttgtaattttaacaatgtaatctcaatatcatatcatctccatatttttcctgctttgaaatatgtgtatacttgctgtatccacatttttcaaaaatttcgtatccccgtattgccgtaacagtatcgtttatctgtgattcctaggattgattggatatattctacatgttaagtagcttaatagtctgagcattattcccacactggtgaattttcagttgaaaatatctattatcaccatcctgtgcaatattgccatgatacatgctacttcttacttggaacgtatgttagggtggacaattgtacaagaattgctgtaatacaaatcccaaggtgtgactcaattcggatggaagcaaacactgatttttttccttacatggatatgtatgctttgtttaatacgaaaagaaaatatgcaaaatttcacaaaactacagatactttgtccaaattatcgcaaaactattgatttaaggtgatatatatcacaaaactacagatttaacaataaatttatcacaaaactacaggtttaagactaagtatcgcaaaactacaggtttaataataaaattgtcacaaaactaaagattttatggtttaaatccttaatactaatgttatgtttgagttataaacgtccaagttttgtgattaaatatgcgctaaacttgtagttttgtgataactttgttactaaatctgtagttttgcaatactccaccttaaatctgtagttttgtgataaatttagtattaaatctatagttttacg

SEQ ID NO: 62474 - DNA, 2323 bp, Oryza sativa
ggaaagtgtaacagccaactcatgctcaagttaactcaagggcatgaagtcgatgagcaaaattcaagggtatgaaagggaatgagtgaaatctcaaggccatacaggaaattctctcatattatgacgttgatgtatcctcaaagcacctcccacattttcttaacaagtcccatcgtactataaagaataaagtatgtaataactatactagacagaaatcgctacatcaaattgatgatatatgctctaacaatattatgtcacatgatgtaaaatcaagcaagaatttcttgttctcatgccagataaaatattgcattgttgtaaaaaaacaaaggatcaactgctaacctcttcagttttaattttcagaggaaccgcaaaaaagtcagctgctgaatccatcggccatttaagctgtttgaagcatctctttgacctgaaattgtatagggttatgacaaaaaggtgacagataaagcattacctttttcctgaaattatagtacattagaacccactgaaaactaaagcaccataagtcaataacgaactattaagaacaacttaccaaaagtattcattcaggtcatcatagtttctccactttgagtggcttgtcctaccacgtttattcattgcagcttcctttcacatcaaatgaaaaataaataaatacagccagagaacatggggctacataggatataacatatcagcacatacctgcttcataacactgtagatgggttgaataacaagctgtagaaaggcatcatcactcccctctcgccgaaagggtggatcaaaatcttgtcttctatcagatatgatgtcatacaaatcccttgccatctaactcgtgaattagggtgaaaatgattaataaaagagttagtgtatgtttagtgcatatgcacggtattagtctagcggtctgtgtaagaaaaaatttataaaagaatagaaaagaaaaacatacatcattttatttgtcaaacaactggtgggaatgtcttattttgataatgttaagcttgtttatggggataatcactagtggcttgaaacggattaggtcattagggtattagaagggagaggtagacattgattgctatgagagaactagttgacacatagcaaatagaggcatgaagtatatttcttgattagctaatggtgattacatgctatccatttttgtaagggtgactcaactttgatcccaaggaaacaaacttgaacttattattccatttaactactgccagccataacattagcttctatgcgcactggcccagcggggccatgtccacaacttttatacacttcagtctttaaataggttctcttggagtttatgcccattcctaagcagcttacacatgttccatgaataaacacatgggtataattgtgttcttgtactgatggctctgaaatatgcaataaatgtaaagagttgatatatctgcaattgcatgtagcatcactttgcacaagatggcaaaagtttatatttcacattactcagaagtaagaagttaatttgtttttctcattactctagagtgacatggcatcataaccttaaggtttggatgaaaacgatacttctcgacacgatataatcagtttatacatagacaaattagactggcatgatacaaagagcagtacagaaaaaaaaatttcatatgcacgcagtattgaagcagagaagccaacatagctctaatgctctataaaccaacaatatttggcattaactgccttgtcagtattactgccaaaagtgcagttacaaaaaaaggaattgatcataacagattttcgataaaacagagtagagccacaagtgaatgaaaggatgtatcataaattgaatttacctcaaatataatagaaaaaaaatcacttacatgatggaagatataacaaatacattcaggcataaagcgaacattagaagcttcaccccagatcagcaaatacaaccctatgtaaagaatctcaggttgttgtgtggaggcatcgtttggaattctgcaatgtcaatattctcagttgacaaggttgcagattttgagcaccagatgtgcaatgatcattagtggtacttactttatgtttgactccaaatgtaaatatcggcaccaagaaatgtagttttcaaagattttcctcatcaaggatctaactgtatcactatgcatctgcgagccatactagaagttcatgaatcagtttaatattcttacatttatgcggactgagaatgatgtgtgaaaaggcaacaagctcactcaagatt

SEQ ID NO: 62475 - DNA, 1202 bp, Oryza sativa
agagttgttgatagaatacatgataggattgaagatagcataagacgtcagtcacttgtaaaagagttccgattggatgaacttcctcagctaagtgctaagtttgataagctgctaaatctattgttggtactgataacatacctttgtatcctattgactatatgttctctgtaccacattttctttcttctccaaaaaatgatcacttgcgtttgcagagaactgatgaagacattgaaccgataaagacacaaattgccaatttgttacaagatataatggaaatcatcacacaggatattatgaagaatggacaagggtaagatctatatttaagtgtgcatagtcaagagttcttttttttttgttttttcaccaatattttgccaatcatgcagtattttgaaggatgaaaacagaaacaatcaattgtttgcaaatataaatctggattcagtaaaagataaaacttggaaggagaaggttatatgtccatccaagcaacttatttcaatatgaatattcttttctaccataagtttacaagtactgatgtcctctcattatgaattgggattctgtgttaacagtgtgttaggcttcaactattattgacaacgaaagaatctgcaatatatgtacctacaaacttggatgctcgtcgcaggatcactttctttgcaaactcacttttcatgaaaatgccaaaggctccacaggtccgcagtatgatgtcctttaggtaagaaaccgaactctccctccacttctttcaccaaccagtgttgccgaatgtcttttgccttttactttttggcacataagtgctctccaatctccataattatttgccaaggtcaatgtagttttctttttgtgagggggtaaagtccatttttggcccttgaaatttttctcaaagtccattttttaccctgaacacaaaaccagttactttccacccccaattttcagaaccaagcatatagcaccctaaatcatatttcacagtcgttttgatcaagttgctagcatgaacttcaattaggtaagtttcatggttgtggacctaactaagtgacatttgcctatgcataataagggtatgaactacaaaaaccacctccattacaaataaaaccactaaaatatatgtcccgaagtgttctttgtccggttttgaaagttgacttgaaaaa

SEQ ID NO: 62476 - DNA, 714 bp, Oryza sativa
cctgcagccccggatgggaggaaaagaggggaggctgggagccggcggcggttggttttgatttttttttttttttggagtctctatgtgatacacggctgaaaaaaattgtagttacagcccaatttatagccatacgatgcgcgcacgtgtcgtcatcccactgctccgttgcctcttccacgcgccccttgcctttgttttgggtcggatcttgtttgcaggcctgtttgtcatcttcagaaaagcccagcaaaacaacacgctctatccgaacaagtttattggatctgggcttcaagcccgtttgttgtcaaaaatagaaaacaaaacgtataagttcacttgacgtccctctatttgtcacccagtccgaaattcatccgtgtaccgtaaaaccggatacagcgcatcccctaacttacaaaacagtacaaacaagttccctcggtagtattatgccaggttatggctgacctggcacctacgtagctcctttgactaggtcttcgccctccgtcgcattgacatgacgcttacgtggcaatttgatcctggaaaaataattaaagccatgggaccaacatgtcagtttcacatgcaaaataataaaaaatagtggggcccatgtgaccccacatatcatccacactactcttgcttttaataatttaattaatttatcaatagaccatgccattaaaaacatatacc

SEQ ID NO: 62477 - DNA, 4657 bp, Oryza sativa
aaactcaaatgtaaacaagaagataattataccattaggaatgactttttttcatctttctttcattgtcttgagggacgccaatgccgataccgtttcaccatatattcttcaaatgattgatgcggttacttgtagcttcaaatggtctcgcacggttcatcatgacaaagccgtcactcgcccttcaccaccggatttggttcttcggcgccgagccccttgcttgcccttcaccgccgcatggtccatcgtgaccaagcatcgcttgcccttcaccgtcttgccataatagccatttcgtatcacacatcttcaatatcttcactttgtcattcttggtattgttaggtgtaatgatatcacttgagcatcaacacctttgtaatccttgggacctatttctttcattaaactcaataaaattattagtcccaataatccggttgtcaacctccacatgttgaccaaccgatcgcatgtataaaaggatatgaataaatgatgagtattaatcaacaccacaggtgtcatatactcaaatatatgttcaaatgtaaagatctcaattaaatgaaggtgaataacttggatcgattacatgcataactaaagtataggatttgctccccctaactgtatgcatacaaaatatttgtgtgaagcaagagtatgcataacaagatattaaacattgagagcttatcctatacaagaatagagggcatttatcaaatatagacaataaaataaaaacataccttcatcatctccatgttctaaatgtaaagagactaaacaagatatggctcaaacaaaacattagtctcatatgcttatgtaatcacatggaaatattatatatgaatatatcaatatgtgcacggatagaaagagtgatacatatagcttgatctccatgcatttcatccttgtgatttaggtataccatcaatgaacgtttttctctcaactcatataaagtccagaaatcacctctcacatattccactttcatatccatatgagactagtagataaagaaatgcttataacaatgttagtctcatgtaattggattcgtcattaatcgtcaaaaccaaattaatggcacttgaactttcaaaaggaaccgtccatggtggcatcgggtgcatttagggatgctaaagtgcccaacattttagcctacaaaatattgatgggtataaaatggggtgggctaaatttctatttattttgaactaaaaatatatgagggatagatagggttgtgaaagaacccatgggcattgacccattatcacccccgtgcatcaaggggtgaagttgagctgcgccatcaacatcacggcgaggtgactccacaaactcctagtctccgacggctgcattgacacttgtggcatgttcaatagtggcacctactactataggagacaagcttgatccaatcggatctaggggagcttctcccagcggcgggaaaggtgggatggcgggggggagctagcaccaatggggcactgactagagtataccagcaatgtggccgcccacaatgaactaagggtcaacttggaggcataggctaaggcctaaggggcctaaggggactcagggtcaaagaactcagcgtcacaatagcatccgaggatggcaacaacccaacccacaagatgccatttgcttcacttgtgtatccccttgcactgttgtaaaaccaacaatcaattgccgatgaaaccacaaggcatggtaaccgccaagtaggacgatagcgagcctgttggaaagaagaagagagaggatagagtagtatagttgaaggaagaaataaaggtggtcaattccacatgggtccttgtcaatttccacatgggtcattgtggatgccacatagtatagtagtatggtataaaatcaggttgcaaaattgttgagatccaatttacaatggttttagggcctatttggtagacctctggctctagctccacctcttctgaagctggagcccatccaaacagtttcagctccatccaaaatagaagtggagctagctgaagtgttatcacaaaataaactagggaggtggagctgcgttttggctgcttcacaacacctaacttttgaaattaagagttctactccctctgtcccattttaagtgcaaccataattttccatgcccaactttaatcatccgtcttatttaaaaaaaattaaaaacataagtcacgcataaagtattattcatgttaattagaaaaaaatttaaataagatgaacgattaaaattggatatagaaacttatggttacacttaaaatgggacggatggagtaccaaataaccaaacagccaaacaggctcttactgtcgagggaataaatcagacccggccatagttgagggaatcaaaatatactctctcttttttttctctacaacagattgtaaagacatccaaagagggcagaagtcttcctccggcccaaacccactgactttctgagatgaagcccactcggcccaaataaagccccaaccagacaatccttcttcgagacggcgttgcgtcccaagcccaagagcggaagaaagaaaaagtcagccgcttttgactcgtttcctccgggtccgccgctactcctccgctccgctgcctgcctagcctagccttcgccgtcgccgccgccgccgccgccctcgccgttgattccgccgcccgccgcgtgatggacggggaggaggcgccgccgggagcgctcaacctggccgactacgcccccgccggggcccgcaccgtcgactgcttcaggcgcatccgcaagatcggcgagggcacctacgggtaagcgaaacttcccctcgatctccgccgctcgcgctatgaaatgtttcgtgcgaaatcgctgtctcccttgcggcgtggttgagccgcggtggagtgtagcggtgtagcctttgagatcgtagtggggggcgggatgttcgtctcacccccctagttagggctgtggttccacggaattgtgagaggtcgaattctcgtcaagtcaatgcacgctttgtgtcaattgttgctggctagtttgctcgcttcagaatgcgaggcgacatttttggtctagttgttttccctatatttagttactccttttcgtttgagctctagaaatatgtagtggttcgttggtttcggttaggtttcgttggttaatgttgcacgtggggcatttcatttacagctgattgctgaattcgctagttatttggcagatacgctgactaacctgcaacaatgagaagtaatttatccacggcggctagctagttgagattttcaccatgatgaaagaaagaggacacatgtttatgctcgctacaacactaaccaatataaatgattcgttcgaaacatcccgtctcttcacacggagtagcatatctttcttaacataggcctttgtcctgtacaaagcaggtttattaaaaattcacatctcatttgccgaagtacattaggaaaagataaagaatgttagagacatgtaattgatgggtgaattcgaatattgtcttgttaggtccaacgactttgcaatttcatccatattccataaggaaaaagaatccaagactgctctttcctgtgtgcagaagaaatgaggtttcgcttgattggcaacagtccagattatgccacactagtatggtttgcagtttgcagctcactgagtccaaaaataaatgacgcagttgcaatatttgtttcctttttattttccttaggaccaatatataataacaatacatattaaatatttaaatgtggtaccagtttttttatgaatttaccttcttcaccattggccaagctggcagtgcgctagttttacctctacatttatttatttttcctaacaatctcagtgaagtattcgaggctatggatattataactggagaaagagcagcacttaagaaaatcaaactggatgatggcaaagaaggggtaagctttatgatatccacaaagctatggctactctttctaatgagcaaccgtgttcattgaagaacattgcacttctctgatctgatccatacttttgtagtttccacgccaaatcttgcgtgagattaaactattaaaaaagctggatcacgagaacatcatcagattgaaagaaattgtagtatctcctggtaacaaatttcttctagcaatttcaagatgtctaagagtacagaaaactgcatattcccaccatgtgtaaatatttttcaggtacagcacatggagcaggaggatcaggtcagttactttattctttgtttcttgcattctccattgatgtgctaatgctgatatattttatttgttttgtttaataatttttcattctgctcaattttttcttcatattgatcaatgcacagaaatcattcataacctatgctaaaattctgcagatgattacatgtataggggagatatctatatggtttttgaatacatggatcatgatttgaagaaagttcttgcaccacagtaccccatcccaagtcaaggtactctggtatatgtagttcttctatcccatgtgttttaagcaggggcggagctagaacgaaatggagggggggt

SEQ ID NO: 62478 - DNA, 5232 bp, Oryza sativa
gaagtccgaacccttctattcagacttctcttcaaaatcctcacccgcatatctcgtcaagtagtcaaactcaaactcccaagttacactctctttctctaaattatccatctccctttgactcgtctccgaatattgttctcttccttgactcctttctattctcccaagaccgagtatcgacttcgaaattcaagtccagactccaaccctaaaaccttccaattaaatctctctgtaaaagtctagttaacctcccccataggttggattccttcttcctttttccggtccacctcttccttctcttccatcccgtctctctctgggtctcgacctatcaacctatctacctatcaatctatctatacatcgatctacctaacgatctatctatctatcgatccatctatctatctactatacctatctatctgtttatctatccatctgtctatccgttcctctacctatcaacctatctctctgtctatctatctatccttgaactccttcccaaatatttgtcccatggtacaagatttctttaaaccccccctctcaataatccttgagccaccaaatacaaatatatccctagaatatcaattctcgctttgaactccaacttcccatcgacatcgagaatcatgcctcatcgaaattccttcccatttccgaaagtatcaaattcgctctttgaatcccctccttggcttctccaaactttgttgagctcaaatatccaatttgaattcaatccagaaagtcgatcccttcctttgaatccttgccgaatattcgctccgactacaaaaatattcaattcccgttttgaatccttcttcgactcttccttattgttcctagagtccaagtatcaaggttaaattccctccaattcaaattgtctccacattcaatccatctaaaaaagtctattttgcctccctctgctttgtgggccgaattcctctccctcggcccatcactctctctcagtccgtttcctcctctctctccacgtgcgccgcgcgtgaccaccaagagagagcgccgtctctctcccctctctcggacgttctctctctcgttctctctcactctccctcgccgcgcccaaaccgctccccaccagcgccccgccgattcaaaccgccaccattcgattttcgccgccgcccgtcggtttcccgcgcgcgcgcgcgtggctaaccacgctcggtcggtcgccgcgctcagttgtcgccgcgtccgtccagacgccgcccgtgccctgttgccgcatgcccggccgctccaagccatgtgcgtccaactcccggaggcagagctctctctccctcctcctttctcccagaatggcatgggcagagccccctttcctccctcccctttttgcttttttccccgaccggcaccatcgacccccccctctgccgcccgtgactgccaagttcgccacccccaccttgaccacacgcgacattcgagctcccttgaccatctaagtcggttccccctcctaaaccgcctcttctccgcctataaaagccaagctgctccccgctcttcctctgttcttgccgccttgccgccaccaccttcctcgccgttgcgcatgccggaaagtcggcaagcgcgcggagccgaaggggacctccgggcgccgtcttcttcccctttcccggcccgaggccgaggagatcccaacgcggtagccccgttctccctccccgcctttcctcttcccctctagcttgcgtagtggctcggtagccctcccgaacgcgcgtggatgccgccccaagccccgccgccgcccggcatagccccgctgccattgccgtccgatcccggaggccgccgctcgtcaccggccctcctcggtactcctctgccccatccgatgccgggaatgcaccccttgaacaccggagatgctcccaccccgccgaatcgaactcccattgcaccggtggattttcccccttttctcgccgccggcgtgcgccgccgcgattcatcgtcgccgacctccctccggcgaatccgagccgttgggtcgctccctcttgactccatcgtcactccggtgtgctccccgaagaccaaatccgtcgcgcaaggcttcggtgaactcggccgccgtccgccatccatctcggcttcccctttcttcctcctcccgccggcccgcgtggctgccacgtaggcgccatgttggtgccaactcggctagaccgagtcaaaccggccagccccgctttccccctccgtgcgcgcggacgatggtgcgccatgcggctgcgtatgggcccgccgccgtttgtccacccggtgcaccgttcctaagccacgcgcacccgaaaccctagcgccgcaccccgcgtgcgccctccccaccgtgaacccaaccaccgccatgtgggtcccacgcggtggaccgcgtccacccgcgtcggcctctttctccccgcgccccctctctttggccgcccctcccgcgcccgcgccggcccattaggtctggccaagctgcataaacccctcgggccgcgcctaagccgcccgaggaagtctatatggcatccctccttcctttctttttcaagggatttaataaaccctttttcccctattccataaatcatttctctattccaaaatcccatgaatcattttccttggtctcgcacaccagtgacactcaataatattcttgagaatattatttctataaatttcaattaaacttccaaaatccatatctcccgatccgtaactccaattgaccccgttccacttccaataattccgtaaaattgagatctatttaatggcactattatttagtctaaataggatccttttcttggtcttttgtttaggtttttgattgtttgcgtatagattcgcgaagctctgtgaagaccctgagcaaggcaagccacctttgaacatcttgagcctatatttgaatttaattatattgcttgaaaaatattatgcattgataggattgcactcaatctgcttgccccgtctgcaaggcagattggcgggcctacctaacttgttgcatttgatccttccattgtgattgttatatcatgttcccttgtaaccatctagttgcgcctcgatattcgtgcactctgtgcgagtatcgacggtcgccttcaaacttaaaatttgagtaacttcttgggtaaatcttagtttacaaaaggattggaaaacccgacgcctgagtcggtgccttgtgaaagaaaatgagttttaaaaataaaactcgcgacacaaggccattcctgggcggaatgcatgtgtggtcgcatttaaggaccgattccttcggaattacatccgagcatacaatagtgcgaccacacgggtggaatgggacacccctggctgagtaaattgctaatcgggggagccttgatgccgagagacatgtggattcaacggggtggtgtcggggagaacccccgggcttcctggcatagtatggtctgggacctaacctgttgttggtctgggacccctctcgtcggcatatggcaaccctgtgtatgctctcgaaatgccttgtcatgaaagcccttaggtcaccagacgtggccattctgcacgggctgggtgattcgggttagtaatgtcgtgtgggtaaagtgtaacctctctgcagaggttaacaaactattcgaacagccgtgcccacggtcatgggcggatgtgaggtgattccttagcgtagtttttgttttaccctgttttatgaaaaggtgttaaggttagggaaacctaatgcttgggaagcaattagctgtccggaagacagcgggaccgggagtccctggaagtgattggtcgtttggggaccactattatcgggaagtttggaaaagttggtttggtttggaaaaaataaaccagatttgaaagatcttgataaataaatttgttacttctcaccccgaccgagctgagacttgtctcgctctagttgtggaaagcacacacttaaattgttgaaaatcttgaaaacaaaattgattgctaaattaaccagccttcccttgaagcttgcattaaccacctaagttcccatggcttgctgagtacgtaagtactcacccttgctctatataaatatagttctgccagctctgaagatgaagttgaagtgaagtaaagattagggtttgtcctagttccctgctgctgcctgtggtgttgggtgttagaccgttggttccgctgctgccgctgttgttggtgtttgcctcgtccgtgtcgtcggttgcattctcgggctgtctgagctgcaacctaagttaaggtaaataagtccactatttattttaaggattgcaatgattcatatttgtcaccgtgggtaccagcgctacatcctgggactggtactgagatcgcggtttcgtaggaagcggctcgcgctgtttttcctacgacacgctcctatcaggtgccgttgtacggcggtgctggattggggtgtgacacaggataagtaagccgaaccacacatacacgctagacgaaaagaagctaccagaacacatcaaggcgatgactcccgatgagaggaaatcttacatagcacaaaggcatcaggaaaaggtgctagatgtcgctatgtacatagctatggcgcttgaatctacgcaggacaaggagtgtgtttatgccccatatgcctttgagtaagttgtaatatgcactaagagtatatacatataatcatggctcgactaacaatttcgtttgcagtgaccatttgatagtctttcttctctatccaaagtacaatgaagtcaacgtcttggattctctcgataaagatagcaagacctatcaggaatttctaagaattatcgatctgtaagttatatattagcatgacgtgttttaatatatgacgaatgtaaattaattatatctacaaacagtgcatttaaaagaggtattatcagcgaggcggacaacgcaaaaactcaagagaacgcatattcgtcctcaataagtggccggtgggtacatatggatgccaaacagtgctacttaattttcataaatgcttgtgtgtttccatttaataacctaatataccttataattatttgatgttgaaagtgtcacaagcaaccggtgggaacaatactatgcggatattactgttgtgagttcctaagggttaatggg

SEQ ID NO: 62479 - DNA, 1958 bp, Oryza sativa
gacttaatattgatgagatatatatacatcatcgagtgatgcaagtcaactagtgtctattcgcttaattggtgactcatcagagcctgttcataacgggtactcccccgttctaaaatatagtaacatatgacttattcaagaactacgaatttagacatgctcggagtaataatagttattagtatcggtgcactgtacaatctacagtaaatggagaaagatatatcagggagaaagatatattgtcgttccaaaagctgacaccggtacttgctccgtattaattagtgtcagatcaagaaaaacgacactctactatactccctacgtttcataataaacgaatctatgaccatacgtgacatatttgatatattctagttctataagtctagagatatatacgttcagattcataatactaggatatgtcatatctgatactagttagttttcatagactgagggagtactggatgtgacacattatagtactgtctagattcgttgtactatgatatgttagatcaaattttaggttcattatttttttttgacggagacagtagattcttcccatgaacccatgaactggaatcaatatcaagtgcagttagttagtgactgcaagttaagcagtcatatccatttacagccgttggatcaaagttgatgaacggcagagagatatgccacgtcacaacctggctggcagagctaagtacatgccacagtgcgcaacaggactttatgtgcgtgctacagtaccctggccgaatctgagctgttcttatttgatctaacggtgaggcaacgactgctaaagttgcagtccctattacaactgcaggggatcctgatccgtaagaataaatctgaatataatgcacgtctagatacatcccttgggttaaactttatttttggcacaaagagtatcacttatgcacattgccactacaatcattgtccgtccgataagaaattaatggttccttttggcagatgtgtgggttctctgccataacactagatactgtatcattgattttcctcgacgtcacctcattttgttttcatgcggtccgtacgttgaaccgcatgaaaaaaatggagggaccagagccgggtcgtcgcccgcacaggaaaatcaattttcgtgtgcaggtcatttaacaggccgctcgaccttctcccctcctgacgctcgcgcgaggcggccgggagcggcagcgccctccccatgcccggatccggcggcggctgttgccccttgcccggatctggcggcggcggcagtcccccgtccggatttggcggcggtggcggtggggtgcccggatcttgggttagggtttccaattatttgaaattttatttttttttcggattttgattttcctgtgcgagcggcataagcggattttcgcgtgcgggtgcgccacccgcacgagaaaaacgtgattttttcagacggggcgttccagacaggcgtaaaaactgcacgcaaaaatcaaaataaccacacgcaaaaatagctattgtagtggtgagaggatggttatgattaatttgttggtccgacgggaaatggtccctggctgccgtgtgatactgcatatgtggcaagtggtgaaggaaatatttttaggcccgagcaaatttaaatatacctactatttgatacaagatttttaactttaaattaaattcaattgtgtatttgacggtgagccggacagctccttgtggtagccggacggtagctccgcccctatgtgtggcatattccaccaatagacactacaagaaactttaataccacaagatttatttctatggtataacaattttaaaattgttgtaatacataactattgccaagatgctgatgcaatgatttttttttctggcaaaaggctagttccgtggtggagttaactactcctacgcaa

SEQ ID NO: 62480 - DNA, 1324 bp, Oryza sativa
tcctgcagccctaggttaattggatccgtgctattgcaaaattgcctattgtgaaaaatgccattacaatttgtctattcgtagccgtgccattacaaaattagaactgtgccaccaccgtcacgttttccatgcatcttcttccttctccgtcttcttccttctttctcctcttgtatcgtgggcggcggggctgtggcgcgctgccgcgctggggatgtgggcacggccatggagcagccccggtgggatggtgccggtggggatgttgccgctgaggttgacgtagcggaggttggggtgcttcacgagtgacggtggtatggggcagagggcgagcgcggcagtggtgggctttgctggctcggcaacctcgggcggccctgccgccaccgacgaggaggtggccgggagtgggcgggcgggaggcgcgatggctccacctcctcttccaccgctttcctcctgcgcagatctagctgccactccgccctacatgtgcggatccggcggcggtgctgcggatctggcacgggcgatggtgggaggcgcggcgggtgagagggaggtgcggcggctccacctcctcctccactgcctttcttctgcgcggatctagccgccgctccgccccacgcgggcagatccgacaatgtcgcatcagatctagcgcgggtgacggtggaaggcgcggtggcgggcaacggttgtctcggtgctgccgccatcgaggcggtggccaggagcgggctggcgggaggcgtggctccgtcagctcgctgagcaccgacggcacgcgtgcggcgtcgtcggggaggtagaaaagggctagctcagtgatgctgccagactccttggagcagaagacggcgggctcccaggtgctgcaattggtcgatggctgcttgacagggtcgcccagctacgcggggcggcgaggacggaaagaaggaagaagaagcgagaagggcttggccggcatcggaggaggaaagaagacgggagaaagaaggaataagatggaaaagggaggagttggatggaaaatgtaacggtagtggcacggttctaattttgtaaaattttaatggcactgctacgaatagacgaattgtagtggtatttttctgaataggcaaatttgcaacatcatatatccaattaaccctttaaaaataggggaaagccataaagtgtatgtgtaaccaccacctaaactggaattcctgagtgatagtccatagtagcaccagtgaaattttttgtttccatccttggcttgacttttagaagatgtcatattcggctattcaagatattttca

SEQ ID NO: 62481 - DNA, 2619 bp, Oryza sativa
cattagacaattatactataagtttactttactgccattgggcctaaaatacatgaccagcccacacaggacttaacccacacaaaaaaaaaaaacagtagcatcacgattcacgagcaatggatcaaaaacaagatgaaatattgaagaaagatagagcggagcttctgcaagctcaggcagagctctggtgccacacttttggctatctcaaatccatagcactcaggtgcgccgtagagcttggcatccccaacgccatccaccgcaatggaggctctgcttcactgcccgagctgcttggcactctccctctcgcggcaaacaaacgatcatgcttgcctcgcctcatgagattcctagtctctttcggaatcttcaaagaagacatctcaagggagggaacaacaacaacaacaagcgtgtatcagctcacaccggtatctcgcctccttgttgatggtattggcatgaacagcaacactgagcacacatgccaatcaacctatgtgctcgtgtgcgtctcacagcttcaagtaggggcatctttgtgcttgggaattggctcacgagcagcgatgagaacaccccatttggaatggcgcatggcatggatttctgggatttcaccggccatgatgccgagtatagcatgctgttcaacaaagggatggcgtccgacagccacttcgtggtgaacatagtcatccatgagtgcgccgaggtgtttgtgggggtaaggtcgctagttgatgtcggtggtaggaatggcgcgatggcgaaggcaattgctgatgcctttccacacataaagtgctatgttttggacctccctcatgttatccatggcaccccaactgatggtattgttgagtttgttgcaggggacatgatgcactttgttccgtcagcagatgttgtgttactcaaggtactataatttttgaagtgatttttttaggtttgcactacacatttttcctgtttctctaaacaaaaatgcacaagagtacaaaagaaaatgattgttgaaactgagcttggtcaatgcggcctatagtggagtccaagctcatggcggtaggaccgtgcggccatgggtggaagccatagtcgctgaacagaaccagacgccatcgctcctaaagtccaaaggttgcaggagggagaggggatgaaaaagggagaggccgacaagtgggtctgatgccacattggatgccaacataggcttaaaaccactcgtggttagcaaaggttagggaatgttaaatatccggttttatctagttgaagggggtaaatcgtacctttgtaatagttggggtaacttaataggcatgataaaggtcaaaagctatatacggttgtgtcatgtcttttgttagaaaaaatgaaataatggacttgtcttaaaaacaccttgcaactacgtaaccgtatattttacacccatcaactaacagaagttcaaagcttccaaaatagtacatcgtaagagcagtacaacccggtttaatggtgctttcttagttttgaaattcaaatatgctttttacttgtatgacacctaattaaaaagatatgtaaaagtagttaaatgtaagtgaaacaaacatatttttggatgtcaaaattgtgaaaaccactataaaaaaggctgggttgtactgcacttatttggaccggttttggtaataagagggtgcaaaatgttcggttcccaagatgcttccttttctttatcacctacaacacatgcgcacttgcacatctaaagtttgtgtcagatgacttgtatcttcacttaaaaagatgtaataattcataggttgtttttcctctattcccctaaccatgcctccagaacaaaaaaaaaatgatgaattgacctaattttgtactttggttgtggatggcagtttgtactacatgattggagcgatgaggattgcgtaagaatcttgacacgatgcaaacaagctataactaacaaggaagaaggaggcaaagtgataattatagatacagtgattggatcaccatctcaacagatacttgaagctcaactttcaatggatatatgcatgatgacgttgacaacaggcaaagaacgagaagagagagattggcataagatattcttggaggcgggctttacacgatacaagattatgcccatcttaggggttagagcacttattgaggtttatccataacatattagatgaatatgtcataaaaacaactttgtatctcgaacaactacatgatcctctttgtattatgaatatgttctacgttgattactcttaaatgtgtgtgaactccttgtattgttctatgtatgccagttagttattactaatctcatgtctacactacaccggaccaggtcatttgtgacgggtccaaatccttatcttcgacgggtttgtccctttgtcatagattagtgatcactgatgacttaacctcacctgtgacggttgaaggtccgtcaatggtgagagacacctatgacgggttacaattagcaaccattagtggtgagagatatttctgatgagttataattagaacctgtcacagactatgtcacctcaagggctgcaggaa

SEQ ID NO: 62482 - DNA, 1117 bp, Oryza sativa
ttgagaactagaatgttcaaattccaattttctagcaacatcaccaaagacaatgaaactctaaacacttccagtgcaccaccttcacgaaaaacaagacacatcatgcggctccaactaacaaattagtggcaacacatcagtcatccacccctgcgattaatctccagtggcaacacatcatgcggcttcaagaagaacacaccccaattaaaaacttggcaccgataacttgcaagatctaaaatcaaatcacaagaatacaaacacatacatcagtacccatctgatgcatgacggtggaggcatcgacacgtagtgcccacaggaggaggtggacactgtggcagccgccgcttggggatggaggaggcggctagcccttggaggtggctgctcggtgatggaggaggagccggatccggtttcccctgacctggatctggcatcccctaacttgcccttggaggaggcggctagcccttggaggagccggatccggtgttggagaggccggatctggcatcccctatctcgccgacgttcccgccgggcctcggcaccttgctcagcttgacgatggacttgacgaattgcgtgaagaaagcggccttgtcctgtgtgaaccgcctgacgaggtggctgcagcggccgctggatctcgcccttcctcgtctgtcggatctcgccacgccgacgctcggggatgagacgctgacgcccggccacatctagccacatctggccggcgcccggcggcatctagccgcatcggcgcccagtggcttggatcccggcgcacggaagaagggagaaagagggaggggcggaagaagggagagcgcgggtggaggcggaagaaaaaagaagaagaccgatgggcgtgggttcggagctgggaggagaggggagggttatgagagcgattttttttatcatctttgacgggcacacaaatatttggcccatcacaggtgactttacctcacatctgacgggttcctttttggcccgtgtcacaggtgaccttttttttttcggggaaatgggaataaattactcaggaataatattgtttcttacaagatatgaaatagaaacacgactagagaggtcc

SEQ ID NO: 62483 - DNA, 1450 bp, Oryza sativa
cctgcagccccgcagttgtgcgtcattgttagacataataaaaaaaagagaaagtaaaaaagaaggaacaaaggagagaactcacagggcagccgctgaccaaacagagcgctcatcgccattgatgtggtgttttgtggctaggacatcatgtctagaggcctcgagtgccaggaccagggtgaacttttctcagaactactctctcacaaaatcaatactaataggtctcactgcctcttctaaaggtggttacccaaaagtcatgaatccatcatggataagcagtcctaaacccatagaaaatcaacacggtattgcaacggcgatagctaattcgcgtgtgtgttgcggcgtgcgttttaggcccataaggcccacagcgctagtgcgtgcggatggcgtccacgtccatattttttttcacggaaaagctaacgtacgcgtttttcccgtttctttttcccctttttcagcgattttttatttagaagttgaatctttcatctctaatttctgctgaaagttttgaatttgagttgaaagtttttaagatttgagtcgaaagtttttaagttttgagatgaaagttttcaaatttgagttgaacgtttttgaatctgagatgaaagtttttaattctgagttgagatttttcaactctttagttgaaagtttttaagatttgagatgaaagtttttcaaatttgagttgaatgtttttgtatctaatacgaaagattttaaatctaagttgaaagttttcaaatctttagttgacagttttcaaatctttagttgaaagtttttaaatttgagttgaaagtttttaaatcttgacttgaattttttcaaatcggacttgaaaattatcaaaatcaagatttggaagcttcaaaatatgagttgaaaatttttaaatttaagttgaaagtattcaaatcttgacttgaaaatttttaaatatgagggtttcaatctagacttgatagttttcaaatcttagttaaaatgtttccaaatcttgaataaatctgattcgaaagtttgtttcaatcaactaaacaaagggaagaaacagacacatgatgaattcttattgaaaaaaaagaaacaagaaaaaacagcgctaagtgctattagtggaaaaaagacgctaagtgctcttagggctgcgaatgtgagcgccgcgtccgttcctagcgcttaagcgccgaacaggaaccccgtagtgcaacatggataagtagtgcgttagctcacctattggggaagtcaacacacagtttgtataggtctgtgaaaattgtattacacaaatggtggcttcacatggcctatttttataggcagacctttttagtggccatctagaaaatcaatttttacatgtcagattaaaccacctgtgaatttttctagcccacctgtgaaaatagatacctcacat

SEQ ID NO: 62484 - DNA, 740 bp, Oryza sativa
gtgccattgcgttgttcttatcaatttttgctttgttgagttctgcgttacatcgtcgaatcgagttgctggtcttagcgtctagtccgtttagagttttgagttctagtcatgttttgttccacaatcgtcgccgccatcatgtctctattgtcgtcgggacctaagaaaacggaatcggcttgctgccacggttctatttttgtagttttcagaagttttttgtcggtcagttttggagttgcatctaggttttgcttaagtttctggtttgcccgtgaatagatcggccgtgcttgttgccggcgtagagaggaggaggaagaatttccaaatctgtttttggaagtacgagagtttaatttggaaagaaatagtagatcagattgattgaaaatcagtttctctttttcctagtggtgccgtatccatccacacgtcgcccaccaccaccgtgaggagtccgaccccctccctctcctctcggtttcggtttcggtttcaatgcataccgtgagttgctagacaccttggtgaatttttgtttggtgtcagtttcgtgatctgtttggaaaaacggaaccagtataaatttagcattccattttttgtataattttaattttcggtttggaacttttccatttgacttcctgtaatttttttatttatatttgagtccctgtaatcgtgcattgaggtccttgagttgtttttgcagaaaaaaaagaaagtaagaa

SEQ ID NO: 62485 - DNA, 12341 bp, Oryza sativa
  unsure (1)..(12341): unsure at all n locations
gatcgaactcttctacatcgtcaagggcaacatcctgaccctcggaatggctacggtttgttttgtatcgactactcttgcatgttgggcatctgtccaaatcctcgtactctttatggaacaggatacagtggttaacacacgcgtgtatctttcgcacacccaatgacaacgggcatataagcttcttcgcttcataggtgcttgttggcagggagttgggttgcggaaaaagtttcttcaatagaaccaacatgtcgttaaaactactgtcggaccaaccgtttctggccttcaatctcataagctcaagcaccgttcgcaacaatgtgaaatccttctcgcagccctttgcctcattgtacaaaagatcctttgctgcctttttcaatgcatcaaagttatccaacccatgagcggacccagcaacaacctcaggttcagcatgacacaacatctcttccaaatctgcaaaattaccatcatctacgctgacattaccatcatcggcatcatcaactgtaccatgctgaccattgtcaccaaaaacatcatcatcatcaacgggttctattgcatgcacttcttcttcttcttcttcttcagctactacaatgacatcctcgtcccagctcaacacttcatcgcgtactgtaacctggttcggaacttgcttgcttgggatctctccatgatgtgaccaatttatgtagcgttcaataaatccatgcgtcattgttggtatttcttaacgacattactagaaatataattcccagcaatggcgtagaaatacttttggtatattatggttaagagttcatccgcaagcgcacatatataccattgtagcatttcacattctagttaaccgatatactagctaataccctctattcgatgccctcctggtacttcgagaagccactcctgactgccgagttccttacgacaacccgtcatgaatacggaggaataccctccttagggaattaacttaggattatatactggcgcggaggaatacccgtactgagctgtcaccatcagcggcccacctcttatccgcaatatataaccccaaataatgatatcccataatctagacaccacgcctaaactaccagatactgctctaatatcatcgtcatgacatagagtaattgcatatgcaaacattatacccgcaccaaagcatctcctagataagctagccgtacagtataacatgaacataatgtaaagtaggcattcatatactcggaaagtataccataaatgtataaagaagagtattccaataaaagtacaacgcttacaaaagaggaaaggaaagctactagagccatacccgaactcttccaaaggcttccggactcctgatttctactattcctattccaccagctagatactactaaactaaacttgagagaaatgagagagctcttgcttgaggtgtgtgaatgaagtgagaagaggagctccttaaataggctgccaatgacggttgtggcagttggaatggtcggaattgccctccaaccatcattggggagtgatccacgccgtccagccaaaacctagatccaacggtgccaggggaggttcgaccaaaccaggggccggcccatcctagcccatattcgacaggtggactcctttgttgttctcctccgtagacttgtgaattttggcccagtgtgtcgtgtcaattctgagttcttggcccattcatgcataagtctaactctcgacatcatccgattgatttatcgtctgtgttgatgtcgattctcctccactttattgtcattctctgcaaaaggttagtagacctaatactagtggaatattattattctaacagatatatgcgttgcaagcatggctagttctcctctattttggtaatattgacggccgaaactgatcaataacgaccgtcaacagtcaccaagtgttgctcgattacagatggatccttccaaattttctgatttttgcagtgcgcgcatggacatccatgccctgtccgccatctatgcattaattaattaattacggaaaaaataatacaactttagttagtttaaatattttgaacacgataattaaagctagccaaaaatctgcatatataaagcatacaacttgaagaattaccaaactacccttctttctcttcttctcttcctagctagctcattcttttgcagttaactaatatataaatctgctaaacataaacctatcaaaaactagatatgtatatggaacatcgatcatgcacaatatttcttgcaaagtttgcccattttgagctccaaataacaaataaaaaatgtttttcttcctccatgtcaagtactttttgcgatgaaaaatctcaacatacaaccaataaaaatgaaaaaaaaacttgacaaaaagagtaggagaaagtataactaacctctggtacaataaatctttcaaaagattcaagatcaaaaccttcccccctatgtatgtgttcttaagagagagaaaatcgtgctcctaatggtgctcgaagttactgtagctgggtgatatagttcagcgcattttccctggcggtcgtcatatgtcggttcgtttgaatcgccattgaaaatgattagaggtggcggacggtttagatggccgccagcgaagataccataccttcgttggcgtcagcttaagagggccgacagagaagatatcctatcttcgctggcggccttcttaaatagatcgctagcgaagatatgtttctgctggaggcccttgacccccccaccccacaattttctgcactggcggtttttccacatagccaccatgaaaaatattttccaaacgccatgaaaaatcgattttctagtagtgtacatgcctcttttccgtttggtgaacaggtaatgcaccatgtccaaacagtgtcagcaaatggatggccgctaaatccaccaatcagttggcggcacagacggcagcttgtgataattagataagatagagttaatattgatgtgacatacatcattgagagaatgattcatcagagcttgttcataacgggtacttcctccgtcctaaaatatagtaacctatgacttattctaggattatgaatctggatatgaacctatgactcattcggactatgaatctggacatagtgcatgcatgttcagattcgtagtgctacgatgggacggaagcagtagctagctattagtattggtgcactgtacaatcagcagtaatagggagaaagatatatcgttgtctttccaaaattaattatgcgctagttagatatagagaaaaggttaatgcaacatggggaatggtgactttcgcataagagggtggagccactgtagtggactagtggccccttcttcacatttttgttaaaaataaaaggatttactttctgttattctattaatatccccatctattcgtcactactacacatgagattttccttgacgctggccccggtaacttccaagcgggccgtaagtggctccgcctggaacaagccgaaggccggcgccgggcttagggccgcacaggataatgcattatcccgtgcagcccacgtaaaccgaccgcttgcgatggtcgggaggctacagaagcccccagcccgaccattgtcatgataatccgacggttttctctctcctaaacatacacaaattaggggagaaaggttttagatctgaaatctttgattgggttacatataaaaggtgtagagcttgttctcctccttcatttgcttcttttttgtcagttttcatcagtgcaatgcaaagaaacttgcacttttataaatggaatagtgtaggcagttgacggagcgtggggctcctcaccgggagaccgcgcaggcccccctttgccggttcggccgggggcgctaagtgaggttcttcgccctcgatctgaggaacgtcagcgagaaaggaaatgcgcaagacacgggcgacgtagacaggttcgggccgctgagaagcgtaacaccctactcctgtgttctggtggatctgtgtgtgaaggaatccagagggcggagagcgagagagagttcaggctctaggaaccattcgccagagtcccaactccccctcctttctttcccccccccttctcttttcttaggcctgggcctcctttttatctggtcaggcgtcaccacatgggcctctagctgcctaagaagggaaacatgctttttacaatcagggctaatctacagccggaaatgacttctgacaagcagagcgcacgtctcctgccccgctcgcccgcttttcccggtggacgcccatttcaaccttcatttaatggccagcgacttccttgccatacttgcgctgaagcctggaacgaatctgaccgggactgacataccaactcctggagttggcacgccggctctggctagggacgagagccaggaagctctcatcattccgacgggacggggcgaggcgtgtgacaggccgcctgttgccacctaacccgcgatctgaccggtctgtgaccggtcactcaccgcgaccggtcacggaccggataagcgtgcgctgcgccgcattaaatgtggcgtggcgcgctcgtccaacctgccataaatgcggttaggtgagcccngtgggctcacctaacccacacacgtggcgccaaaaccacagggggtcggggcgccccagccctcggggcaggaacgggagcggcccgacccctcgggcagacagagggaggggtggccacgtcaccttcgggcccgacccccccgaggggtcaggcaacgtgggtgaccgcggctacccaagcctctagtcacgatacccccggccccatgtcaccgacagtagcccccggcgttacgccagggcgatcgcccccctcgagggaagcgctcgggcatgatgccactccttaggcccggtgacaggtggggccggtccctacaggcgggcagaaacccagcggtcgcaaatcgcgagcatcggcaagggaaaaccgaccgacaataatgagcggcctctttaagaccgctacattactcgagcagcgcgcgaatcgggacgagccggtttgtttcgcctggagacatgatgacggcgcatttcacggttggcgggcgtagttaatgcgcgcacgatctgccccatctcgactgccacggccgcacatctgccgcgtgcgccgcaaacgggcgagcggggttagtggaggcgtgggcgcgagaaacgagggggcgaggtagtgggcgcgggaatcgaggagccgggcatagcgttggcaagggtgtaaagacgccgagggagggattcgtttctttcctctcgccactcttttccttgccttcgccacttgtgctctaactcttcgtttccggtgccctacccttgccgcactcgctcgctctcaagctcctcctccgccggcgtcatggcacggggctccgcaccgctcgacggtagcgtgctgccgccttcccgcatcgtgagcgagaggcaggccgggctgccgcgccgattcatgccggaatctgccaccggccgggaggtggtcgcgctgggcgagggacgcccggcgccacactacccggggcggtccgtcttcttcctctctttcgcaatggcggggctggtcccgccattctctatttttttcatggatattctggagttttatgatctccagatggcgcacctcacccccaacgcgataatgacgttggccatcttcgcacacctgtgcgagatgtttatcggggtgcgtccatctctccggctgttccggtggttcttcaccgtacagccggtgtcgccgccgacggtagtcggtggctgctacttccagccgcgggggcaggtgctgaaccgctacattccctgcgtcctccgtaaaaagtgggacgactggaagagcgattggttctacacccccctcgccgacgaagcgtgcctccgacttccgagccagcccccggcgcaggcctccagctagcgggcgacggtagatctgggagacggctacgacgccgttcttgaccgcctggcgggtctgcgatcccatgggctcacgggggccatggtgttcggcgactaccttcatcgccggatcgcgccgctccagcggcgcgcccggggcgcctgggagtacaccgggcccgaggactacatgaggacccaccaggggcgcaaatgggactgggaccctgaggacttcaggatggtggtccaacgggtgctgaatctcagctccgtggaggcatccctcatcccccaaggggtcctccccctctgctgcgatccagagcgcgccaagatcctgaccatcatacaggtggtcggggtgtcgggggagcgggccccccgaggccacgatggcgcgggcgggagccgcaggggggaacaatctaccccgggagggggtcgtgcttctgggccccgcgacgggggcccggggggcaaccgccctaccgacacccgggggaagaggaagcaggagggtactcctcccccatctcctccccgagggggcggggcgatgcgtgccagcagcaggcgcccggagggtgccgtgccgacgccgcagcccgagggggagcgaaagaagaaacggctccgcaagatgggggggatcgtaccatgccgggggaacctcatctcgcccccaaggtggtcgtttagccgacctccccgcaggttcgtccccgcgcccaccgcggccgtattcattctcccatctcccaaggcgagttttcactcacccgtttctttttgtcttctggtttttcttctgcctcagcgagatcccgtcgcgcccccccccctcccccccgccattccaagtccggccggtctgaggccgaggagacggcgactgcggaggcccggaggcgggaagctgaccggcgagaagccgcggaccgcctccgggaagccgaggaggctgcccaggaggccgtccgggttcgccaggctgaggaggtcgctcgggagcaggccagactccgccgggccggggagtccgtccgggtggcagaggcggcgcgcgcacgccaggcggcctgccaaacccccgactcgactccgcccgaggcgacgacgacttcagaggccacccatgacgaggccgcgggcgcgccgctcgggcccgacccctcgggcgacgcttgggacgagccaggttcggggggcgcccccgagtccggcacgtcgatcggcgggtcgagccgcgcggcacccacaccatgggggctctcccctcggccttccgctgccccactgagcgcggagcccttcctgcaggccttggccgccgcgaacagcacggtgctggacgagttaagtgcccagatggaggccctgcaggcggagcgggcggagctcgacgcggcgtgggcgcgcgtcgaggaggggcggcgctcggtggaggccatggtggaggcgggtcgcaaggcacaccgccggcatgcctcacagctcgaggcccgtcgtagggacctggcggagatcgccagggaggtggaggaggagcgggagactgccctcatcgccaccgccgtgctcgacgaggcgcggagcgacctccgcctccaatacgggagccgggcggcggagctggaggagaagctcgacgccgcccggggagtccttgacgccgccgctgcccgggaacggcgggcggcggagaacgaggcggcgtcccggcggcgtgaagaggcccttgaggctcgctccacggcgttgaaggagcgcgcccgcgccctggacgcgaaggagagagacctggcggaccgcgaggccgccgtcgccacccgggaggcaacactggcggcgcacgaggccgcctgtgccgaagaggagtccgcactccgcttccgcgaggacgcgctcaccgagcgggggcgagctctcgaggaggccgaggctgcggcgcagcggctggcggacagcctgttcctccgcgaggcagcgcgggaggagcaggcgcgccgcaatctggaaggcgcccgcgccgagagggccgcactggatcagcgggccgctgagctcgaggcgcgggcgaaggaactggacgggagagcgcgcagcggcggggcggccgcgggccacggcgacctagtcgcccgcctcgcagccgccgaacacaccatcgccgagctgcagggcgcgctggactcgtccgccggggaggtcgaggccctccgcttggcgagcgaagtagggcccggcatgcttcgggacgccgtctcccgtctagaccgcaccgggcggcaggcgggcctctggggcgggcggcacgcaaagtacgccgccaaccaggggggcctcgcccagcgcctctcagagatcaccggggccctcgagcggctccccgaggagctcgaggagacgatcaagtcatcctcgagggacctcgcccggggggcggtggagcttgtactggcaagctaccaggccagggaccctgacttctccccgtgggcagtgctggaagagttccctccaggaaccgaggacagcgcacgcgcgcaggtccgggacgccgccgaccacatcgtccacagcttcgagggtatggcccctcggctcgcgttcgcgctcgactccgatgaggagggcggtgacgacggtgcggacgacagcgacgatgaggccgacgccccgggcgcgtcggagtgagccctcaggcccccgccaatcttaataacttttgcttcttcttccgaggccttcgggcccccttcttgtataaactgatttaatctgtaatcaagtaaagaggaaatttctgcatcagctctgtttggtgtgtgtatgagacgaggatggtctgtgccacggtccttctgtgtcttggcttgaacaagggctcgtgcccaggtcccagcctcaaacggcgcgggtcggggctagtgcctggggagatccacgtgtcgagactggccaggccgggagcgcggtgaccgagggttatggatgacccgattgtgagcctttgccgattcccccccggagttcaccgcgccccggggcacggctcggttctgggccccgtttggcgattttagccggcccgggccaccaagggcagggtcgagcacgggcgtgctaattcaagccaagattcttcaaaaggaaacgatggcacagacacagtcctcaggaaatcgaaaatgcttttattgagatacggaagagaaaaaaggtaagtatatgcatgtggtagcccccggccaaccctgcacgcccgggggggtgcggggttggcccaagcccgaggcatgacacccgaccccgactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttagacgcggcgtaggacgaggtcgtcgacgcagagtgatcgggcccggacgtggcgctgatggtagcgccgcaggctctgctggtagcgcgcggctcggagggccgcgcgccgccttcgctcttccaaatagtcgaggtcgtctcggcgaagctgatcttgatcagcctcgcaatacatggtgacccgaggggacctcagggtgagctcagatgggaggaccgcctccgcgccgtagacgaggaagaaaggcgtttccccggttgctcggcttggcgtggttcggttcgcccagagcaccgcaggcagctcctcgatccacgagtcgccgtccttcttgaggatgttgaaggtcttggttttgaggcccttgaggatttccgcgttggcgggctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccacccggggcccgcctgaatggacccaggatatcgagcccccagagagcaaatggccacgaaagaggtatggtctgcagggcctgggccggctgatgggtttgcctggcgtggaactggcacgccctgcaccgccggaccaggtcgaccgcatcgttgagagccgtcggccaatagaaaccctagcgaaaggccttgccaaccaaggtgcgtgaggcggagtgggctccgcactcgccttcatggacatcggcgagaagctcgacgccttgttcccgaggaatgcacttcaggacgactccgttagccgcacgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggagctgggagcgctcccctcgggtcccgaggcctggactccgacgggcctcgggggccgttcaggcgcgtccgtctcccctagggggtcgggtcgcgccgacggctgggcgagcctttcttcaaaggcgcccggtggggtctgggctcgcgaggaagcgagccttgagagttcgtcggcgaccgcgttatcccgtctgggcacgtgccgaagttctatcccgtcgaagtggcgctccatacgccgcacctggcgcacgtaagcgttcatctgcgggtcagagcaccggtactccttacagacctggttaacgaccaactaggagtcgcctaacaccaggagacggcggatccctagtccagctgccactctgagtcccgcaaggagtcccttgtactccgccatattgttggtcgcccgaaagtcgaggcagaccaggtatctgaggacgtctccgctcggcgaggtcaacgtgacccccgcaccagcgccctgaagagacagggagccgtcgaactgcatcacccagtaggcggtgtgaggcagctgcgaggggcccgagctggcctcgagggcggagacgggctcgggagctggggtccactccgccacaaagtcggcgagggcctggctcttgatcgcgtggcgtggttcaaagcgcaaatcgaattcagagagttcgattgcccatttcaccacccgtccagtaccctctcggttatgcaagatttggccgagggggtaagatgtaaccaccgtgacccgatgcgcctggaaataatggcgcaacttcctcgaagccatcagaatagcgtaaagcatcttctgggcctgagggtatcgggtcctggcgtcccggagggcctcactaacgaagtagacgggccgctgcacctttcggcggggccgatcctcttcgccaggggccgtatctccagggcgctcttcgtccgagaggccacgcggggcgcactcggcttctgtgccgacgacctcggggtcagagggcgacaggcgcggccttcgcgcagtggccccggggccatcctgggggtcgggggcgcctggcaccgtcggacaagcaggcggagggccagctccggccgtcgggggccttgggccaccgttcggctcgggggcctctcctccctgctctctcccgggtcgagtcgatgcagggtggggatgcgcggagtgagggttgtcctcgtcgcgctccacgaccaacgccgcgctaaccacctgcggggttgccaccgggtagagtagcaacggctcatctggctccggggcgaccaggactgggggagaactgaggtacgccttcaactgagtgaaggcccgctcagcctcctccgtccaggtaaaaggcccggagcgtttgaggagcttaaacaggggcagtgccttctctcccagcctcgatatgaaccgacttagggcggccatgcagccggtgacgcactgcacatccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaa

SEQ ID NO: 62486 - DNA, 1050 bp, Oryza sativa
agagggatccatgatagagggataaacaaccgaggaggtcgttgtgtgttgcattgattacctaaaagatgggaaagcaattggtttaccggtacctcgacatgaaggtagattatctgggaaaggaacaagaggaaaaaaagaatccacgacaatgactacaaaaaagtgaaagatgctcatttcactgtgctgcagcaactcgcaatagtggagccgtacatggagcaacacctgcaggaattacaagcaacaaatgtggggcgatctaatgcatggatcatgaagaaacacaagcatcactttactaaatggttcaagaacctctatctaccagatggccataccatggaagaaagaacaattaaaatgctggccgacgggccatcaagtgtgtataccttgtggcaagcatatgatctgaatggatacacgttttacacaaaagcgaaagacaaaaggagtgcatgccaaaacaatggcgttcgagtagaagcaatcgacacaactgggcaaaagagcacatactatggattcgaagatgaaatctgcgaactagactacgggccaaatatgcagattccactgtttcggtgccgatgggtgaaacacccagccggcgtgtttgtggacaactttgggctgacaattgttgacttcgacaacgtaggccacaaggatgacccatgggtgcttgccgatcgggtcgctcaagttttctatgtgacagacccatctcatttgaagaaagacatagttatttcgagaaaacaaaggattttgcaagttgatgatgtcgaagatgtcgaggcatacaatcaatatgagaacatgacattattcacagattttcgaaacaagatattacgcgtcgaagaatcaattggggaatcgctgaagccatacttgagaaatgaaggtgtagggaaaaatgttagatgctaatttattatgtatatcatattggacgtatcgatgaatttatttgtattataatgcgtgacaatgatagatgatgaatttttgtatatggatatatatggtgacatg

SEQ ID NO: 62487 - DNA, 2869 bp, Oryza sativa
ccatcggcaccgccagatccagctcccaccgtcattctctccgccaccgccgggtcctcgtcgtcgacgctgcctccacctcggccagccgtctccacctcaggagtcatcaccgccgccgggtcctcgtcgtccatgccgcctctaccttggccggccgcctcaacctcgggagtcgccgccgccgggtcctcgttgtccacgccgtctccacctcggccggccgcctcgacctcgggagtcgctgccgccgggtcctcgtcgtccacgccgtccccccgccaccgccaggatgccgccgccgcgcagggacacgtcgtcgccgcctcctttcaccaaggtgagcccacgccctccgcctcccctcttctatcttctctctgattaaccccatcttctcctcctcagccgcgccgggactcgttgttgtgccaggaccgtcttcaccgccgccgggacctcctccccgccgactcttcctcctctcggctgccgcgccaagaccatcgttgccaccgccgggacctcctctctgcctcttcctcctctcaactgccgcatcaggaatcgccgccgctgcctacgctactcgccgggcagccgaagccatcgtcacacgcctccaggtacatccccctcctctgcgcatcctacctatgctggaaatgctgatgaatgctgagaattgatgaatggtgatgaaaattgatgaatgatgaatgactgaattgagatgaattttgggtgaatgcaaattggttggggggtttgcaggggatttgcaatgtggcagatggcactgcaattgaatggttgcaaatgtgatttaaaaacatgaatgtatagatgatttaaaacttgaatgttgcaaatggttgagatcaattttggatgaatgcaaattggttggtaaaatttgggggaatgcagaaatatttggggggtttgcaatatgtggcagaaggcattttggatgaactttataatttatagttacagcagtagttaatggaattttggacgaacttttggatgaaattttggatggaattcttaaatgaaaccgcatatatatataattgtaacctttttttttcaaataagttcagaatgttgcaaatgtgatttaaaacttgctattttgacatgcatactgctttatatgttgttatgttcccttttgaatcagaagtgattggttgatggatggatgaattgatgaaatgatatatttttttcaccccatttcgtaatctgtaattgatatatattgatgaaatgatatatatgtgagatgtagttgggacttagggattattgagatgtcatatctatagctagcccaattcaaaattttggatgaacttttggatggaattatgaactgaaactgcatatgaaattttgctattttttgtcatataagttcagattgtagctagtttgaaacttgtggattgttgctatttttttttcatataagttcagattgtgcaatatgaattggttgatggatggatgaatttggatagattttatttgctgttttgtttgactgatgcactgaaactgcatatatatcatcgtgctcttttttccatataaattcagattgttgcaagtgtgatttaaattctgaaatccagtgatgtatggctatatatatggttttgcaatgaaatgttgtagtatctgagagaatgagtgtttgaaatatgagagaatgcaattttgggtgaaattctgaatgcaggaattgggggtgaaattttcatatactctgaaattctgaaatctgatatgttctaaatgaaatctgatttacattgccatgaactttgtccataagtagttcatatgtgagatgtagttcatatttcatatgtgcactttgagatatgtaaactttgggacttaggggttattgagatgtgagatgttatatgtgatatcaaaccatcacagaatacgaagtgcatggggaattttgttggattggtcagggtagtccatggacggaaccgacctagacaccgaaattttccatgcacttcgaaatctgtcattctttgataattaaggaacttaattaggtttagggtttgaaatttagctgaaatggatgaattgatagattggccgtacttttaatgtagttcctatgttatcaagccatcacagaatacgaactgcatgggaaattttgttggattggtcagggtagtccatggacggaaccgacctagacgccaaaattttccatgcacttcgaaatctgtcattctttgataattaaggaacttaattaggtagtttgaaatggtcagggttggtggattgtaatattgttgtcgttaccaatctcattgattgctttaagcgatcaaggagtttgttggcgataacaatattatagttgtagtacaaaattagtatctaaattttgccttcttttcggacttacaataagaaaatgattgcatttcgcaactaacataaattcaccttcaaaggatatcaatcgacaaacccacccaagagcaacccacaggtgacaagggcaaggaaactcaggccgtcatcgaggaagatatttgcatgcaagtagtcacggaggaatcttcgtcatctagttgctgttttagagcctgagccgagctatcctttcgatgatgtaacggaggatactccgtgcaagcacttgattctggtcggtagggtgggaaagaaaatactcattgcaactgggaggttcatactaggccgcaggtttcattgccaagacattccggatgactacgccaaggtagaggtccggacggtcattgaggcttactggatgcacgagctcgactttccaactactgag

SEQ ID NO: 62488 - DNA, 786 bp, Oryza sativa
acaagcaaagcctacaaagctagcggcgggtgaaattgaagcggtgcctgaacagccaatgcccgatcaaccagagccatcacaaccagagccatcgcaaccagaggaatctaagggtgccgatgtgccagtgatggtaaggacgcacaagcacaaagcaaaaagtgcgtccaagaaacagtatatggtaacggcattccgaggaagggagaaagatatcataaatgccgaatttgataaaagaaaattaaaagggttcaagcaaaccatggatgactatctcaactatatcaattccccagacgtgccacacgaatttgagaatggcaaaccattcatttacgactggcaactaagagaaggaccgtggcaactaagaaggtggcacaattggtacattagggcaagcaccatgaaaggcatttcatcattcacagttgccgtgggggagaacatcttctggagcggtccttgtctactccaagtccatttctccgatatgcatcccctctaccgtaggaagaggctggacgccaatttaattgccatctggtgtctgtaagttctagacttgaacatgttaataaatcactacacctatatgcgtagctcatttgatcatccattgttggcaggatgaattacgtggaagctgaagagatgaaaaaacctgtcgcctacctaaacccgtgcaggatgtaacgctccgctttctgcgggacgttaaaagctaatttattgaaaatcctaattgcgaaaattttgttctttgaggggctgcaggaa

SEQ ID NO: 62489 - DNA, 6994 bp, Oryza sativa
  unsure (1)..(6994): unsure at all n locations
cctgcagccccgcacacacgttttcaggtttcagtacgagctagctagccaacacccgtttgcagcagtggcgttttgccagaaaccaaaatggaaggtgattttgttatttgtgtaataacggtggagtttaatttccttagatatatattcagagactggctaatgactgggtaattataactgcaaaacacttgggctgattattatctcccacttggccctagtcgatttcagtgtttgttagcttgcaggctaccatgactgaatgattgattattccgtaatctgtagctaatcagatcggatacgctaatacggcgcagtaggtatagggaggacaaagtccacaggcccagtagcactctttctgtcactcactcactcactcactcactcactagagttatagagcagacgactctctcactgtcagtcctcatgaaactgaaagctatgaaaatcccatcaaaagaacttgaccgtgaaaaataccccaattaaattacataaccatctaattttatgatgatagtttggttcgttaaaaacctaaaccaattaggccccgttctttcacgattaagatataagtagattttagcacggtttttaaactgttgaacgatatgttttatctgaaaactttctatatttatatatttccttcgtttcatactataaattgtttgatttttttcccagtcaaactctattaaatttgactaagttttttgcaacatataaaatattaaattggttttactaaatctaatattgaatataatttgataatatgtatgttttgtgttgaaaataatactatatattttttatatatttggtcaaacttaaaaatatttgattgaaaaataggtaaacaatttataatatgaaacggacggagcatcagcatattttaagtttgcaataatcaaggctcaattatgcactaatgttttttttcttgttttgtgtaagtaatctgagccgttcgatcacgcctcttctctccggatcacacgacacccaccgtttgcctactttttatctccgtcctcttggattggatgcgtccgacactcgagccacaccgaatcccaaccaccattgccgcgccgagctcttcttcttcaccatcagcgaagcagagcagagcagaagcagagcgcggagatatgctcggaggtcgacggcgaggtcagcagcaagaagcgaggtagcgggcggcggccgcagagagacatgtggacgccgtcgcgggggtcggcgagcgggcggcgggcgacgggtcaccgccgcatcgcggactacctcgccgacgaccggacggaggcgtcgacggagaacgggtcgttcaacacggcctacagcgacgagctgttcgcgccgacgtcgtcgtccgccggcggcgatggcgtcggtggaatgctgccggcgttcctcgccgaccagagcgacctcgtggaggtcatgctggagctcgacgaggagtccatggtggtgcggagcgtgacgcccaccacgggcgcgctgtacgggcccacgtcgttggccgggggcggcgccgcgcacacgccgccggggagcgggcggagcctgagccggtgctcgtcgacgtcgtcgcggatacgcaagaagttcgcgtggctacggtcgccgtcgcccgcgccggcgcctcgcgcccccacgccgtcggagccgccgccgccgcgggaggcggcgatggccgcacgcgagcggcggcgcatccaggcgcggctgaaccgtgctcgctccggcgccaggcgcgccctcataggcctccgcttcatcagccgcaccaccggctccgccgaggccgccgagctctggacccgcgtcgagcaccgcttcacgcctctccccacggctccttttgnncccccccggcganccaacttcggcgtctgcatcggtaagcaagcaaagccatcctccatgtccatggcgcgccgcgcgcgggcgcgatcacgcgatgacacggcgtacggcgccggcattggtgcagggatggaggactcgaaggagttcgccgtgggcatcttcgacgcgctggcgcggcggcggcggcaggagctcgagcggatcagcaaggaggagctctacgacttctgggtccaaatctccgaccagagcttcgacgcgcgcctccaaatcttcttcgacatgtacctaagccagccataaatccaaccaaatttccttcgaattttgagttcgtgcgtgtttcgatgaatttgtaaaaaaataaacgagtttctttcagggtggataccaacgtggacgggaggatcactagggaggaagtgcaggaggcaagtagacttaattacacttacttattactccatgattaacttgtaaaatcactggacagtaacattttagaagcttccgttgttgcatggctaacgacattactactaccgtaactgtcactctcactctcacagcatttccagtgtcaaactaggctacacgaatgattaacttcactgttagttaaggtaattaaataatttttactgcatgtggttatttttttttttacagctgatcgtgctgagcgcgtcggcgaacaagctgtcgaagctgaaggagcaggcggaggagtacgcgtcgctgatcatggaggagctcgacccggaggacctcggctacatcgaggtgaggatttcgctttcgccatttctgtgctctgtgtccgttgctgcttgagcttgactcgtcttctccggcgacggcgtggtgcagctgtggcagctggaggcgctgctgctccagcgagacgcgtacatgaactacagccggccgctcagcagcggcagcacggcgcagtggagccagaacctcggcggcggcggcggagggcagcaaggagggcaagggcaggggcaggggcagtcggaggggaggaggaacgactggaggcggcggtggagcccgcggcgagcggcggcgagggcgcaggtggcggcggaggagaactggcggcgcgcgtgggtgctggcgctgtggttcgccgccatggcgggactgttcgcgtggaagttcgtgcagtaccgccgcacgccggcgttccgggtgatggggtactgcctcccgacggcgaagggcgccgccgagacgctcaagctcaacatggcgctcgtcctcctccccgtctgccgcaacacgctgacgtggctccgctcctcctgggcccgcttcttcgtccccttcgacgacagcatcaccttccacaaggtaggtactcctcctcctctcgagctcaccgccggtggttgggaggtcgccgtcgccggagttcggggagacgactcgtcgcccaatgattggcggccggtgcgtctctgccttgtgggcccgggtgggccggctcgggatcttctgcggctcggcccatgtggggcggtgcgacttttgggccgtgtaggtggagagtagctcgggctttaagtgggccccaccggggcggtccaatcagtgtagcgtggccggggaacccgcgggtacagaagatccccggcccggtcggctcagggtcaaagcgccggtcattcaaaagtctccccgaccgacagggctcccactgtcatgtggggccactgtaagctactccaaccggcagggcccgtgttcattaagctaagctccaggcataaaacgtttgtaaatgtacttataggatcaaggtggtcaagatcgcaataatcgtttcttctgacattagcaattataaatttaccaccctcttaactcgttatcataaaactagaatatgaatagtgtaaagcattttattgtaacatataaaaaccattgataaatttacaaatacccctgcttatacctatgtaggatcagtcgtcatacgtcaaatttaaattttaaaagttaatttttatttttttaatattttgtttttaacattttctttggaatttaaaacacgtatataaaaattttacttacgctccgttcgttttttctcttaaatggcaagaaaaccggagcaaagaaattaacaaataattaattaattattactccattacaaacttaaaaaatagattcatttgaatttttaaataaaattttatataaaaacattttataaaaaatacaccgtttaatagtttgggaaacgtataaaaaacaacaaagttgaagtttagactttttttaggtaacttttttttagggaacgaagtttagagttggagtttagaacgggcctttataaattaattttgattgtttcatctactttttcacaactaattagttgtagagcaaagagagcgaggctaaaattagcacattgttgaggttgctagtaattgcaaaagctaaaaaactttggctacacctgcagatcatcgcgacggcaatcgcgctgggcatctgcacgcacgcggggacgcacctggcgtgcgacttcccgcggctgatcgggtcgagccgggaggagtacgagctgctgctgtccggcttcttcggcgcgtcgcggccgacgtaccggggcctcctcgccggcgtcgagggggtcaccgggatcgtcatggtggtgctcatggtggtctccttcacgctggcgacgcggccgctgcggaagcgggaggcgccgcgcctcccgttcccgctcggccacctcgccggcttcaacgccttctggtactcgcaccacctcctcatcgtcgtctacctccttctgctcgttcatggctggttcatgttcctcgtcaccaagtggcaccagaggacggtaagtaaagcttatattagctaccttgtcacgtcatctttacctttcactatcagagcttagttctttttaatatattcatcagattattggaaggaaatatttttttcacgcttaaaaatatatttaagctatatgtttatctatttatcaaaatatctaatttgttcctataatgaagtactatataattcttatcaacaatctgttttaaactgagcctcggagtacttgattataataagatcctattaaactctcaaaatctagaataatagctgtaaaagttaagaactattataattttatatacttatttcgatatccttaaaaaaacttactactacattgatatgaaataatggtaaaaaaagtactacattttcaatattgtttttttaaaaaaagtcaaatgctaattactctgtacttcttaccgtacaatagattctttttgctaggatgctcatcacagatgccagtaatttgcctcgtggggtagctttcgtgagggcgacatttttccggttaattttgatccttccaaaaggttgcaattgcacgtttttttgggttctagcatcgatcgttttggatgtgtgctctcgctcgctctcgccctctctttctcctttggtggcttttgcttttgttatccatttgttagggtcatcctcctcctcctggtcctgcctgttacggtgatgggcacagggcaccattggaaaaaaaaaggagagaaattttagttgcaaattaagggacaattgacctcttggggggccggccaaaatcattgcaaaacagaaaaaggaaaagataattaggacattacaccagaaattatttagtgagtatcaagaattcaaagttaaattttaaggtcattagtagtacgtagttacacaggcacatcaatttatttttgggtaggtccatgctttggacattggacatggaaggaagatatgtagaccaccattgcactgcttcaaattgctttccttggaggaaaaatgacgtgtgcataaatgtgagtggagcccacgtacatgtggggtccaggatgactagatgcatctctatccgtgtccaacactccaacctgttttagatagtcttgaaaccactgttcaatatcatcatgttgttttcaagttattcactcgattatgaaaatagattatttgctccacgctcttctttttaagcttattcactaaattattgaaacgggttatttgtttcacacccaaaaaatacgtttctctctacggcgcgtcgcttcgacaacctgatttttctttttgttaagtctatttcttaaaatatttaatttattcataaaattaaatcgatgatccattgtaataatctgtttaatgatgtataaatcacatggcttctatccagtttcaccgcaaagagtttagatccaatcattccataaacatagcagtcttggataaaatctgttgggttctacggaccgtactgttgcaaagctagctcttgcacggaacgtacagtgatggtaacgggatgttgacgccggcgcacgcacaatttattgtccggttggtgtcgcgttcgagtcagaccggaactcgatcgaccgaagcaaatatgaacctgtccagtattgagggggtttgatacgccaatttgtcattttcagatgcctacgcatcaattggggaatgcggggtccaaccgaatgccaagcccaatctgttgtgagttgtgaccatgaaataataaagtatcctgcaaatcagtctgggagatgaaatcactgtcacatatatatatgtagtatattttttggatacacagagagttttataggagaaaaatactagccaattggatatttttggatccacagagatttttatagggggaaatgctagcccattggattactcaattaggttacaattatagtgacaggggatttcgttaatggcatccatttgtagattatgattgggtgtgatctgctagtggttttcctttaaagcatgtctggcattggttggttttaaggcatacaaacttccaaaactacagaaaattaatttaattatttttgcaccatttctaatttgagcacatggaaaacacctataagaaattagctttatcttccacaattacaatggtcagtgccattcacaaatctgcattcatagccttatgggt

SEQ ID NO: 62490 - DNA, 1817 bp, Oryza sativa
tttatgtcggcgaaaggacgctacgggccttcagatccaaggcttatgcagtaaaaatcctgaaggtaactgaacatctgaatgatcatacattttctgaatttcaagcattaatcatcactccttgaacgataaattgttcttaaaattattagttggttggatccaaaccaaaaaaggttgtataatttgcattgaggaacatacactgattaagtttggtgatccatttatatcataagaatcttgaaggcaacaataatatagtatagggaatggaaagattcaggatgcatgaaagataatggcatgtggacggtcagataaggttctggggttaggtcatattggcactacgatattgatgatattataggcctaactaagcttctatctccttttaggaattttccatcacatcctatccaattcaaaagtgacaccatctaatgttgaaaccaaatgagacaaaaagaaggatatagcgtataaactatatgagtagcatctgttatcattttctttactactacctccattcgtctcagaatatagctacttctggctataccatccaagtgcatagtcaggagtaactatattttgggatggttgtagtagtaaaaatatgaaaatgaaaataggctaaattaggttcatgttcttaactgaatttgatccactcaggtgtgtcttctaccgggtaatgtgttgaccatcacaatgtcaaagccttatggattcagatacaggagtgggcagtacattttccttcagtgtccaacgatctctccatttgaatggttcgtctgcccttcaatctactgcttcagtcagccttgctctgactatctactactactactttcagacacaagtaactgatggtgttctttcttgccccattgcttcaggcaccctttctccatcacttcagcacctggagaaagggtgcctgaagcaggcaccctttctccatcacttcagcacctggagatgactacatcagtgtccatatccagaccaggggggactggacgcaggagctcaagcgcattttcgtcgagaactatttcgtgccaagcgttccgagaagagcttcatttggagctctaggcatggcagaacagaagaggtcaatgcactctccctgtcaattgtcatttctgatcctaagagttagctatggaactgagcactccctcatctcttctgcagtccaccaaggttgcttgtagatggcccttatggcgcgccggcgcaggatttcaggaactacgatgttcttctccttgtcggcctcgggatcggtgcgacgcctttcataagcattcttagagatctgctgaacaacatcaagctggctgatgagctgatggtaaggtttctttaacatcagtaggctagctgggttcccttctcagccttctgaaagatgcatcattgcattgatgcctcctcccttgtctgaattcttcaggatctggcaatggagactagcaggtctgacgacagcgccaacagcttcagtgtgtcgacggcgagcagcaacaagaggagagcgtacaggacgagcagggcacacttctactgggttacaagagagccagggtcattcgaatggttcaagggggtgatgaatgaagttgctgaaatggacaagaaggtgatgccttctgctccctgaactagtgctgctctccttgcaatttttgtgtactgatgaaggtgatcatgctttttgctgttgcaatcagggtgtcatagagctgcacaactatctcacaagtgtgtatgaagagcgtgatgccaggtcg

SEQ ID NO: 62491 - DNA, 787 bp, Oryza sativa
acatgtatagcctatagctactcatcagatgctaagcttacaagaccctgaggtcaccaaagtacacgtctaccagtctagtactggcagtggcattgcgcagtgatactatatatggatattcagttgggccttggcattaacacagaaaagcagactcataaaatatgatcacgtgatccttactgcaagcatattgcagtactctatatttgttgaaacaaataacatgctgtataattagaataccagtaaagagctgcttaggctttattttgtactttgaaggcactttgtatagccttcacttcagtaagtgctgttctccataccacaatagcacaagaagaattgcttactattaaaaaaactaatggaatggattgtcacaagtaataatgtacaacatatccacatatctattgaagctattaaagacaaaaaaaaaacatttttactacgcagtagccctatagttcctaaaccaaggtcagaaggagaaacaacagtcttcagatagtacttacacctatttaacgccaaggaacttaatcctttgcaaagaacagtgagtctagattcttttccacagaaaggacctacattttagtgatgaagtatgctgcgcaaagagcatcatgtgcggaaatcctctgcagaataaataaaagcagaaaggtattagattgtttccacgttcaagaccccagtaaaaaaaccttaagaatattcttctatagagagtacaattgattctctaaatcatagtataaaagggctgcaggaa

SEQ ID NO: 62492 - DNA, 833 bp, Oryza sativa
ttcctgcagccccatttgtgcagtctctcatattgtacttgagctagtttttacccgatctacttgcatgcttaattgatttagttggtgaccttatatcttgtttagatgccttatttgtcaccttttgatttatatacattttgtttatttgagctagaagttcatagctagtgttttcttccattatccgccgaacttttcggttgagaccggaacttccaatctcatattggaagttcctatttgaaccgaaagttctcatcattctaatatgctatgaagttgtgataacttttaggaacgcctattcatccccctctaggcgacattaaggtcctttcacattcctttccacccactcctcacccttcggctgctcttgctcccctaccttcatcctcgctctggtgcctccccttgtcccccttcctcttctcgctggtggcacttgatgcctaggctgaagttcgagaaggagctcaaggctcgagcttgacatctgggagctaccaagtgggggtggagcaactacttagtgctggcaagagagtcgaggaagcagtggagggtggagcactactaccatgggtagtgctcccatgcgccattgtcagtgttcactaattgaggtgccggtgcaagccaaaatttgctggggtagtagggcagttcaagtcaggccactctgactgccctcaccaccctccatggaggatgtacccccaagcttagttgccatctccgcttctgttgtgagttcctcacctccgcctggttcccttctactgattggaatgaggagagaagatcacgatacagagaaaggagat

SEQ ID NO: 62493 - DNA, 1769 bp, Oryza sativa
cagatatctgatttaatagtataacagaaaagttaattatccacaataaaaagggaaatttatctaggttcattagcatcaatatgaatgtgagaaatgctagaatgacttacattgtgaaacggaggaagtatatgtcaagccataacacatcgaccttatacatgaacaagttagaaattagagacaatccaagaaatatcattgacacacgcccaatttctagaaatgttatcgataagtgcgagttccatgaaataccttcgtacaaatgattttgtcccaaaaatacgacgtcgttagggttccgtccatctcgcaccgttaaattaaatacactatttatcctatagcatttaatagagagttgctaatggaactctaatagcgatgacattttcgagacaaaatcgattgtacgatggtattttatagaactcacacttgtcaatgatatttcttggattctctataaattaataagagatcatagctaagcctttgcaatatatgtatgcatgcgcaaaatttaattacaatgaccagctacagttagtttgacatattccatgagagaaaaggagtcaacttgctctaacttttggaataatttatcgaagtcaatcataataacacggatggttaggttaaaaaccacatgagctcgatctggttaaacaaccacaacgacactccatcatgcatttggatcacatgcaacagtgcaaggcctaattaataagcacatgcgtgcgtagggcgcataaccaaaatgaactaattgcgctcttaggaagtggtccatatgtgtagtactttattttaactatatataggcatataattaattaagcacacgttgccgcgcatggccacacgcttaattactttaagctagctagcattagtagtgatagattatatatatacttaaaatgtgatgtcctagaatgagtataaatacagttaaattatgatatataagtacatcgcaaattgttgttaatatataaaaacatattgttgacattttttttacttggaccacttcagggggagtaattttgagatttgatacgtaaaatagtggtgtgtttgcacgggtagattcttcattttttttagataatagaaatgggttacatctctggcctctatccataggcacacggccaacgattatagagtatacatttatagttttaataatttttataaatacatagttaagtaacctctagttcttatagttaagaaacacattattaagaaactagtatgtcaatgccttcgtacaacatactacctccgtcccaatataagtgcagttgtgagtttccatacatatctggtatttgatcgttcatcttattgaatgattgatattattattgttattagatgataaaatatgaatagcattttatgtgtgaataatttttttaattttttcataaatgttttaaataagacgaacggttaaacattggacacagaaacccacaactgcacttatattagaatggatggagtaaaacagaacggatgtatactagctgaaagtgtgttcaatttcaaaaaagaaaacctagctagctagctagacctaggaaacaaaaggagtcgagataaataatattgggaacgagtgaacgacacccaaaagtaccaacattgctttgcaagttggcatgtcacatgtgtaatagaggtgtggcaaaatagattattaagagatgatctattgaggactatgaaaaaaaaaggaa

SEQ ID NO: 62494 - DNA, 6936 bp, Oryza sativa
ctatgtattttttttagataatagaatttatttcgtctttagcttcaaaaaaggtacaacaaactgtttcagatgttgtagttcgaactactgcagattataatatcatatcttcattaaaaacaagaaaactaccaacacctattgctaaacctatatctatagttgacgaaaatgtacataaccattgtttctgcgtagaggcttgcaagttgcatgtagtccttgtctttatcaaaaaccaggaacaaaatctccgaaatcagcggctaattgttatgctgatcgaatttcgtgcacatcaccaccaacaaccaacatcgaaccgaagcaaaagataaccaccgccacaaccattggagctgacccgacaaggatattgacaatggttatgaaggttgccactagacagatgacactcccatcgtctcaatcactggatcttgcagacgggacctcgaccacgacctgagctagccaatcattgtcatcgtatattagctcagccttgacatgcccgcgaagtcacggacatgagcttacaacatcggagccgatgccaatgatggtgatggggaacacgaggtgcgtgaaggaaactcaaagccaaagtaatagatgagcaagttgaaatctccatggtgccggggaatacgtactatctccattctacgtgcaatcaattctttaattttgaatcatgataatagattaaaaaattaaaatggccatagtatatggatgggatgcaggtctcgagggttggtggaatgataggacccactaagaatatatcataaaaagtaatagggtaaaagtcacattttacgtatcctatacagttctaccaaaataaaatggcaacatcaaattggggcaaaatagaagatcacactggttaacgtcagtacgtcagcatacttgtactttcggttgtatcctttgtaataatatcaaaattattaaacacagtgtggcacatgccctataccacatagctagctagctagctgctacacatccatcttgtgaaagatcgtcgcggcttcacttctccgcagcgacaaacaagggcaaaaggcacaaaattaaagcacatattgattgattgtatgtacgtacgtacgtacgtactgtgcacttgccttttctcaaacgtgcttgttaacatcatatattgggcagcagtacaatattccttctaaattttgccaccaaactgtccgtttccaaacctcttgttttgcattgcaagcagtcttgcggctctcctcccacacggagaggttgaccattaccagcatgcgtgttgttatccatcgcaaattaaagctgatttaaatcatatcaaacaacacgtcttccgtgcactataagtataatctctcactctctcctctttgatcatcatcagctcatcgatcactagcatagctagctggctgcaaatctgcaaaatgaatatgatgagtaactaatgcgtacataggagagtgtgtttcttgcctatattagtgattagttgcgagcttagctagccatggatcatattggaattagcggcggcggcgagggcggggtggtgtctccggcgcagccgtcgtcgccggagcggcggtacaagggcgtgcggctgcggaagtgggggcggtgggtgtcggagatccggatgcccaacagccgggagaggatatggctgggctcgtacgagtccgccgagaaggcggcgcgggcgttcgacgccgccgccgtctgcctccgcggctcgcgcggcgccggctcgctcaacttcccggagtccccccctcccgacgtccgccgccgcttccccggcgcggctctcacggtcgagcagatccaggccgaggcggcgaggcacgccaaccgcccgtttccggcgaacaccgccgccgccggcgggtcgtcgtcgtcgtactcgatctcgcagcggcaagaagcagcagcccctgcgcggtcgacgagcaacgacgacacggccatgtcgtcagtgccctccaccgacggcggcgctgccgactacgacggcggtgatgatgtcattgactggtcattcatggacacgttgccggcgatgtcgtcgtcagcggctagtaccaatgctgatctggtcccggccatggatgatttcatgtacgggttcttgcacacaatgccgccatcgccatgcgaagacggtggggaggatgtgatgatcgacggcaattgcaacatggatcagacatttttctcagtagatctttggagattttgatcctagaaatctactagcaactggtacccaagaacacaaatatggcggcggcctatatatttaccgcagtcacattagcattctcaccagcatagatacagcatgatacgaaattaattaattagtgcattgtgtataaggttcgatttgtatttgctgtgctatacgctgcgttgtgcttatttttaagttgatatacttataatcgccgtacattgttttacggatcaaattatagttttaaactagttagataaataaattaaaatatatatgttaccatacttccagtttttcatagttctcaactttttttatttcctattttcaaactgtgatattacaactactaatagaaaaacaatttactactacgaggctgattaactacaggctgactgtattttcagttggggcggcctggttgcaaaacaatatgattttcgtaaacacatgctaagtggcgggctgtctgcgtaaagcgatttgatcgcctgaaaaaatggttttcatagtatcgaacaccaaaagaaaataatttccaaatatgaaaatgtgtggttgtatccagtggcggatccagaacaagatttaagggggaactcatttccttcttcctttttcagtcccccctactcttaattttcttcctattcttttcctttcatctccccctttgttagtggtgatccagcggggtaggggggactcaagtccccctagcacctacgctggatccgcccctatttgtatcagactatatcatactgcactgcaatactaaatggagcctaaagttgggttgcattcatcgatttgcagattcttccgtgggatatataattaagaaagtccaaaggaattaattaatcacttgcaagttaatcacttgcaagctccatttctagcttagctagctagatgatggtcaacattgatttggccaagtaagatgatgtctatgcctgtgctgcttagatccaacaacaacctcttgcttctggtaggaatccccccatccattacagtcatggcgaaactcagtggcggataggctaggtcatggcacctgcaaattaaactgagaatcagtggaggtgctcaaaaggatcccatggaagtgaataatggcaaagaatgctactgatcattgtctaaattaatggggatggactagacctagaggaaggggccggggtggctagaagccagaacaaagcatcggggtattagagtatttcttccgaaagatggtaagttatccactacctcaaaacatcggattagtgccagttggtactatatttattttttataagatggagggagtaacatttgaacaatatatgaatgcagggcatcaccaatatatatgaaccaactaatcaataatgctattcggattcatagtactaaaaatatgttacatgttgtactctctctgccctataatataagggattttgactttttccttgtaacgtttgagcactcgtcttattcaaaaaaattatgcaaatataaaaaacaaaaagttgtgcttaaagtactatggataataaagtaagtcacaaataaaacaaataataattctaaatttttttaaataagacgaatgatcaaatagtgcaagtaaaatgtcaaaatcccttatattatggatggagggagtataagatttcttttttatgagatgaagaaagtatgtcctaacatcttaatagtacatgcatgcagggcatcaccaatgtatatggaccaactagtccatataaatgggacccacacaagtgaactcttcttgtttccatttccacaatgtatagcgatagccattggcattaagataggatatactccctccgttccaaaataaactaatctaggattcggtgggacatcacctaaattggttatgtactagatgatgttccaatcaatcctagattgttttatttttggacacatggagtacatcataaaataatcaatctaactaataagagttctctctttttcagtgaccttggtcctcgttttatatcacggtggcatgttttttataaatggaccctgcataggggtaaggtgtctttttggtcttgttgcttcttggtgactgggcccggttgtcaggccgtgcgcctgccgtcggaagaaagtgtgcgatgactgtgaactaaacgtgcgacatagtactcaacagtgccgcctatagcacacgccttttcgcataggagagataaaggcttgttgcagggttggtatgtgttgtcttgtcgcgtgttgtaccggtcctaggctaggttggtataccccagatacttgggaacaggtgacagatgtgctccgagaaccgcccacggaggccaagttctagagttcatgcccgaggggcgaatgtgccccgagcatcgcttgggggggagggggcgcccgaggtgcactgacatagcccacaaaaggatcatgcttgtgggggtcatgcctagggacgaatgtgtctcgagcactgccacagggagcatcacatgggagggaacaagtgtgcttatagctagttagagaaatgggaacatgggtcgaccttacaattaatgtgagacaaaaataatacttatagcttatctgagaaataagaacaaaatccttatcgacaagttataagagtacttttgtctcacattatggatggccaattagccagttggccttcattttattttgagactgtcacacgttgataagcataaagtgtcaggagacccatgccgttctcttgtttactgatgagaagtgtattatataagtgcaaacctatagctagtgtgcaacgcgtgcgtttttgtggtttcaaattgcaggcacatccccgtggttgtacgtgttcctgaatttatatattcacacaggcagctgaagtcctgatatacatatagtttatttgatcaacagcttggctcctcggaactgaccatgcgtcaacaggcagggcccgtgatgccagtgacgtacgcaggatttattaattgagtatacattcaacaattatataattacatactccctccgtttcattaaaaaaactaatgtagctagtaattaatgtaacacatcctaacactacgaatttggacataattttgtctagattcgttgtattaggatatgcgccactggtggagaaatcatctttcgtcggtcgggcgaattccacaatagttccggttgcaataaaaaccggaacttggcgatttgatcatctttagtcccgattaaaaagggtaacatgcatatttgatcatctttagtctcggttcaaatgctgtcagggcttgtcaggccccccgggatctttagtcccggtttgtaacaccaaccgggaataaagatcgtaactttagtcccggttggtgttaccaaccggggctaaagatcccggcgatctttagccccggttcataacaccaaccgggactaaagttccacccctttatatatgtctttttcctccttcagcccgagcaagcttcaaaatttcttcaaaaaagaggggaggtcatgccaaaatttctagtgaatttattttggtgattatatacaaatcagaggtgcctaaaaggttagcaacttcatcctccaatgttttttttgtcatattacatttggagctatgttttgctcacttttttgtctccaaaattttgttgttagttgatgagagagaaaatttgtgtgggaaagaaagaatatatagaaattttgttaatttgctaaagaaggttttataaaatagttgagaaggaaaatatagtgaaagttaatcttaaataatagaaaacaaactaaattgaaaaccaaaagaagtacaacacattaatattagtttaaaagttcaaaaataataaataagaattatttggtggaatattttataatttttgtatgaataatgatatgtcattattgtatgacctttggaagagtttgtgattattttattattattgtatgactgtcattattgtacgaataattatttgtgtacgattttttttttcatttcatgtagatggatgggcaatgaatgacgctgaccggcggtctaaagagtttattgtcggcatgcattattttttgagagtggccgaagctaacaagcataagggttttatttgttatccatgcaataagtgtaagaaccagaaggagtattctgcattcaggactattcatttccacttgtttaagtcggagttaatgccaagcgataattgttggacatctcacggagagcaaggggttgaaatgaaagaaaatgaagtggaagacgacaataatccggactttgcttagtacgctggatttgaaggaaatcaaacgggcgaggaggacagggatgctaatgataacgatgttgcggatgatcttggtcagatgttgcaggacgccaaggaggactgcgaaagtgaaaaggggccccataaattagacaagatgttaaaggaccacataacgtcgttgtacctaggttgcgagcaggggcacaaaaagttggataccactgtggagttcttgcaatgaaagaaaaaaaatggtgttagtgacaaggcatttggcgatttattgaaactcgtcaagaacattcttccggagggaaacaa

SEQ ID NO: 62495 - DNA, 8212 bp, Oryza sativa
ccaacaaggggtataaggcttgcacttattgtatggatgaaacagaaagtacgtatcttaagcaccgaggaaggttgtgtacatgggtcatcgttgatttcttgctgcaaaccacccagtatggaagaaaggcaagcactttgaacataaggtagaccaccgtacgaagcctaaacatcgcagcgggaaaacagtgtttgctatggtgaaagatcttaaagtagtatttggaaaggggcctagcagctagcctatagagagcgaagatggtcacgcggcgatgtggaaaaaaaactccatattttgggagttaccctattgggaattcttggacgtccgccacgcaatcgacgtgatgcacctcactaagaacctttgcgtaaaccttcttggcttcctaggtgtatatggaaagtcgaaagatacactggaagcacgtaacgatctgaagcatatggaacaacgcggcgaccttcactcggaaccaaaggagaaaggaaggccattacttgagtccagccagctacactcttagcaaggcagagaaggaaagtatatttgaatgcttggagagaatcaaggtaccgtccggatactccgcgaatataaagcgaataataagcacgaaggagaagaagttcacaaacttaaagtctcgtgactgtcacatgttgatgacacaactgctaccagttataataaggggtatcctcccaaacaatgtccgggcaacaataacaaagctatgtgctttcatgaacgcaatttcgcagaaggtcatcgatccggatagattagaaacccttcagaatgatgtggtgcaatgtcttgtcagctttgagttgatatttccaccttcatttttcaatataatgacgcatctgctttgtcaccttgtcaaagagatcggtattctcgggcctgtgtacctacacaacatgtttcctttcgagaggtacatgggcgttctgaagaagtatgttcataaccgtgctcgtccagaggcaagcatcgccaaggggtatggaacagaggaggtcattgaattttgcgtagaatttattgaagatcttcgcccaatcggggtacctgaatgacgccatgaagggagactacggggaaaagggactctcggaaggaaagcaataatgacggtagacaacaatttattccgtaaagtccatttcacggttctgcaacaatcttcattggtggctccttacatcgaggagcacttggctctagttcgcgccagaaacatcggtaagtccgatgcatagattacacggcatcacattgatacttttcccacgtggctgcgataacatctcatgggcaacgagacgattaaccaacaactggccttcctggcgaggggaccatctggctcgatcgtgacattccagggatatgaaatcaatgggtacacattctatacgagagcccaagacatgaagagcacaaaccagaacagtgttgttcgtatcgatgccatgggacacgatggtacaactggcacgcattacggtgccatcgaggacatatgggaacttgactatggacctctcaaggttcctctgttccggtgccaatgggttaggttgactggtggaggcgtaatgattgatgacagtgggatgacaacggttgaccttaacaaggttggatactcggacgaaccttttgtccttgccaatgatgtaacgcaagttttttacgtgacggacatgtctagcaaaggaaagaagggcaaagggcttgacgagccgaagcgctacgtggttctcctagacaaaaagaaaaatcgtcggagtagaggacaagactgacgaggattacgatcagtttgatgggcaacccccctttcacggtgacgattgaccctagcatcctcctatcaaatgaagacaccccttactcacgtagcgatcacaaggaaggaacaatagtgaggagaaagtacgtgccgtaaatcgttaccgccgatgtattgccgtaattgttgtgtacacgatgtaaactattttggatatattgaatacccatataaatcaattgttgtatggcatatgttaattatgtatgattattagaatttttaacaaatttaaatcatgcatatcttagttatatacgctaattagaatttttaaaagttttaaatcatgcatgtggtatttacatatgttaattagaatttttaacaattttaaatcatgcatatacaaattatatatgattattagaatttttattaattttaaatcatgcatgtggtatttacatatgttaattagaatttttaacaatttaatattatgcatatgctaattatatatgattattagaatttttaacaattttaaatcattcatgtgcttattatatattatccacttaatttactacagacaacaataatttttcgaaggttttgtcattaattttttgactttaaataattttaatgcattatttactattttagaaacacatatgtaatgaaattcaatattcaatgctattatctttagtcccagttcttaaccctaaccgggtttaaaaagaatttggaaatagcgggaaaatatctttagtcccggttgttcttacgaactgggagtaaagatatctttagtcccggttgttctcaccaaccgggagaaaagatctatgggtatatatattcccgatgtgccctcgtcttctccaccaacacttagaagtttttcctccgatctcggcttctccttcgccgccactgcataggccttctccttcgccgccgtcgtctctcgccgtcgtctcgccgtcgtcgccgcctccgccgccgacaccgccgccgcatctctggggtgatcagagccgccgctgcttctctctctctctctcgatctctctctctctccaaaccactgccgcctcgttgccgacgccgccaccgacatcaacgcggccgaccccgactccgcctcccgctgatgccgaccccgacttcgccgcggccgccaccgccgccgacataacatgcacgcggccgtcactgccgacgacgccgacgccaccgccacgccgccggccccgcctgaagctcggcacgccaccgtgccacgccgacgcgatgccacgccgctgccgacgccgctccgttgccaccactgccgccccgtcattgccgaacgtgaacgaaacgtgaatgaacgtgaacgaacgcgaacagaacgtgaacttacgtgaacgaacacgaacttaacgagaacgaaaacgtgaataaaacgtgaacgaacgcgaacgaacgtgaacaaaacatgaatgaccgtgattgaagcgtgaacgaacgcgaacgaaagaggacgaacgtgaacgaaacgtgaataaaacatgaacgaaatgtgaaggcacttgaactaaaagtgtgagaacgaacgcgagcgaaacgtgtacgaacgagataattaaacgattattaaacttagcatgcatatatatatatatatatatatatatatatatatatatatacttgaaaacgtgaaatacaatatatgttcctttgcgtttagactaatacatttttttgcatgttgcagaaaagacgtcgtcgtcgtcgtccctcaaacctaagtggtagctagccctcgaaggatttcgcgcatgcaagtgatttagagatgtgattgttagagattcaatataagattcgtagtcccggatttaatatgagatttaatattaaacattatttcacccgggactaaagatagttatctttagtcccggattcatagtcccggttgtgggctacaaaccgggactacaaacggtttttccaccggcatgccacatccaatcctatgtttgtttttcgtgggatggagagagtatgtattacgtctaatgtttaataatgaacttgtgttttgtgttagaggatttaagtttagttgactactagaatataaatattgtgagccaaaagtctaggagaaataaatttggtgaagaaaaaggcaaaaaataaagtattaggcgtagtagtttcttttcgaattaagatttagattttacctcggttctcattagcacgttttttaaagtaataaatgatgtttttcgtacgaaaattttatatatagaagttgctttaaaatattaattatctatttgtcaagtttgttctaattaaaatttaattaataatatgctaatgtcttttttgttttacatgtaccaacttaatcttcttcttccatcagtttcaaacacccctcccgtaacctttttttttttctgaaatttgtgggtaatcctgtacatacagtgaatacccactgtgtcggccactgcgtgatgcagtctgagaaatgctactagatccaacaaacacccggccacttgaatttatatacttctaaatgcaaaggagagctagtgaaagatgcaaagctatagcagagatcagtactaaagagaataaagagaataacgcacgcatgctagctaggtttgctaggctttcgaaagctagctctagctgcaactgctccagtcacggagctctttcgtcattagtactgtttgttaatacaggagtcacattagtaggtttcaaatgcattagatcatcaatcagcagtcctagactcccagccagtagaaaaggtacaaatatatgaccagattttgcatgtgaaaacacggatgtgctaaaacacacccaaatttgtaataactaaaacacgttacttacataataaaatgtttactgcaaattagatcgtccttaaaatatctcttcatataccctttttattatgcaatactcatagtaattaaaatctttattacaagtagaattgcttccgaccagtcattcttgatatatcttcaaattgataaagtcatcatagatgtcttattatcaatagatatatgatctaccattgaaagaagtaggtaaaaccccgcgcgttgctgcgggagtttagtataatatcaataggtaaaaacaaagtgtaaaatatatagataacataagattacgtaattatgtgggatgatgatttaacatacttgcatttcaaaagctctaaaatttaataattataaaattattgaaaatatagtatatttgcatgatgcttaaatttaatgattgttagtggatgatgatgtgacatctttgcatgttaagctttagtagttagtgggttataactttatactaagagaggataacaattaatccaagcattcatattaaacctagttcttaaacccagatgagctggttgcattataagaaacatattaattagttgagttacgccatccgcaatccgacggttaggggagagagacgaaagctgaaattgcacaacaccacgtggaaaggctatttcacgcgaatccgtatagacttcggcattataagcattactttatctcttttacattataagatgttttgatatttgaatagattcatgtatatgtttcttacatgtatccaaattcatatgaatgttagtgaatatattggacccacatttcagtgtgcctctctttttgcacacttacctctctctcctctacgaggaggagtaacatccgccgtgctagcggggtcatcgtttaggcggctccctccttgatgccaccgtgccgaacttaacaccctcgcatgtactccactgcgagatctctcccttctcaagcatcatgtggagtcgtgaacccgaagcagccaccagcagcagcggctgcgccatcgatgcactcgcacgcctccctatcaaataacctacccaacttatgaatccagcttgataagtactccctcacattacaagatgttttggcctcttcatctctcttgtagattcactaacatcatataaatttatgcacatatatgaaacatatatgtggatcaatgtatgaatctattcaaaacccaaaacgccttatagtattatcatatgaaacataggaaatagtaccagcggagagctagaaccgcatggaggccatgaggccatcaaagtcgccgcacatctgtggtactccgagtccccaattataagagtgcgtcgaggacatcctcatcaacctctacaaggtcacccagcaagatacaaccatacttcttgtaagagctactggcggatgtaaggggttcttgggtattcccgagaatattcaaaatactatgaaacaaaattagtatatataggtatatcatatatccatatacttaatttgacctgatacttgattctagattttttcttaacaaatctattcttcaagacttcaactcacaccacttctaacatggtagtcaactatctcaaatcccctaatcaccaaacataagggacaatatacttacaatgttgagtgaatatctagtcttaaaatcctgcatccgtcattggtaagagagctcacatttctcatttatcgactcatgaagcttcaactgttatcttggtcgtatcaattcaaatcaatatagttgataaaatttcttcttgtcaatgatgcacgcatcaattaatcttggtgggcgctgatacaaaagaactacatggaagcaaaggggacatactgtcgagcgttgctcatcaagccgaacaaaaacaagatgtgcaacctaggcatctattgctgctcctccgccgttgttgctgctattgtgtgacatcccaacccaattagaacatggcatgtgtggtccatgagagttgtgtgcgcatatttagtaccatcttgctagtttagcaaggatggaaccaacttataatggattatccctccaaccatatctcctgacttaaaccttttacacgaagcaagaaggaaagtgtaagtggggtggtatttataaatgggcccacccatcggatgggctaggctatgcgattctggagggtggactattacatatcaaagcacaagctcctctagtgggaaggctagatacccttggaagttcatccaaggtgcacgtacccgagctcgtgttagggtcgagggtcctgtaaaaatgtggacaagcaatgaatacatcttcgggccacttgggagtgtaataccctattcctatgttcatcgctatatgatgaagtttaccatgcgttcttagaagttgttttgagtgctaagggatgaactcaccctccctcagctatagcttgaacctaacttagttaaaccctcttcttagtggcattggtcctccttttatacgacaagggggtaccatagggcccatgcatgtgtacataggtaggggctagctcataggagttgataggattaatcttgtcattgtccctccaagagagccggtcggatgtgacgggttgaccttccatctaacacgtggagtagggtagctgaagtcgtcatccaagctaccattgggcccatctgtcagctactgaggatgatgaaagggggttccaccgggtgagtgtggagcacgcgccgcgtcgcccacctttccttcggggtgatgtgggaaagcggggggaggcatgcaccgccacgtccctacatcatctgtgatctttccacatgaatcaaatcacgccgcaattaaaatgcggaatgatggggaaaggctgcacagagggttcggtcaaatctcctttatgatgtagattcaaccggaacatacctcagggctctagcccacttccagaggacatcatggcctcgggctgatgctagctagggcccaagctgatgttgacctcgggtcaccttccttgctttgggaaagtacctaggtccctgcgtcagttctccgattactctggttactaatgtggtggatttccataaagatccatcgacaccactaggggtgggcgttcgatctagaccaaaaatctggtctagtcttttcgatataaaaataggagactggaataactagtagaaatttgtaaattggtggttcggttaaccgaaatttcagtctagtcttcggtcttactgaccagattgaaccctcctcaaatccccatggcatgcagggaagcatgccagctttgagaaaaatcaaaaagataacttagaggaagattgaagaacatcccaaatcaactcgatgatctagtgaattagaggaaaatcaaatcatgcaatagaatgtgggacggcggagaagtgaagatggatgcccgctaagtcgcagcta

SEQ ID NO: 62496 - DNA, 9239 bp, Oryza sativa
tctatgcggcggcgagaggttccagtgttggaggtgatggggatgaggaagacaaggagcagatatctatgtttctctcggtctttctgaagaccatgcatatgtgcttgttcaggtaagagcatctccaaatctccatttggccggattgccaaaaaaaagatagtcaaatttgcctttcactgcaatagactcttcattacactctccaatctaacgatagatcccatatatcattggctccatcaccttattcctcaccacctcctcctctcactcttcctctcatcttctcctctctctcctcttctacggccaaatctttgtcgttgtcatcatgccgcgcccaagtccacactgtctccatcctcctcctatggcaatgctggcactgctagacggtgcctcctgcagtcccgcgtgtcccctcaccttcgcctccacctccgtctgctccacacaaccacagtggtaggggtatctgcttccactgccaccatcaccgcactcatgtccaagcccatgctagctccatcctcctcctatatcgatgggcggtgcctcctactatcccgcccgtcctctctcctttgcctttgtctccttctcactgtactcacaaccaccacgtgcgggtgcatccgcttcccccaccgtcgtcattgtgcccatgcccaagcccacgccggctccttcctaccacgaagtcctccttgagcacctccagcaacgacacctcgagggcatgtccacggctcctccgtggctgatgcaagggaagaaggagagcggtggcagcagggattccggtggaaggtggcagcagtgacaatgtagagaagagagagatgtggtagagcaagagagagaagatgagaggagaaatagtacgtggggtgcaccattaacaagtgagtgtggctggacaaatttggcaagtgaggggaggaatttagccaaccgaatggccagctggagcaagattgttttgctggaattgcccaaatttggcctggagagccatttggatatatgcattaaggaggcaggctttgcttccggagggtgttgggttgctttggggactcagagttagatcgcgtggaaattgggcctatctcagtcacttcgggtagcaggctaggacaactaaatgggctcaaatttgttcggtctttcgagcaccgatatcttggtcttttctggtttggttttggtcgttagtttttattgtcacccctaagcacttgcaattcctatgaaactattttaccgactaagccacccaacaggtcaacatatactggcagttcccacgaaaactgaagaccccacccttcatccactaattgtagacctaaaccgcataaaacaagcagaaaatttagccacctgacgagttgtatctggctgctcactcgatggaatttccatccactgctcatcccgttgatgactgggcccgatggttgaaaaccactgtcatccacgactcgtcgcttcgcaacaaacaaagcgggcgtgcaaacacgcgtcggatgacgaacaatagaccaccgaccgatcactgggccttcattgtgtcgggcccctataagtcaaccaacatacatcttatttaccagatagagaagctaccagagaggttattgaaccacttatccataatttcattgacccatcgaaataacatgcaggccttccagtcaatcaaaagagagcagccatagtaatttcgcaactataatttctaaagtcacatagaccagcatctgccccttctttcaaccttaggttttaaactataatacaaggagttgctcgaactctggaaaattctgcagaaagatccaactattaccacgcataaatagtgatgtcatctaccaagctaaacaagttatagcagcaggcaaattcttgttgccattgtgatgctatcccaccacaatggcatacaaggcctcaaaaaatagtttaagaaagcagggaattacatcaagttgcaccaaaatctttaacaaaggcagacagagcatagagcctgattcaaatcagaacacgtattcagtctgataagtctacaactctccataccaagtcttccaagctccaaaatcttcaatacgacaatatccaattcatagcttttcagtcttcctgccatcaacttgttctagtagtttgggaacccgtcgaagtctttctttcctggcctccagtttggctatttcagaaatccatggaaagagagaaaagatcaattcaatgagattagcaggaaaactctctctaaagtgggcattattccttgctttccaaatggtccagcacacaacaacaatcccacacccactaaagattgtaaatttctacaccttcccttccacatcataagacgttttgatctctccatccctcgtctaaattcgctaacattcatatgatcttagatacatatatgaagcacatcaatggatccatgcatgaaacccgaaatgtattatatatgatgtgaaatggaggattgaatttatttaatcaagcaccaaaaggttgttgaatgttatgcacaggttcaacatcatatgcacatttattcacatttcataagaaatgagcataccatcaacactaagggaccagaaagtcaaagggacacgaggaaagaacttactaaattacttgatctttagttgccacatcctcaaaagcggagccacctagagctattaccttctataaagcactctgaggctcttgcccaggcacagaagactccgataaaaacaagccttattttggctgacaccaattgcaggtcaaatcccacctggatcaactatggaagtttctttacaaaaatactcttgagctgaaacgaccacagaagtgtagatttgatcaagcaggatgttgcatgtactttgcattgttgttgcactttgagaaacaaatttggttttactccatgggaaagacgtgatattgctgatggtgaagacaccactatatcttgcccaggtacagaggtggccccaatcaacgaaacatgccttgctttggctgacatcaattgcaggtcaaatgccacctgcataaactctaagagtggacggctgttaagtaccaaattctcgccgtcactactacataagaccataaatataaaacatccaacatagtggtagggtttatttctaacaatttccacgagtgttggtgtacattcgtatgcaggtggcaaactacctaagttgagaagaaatatacatgaaggaaaaagagaatcaaacttatatccaaacttatggaggtttggacccaaagacccaattaaacacctccaaatgggccaaacatccatagcaatagaatgaggggcccaaaatgagtgtctaagccgaaaaccggagccaacgaagccgtctcgggtttagccgaaccctgacggaggccgctggcccaagcccaagttgcgctgagtggataacgtcctcccaatgacggttgtgagcattatacctgaagaaactgtcatggacacttgtcaataggagagaagagatgctctttggatgcttaagcatctccacattcccaaggcacctctaggcctataaatacccctctcctctccctcattcacacacacacacaccccaaagcatgaactgaattataagaggctctattgtactttattgtatactagatttgggagacagtagagtagaggaagtcggaggaatttcggagttgttagtaatcctctcttatttcttatactttgttaattactatgctttaatacaaatatcattctgagtaattaagatttattctgtgagagttacctcttagttcataatcaatgtatgggatcattgttcagtatagtcgattaagatatagtgattgctttagtgagttataaacactaaagtagttattaattgcgtagacgtggtgtctgggtagttaatgtcacgccccgaactagtcccgaccggaactagcccgtgacgctccaaattaacctgttaatcgataccagtcccaggaaatagtgctggtatcacagggagacagagtatcacaacaacagaggtctctttattatagagtagaagtacagtcatattgggatgcggacagatcccgagctcacaactgcattataaaaggaaagcggaagccaagacttggaccaatcatcacaggcgcgacttgggaactaggccgaaaccctataactcatcgtagccgacttgctcctagaagaactcctcgtcagcaggatccacttcatcttcttcagcaactggggggggattatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaacaacatttcaaacagccacccgggcctagctgatcccgtcagctgctgatttttcaaacatcgaacccagtttcacaacagcaatttcacaagcagtagtcagacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcatacttgtcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgtttctcagattttaagtttgaaggcgaccgtcgatactcgcacagagtgcacgaatatcgaggtgcaactgggtggttacaaggggacatggtataacaattaacaaaggaaggatcaaatgcaacaaattaggtaggtctgccaatctgccttgcagacgggacaacagattaagtgtgatcctatcaatgcataatatttcgcaagcaatataattaaatttcaaatataggctcaagatgttcaaaggtggcttgccttgctcgagatctggagcttgatcctcgaaatcctcgcactgcgggtcttcgggctctgaaactacacgcgaaacgggacaactcaacaaacggcgaaaataaagccctattaaagacctctaagcgtgccattagatagatctcaagatttggggaattttggaagttgaacggagtcaaacggattcacggttgggaagatattgaatttctaagattattgaatttttgatctaaaggaaaaggatttaattaaatcctttttggaaaagaaaaagaaaagaagggagggagggaatatagacttttctcggacggctaaggcgcggcccaagagaaatggagcggtccggccgagctaaatgggccggctggcccaaggcggcccaaactcgcgcgcgcgggggagggaggagagagagagccggtggaccgggctcaccacgcgcggtcccgggtgggacccgcttgtcagcggctcagctcaccgtgcggagggagcacgcgacgcacgcgcgcgggcggggaagggacgcggtgcatgcgcgcggtccgcggtggacgcaggtgacccatctggttgcaccggaaacactgaactgctgacggtccctgcggtgacttgaaagaggtaacactgttaggcgcagtattgccactaggggcacgctgctgtggctgaggtgccggacggtttatctgaggacgaggggcgtagcctggctggcggttagcctgagtgaccgactggtggtattgcatgggttgaccgtagcgagggcgaggtgcgcctcgggaagaatttccctgatggttagacttgcgtttcttgtattcttcggtagcctcttttctggcatcctcaagtagaagtgccttgttgatcatatgttgaaaagtggggaagtcatgagcaagcaactggagtctcattccaactgcgattcctttcaagaatttcctgatcttcttcttgtctgtgtccacttcctcaggggcgtaccgagccaacttgttgaactgacttaggtactcattgatactgctgttgccttgcttaagtctgttgaattcttctttcttcatgtcaatagtgctttcaggcacatgagctgcacggaaagccgtagcgaactcatcccaagcaatgttagtgggttcagggtgtgcattgcagtaattctcccaccaatctgcggcaggtcctctttgttggtgagaggcgtagagcgtcttctcaacaggagtacactgcactaagttgagttttctatcaacatctttcaaccaatcgtcagcctcgacgggctcgacggtctgagagaactctggcggacgagacctcagaaagtctgtcagcttggatctgttgttgcccatgtgagggtggccatttccatgcgcattatgctgaaaactggctatggctgtgtttagtccttgcaagatttgtgtctgaactgccattaagtgttgcatgttggtttccacatgaggtggggaagggaggcgttcttctccagaattgtgactggcagtgcggtgagagcggtgagactgtcccatctctgcatcacgggaaactgtgcgatgcgagcggctgctgtggcggggttgctcaacctctgcattgcgggaaacagtacgatgcgaatggttgctgtggtgagactgctcattagctgatccatgattttcttctggctcaactctaccatcctcaaaaccaaagcgggctggtgcacgagctgcacggcgggggcggctagccatctaaactcccagaagagggcggggtaagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctatcacacggacggctgctgaagactgcctcctctactcctcgtcggcctggctgcctcctgtagtcggctcctcagtcgaagaaacgtcgatcggctggcgcgaagggaccggcggaacctgtcgagggccggcagcagcacgggccgctggcggtaggggagctgggtagtggaaacggaacacagtggcagaaccaacaacacgcttccgcgcagtgcggataaagcgtgggccacggcgggaggaagcaactggggtgtgtcctggggtgtaggaagggctaactgggtgtgggtagggcgagtacactggtgagtacggcgcacgcgagttgggggagcgcgggccactgggagtgcgggcagagccgcgggagctgtgggaggacaggtggctggcgtggcagaggcggcctgagtcccaggagatagtgtcaactgaggtgacaccctcctcggccagacgggcctccaaggcggcgtagcggcgggcaagggagcggtaagcctcaaggagtaggtcgtgctgagtggcctgagcctccgaaagctcaaccatgcgagtcagcactggctgagactcgctgtatggacaagggtacctggcgtctgagtggccagaaggaaggcgtggaagctgccggaaggaggagcctccgagacggtggctgtagtcgtgggccaggcgacgaagcgcagtccaggagaggtcctggtacgcgatctggagagtgggcctggctacagtgaagtggtgtgggcgaaggccagctccgtgtatacctccacgggggtaaaggtacacagagagctcacagtgagggggaacacggtccacggagtaccccgtgtactcgggacacgagaagccaggaaacgggcgaggtcacgaagctgagcgacgtggtgaccctcaccaaaaccgtgggaactgaagctggcgttcactgccatctacaattttgaaagagggagaaagatcagtaaccattttagaaacaaactattgaaaataaagaagacaaaacaaaccttaccttttcgcaagtagttttgaacttggtatccttagggttgtcctaagtgtcgggtttcgccctagggccaagcctgtgctctgataccatctcttgtcacgccccgaactagttccgaccggaactagcccgtgacgctccaaattaacctgttaatcgataccagtcccaggaaatagtgctggtatcacagggagacagagtatcacagcaacagaggtctctttattatagagtagaagtacagtcatattgggctgcggacagatcccgagctcacaactgcattacaaaaggaaagcggaagccaggacttggaccaatcatcacaggcgcgacttgggaactaggccgaaaccctataactcatcgtagccgacttgctcctagaagaactcctcgtcagcaggatccacttcatcttcttcagcaactggggggggattatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgaggggctgcaggaa

SEQ ID NO: 62497 - DNA, 5823 bp, Oryza sativa
  unsure (1)..(5823): unsure at all n locations
ctgcagcccgtctggctaagctggcgccgacgtggcgcctacgtggcggccacgtgggctggcgggaggtagacgacgacccggccgcgaatggacggcgggcggcggcggcgagcggcggagcgaaccacggcgatacgggcaaaagcgtgcacaccgggcggttgcacgtgacaaggggaggcgagccaacggctcggattcgccagaggttgctcgacggcggcggattgcggcagcgacaaccggcggcgggagaagagggaaacggcgacgaggtcacgagaggtcgattcccggcggtgagagcatctatgcggcttcgggactcgacgctagcatcggattgggcggaactacgccgagcgaggccggcgacgagcgggtgctacggagctcgggcggcgacggcggcgagcacacggcgatcgacggcaacggtcggggcggcgccggctaactacggggagtctacttaagctactaccgaaagctagggggaggagatggagcgaggaggaagaacggagagagacactaccgtgcgggacggggcgcagtgacgagaggccgacggcgcgggagtgatctctccggcctcgggccagggaagaggaggaagacgagcgcccggagtccccttccgcgtcctagtgcgcaccggctcctccggcacacacgcgacggctgcggtcggcgagagggacggcaatggcgcgggcgagaaacagggaagaatgggagaaaagggaagggagggcgcctgggtttatagggggcggcaatgtcggtttggaaaccgactttggcggtcaaggcgcgagctggcgctccggctagcggcgaaaacggcgacaggagggagggaggatgacgccggcgggaggaaaaggggaaaaaggagggagagaaaaggggcttgcccttttgccgattcgggaaaagggggagggagcggggcgactcggcagaaggagaggggctctctgcctccgccccttggaggctancgcgcggagtggcgggggccgggcgatgacgacggcgatgacggcgggcggtttggagtggcgcgacgacacgggcgacagacgcgtgcagaggctgacggcggcggcgaccgggcggtcggccactcggcacgcgcgcgcggcttgcaacgggcggcgtccgcgcgggtggcttacgcaggcacgacagagcgaggagaggggaagggggcgctcggcgcggctctgcgcgcacgcgcgcgcggcgcgcgggcgaggcggagcggagctgagcggggggggagggagagcggagcgcgccgggaaggggagagggccgggggagagggggagagagagagagagagagagagagagcccgggagagagagggccggggaagagatgggccgagcggaattcggcccatcgaactcgggggaggcaaactagacttttgcggagggattcgatttggaaggaattggattcggaattgaactcgacgatagatcggggattgagatcttgagatggcacggacactagacaacaatcaaagaaacaaatttcgcaattagggtttttaagagataattttcccgttaggcgccacgacggaacgggcgctacagttaatttccgttgtttgcttcgtatctcatagtaggtttgaggtgggtgtagaggtggtgacagtccttaagtacattgaaatcctccctgtccgggtacgttgtagagccatatctagagcagcgagctggccagcgcccgaagtaccgcgttaggattaaattgggctttccgtagacattgtctctcgctagtaaatcctctctaccttaaaataccttagcttcgtgtccttggatgaacctgaagaagagctgacacacacgttccctgtggaaatcaataccttgcaatactctcgggtgaagtgctacatcttccgtgcgtttgcgttttttatctgtgacgttaaaaaataccaacaaagagtttatttacaaaatactcttgagctgaagtgaccacaaaagtgtcgatttgatcaagcagggtgttgcatgttcttcgcaatgttgttgcactctgagaaacaaatttgggattcactccatggagaagatgtgtgtcgatttgattaagctccatggagaagaggttgcatgttcttcgcaatgttgttgcactctgagaaacaaatttgggattcactccatggagaagatgtgtgtcgatttgattaagctccatggagaagaggttgcatgttcttcgcaatgttgttgcactctgagaaacaaatttgggattcactccatggagaagaggtgtgtcgatttgattaagctccatggagaagaggtgtgtcgatttgatcaagcaggtgttgcatttacttcgcaatgttgttgcactttgataaacaaatttgcgatttactccatggggaagaggtgttgttgctaatggtgaagacaccattgtatctgctattaatggtaaggatccaacctccagtctttgttattagtatgaatattgagggaagatgagttaagagctgtaatgaatttatctgttgatggcagtgaatgtgtaatcttttgattgactgccgatgatgatgaagccttcctcttattcatcaaatgttcggtaagaatcctcttattcttcaaatggtcagcaaaagtagacatatctagcaccactttcctcttatctatagtattcaaccgatcaagcatacccctttcctcctgttgccagcgacaaaccaccggagacaaggaggaagagagatatggggagaggagactggaggagttttcacccgagcgtgttaacgagagcttgagaaagatatgtaactagctagcaagcccgtgaacctggttggatcttgtttagagtacttcattaagtacttttcacatatgacatatcaaatcaatattcatgtgagataagcttcttcggtggataagctttggcagttctgcagagttaggtcctgcggcaaacttggaatgatggtgggacaatagcaagctcgtttgctttgtgggggtgatgggtgtcatgatatatggcaatgacaacattgtagcgtccatttttgacgagataagctatggtagctcggcgagtgtggtgctctgtggcgatgatggcatggtgccgacgtacttgttcgtgttgtgatgatgtaggttgtccaggcgacacttgactagtgcttggtgaccgcaaggcagctgggcagactagttccatcctttttctccactcacagcagaatagaggagcctttttggtggctgcaatggcagtgagtaggcgtggcggtggaagggcgagctagctcagcatttccttgaagtttgctagctcagcatttccttgaagtttgaagcaatgagaaaaagcttgcaacttagacttttagtttttttctttaggttgtttgttttttttatctcggttatgagattagtagtgtatgcactcgtgtaacctttggctgcatatatccatttgtggatatagaggccagatttagcttagccgttaaaagctatttttaataaagagtaaaatacatggagggtcatctaaattgtttaggtgtgtcatataggtcactctacttctaaaatacacatctggatcaccaatgtgaattaagtgagtcatttagctatctaactattctcatgagcacatctcgtacatattgcgtgccacatatgattgaaaaaattgtttgggcatccgtagccgctgcctcttaggatttaacctgctttgctatttaagtttgtcatcgctgccgcttaggagtatgtttccgtcgctctttatattcatgacttgttgcctctgttgctaggttttatgacaagcgagagagaggattgagaactagaagaactcataaaaaaagcacaagtgaaataatttggcttctctaattttgtgtattttcaagtgctagtgctgtgagaaagggaaaaaattcacacgcgattttctgcacatgtccgggagcaattttttcaattataggtggtataccagatctacagggtttgctcatgtggatggttagatgggaaaatgactctcttaactcattagtaatctagatgtgcattttgaaattagagtgatctacctcatacacctaaataagttaagtgaccctccatgcattttactcttcaataaaaatcctaaatttcaaaattttggtattttgtgcgtacgtagggtctagtagactagtagcaagatctgaattaaaagtcattccttgtgacccaaaacctacatccaaaatgtatatctgaagtaaactctcgagattcggttcccttcctaaaaatttcaaaaccctgatgtaaaatttcctacaaagctttcctttgaccttcattcaaatcttcaccaatccatttaaatccttcaaattacccaagaatgagagcttcccttgaactctacccggagaattcaaatattaattttgagtttggaacacttctaagatcctttccttcatctatctacattttttctccagatcatctaaaattatccaaaaaatcctctcataatcccaatcaagcgttatccattgaaattcctagaaattatataaactcaaatatatcaagcataaattcaaattctcagaatatctcccaaaataatttcatgggaaattatcaaactatagtatgcaattgggccacgtgctccctccatctccgtcttctctccctagtgtagcccaacccatctcctccatcttctagcccaactcgatccagcacaactccttccatacctatcttcttcttttttcttttccagaccggcccactggcccagctcgttccttccaggccaacctcgcccatggcaaaggaaaaagtacaccgaaggtccctcaacttgtcatcgaattacaaaatcgtccttaaaccacaaaaccggatacaacgcgcccccaacttacaaaacctgtgtagattaggtccctcggtggttttgactttggttttgtccaacgtggcaactgactcagcgtgggtcccacatgtcagccccttcttcccttccctctcttcctctcttcctctcttcctctctcatccctaaatcggcgggggaggagcggcagcggcggtgattgcggcggtcgctgcagccttgggggagaagaagaagcggagtccgaaggcgacggggtcggcggacagcagcagcagccagcgctcctcctagacgtagagctccatggcggctgcgaccaggtcggccacgcgacactcggtgcgtgccatcacgtgcagcggccacatgctcggctagcaggtcaagccgtgtctgcggccgctgcttcagcagcgagtgtcactgctctgccgcgccgcgcccgtggaacgacgccgaccgctgccgcgacttagccaccgccgccgccgtcgtcgccgccgccgccacgtgccgcagggcccttccttgttgtcacgccttgaagttcccctcccttgctttaaattcataaaataaatcgccagaagaaattgtttaattaaacctagagctaatcctaattaataaatgcaatcaataattggaaatggcatggttgaccttttcttgagttccccatgctctaatgtgctaacaggatttttagtggaattttcagagcctaggaaataattttaaccaactaaaattagcaaaccgcaatattttaatccttggaaattctttttcccttttctcctttctttttcctcctggg

SEQ ID NO: 62498 - DNA, 748 bp, Oryza sativa
atcgtcatatgaaaaatctcttgactttctatagatgatgaggagatgacgagcagaccggtgagcgacctggaaaaatcccttcgcatgtttgtcttggagaacgaattggtaatgcccgcagaagtctgcgtgaagctagccaacttgtatgccatgctgaaacagtgggaaaaggttagggagtacagacaaaaagcggcagaattccacgcaaagacgagtgatgcgttgttcgacacttccactgtttagtactacctcttttaatgtatgacaccgttaactttttattcaacgtttgaccatacatctcatttaaaaaattcatgcaattatcatttattttattatgatttaattcgtcattaaatgttctttaaacacgacataaatatttttatatttacacaaaatttttgaataaaacgaatggtcaaacgttggtcgaaaagtcaacggcgtcatacattaaaatacggagggagtatatctgtatatgtaggatgttgactgtcaaattgtgagatgccaagatgatcaatatatatatatttttgaaatctagccagccgagctggtttatattcagaaggaaaacactgtacagaggtcacatatatcccatacatcggattccagagttgcactgttccagagatggcgttgttcgagcatatatcccatacatcgtaatcacacggggtttgctcgagctgctgcgccctcaagaagacgggctgcagga

SEQ ID NO: 62499 - DNA, 712 bp, Oryza sativa
cagagtgcaacaacattgcgaagaacatgcaacctcttctccatggagcttaatcaaatcgacacacatcttctccatggagtgaatcccaaatttgtttctcagagtgcaacaacattgcgaagaacatgcaacaccctgcttgatcaaatcgacacttttgtggtcacttcagctcaagagtattttgtaaataaactctttgttggtattttttaacgtcacagataaaaaacgcaaacgcacggaagatgtagcacttcacccgagagtattgcaaggtattgatttccacagggaacgtgtgtgtcagctcttcttcaggttcatccaaggacacgaagctaaggtattttaaggtagagaggatttactagcgagagacaatgtctacggaaagcccaatttaatcctaacgcggtacttcgggcgctggccagctcgctgctctagatatggctctacaacgtacccggacagggaggatttcaatgtacttaaggactgtcaccacctctacacccacctcaaacctactatgagatacgaagcaaacaacggaaattaactgtagcgcccgttccgtcgtggcgcctaacgggaaaattatctcttaaaaaccctaattgcgaaatttgtttctttgattgttgtctagtgtccgtgccatctcaagatctcaatccccgatctatcgtcgagttcaattccg

SEQ ID NO: 62500 - DNA, 6367 bp, Oryza sativa
tgatgtcgtacgaaacaagaagttcttcctagtcctagatgatgtgcagcataatctgcacagccaatgggattccctaaggtcgacactggcaagaggagcaaatggcagtgttgtattgctagtatgtcaatcgaaagaagtcgcaaatagtttgggagcgacagctcaggttccaatgggttacctgccatctccagtgctctggagagtatttgagcaccatgcatttgggaatcagaaaagagcttccctcgagtcaattggtaaaaaggtgctccaaaacttgcatggattgcctttgctggcagaagcaattggaaggcttctgagacaaagattagataaggcgcattggcaaaaaatttcctcgagtccctggtggctcttttctgaagatgaagacgatgttgcgctaccttcagtggcaattatgtgtgagcatctatgtgatcatcttagaaagtgtttgtgctattgttcaatattcccatctggttatttgtttgaaaagaatatgttgattcacatgtggatagctagtttcatgcaacaacatgacgggattgggatgaaagaaatggaaaaggaatggtttgatgagcttttccgccgatcattctttcagcccacaatctggaaaaataggtacatcatgcctgatatgattagaaagccattatgttccattgctggaaaagaatgccatgctgctagtgagttgggagaacaggaaaggacggctccaagattaccgccacctagccatcagttttcctgattttaatgtgcacctagacttgagaaaggacaacaagttgcggaccattttgctttttgatggtcgcaaaacaatcaaaccacacgaagcatttgctaatattctgtcacacctaagtggcctgcgagtattagatttctcttacagtgaagctaaattggagaaggctcctgatttcattaacaaattcacacacctaaggtttctggatctctcctttactgggatgacagtacttccagactccctctgtaagctgcacctactacaagttcttggattacgaggatgtcagttcaaggagttacctagagctataaatgagttagtgaacctccggttcttatatgcagaagctcacacggtttccttgatatacaagatagggaagcttactaatctccaagggttagatgaatttcttgttggtagaatggatgggcacaaaataacagaactaaagaacctgaatgaaatcagtggacaactatgtattggaaatctggacaaagtagcaagcacagatgtagtgagtgatgctgaattattcaaaaaaaggcacttaaagaagttggtattcagatgggggttgacagcatgcaaaccattagccgaagctgatggtttcatgagaactcttgctggcttaaaaccaaatacaaatcttgaagaactgaaaattcagtgctacatgggagttggatttccatcatggatggcggaagagcagtacttcatcaatctgcggcgcatccatcttattgaatgcaaacaattattaacacttccacctcttggacagctcccatcccttgtagttttaattcttcaaggcctaacagcaattgagaaaattggatatgaattttgtggaaaaggatacagggtatttccatctcttaaggaggtgacatttcttgatatgccaaattggaggaagtggtcaggcatagaagaactacaagatttgcaaattcctccatttccacagcttagaaaggtccaaatcaagaattgtgaggtcttaattgacatgccagtatgttgtttaaaagcgtcacttgaggagcttgagatctctggttgtaatgaaatatttgcctgtaatccaagctgtttagatagattgacttcccttgtgcgcttgaagatccaccattgtttgggcaaaatttatcttccatgtcgattgttggagtcaattgaagttttgaatctccaaagatgtgaagtttatttccagggaggtaaagaacatttaatgaaattgaggaggactgtaacaaatgatgttcatgaattgaatttggatgaatcgaaagcaatcagtacagagctgttagttcttaaactttctgaaggtatgttcaattatttctttgtccaaaattactttggacaaataatttatgaaatagtatcttttatattcctgtgtctatattattggtttagaccttggaagtatagactaaagcttctttgaattgttttatattttcagggtatcactacttgtcttcatgctttcttaacaaatggaattttgaagcatcttcagtttcctgaaacaagttggtctgatgcaaagttagcaaggatgaaagaaagtttatgctactgcttttagggcatactttagtgggttcactctcattatacaagctaaaatttgtataggtgagcttgttgaacataaggtgcttctgcagggtgatctaggaggaacatgttggattttaagaggctaaagtggaggatttaggttttgttgaatcacttcaagtaggtttttccatgttgatagccaggccggacagaacttatcaaattctagggtacttattaagcattagttcattagggatgctgattaagaattctgcttattaaggttctggctccgatcagcacttgcaacaaatgctgcacattttagtaggtaaaggtgcaaaatgtgcatcgtgttgcctccgatttgtagttatgttcattacaatgaattagagctgagaagtgcaacaaagatgaaaagtatcaagaagttgaatgaagaaggtttgctgtttgcaatccatttttttatgcattgaaaaatagtttaaacaaagtagttgctggctagctgcggactgcggtcttgttatcgtcttatcctcttatataactagtataaatttagtacaaaaaatgcctagatctgtgaatttgcactttttcactctgacaacccaactagtgctaatttggtctagattccttcatctgtgaaagtgtgaatctgcccttctctgacgagcattttttttttttgagcaaagggcagagccctccatttccattaaagaaacgcatgagttcttacaaaaaaaggagtcttggaaaaccagaggggaagaacccccaggtgctcacaaaagaaacaaaaacaaaacgaaagccagctagcacaggccttagagtttaagctatctctccacaactcatctcatttctctccaattcaccattgtgtcctcaactaccagctaatcttctttgcctgatgcgccatccgaactgcgagttgaagacctcatttgccacttgttttagcagttgtgctccccattgcaaccttccttgtctttcccccgaattctgcaaaacagcccaatccgacaaaaaggaacaagcattgtatataatgtcagttgggttatttggtaagatttgatcaaaacaagccttatttcttgctttccaaatgcccaaattatagcagccacaccaactagcattagttgttttgtaatttgtcacaaggttgaatccaggaacttaaagcatgtctcaagtctttaatctgattcataccaaaagcacaaatcacaacattccaagtgaatctaactaagggacggtcaaaaaataaatgttgaattgtttcttctgacgagcatattactgttgatttattgcctatatgcatagattagtgaatttgcccacatctggcttcacatctcttaacaatcagttcgaacatctgctaggatgtgtgaatgatacatttgtgttcccatttggtttctgacgcaggggcacgtaactatcgttctgaatttttttttattttctctttcctctgcaatttgctaactacaatttaccatgaaaaagatccagttcaccagcatgaacaaggaaaatccggaaattccaacaacattcaaccctgacccacgaagaagggtgcactggcgaaacatgagatgcgcaaatagcgtggcgtacctcagcctttcggcgttcgtcatgtcagggagagccgtggcctcagccgccgccaccgccagcccgcccgtcggagtccaattgaccgtcacgtctgagcattcggaatggtcgatcctcagcccacgcaaaacctgccatccaacaggcaaggttaaatggaaagggaggcgagagcatttcgtcgagcgattggtgggcacggctcacctgccgcgtcggaggccggagaggcaaccgcaaggaagtggagccgtgccactgcccacccccgacgcttgcgccgagtgcacctacccacgcgccgtcggactaccgaagtaagccgcccgccatccaccggacgactcctcgctccatcccgccatcgccgccttttagaagagagtcccggtgttctctgccagtagaaatctaaatttatatctagttttatttaggataccacctattaataatagaaatatgaaagggcataactgttaaataaaatatgaacgcggaaagctaaatttgtactactcttttgaaaactagcaatgcacaagtaaggatcttctaccctaatgttattatcattacagtcattaatatgtgtgtcatatttttttattgtactacatgtcagtttctgtaatgataataccattatattgcaggatgtgaatccacaatgtatgaacaccatccactcccctcgatcggagccgtcgtcaccgccgccgacgccatccattccttcccaatctccaattgcagtcgccgcctcgttgcttcgtttcctccggacaagggccatggaattggccggcgcatcgccacccacctggtctagtggtcttggtcagagttctgaggttttcttgtcacgcatgtgttagctcctagctaacctgcaaattagaattccactggcctcctcatccgccgtcgtcccgcctctgggccgaacgcgaattacgcacaagcatgcgttgtgtgcgtccgtgtacatgcatggtactaggatagatctggtaaaatctcctaccagaagaaatgaccattgtcaggtgcaggagaagcacagccaaccacaggtcatgttcagaactatctcattttgcaagctgaaacatgaaaattgaggttgaacaagcatctcgcttacaaatcataccattgaacttgcacaataacatagactacaaacaaagtactaactgattgcaggtactaaactgctattaactgataatacattatctaaagaaaagtaactgataataatctagaccacaaacgactgaggtggtgtttggatacatagactaaactttagtctctatcacattgaatatttagacattaatttggagtattaaacatagattacttacaaaactaattacataaatgagagctaattcgtgtgataaattttttaagcctaattaatctataattagcacatatttactgtagtattacatatgctaattatggattaattaatctcaatagatttgtctcgtgaattagtccagggttatggaatgagtttttgttaatagtctatgtttaacactctaattagtgtcaaacatccgacgtgacatgactaaaaatccgatccaaacagcccctgaatatcctcgaactagctttgcactagcactgggaagccgacgctgaggcagacgtcaggtgggacgccgagacggggaggtcctcaccgttgccgtggtgacgatgtcgccgcagggcctccgccgcagtcatcttatcgcgatgtccttcgccgcgtccgcgtcctcgccactggcctcctccgcgatcggctgactaccactgtcgtaccaagctagcacagccttaccgcctgctagctacatgcgcgggcctggccgcctcgactggcccaaccagcccaatcccttcggctctccgtcgactacctctccgcgctattgttcaaccccctcgccctcaccatgtggaagtccgtcggcgtgtctccacctggtcgatccctccgtgtcaacccccagcagcatcaacctccaccctatcgaggcaggcgcaccttctgtttgaccacgtgcgggaggacaccgcgacaagatgacggccgtggaggctctacggcagcatcgtggacgggaacctaacatggaggtagcagaaatcgaacaaggatcgaaccggaggatggtgatcgaatgatcgataaggtccggagagggcggcggagcaggggcgaaggcaggccagctgacgaagacagtcccggttaactgggctcggccctggctgctgcacagccaccgc

SEQ ID NO: 62501 - DNA, 3213 bp, Oryza sativa
acaacttatatgtccaatatgatataatcatagaactatcatatagtgtaatgtacggaatttcagctcaactcgttataatgaagataaatttattcatgaactggtatcagttttttaaagataggtgacctatgaatttgtatttttttccccttactccttccgtcccccccccaaaaaaaaaaaaacaaaggccaatatggacagacctctctatttctaggttggctcttttttttttttggacggatgcagtatatgttttcaattgaaactagcatggttgcgcgggccagtattattatattttctctcgtataataatatatatatatatatatatatattctcaatgtattatttaaatatattaaattcacaacataattttaaattttgtactacctttacgaaactactaatgtataatattcatattgtattttatatacgtattagttattaattatttgtaatatcaaattttagttatttgtaaattatattcctatatggattctatactcgtctttcaattttttttaatttcgaattttcgttatctatatagactctaggctcttcttccaatattatttatttttaattctgatttttattacttctaattgtatttctacgtgtactctaaactcatctttaaatattctttaattttaaattttgaaatttagttattcgtaaatcgtactttttatactgaaatttctgaaagctgctgactgtgtgtaatgttgtatgtatgggtgtatgtctacgaatttgtagttagctttgtaaattcttatatggactctatattaatgctgaatttctattatttcttaattgtatttctatatagattctagtctactcttccaatatttcttattttttaattccgaatttcaactagttctaaattgtatttctatatagactctgttttttctttttctccgattaatatgagaatttgtaggccatgagagcgaacgtggaggctcctttttctattcctttaataagttaataaatacgattacaacatgctatcgatttcaatgattatttaaaataaaaattaatcatcaaattgagctaaataaaattttatcaaagtaaatactttgtgtccaagtatttttagaaattttcttgaaattatttgagcactagaagtatttttcaaactttagaagatcattttgaggattaatttaatcagagaagtaattaaaactccctctcctttcgggtcagaactggaaaagtatgcttttcgtccctcctccaaccgacctagtcgcctcctctccctcccaaaagtccagccggcttccctcagcccctcctctctctggcgtttgggccccacacccacagtgcgtcgtctttaagctcgggatggagtccttatagcacccgaccccatctccaggcaatccgactcgattcggcctctctattgcttatcctctaaaattgatcacggaaaccaaatccccttgatctcctttcctttttccctcaactaatttcgaaaaatcttgaggatttgggagaatgaagaccctgatcggtgaaccaatccatgtgtactactaacaactaatgtactagtaccactgctctatcttttgctccaacaatacatatatatatataagaccaagcagcccaccccctgcgtgggccacgaatacggagaacaattttactaaaatgatgcaaagcctagatattatttcctggaacgtgagggggctcaattcggctgcgcgctgtaacacgatccatgagcttatggcagacacgaagtgcagcttggcatgcttccaagagacaaagctacagaatatagatgacggtctcgcccactttttaggaggctacaagctcgacaaatttgcctttaagccagcaagaggcacgagaggggggatcctcctcttatggaatagcgcagtctttgacgtccaagaggtccgagtcggccgcttcttgatttcggcgcaagtgacggtcatactcacaggggccacatttctgctcaccggagtttatgggcccacaaggcaccacctcaaaagcgccttccttcggcacatcagaagaataaggcccggccccgaggatggatggcttatccttggagattttaacatgatctatcgagcaagggacaaaaacaacagcaacgtcaaccttgcacgcatgagacgctttcgctcaacaatcgatcgatgtgaactgcatgagattcccttgcaaaataggaagttcacctggagcaatgaacgacgaagggctacacttgttaagttagatcgctacttttgcaacgagacttgggacttggccttcccccaccatgtccttcacgccctacccacagggccttctgaccactgccctctagtcctctccgacccccaatgtccatgtaggccgagtgccttcaagtttgagaacttctggacaagaattccaggattcaaagacaaggtcaaggatgcctggtgtcagccttcgtcacacacagagcctatgcaccacctaaatgaaaagcttcatcgcaccgcgacctgtcttagagaatgggcaaaaggaatctgcaccgaggccaaactgcagtttcacatggcggtcgacgtcattaaaagactagatgtggcacaagaacatagagacctctctgcccaggaaacaagactaagagcagccctcaagcgtaagatccttggcctcgcttccattgagcgggcaaggaaaaagcaagcctccagagtaacacatatccgtgagggagatgcgaacacaaagttttttcatctcaaaatgaatgcgcgaagaagaaagaacaccattcatcggctgaaaaaaagacaatggttgggctgtgacacatgaggagaaggaagcaacgatccatgaccattttgcgagcataatggagcggccggcgccaagaccaaatgagctaaattgggatgcccttgacatctcactgattgacctagccaccctaggggagcccttctctgaacaggaagtacatcaagcaatcaaggaaatgccaagtgacaaagctccagggccagacggcttcaccaggattttctttaaagtctgctgggaaatcataaaggaggacgtccttctggtcttcaactccatttacaatctcagatgtgcaccctgaat

SEQ ID NO: 62502 - DNA, 1851 bp, Oryza sativa
ctaaggcctttgattcagttcactgggattacctgctagccttgctgcagcgaaggggtttcccaacaaagtggatagattggctgggggctttgctatcaacttccacctcccaagtacttctcaacggcttgccagggcagcggatcaagcacggaaggggccttaggcagggggaccccctatcgccactccttttcatacttgcgattgacccccttcagcgaatccttttcaaggctatagagctcggcgcaatctcaaaaattcgggggagaacaactaggctaaggatctcaatgtacgcagacgacgccatcatcttcattaatcccacccgaggcgatgttacggccttcacggacatcctgcagcacttcggcactgcaactgggctcgtcaccaattttcagaaatcccaagtggcggccatcagatgcggcggcatcgagttgaatgaggttcttgagggcgtccctgtggtgagggcaaatttccccatcaagtacttgggcctccccctagctctgggaagactgcggaaggtggacttgcaacctgtctttgacaaaatttccagaagggtagcaagctggagaggaaaaaacatggcagcggctggaagaactacgctcatcaaatctgtgctaacggcgcaaccaatctaccttctgaccgctctgaaaatcacaaaggaatccctcgagcagctagacaagcagcggcgccgcttcctctgggcaggcacgggtgatattaccggagggaaatgcaaggtcaattggacaaagacgtgcatgccgaccagccaaggaggattgggggtcctaaatctggacaaattcacgagggccttgaggttgagatggctgtggcatgaatggaaggaccagaccaaaccttgggtggggctggagacgccatgtgatgaaatagataggaacctcttcgccgcctcaacaaacataacaataagggacggaaacacggtgcgattttgggagtctgcgtggattggtgggtgaagacccaaagacctcatgccacttgtctttgcgatctcaaaaaacagaggaaaatcccttcggcaaggaaagaaggaggacgcctgggtgcaagatttgaagcttgattcacaatcatctatcacagtcgacctcgtcgaacagctagtcgcactgtgggaagcggtccgaaatgtgcacttagacgttggagaaccggatcagattacttggaagttcacaaacaacgggcactacacggcctcctcggcttaccatgcgcagtgctgcggggcgccgagtacaaacttcaattccttgatttggaaagcctgggcgccggggaaatgcaaatttcatgcttggctcatcattcagaacagagtctggacttcagaccggcttgcgaccaggggatggcagaacaatggttgttgccctctttgccgccgcgagactgagacggcattgcacctcgttgccacttgtagatacaccaagaggatctggcacctcgtctctgcatgggtgggctatcagcagatggacccaacggaatgggaggaagcccggtcagtcaaacagtggtgggagaacattgcaaacacgcctagtgtcccgaaaaaaggacttcgatcgctcattctgttagtcgtctgggaaatttggaaagagaggaatcggcggatttttgatcacaaagaggtggcaacgaacttcctactaatgaaaatcaaagaggaggcgagcctttgggctttagcaggagctaagcggttgcgtgagttaatcctgcactctgtatagtgtactagtgtacagctatagtggttctccgttttccttt

SEQ ID NO: 62503 - DNA, 6112 bp, Oryza sativa
aaaacggcgcgaaccgcttcctacgaaaccgcgatcacagtaccagtctcaggacatagcgctggtacccacagtgacaaatatgaaacattgcaatccttaaatttaatagaggacttatttaccttaacttaggttgcagcgcaggacagcctgagaatataaccgacgatgcggacgaggaaacaccaacagcagcagcagcagcggaaccaacgaactaacacccaacaccacaggcgacggctgggaaccaggacgaaaccctaatcttcaattcacttcatcgtcacttcaaggcagaggaactatatatatttatatagagcaagggtgagtactttcgtactcagcaagtcacgggaatttaggtgtttgatgcaagcttggaagagaggcaaggttgttttgcaaatcctttattttgaaatcattttgaaatcactaagtggtttacttctttctaagtttgggccgaaaagagacttgcgtctcgattcgactttaagagatgtttttcaacaactcattaggtaatgtaccgacctcccaggtcagatcattacttctcggctcccagagccatttcacttgattagtcggctcccagagcctttttcattttctgggactcctagagcccagctgcccagcagcacaacaatccgcttccactcgggaagcctagtctatgatgcccgtaaacatcccgaatcacacagattcgtttcttgaccactcaggttatccatctgccacataagctgattctggtaacgattcccaaaccacaacaacttttcacaaagcacagacaaacaaatctacgctacaggaaacacctcacatccgcccatgaccatgggcacggctgttcgaacagttgcggcatatgcagctgctcaatatacaggcatatgcatgagatcaatctacatgcatacgaggacaaggactagcatgggagaaaaggaaacactacatgcatgcttcgatgcctgctagtaattaattagcacaactaataaccagaacccacagagttttggtctgtactctgtaattgattggatctgtgacttagcagtgcttgtgcatatgcctgaccgattgatccgcacgcttcttgccttttgggggtaaaatttgtgcacaccatcggtgaatatattctacgtgttcaattcaaactgttgagaatctcatcgggttgatgatcagatcaaatggatatatatctgtttctgctctatatgagaatgagatagtgcatttggatagtaaagatgggcaataatgagctcatttttttactcagcgcacttctttttcctcaatataatatcaatactgatggtccattttctgctaaaagtatacctcagtagcatggccattaaaattttctttcctttgcaatggactatggcataaacataactgcatagctgcatatgcatgtcttatgaagtaattaaaaataactgatccagccatgaacaacaatgccttatgcgctgccataatttatgatccagcattagatctgagctaggaggtaatatctgaacatcacttctgctatttgatgaacatcatattttcatcatatatactttctttttccagatttcctggtatatattcacatatataaattgtgtagattttagtagatcttttcagttagagcatgaaaaatatcatggtttttagatggctgttgtaggtccaatgcttctcttacaacaaaagaaacctgctatatattcacatatataattgttatagcttcatgaagaagaaatcaaggctgtaggatgacgacgttgctgtgtaagaatcgtgaagaagaaatcaaggctacaggatgatgttgctgtgtaattaagagtcatgagagaacatgttgatataaagggggagaattttcaacaccttgctgcaaaaataaatttgaaggttcatattaccgtgacttgccttcattgcaatggcttttgtctctctttttttatttttttttactgaagtactcatttttcactcctgtttgcttttgttaagttccgccaccgtatagaactaattaagacacgtggttcaatatctggaactaatttgtaaatattttgtggaatgtcgtaaacatgagccaagcttttaatatttgtggccattaggatttgaactctggtgggtagagtcatgcacccaccactctaccaccacactactagtgctttcccacactactacaaaaaccatttttcgtggcggctattttgggctttcgcttgcggcatttggcgctgccacaaagcaaaggccagtgaaaatgtagcatcttcgctgacggcgataaaccgctaaaggagataacttttcgctggcagctagctaaagacagccgctagagaaaatcatcttcactggcggctgccttatgtgggccgccagcaaaaatagccttcgatggcggctgccttatgtgctcctccagcaaaaaatagtcttcgctggcggcttcattatgtgggccgccagtgaaaattattttccataaaaaaaactaatccccaaaatctctttttgccaaaaaaaaagaaaataaatcagattttcgcagcatgtacggattcaaatccacatccaaattttcgagcatcgattcaaatcctcatccagagttcattagattcaattaacatggaagtgagcacagcatacaagcattttgaacatgaaaataaaaagaaaaacagcatcaatagaaaagaggaaggaggttgtcggcgccgtcgccgaccgagcagcccagccactagcgagaccgtgggggggagggggaggagctcgccacgccccctgtcgccattgtcgtcccgtcatcgcgcccccgcccctcgtcgctgttgccatcccatcgtcgtcgtgcccccacgacagctcctcccgttgccgctgtgcatagtgtgtcttacctagtagtagtaggaatactttaatccctattgcctcctcttctaccacattgtggatgcctcgtgccattgatcccatggatactagtacgagctgtccgtgtaggttgccttcttatatattagtatattcatgtgatagaggttgcgagcgcagtaaaggagctagagcaaattagaggatgtgcaccactattttggtattagagtactcaacggtaataaaataagtacatctattaatttttaacatcgataatttgatataagcaacgcaaataataatgtaagaaataaaattatagcgatgaaagtgattatcaaaatgggaaacccaaatgataatattagttagtatagtttagtgaaaaagacaatagaaatcacaaataaatggttacccaaactgaaaaactatacaatttgacatcattgtcttagaaaaaacatagtttaatgttaaaaaaagggaatatccaataagataaatacgatatatttaatttgtttattatatatatattactgatagctcaattacatgtctatataaatattacatattttaaaccgtgtggctagtaacacaaaatcaatgtagcgagtgaggagacggcaatgctaaatattcgcccccatacttaccgcattaaccacttaggtaggatacataacttcgagtcatgttacaatattatacctcgtcatattatttatccttattagatctcgccatattatctacccttattagatctgacataatcattcgatcttgattcgatcagtagaggtgacacaatcattcgatcaatagaggtgacacagtaaaatagacggtagtggcggcggttgaggagtcggcagaacacctaggcatccatgggctttggccgcggtatgtgccgttcgttaaatgttaaatgttgtgtgtcacctacaccatagctgcgacgacttctattgcagtgaagatcagcgtgcccttttataaccgtttaataagattaaattattacagtctttaataagattatctcaatttgtattaaattattacattaacatatattgtcccaaaatgtagatatttttgaggtgaccatgagtattaagaaaattggtgaaaataattagaggaaagttgtgattggttaagaagaggaagtaggtgaggaaattaaatgaaaattggtgaaaatgattggaggaaggttgtgattggttaagaagagcaagtaggcgaggaaattaaatgaagaatgattacgattagttgagatctaatcacaatcaaattctgttgacgcacgtgaaaactaggcaataaagttataacaccgagcattttgataaattactttgctcaaactgggacctaacatcaccagcagtaaatttttgaaataacattcatctataagcaaaattacttccaaacatcactttggtcgttgatgttaaaaagaagcaaaattattttcaaaagcattgtttcaattgctgttaaaaatataaaaaaaaacttttttttggttcacacctactcacctgaggtacgttttatcaacttatcatttaatgcttttttagtgagcaacaactgtaaacagtaggctgtattgatataaacataaccattattgggttgagatgtcaaattctgtatgttctcttcaaaaaaaatatgtatgttgcattctgtattaagggagtgtgttcttatctgagatgtttaagttcttcaattttttgttcagtatgggagttttcacagcagatggttaatggtttcaaatttttggggtattttacaggtgtttgatggctatggttatacatatgaagtatgaaggtccatggttgatgcttggttgacttccccagcagcatccacaatgtaatcaggagtgcattttggcaggtaagttctatagcaagtatctcaaaatgttattctggtggtactcataagattcagagggtttgacctcagggaccataggatatgtcccttgtgctgccgcatccgccgtgagggggagaagggagggccaagcaggaggagagcgggcatggcctggtttcacgacagacgccaggaagaaggaggttggagggcgaaagggtttatgatggccgcaacttgatgccttagcgacagctcaagcagtgtgatggtggtgtcatggcctccagatctggagcgaggaggttgtggtggcgcctcgggttctgaccttctgtaagctccttctgcccatgtaaagtttatgtaaagttctctcttgtgtgatgtctattcaggtcctcctccccatgattctttgtgactgtgttggatccactcatttcttgttaaagattgattctgttggccgtgttaagatttattcgaggcacaggctcttgcttcagtttatgtgatgcagaatgttggagaaacaagaatgattgtcctccctccagggccctggtgtgtcgttggctgtatatttatgcaatcgatttggcctaacaaaataataacgtaatatgatataaaatgtgttcccattgcaacgcatgagtgaaatttcacatggtattcaagaattcaaatttgaaatagtaatatcgatctaaatttgataaaaaaatgtatcaaaatttggtgaaaaatgtcatatagctcagggttggcgtatgacctaaatcgaaaaggtgtacctcggctacaaaggcttagttgtgtctggattatccaaaattaatcatgccatataattcatttaatactttatatcttttaatttgtaaacaaaatatcatttggtaacaaaatactagctcactagctctcaggctcatatttatctttgatgaatcatgaaagggctatcggcggggtaaatatcgagctttgaacatgatttcttttgattcccgttgcaatgcacgggcacacaactagtaaaaggtaatatcttgaatgttcttatttatcttaatttattgattgtattgtactttttatgtgattaaaatatataaatataatacgtgccgtgtttggttgtacttatcgagcgaacatatccgccccatcttttttataaagctgcgtccgccactgactagggagagag

SEQ ID NO: 62504 - DNA, 4044 bp, Oryza sativa
cagtccggctctcctctccctcagtccctctactctcccccttccagtagtcagcaggcagtactacctccttctataatcaagttctttatatccatgattagctaattggggatatagtaatttgtatagattaccacgaaattgtgcgccgcaatgaacctcatatggcatttttgcatggtgtgatggttgttaggagattgaggaatgaagaagtcgagcattgtatttctttttcagaagcatgaagcaaaaaaagttgcatcttgtgatctaccaatcccacctatttgttattttctacttgtattgaaccatttagagttatatacccgtatcgtttaccagattttatatcgaatcatgatgtattgcatttagatttttttcgctaggcctaccctgggttcaaatcctgggtccgccactaggtacatatcgaacaaccacaattcgacagagtacttgttgaactgcggttgtttaacagggaataaaaaaatatcttaccgaactgcccctgttcgacaggggataaaaagtgatagaaaaaaaaggagatcaatcagtgcgcactgtacactaccgtgcatgcagatctatgttcgataggcccctgccatgctctttcttgtcctttttctattttttaagtgaacaacaatcctgtcgaacaactgcagttcgacaggtacatgtcgagctgttcgacaggtgttaaatttgtaattttagccgatcaatttctacttttacaatttttctattaaaataatattattttaaaaaattctaaggtgtccatcttcttcttctttttttttcacagttcaaggtgtccgtcttgggaaactattctaatccctcgaggggatgttccctcgtttgctcaaaaaccatctaaacaattatgaaaaattttggaaaaatttgacaacattcatacaacacatatatataactccacaaaatcttaagtccaaactcaactcacacgtcgagatataaaaaagacaaattcagcatatgaatagtagcgtactgtttatatataaatttatcttttttgtttctcaatgtgtagatcgaatttgaacatgaattttggtggactagtaggtatcattatactctacattgtcaatttttttcagaatttttcacaactatttgcatcgaatttagaagaaaaagatatacgagggatgtcccatcgagggattagaatccactcccgtccgtcttggcaagtaattaaaccgtactccacacgtggcaatgtttggaattaccatagcgccatgcatgcaagggcgcccaagtcgtctccactaactctacgtgaaaaccaaataacgcaacgaatgtgatgcgattaaaaacgacagcaatctgctcgtgcaatttaattaattaacgagattgatcaattgatcgttgcttcttctaggcagagtgtatatatattaatggtccatgtggagcaacttgaactgcaattggtaattaagatcaataaaaccatcgccttctgaggacaagtctaataaaagagtaattaagcagccatctattagatgcttacatgttatttttatataattaaagataatataaaaattaaccgagccattattttttttctcgacgtgggccaagccttggttctctctcgtaggctatctaccaatcacagatgatcttttcatgtgggcccaccttaattatctctcacctaatttttttcaccaatcaatttagtcgaccccttctctatctccactccctctttcttctagcaatgcaaaataagttgatatcaacggctaatagtaggcatattttccctattacacttgccctaacagatcaggataattttctaacggagaaaatacgtcaaaaattttattttttgagcgaatagaaaaattaatacgtcaaatttgtgactgataccgacaagtgactactgatattttatgctaaggccagctatagcaggaaacagctagagagagaagaattctcgtcgcatacgacattggaaatgaaatggaataatggaagaagctccgcaggttcatgggattgatgactaccagagaggcacggaaacaccaccggttcttgctgttgaattccaagcacatgctttctagaattccagaaccccatgagagcccagttaagttgagttgatctcgacgacgacgacgacttctgttgatcgagataaaacggttgggagatattccgagattgagtagtattcaaagctattgatatgctgattcttcgtctttgaccaccttgggttacttggaaaagtattggggtttcatctactagctaggttgtttgctctagtaggagtagtactgtagtagctaacttggtggctacgcagggcatatatgcatgttgctagaagatgattagtgtgtacacacgtttcaacgaaattaattgtgcaaattaacgaagatcatcacttcattagtactccagtagtttataatcaatagagtaactattggtttctaacgagacaaaatactcaatgttttaaagcaaagagagtactgtattatattttctctcgttgaaaaacagtcacaaagttgtttttgatgcgctcacgtgacacgtgtgcactttgcatcccgttcgttgtatccgaaaccctctgaacacgcatcatgtctggaacaatcattgactaatctttccgattaccttggggatcaccacccgcgtagccgcctagctctgaaccccagcagtagttgaatcgagtcattgctttatgatgcactgccgtcatctatgtatcttttagggtggtcaaagtaaacaagttctgtcgttgaataaatatatactgctgtccagttaactgtaatccttccgtttcagattataagtcgttttaactttggtcaaagttaaactactttaaattcaactacatataataacctagaaccagataagacgtatcccagtacttgcatattcgtagtactagaatacgttctatccgattctagtttgctatattttgggatggagggaatataacctaggtacacagccaatggataattgacaaaaagaatcctataaataagaagaaaatgtatctaccggaaaacatatcatttctaaatagtcactgctaaaaaacgattttccaagaggccaaaagtggttttcgcgtgcggacctccggtccgtctacccgaaaaggtctgcgaaaatccaaattttccgtgcaagtggcacacccgcacgcgaaaattagtttttcgcgtgttgatgcttatgttgcccgcacgcgaaaacaaaaatacgaaaaaaaataaaaatcgcaaaaattgagctgctgtcgtcctcccgctgccaccgacaggctcctctcgccgccgcggccgtgctcctcccgacaccgccgcccactggatctgcatgggggatagccggcagcccgttgcccaccaccgcgcgccccatgctgccttcgtcgctctcctgttggctgccgcgcgcgccagcctctacagccgtcaccccacgccacccttcctgataacaatctggcccaggtggggtcggccgaggcccaacaaattaaggttgcccggaccccaacaattctttggcacacccactcggggaaaggcccaatctccctaaaagactagttcaataggggaagggtggctctcccttttaaggtggcttcctcctcccaagctaagtaaggtgggattattcagttcagaggctcacacggtcgccgcccgactttgtcgtctttgccagtggataatagtggaggatgtcctcatcacttctgccggccactgcgtgcctctgccgccgtcaccccacgccaccttcaccgtccttccgccggccgctgcgcgccagcctcttctgccgtcacccctcgtcgcctgcactgcccttccgccggccgccgccactctcccggctaggagagtttgagagagggagagagagagagagaaagag

SEQ ID NO: 62505 - DNA, 2633 bp, Oryza sativa
gcaatataaagaggtccttgtacaagaaaatcatttctgtagtagtgaaccattgcgacaattagctagcggtttctcaacatgaagatgtggtttgaaatcattgtgaacattcgaaagccacccagtaaacaaaaacgtgagacattggttggggggggggggggaatagattcctcaatctatcatcgtcgttggcgaaaggaggaatagatgggtgtggctcactactgttcgtccgatctaacaagagaaagacccttttttgcagtgacgactggggatcgagatcgaggccttcagctgtgaacgccagccgtcaaagtgagagctgaaataattcaacacttttgatggtgtggccaaacatacagcaaacgtacgttagttagctagccagtattacaaaatacatttcggtcgctttcaagttaattaatttcaacggtgaatatatagcttattccgtggagtctagctagtgtgaagaagtaatagcttttccatacgttgacaagtctccagctattcttcttccttcattgttgctaaattataggagccatttctagaagcagaccctggaaaattggacttagaatagcgtgtattgagaatatatggcatgcctgttagataagttaggttttatctagtcatgtgtccccggcatcttcttaattcttatctttatctaaaaaaaaccttcttaattcttatattaattatattgttgtatgcaaaacagcataggtcttgactgaagaaactaagaaagaaaacctgacctagtttcaacagatttatttttttttgaaaaaaaaatggtcatgcatgactgatcaacggccaagatagaagtgtacgttcagtacgtacatgcaagctagttaagcttaattactcgctatatatgaactctagaaaaaaatagttaatatcaagagtcaaaattttgattacgtcccaagcatccagaatagtagaaacaatctacaagctagctcttgtaattaattaaaagcaccattctagaaggtcaaaattaattaagaacagcggattcccctacacacacgttcttaactactattaactccaagatgcgcgggatggatggtttatctagagcatggattcataaatttttgtgtacgtaatctcgtatattacgacatctttcaaagctagatgtactataagtaagatcgatctctgactcatgaggttttcattatgaatttaacatatgcattaataattaattaatgcactaccacagtttaagcaataacatcacgtatttttataaaattatttggcgagataaatccagcaatatatcattcagtagtccatcacaactaagtactatccccgattttaataattggtgtcgttgacttttaaacgaacctttgatcatatcgtattattcaaaataataaattgtattattatttattttgttgtgagttgagttatcattaaatgtgctttaaacatgatttatatttttcatatttacattgattacattgaacgagacgaatgatcaaattcatgttcaaaagttaactgcgtcaacgatcggcattccttgcatttccaatatcatcaaaacatctttctcatgctactcctagtccttggcactcacctcctgtaaatcattctaattaaccactgaaccttcctacgtcgcctcgagccaattaattataattcaattgatttgatcaattaaataacgacaacgtgcatttatcttcccgttaattagttcgttctccaggaccaggaaccttcccttcaaggcttcaaatctgcagcgtattatataacacatccggaaaattcacacggacaaatgctgacgtcgacgtacgtaaggtcactgtacccagtcatacggtgcggctgattaatccaactccctacatatataaaccccccatctcccgccaagcctagcaaccacacggcgacggtcagaacgaacgcctcgccgccgtcgatcgccggcggccggaactatctcgcaaagtaatcgatcgaaggtatcaaaagcatcatctgagctgagctgagcggcggcgcgatggcgggggagataaccccgtcggggagccggcggagctggctgtcgtcgggggcggcgtcgctggcgcggtcgctgcgcgacggggacgacccgttccggcggtcggcggcggcgagccggcgcgacgccggggacgacgaggagaacctgcggtgggcggcgctggagaagctgccgacgtacgaccgcatgcgccgcggcatcctccgcaaggcggtggacggcggcggcgacggcgagggggccgggtcgctgttcaaggccgacgaggtggacatcgccaacctcgacccgcgcgagggccgcgagctcatggagcgcgtcttcaaggccgtcgaggacgacaacgagcgcttcctccgccgcttccgcgaccgcctcgaccagtaagcataaaaacttttcttcttcttctcagagaccatatttacgtgaggactgtggaggggatacgagcgggtcaactcacgaacccgtttataggcaaatgagtggataacccgctggctggcttgcgggttacctacta

SEQ ID NO: 62506 - DNA, 1756 bp, Oryza sativa
cggcaagctgagtcatgacacgaaaacccgtagattactctttatttaacatataagtaaattcgtgagtcggcccgcttgcatccctgtgaattttaactatttgaatcaaaatttattgtgaatttgcttcgttgatttgtagggttgggattgagctgccgaagatcgaggtgaggtaccagcatctggacatcgaggcggacgtgcacgtcggcaagcgcgcgctgcccacgctgctcaacgccaccatcaacacgctagaggtatatacacatgtacatcgctcagctcagctcagctctctagtgtgatcactcaacaagttggatgtgaagatcagtggcgccttaatacttaatttggggcgtacgatggattttactgaaattttaaagggattaattaagaaaactgaagggtatgaaaacatttttgtctcttaaaaaaaaagtcattggatgaagccactagataagtacatcaatcgaaacaagtcaagcatgcgcagtacaaaaatcaagaccattttattgtccgactctggagagagagattagcttaatttggagctagtagattcttgtacgatgtccactagcttagctcacgtatgactgtggggtccaccgtagaatcttgataaatagtaatgcgtaaaacggccggtcgcgggttctcgcggcctgcaaatttggaaggaagctcatgtgttcatgctgatgagtggcgattagtcgccggttagtcaaagcacgtttttggagctgtgttcggtcggtagtgtttggaatttaaagccctcacacatgtagaacagttctagtgactccttagcttataattaattaattattagttatttttttaaaaaataaattaatatgattttttaaaaacaactttcgtatgtaactttttttaaaattgtattgtttaatagtttaaaaatcgtgcgtacagaaaaacgggagaaaagtttgggtggtttcgacctttgaccagctagctgttagtctgttaatgcccacgccctgatcacaatgcgtgatagaatttctgacagacaacgacgcctatagaatacacaatgcgtgatagaatttcgcggctagcaggtcgtcgcacacccgacgaaaagtcccacaaaactgcacacgcatggtacgtacgtagaattagttagtactagtcagtaaggatcaggtttcccagaccgccggcggtaagcacgattatcacgcggtaaccgtaaaaaaccgtgtaaaatttatcaaaaattcaaattatttttcaaatttatttaaatttaagggggttatcgtggttttttattactgtaccccgcggtaagccggtaaccgatggtaatgtaaaccctggtaaggatagatcgagttgtactcggctcgagatcttctagaagttatagtgtactcacgagatctttcagatgtggtaagtttctggtgctgggtttaagttttcgcgtctacgcttacgcaaacgacaccacacgtacacacaccggccggcagaaaagtttatgagatttccatatatatatatatacagtacttgccaatctcggttggtatagtacatgtactaagatcacggaaggaaagggtgtcaaagtcaaacacatgatgatttccccttgaaacttgaaagtgcacgagcaaaaatttcaaaacaaaacaaaacaaaacaaaaacgtgcacgaacacgaagatgtgggcttttaccaaaagcc

SEQ ID NO: 62507 - DNA, 1969 bp, Oryza sativa
ggcgatggcggcggaagcatcccgcttccgtcgccggctcgccgccgctgcggcggaggaacggcgagggcggcgcttgtcggccacgcgcggtcagtggtggtgcggcctctgcagctctgctcccccatgcgtcggtccgcctcgccttcgcctcctccagtaggagccgtcggttcgtgtgtttctccccccattccgctctcgatccgttcccttctccatgcgggaggggggaggggggggggccggttgctgacgccgtagaggcagacggcgccaccaaaaggcctagttagggtttggttgattgatgccatcgaacattcccacacgatgtggctatcggtttggagagggcgtttcgttggtactaatactagtaatctgaactagcaaagttcattggtaatttttttttaatctccagttgttaagttttgacgagcagactcgattttgctgatttgtggttgtagtggcagaagttcgatgagatgctacctaatgcttagcgtcgcttacttgttacttgctctggctcaaacgttgttttttatgcttcatgacagggtctcgttagcctatttatctcgtcgaacaagaggaagcttaagatactcaacgatgttaatggcattatcaagccatcaaggtacttggaaattctttgatactcagctatggaacgttttaatccaatcgttaatcatttctagtcttaaatggaactttatgtttttaagctgcattctaattctaactagtttgataaactatctgtaatttattaagtaatttctattcccaagtgatacagatatagatatgatctctatgatttatgcagacatggttactctgcaatttaacttttttccccttcataatagatttgaagcatggcctgaaaattcagaaagaaaaaacgtatacatgcaaacatcatactgtagtaattacccacaaaaaacagtgtaaaaatatgatcctatgtctactgcaaacattatctgtcttatttgtgcagtgcagatatggtcattaattaattttaaattagtgataactaaatggtttctcttatattggccatcccttttcccatcagtaacaaaatgaactatctcatacattaatacatatcatattgttccaattgctattgctacagacctactatatccttcctaacaacaagttccccctgtcccctctagcattcttgctaaatgattggttgaactatggctgataagccgtagaaatataaaagaagaaaccaaaaatattttgaactttttgtctgtattattcatggtttaaaagccatgctggaaaatagactgcaatgaagaaaaacctcaaaatcacctataaaattatgtttcaaaattcaattttggctatggatgataaaccatcaagcagacaataagagttatttacaattgttgcattaaactacttgtgtcaggatgactcttcttctcgggcctccatcgtctggaaaaagcacacttatgcgagcactaaccggcaagcctgataaaaatctcaaggttttgatatttcttatttagtttaatgtagccacctctaacagtagagtcgtaccacatgactaatcactcgatggctacaggtgtctggcgagatcacatactgtggtcatacgtttaaagagttctatcctgagaggactagtgcttacgtcagtcagcatgatctgcacaatcctgagatgacagtaagagagacactggatttctcgagacgatgccttggaagtggtgccagatatgatatgctgtcagaattaacaagacgggaacgtaatgcaggcattaaacctgaccctgagattgatgctttgatgaaggcaactgtagtagaaggaaaacagaacaatattgtcacagatcttgttctgaaggtaacactgtttgactttttacatgttaaaaaa

SEQ ID NO: 62508 - DNA, 1675 bp, Oryza sativa
cataaatattgatggtcttgtaaatcaacgataatattcagcattcaataatttacagctgcatgaggaatcttgatattacattactgacacatttacatcctaagattggagttctgtcattgttttgttgcaggggagatgctcactggaccagcaacagctttgttcatggatgaaatatctactgggcttgatagttctagcacatttcagattgtcaaatacatcagacaggtgacccatgtgatgaatgctacagtgatgatgtctctcctacagcctccacctgagacctatgctttattcgatgacatcgttcttatagcagaaggttacatagtctaccatggaccacgggagaacatacttgaattctttgagagtgctggttttcggtgtcctgaacggaaaggagtggccgactttcttcaagaggtgacttctaggaaagatcaacagcaatactggttccttgagcaggatcattatcgttatgtgtcagtcgaagagtttgctcagaatttcaagaaatttcatgttgggcaaaagctgcagaaagagcttcaagttccctatgacaaatctaagacacatcctgctgcattgactaccaagaagtatgggttatctagtctagagtcccttaaggcagtgatgtcaagagagtggttgctaatgaagcggaattcattcctcttcatattcaaggcctttcaactgtttgtccttggatttataaccatgactctgtttttgagaacaaagatgccccacgagaaattttctgatacctctaaatatgttggtgctttaactgcttctttgattacaatcatgttcaatggttttggtgaacttcaattgactatagataaactcccgatattctacaaacaaagagacttcctgttctttccagcatggacctatggacttgcaaacatcattctgaaggtgcctttatcccttatggaatcatctctttggatagttttgacatattatgttgtgggttttgcacctgctgcaggaaggtaacttttctattttcttttgctttcctaggtatattatttttaatattttctataaacagaattttctactagtgattgacttgatgggtttgtctgtgatctgtctactgatttcaggttcttcaagcagtttcttgcatacttttggacacaccagatggccttggccttgttccggttgctaggtgcaattttaagatcaatggtggtagctaatacatttggcatgtttgtgctgctacttattttcctctttggaggatttctcgtttccagaagtaagtgtattgtcgtttgaagtgtattttaattcttttgtccatatgattagttagaagcattgtgaaaccctggaagattcattataacgttttccctaaggtttatatcttattttctctgaatattcgaaatattccagtctgaactactaacttatgtttcttattttcgtttttgacatttatgttaaaagaggacattaaaccgtggtggatatggggctactggacatctcccatgatgtatagcaataatgccttatcagttaatgaattccttgccagtaggtgggccattgtaagttttctgtcaacacaacccttttctttccagaagcatagtattttctttgc

SEQ ID NO: 62509 - DNA, 745 bp, Oryza sativa
cggatctggtctcccccgtcgttgcggcggcagatccggcctccgccgtcgtcgcagcggccgaatccggcccgagctcatggcggctagcggcggagaggaggaggccacgccccaccgccgcggagaggcggtagaggcgacggcagccgacggcggtggagaagggaggaagaaggtgaaaccgagagagaaggaagagaggcggcggaggggccacgcggtgggggaagggagaagggagcggtgggggtgggggacggtagatttatatattcgcccaaaactttttttgcagcggtcctccttacctactgccagtgaaaatgagatttttcgctggcggacgcctaagaggtccgcctagaaaaactggcggacacttaagaggcccgcctcgaaaaatagagtagttttttaggcgtttctcttagcgtggttaccagcaaaaattggtttttgctggtggtccgtagccccccacctattgttatgtttttgttgacggtttttgcatatggccgccagcgtaaattatagggtaacatcatgaaaaatcgttttttatagtgtaaaattgttatgatgataaaatgtgtattgcggactatgctgatgatgtcactcatctgaaaacagagatagtaacaaggagtgaacacgttacatatgcccacttaacccttacgaaaatgtattcgagaattactaatctaaatgctccactacgtacagtacatcgtcg

SEQ ID NO: 62510 - DNA, 739 bp, Oryza sativa
catgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaa

SEQ ID NO: 62511 - DNA, 3103 bp, Oryza sativa
tgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccccgaccccttgtgggttttgcgccgcgtgtatgggttaggtgagcgcagcggggctcacctaaccgcatttattgcggtttgggtgagcacgtcacgccacacgtaatgcagtacagcgcgctcgttcatccggtctgtgatcagtcacagaccggtcagatcgtgggttaggtggcgacaggcggtctgacgcacgcctcgccccatcccgtcaggacgagagcctccaagcactcgtccctagccggagccggcgtgttacctcctggagatggcacgttggttccggtcagatatatgccaggcttcatcctaaccattacaggcaagatattgtatgaagaagggcgaacatgcagattgataaactgacgcgtggtggacaagaatgaccgatttgtgaccggtctgacactggtcatatcgtcagcagacagccatgttcccacgtcgcgcctgcttccggcggaagtggaggtaggtgtgggctgtcccatcagaaggtcattcagacggcaaccatacaaatctccgtccatttatgaaaagataggataagtccccacacaaaagagagagaggggtgcatgtggtatccccttgaaatataaaaggaggaccttgcccatagggagagcaggcttgggttgggactggaccttcccagatcgggaacccagaaggagggagaggctggctgatactttgtagctccttcatacacagatccaccaaaacacaggagtagggtattacgcttctcagcggcccgaacctgtatacatcgctggtgtttcatgctctttcgagaggtcgcgatctttccacatatagacagagcttgggatttcaccctgagcccccggccgaaccggcataggggggcctgtgcggtctcccggtgaggagcccccacactccgtcacggttggtaacacaaaccgggactaaagatcaaatatgcccgttacccttttgaaccgggactaaagatcatctttagccctggtttttattgcatccgggactattgtggaaatcggccgaccgacgaaagatggtttctccaccagtgatacatgccgatgtactagcaacgatataaatttaacatacactataaattgttgcattgcgtttgtatatcataaccagacaacacagagaggcagggggacgtagttttttgtatggctgcgaatcagttttgatatatattactatctcatataattatttgatggttggaacaatataaatggcttatgtttatatatagacaagattatcttacgattcgcacagttttttatagggagtaattttcacgcctcgtgtttttatatatggataaaaaaatactatatgaattggaaagggcatatttacggtgactctaatttacaggttaagtcatagacttatgagcattcgtatttacggctatttatccttttagtagtaagacggcgtatttgtcaacaacgagatgtccatataacttgcgtcaactagtctagtttttttaatatgcttataaagatatggtgtgtgtatatgttcatatcggtaagtgtttgcgttgtactgtgtaattctaaaaaaaagtgagctaggtagcgttacgagtatattgttgggaaaattgatctctcggtttgaaagatcacgctagaccgttttccacccgttgtctacgcaaaatcagagcgatccaatctgttaattcccgattaactatgcgccgtgatcggtggcacccaatttatttcctattgagtcgcccccgattccccacagtgctaaatataaaaggggaggccggcccaacagtagatgacaatctctctcggtctcaatctaaacccaatcaacattggcgctggaggggaaacgtgtggcggttctaggatagtgtaggtggcaaccggaaggctgccgctaccccgcaaccggcgttctcactgctacgactacttcccttacgccgacgatcacggagcagttcgagggacttcatcctctacttccactccggttgatggtattggagagggaacaacaagaatcgcaacggtggtttcaaataacggtcagtaatcgtaaaattccgtattagggtgatcatgtttagactaagcactcatgttaatagatcagtagaatctacatatatgtgttcgtatcgggtttctagaaaattttacaacgaatagggtaatactccctccgtttctaaatatttgacgctgttgacttttttaaatatgtttaaccgttcgtcttatttaaaaaatttaagtaattattttttttcctatcatttgattaattgttaaatatacttatatgtatatatatagttttacatatttcacaaaagtttttgaataagacgaacggtcaaatatgtgataaaaagttaatggtgttaaatatttagaaatagagggagaggaagtactgatatacggagtaatcagcaaaaagatggaccatagccgtcgtgttggactcctccatgtaagacgacccggaacagcgaaaagaagaagcgcacgtaagaatcggcagggtcaaagctagtttctcaaaaaaaaaaagataataagaataatataataagaaaataaaaagaaaaaaaatccccatggagacgaaacgtggacaaaaatcgcagccgtcacgtccatctccgcaagaccgcggcgccaaacgggtcaaccacccacctctcttctcctcatccccatcccattcccatttctctcgcgcgcacggcgccgcgcgcgacgcgagacgcgacgcaagccatcaccaacacaaaaacatggcgtccaccacctcctcgcccacgcgcgcaccctcctcctacccgtaaacgacacccacaccgacccgcctccgcctgcgcggcgagaaaaccc

SEQ ID NO: 62512 - DNA, 3215 bp, Oryza sativa
aaggaaatggaataaggttggtacattgttcttctataatcgtgtggttttcattttttctggatgtgttctttaggattatagctgaaccataggtagactgtgcactgaaaaattgttacagtattacaagttgctgctaaaacagtaactagcagatgggttcccacaatccaacatatgtcagagcatgcctgcagatcactgtttctgaacaatttagtaatgctgatacttgttcatatgtttttatcggtgctctagctgaacagtgaaatggtgtccttggttcttggtattgtagctgaacagtttttatctctcttttgttttctgacagacggctattccaatcctaattgggacgaagtttgatgacttcgctcagcttcctcttgagatgcaatggaccatcgttaacgaggtacgtttattaatagtttcttgcaatcaaaatattgttcccccttgcctttctttggttcttggatatgcagccttcagcatctccaatgtttgttagcatagaaagatgagaccttttcttggttctgacgatatgggtttgggctacacatgtttcttttatctcaaacgctgcaaattaaccagataggtcagaactttaatcttgaattagccttttcatggctaccaagtgctaatagcaaatcagaaatattcgaaagccaaccatcccctgaaaactcccattttgaggttcagatttctgaaaactgctactgaatcaaaattttctcatcaaagatttgagcttctttctgtaggccatgaacacgaaatttttttagcttgatcgcatctgcaattaattaagaatacctatgtgaaaacgacaagagagcccaaatcaaacctgaatcgagtacagcatgctaccaattatgtttgtgcagaccgtgctgacctgatagcaccatatatgaatgcctattactattgcaacattgaatacagtggaccttggttgatcagggggagcattcgttaagtaggcccaaacacgtcttgtcttcgtcttcgtctccggggaaggaggctcgccagtcaccactaacaacagccgggatgatcgagtcaaacgatagaaaatttattaggcaatggatataatttctgttttgtttgtgcccatttgtttgcatcttgtccaaaccatacgacgatcatcgatccctgtgggccttacaacatacagaatgtagatcgatggtcactaatcactcgacatgctaaaagcaaggaaaagctacatcacaactaaccgaaaataactcctcgtgctactgggagccctcatgcttgaaaatgtagttgcgtttcttttcagccacagtgaatatcagttcactgaaaagtttttgtaactaatcctagaaactactgtttgaccaggtttaattctgacaaagaattcgagaacacaaaaccatatgcttcgcatttggtttactgttgttaaaaaaacatgttgtattcgaaagaaactcctctgatgtaatgccctctgacatgtgggtccacgagttatgggctccatatgtcagtcccttaaagtcggaggacagtaagttagaaggtttttttccgttgtattcttgtttctgatggaggattttttttttctgaaatttcaggccagggcatacgcgagagcgatgaaggcgaccctcttcttctccagctcgacgcacaacatcaacgtgaacaagatcttcaagttcatcacggccaagctcttcaacctgccgtggacggtggagcgcaacctcaccgtcggcgagcccatcatagacttctgaagactctacacccttacactgacaaaatgctaggcaaaaaaacgtacacgagcccttccttccctccccttcgtcgtcttcctcctgacctttctctcccggtaatggaggccggccatggccatggctgagcagaactgagctcttgcatgtacatataggtgaaagaaaaaagaaaaaaaaaagaaagaaaaaggatcaagttgagttcgtcgttgtcgaggtgttatcccttcccttgtgcagtgcaggcaagggcagaagaggaaaccgtgagatgttgtctgtaaccctcgtcacagtgtatagtagagtaggagtttaaccgatccatgtaatataatcctcaccgtttttttaacaccagttttagatatgggtactcatcgaaccattcgatcagtttaattttttttttttgcggggaaaccattaattcgatcagttcatctaaagtctaaatgaactaaaatctacatagtccctcgtttcaaactaagtatatgtccaggcctccagggatacttgtactacttctatcctaatataagagcatttttagacgtgagagaaaaataagaagagaaaattacctaaatgttctatattaaacgagagatgatggaaagtgcgagggtaattgaggataagatttttttttgactaattcaccaggagggagagattccccacctgaatatattgcgtcaaacgaaattacacagggcaggcttcacctacgcaagtgcaggaaccctggaggataatagcaaaaaatacacggggagtcctgagaagagaatacaaaagagaggccaccttcccaaaataacagcaattgaagtttgcacttgcaagaaacccaaccgaaaaccagagcaacctaaagctaacaccctagctcatcaacaaccatatcgttatgcaaacttggaaacgccagagtccacgccggagggcctttttgccacaagcatgtcagctatggattaacggcaaccaaaagactgaggaagtcataaaccacccgcattaagccgtcaaaatccaacttaatcttgttgctgcttggatcagtgcccgccgacaccatttgggggaaggaagcctcagagaagggagggccactaaaggttgcggccatagagaccgcccgcatcgagtcttcttcaatccgactataacaaattgctagctagttccacgccctccaacgcccttttagggaaggaagcctcaaaggagggagggccgccgaacaatgtggttgaggacaatccaaggaaaagggtggagacgaagagggagctggacaaaagataagtggtagaggggggaatcctacagctgaaagaacgtcaaccgcgtcaacagggaaggctgcaagaatag

SEQ ID NO: 62513 - DNA, 1503 bp, Oryza sativa
ttcctctctcgccactcgcccatcttcctcttctgccacaactcaatcttacgcccctctggccgcgcatctcctgttggattctggcatcgtgcctctagttcaaatgagcactcctctatttgcaactcttttaggttacctggcaggctgttgggtggtattgaatacatccagtggcagtacttcagagtgcacctcctcaaggatgacagagaggacaagctcgatgggagtgcatggcacgaataaatctccagctcctgtagagatgtgagatactgaagccacttcttagtaatgcttgtatggccctgtactatgtcaaggcgcaggtttcggagggagggagtttggggaataacaaattccagacctactttttgcattgtatcgccacccaaggtaaggtgggtgagagaatgcatagtgcgatcgatttgagttggggattgcttgtcttcttgtgctgactcttcatttgaatctgtaactactgtagaacaatcaataatcagtatattcttcaggtttttgatataccacagtccacttttaatgcacacatctccaaaaccttggatatgtaggtactccaaggacatcaattgtttacatggaatgattaatttgcacctccggctaccacctacctctaaacgtgtcagaccgtttagcccttgcaaatacctcgagaacgtatcatcatatggatcacaccacttaattattatctctttcgtggctaaacccaacgactcaaaaggcacctttctcaatttttcacatgaaagtatcttcagcttttttaggttccgaatgaagtcactactccctgcatatgtccagctctcccaattctccatatattcaaagcttagctcctccaaggaccaaaagaccacgtttgaggttccacaaatatcagagtttatatcctttattgacggcaaaccatccaacttgagtttttgcagatgctcaagctgtccaagtggagggagaacgttcaagtttttgcaccaacttatctctacaacccgtacatgcttgagctgccccacccaatctggaagttcaaatcctgagtaaccatacagttttagctcctgcagatatcttggaggagacaaacacccaagtatcgacttggacagatcaggcaaagtataagaccatcttaattctaaagctgttatatagtccttctcaactatgttagcttgaagtgcctctgcaggatcagtcaccatctcaaggtgtgaaatacaaagggaaccacccaaatcgttcatgtcacttagctcagttatcccgtgaccttcttctgctttaatatggaattcatgtagctcttgcaatttagttagcttcccaatgccattaatttgagcaattgtgcctgagctagcatgcaagtgacgtaggttgattaagaaattcatgtctccaggtaatttaccaaatgtacagcctctcaagccaagaacctgaaggtggcac

SEQ ID NO: 62514 - DNA, 2404 bp, Oryza sativa
acaatgggaataactgccggattcgaaggtatgtaacagcactgtcatgtggatgacgaatatattctaccttttgctcttttcattttcggggtgtggggatacttctattgcttgctgtgtccatttagacatatcaattttatgaagagtttcagtaatccaacccttatgaggaacatgtaacttctcagcttcttccctaatcttaagtgttatttctgttggtacatattgggcattgtccaataccatgtctcttatcatagctatttcctcatcgcgaccaataagaaagtcatcaccaaggaaagatttgtcttggcgagtcatggcaacagaagatgaagctatcttatcttccttttcatctcctaaggcactctcattcaggggtggtgtgtcaactatagatttgccttgagaacatgcactggcaagtttactaatgacgtataccattctaatcatgtttctgtcatcagaggagagccaattcataacatcagagattgaagagtcaggagctttcacctcagattccatgtcgtcaagaagtccctttgcatcttgtgcagccttgttcaggtcctgcagccatgcaggggcaggcttgacccgctgcaggctgtccagacggaggaagcgaagcttatcctccaccacatccagcttcttcgtagttctcttgaaggagtcgctacttttgcccagagagcggcggagcttctggaccacttcgctgatctccaccgagagaagcacagcaggatgctcatatccaagatccattgatgcggaaacgtgtttgtcgaacttttgaggcaagagttgggggtgcagggctaagctgccgtgttgaccttacctctagtatctgatggaaccaaactttttatttagagaattagagggggcgtggggcctgcttgtgttaggctgagctggaccagcacattgtccaagacatagcataatttatttttacataaacatatacccctctatccacccgtataagcatctatctattatatattattaaaaaaagccttgaaagaagacacaccattcgttatagagactagaaaattctcacattagttggagaaaaaaaagaaaaatatcttagtcgtcagatcatattgggtttggattataatggtatagattgattgatatagctataaaatacaattatatctacaaaaatataagttgagagttatatataaagtctactgcgttcgttgggtggagaaagagagagtttatttcgttttccgcgcacacatttcccaaactactaaacggtgcgttttttttcaaaaattttctatagaaaagttgctttaaaaaatcatattaatccattttttaaatttaaaataagtaatactcaattaattatatgctaatggctcacctcgttttgcgtatcttcccaatcttctcaatccccttctcctcaaactctctataaaaatagaatttaagagttaagagttatatatgaaatccatgaattatagaaatactccctccgtccaaaaaaacagtgaatggatgcgacatattctagtacaacgaatctggacagatgtatgtctagatttgttgtactagaatgtgtcacatccagtattaggttgtttttttatggaacggagggagtggaagctaaaagttgtatatgaaatttatggattataaaaatagaatctaagagttgtatatgaaatccaaatgctcatagaaatagaagctaagagttgtatatgaaatttaggggttacaaaaatagaatttaagagttgtatatgaaatccagatgctcataaaaatagaagctaagagctgtatatgaaatttaggggttacaaaaatataatctacgagttgtatatgaaatccaaaggctcatataaatagaagctaagagttgtatgtaaaatctacggattataaaaaatagaatctaagagttgtatataaaattcagatgctcatagaaatataagccaagggttgtatatgaaatccaaatagatttctacatgcaatgatatcttttggggcaatcctctagttttattataagagtgctaagttttgacttaactatcaatagcaaaaaaaaaaaatcataaaaattcatggcataaaaaggatgttgttagatttatcattaaacaaactatcctaacatgcaacttttttaaaaaaataaattatttttatatatattattggtcaaaatagtacattgaagatcgatcatgtgaaagtctaaaagtacttatatttgtggatagagagaagtgggcttatttgggaaagcttatagcagcttctctaaaatcaaaagctcctcaaatattacagcttttgtccacattctaaa

SEQ ID NO: 62515 - DNA, 3797 bp, Oryza sativa
ctagccttgtcttctttcttgaatcttgatcattattgattttattgattattgattgtattttttcttctttcctggctattgtctcctaggactctagccttgtaatttttctcctgctctattcaatgaatcttcgcgatgtctggtgcggatcgttcaacaaccagatttctggtgtgaatcctagtttttaagacaattagtggtctatgaggaatgcaaaaaaggtttcaaagctatcgactacccccttggcttcattttcaccccaactagttcgggcccacacctcacccaccccaaggaggcaaacaagtatgtttaccgatctccttaatagccgtaccaagggataaaacttgctatattttgggacatatgaagtattttagaaggattggtttaacaaaatatgtcttcacaaaaccatattttgcaggttagcatcttaatgcatactataaggtttcaccagtaatttttcaacaaaaaaaaaatcaaggccccttgcagtttacaatggtcaagatggatatgtcagtttcttctcaaaaacttagaaactacagtgctatattttggttggctttcccatttccaccacacctatcatccatttcaggagcaatgattttcttgaattttgcagttttcaggttactgtgtataatatattaagaagttggtggctaatcttgaagaacaaaacaattgagtgaagaggccacggtgtagcaggtaaacaagttccctgactaattgcaatctcggaccataggaagagcaagaggaaaggcaaaccttttaccatcagatagtccacttctgtttatgttctttttacattatgctgtaatctgatatctacaggtttcttattgctcctattaatatagcaaaagcactccactggattttcgaaaaaaaaatactatgtacttcctttgtttcacaatataagatgttttaggttttgaatagattcatgcatggatttatgtatgtactccgttcttcatttatgtgtccaaattaatatgtatatgtgcgactctagacgagagatggagaagccaaaatgtctaataatatggaagagagggagtattatattttctatcaaccttttagctctcagagttacccttttttcagaatcattgacagagtgaggtacaatgtacatgggaactgctagtctgtagattgttcgttatgtattcagaggctgcacaaatagacctgaatgtttgaactatctatgatttgaagaattcgcccacttgaaacatgggaccttctagcaacatgaacagggttcacgcggagattagccatgccacaagaaagataaacatagcccgtattaccacacagaatgctgtatatgctatattatacacaaagagccgaagaggacaatcatatttaatactgagaacggcaggcgcgcgatggggggcgtaccttaattccgagttactccatcagaaagataccactgcattgtcatcgaataggacggctgcatgccaccgcatgattgcggattcccggccacttcagatgatcaaatcgacgccttcatctgtccgcacctggtgcagagcgaagagcggagtcagggagaagtgcgcatttcgtcgagcaagtggcgagcaccactcacctgggcaaagagacggcccgcagaagcaaccagcggaggagaggagggggagctcgcctgcatcacctaggcaccgcctgcctcgtgaacgccgacacggttcaggagcccgtagaggtagaggtagagcggctagggccatcggcctccgccggcgtgtcctcactcgggactcgggagagggcgtgaggctcgccgcctcgcgcccttcggggaagatgcagaatttttattttatttttctgttctgacctttattgacacgtctcacgcagcaggggttaggccttgttcagataaaaaaaaattgtggcaaaaaatgtcacatcaaatgtgtgatattaaatagaaaaaaaaaccaatttcacagtttacatgtaaattgcgagacgaatcttcttttttttagaaacacaatacaaacgcagacgctcacaacgtgcgcacactcacccctataaacgcacacacgtacaccctacccctatgagcacctccgaaagactgagccgacatgtcttgaaattgacgaagtcaccacaggcgcctcgctgtcgacgggttcgtcgcctaccactgaaagaataattagccgtaaatgcgagcacccgtgtcaaatctaggatttgaacttggatgggctggttccaccacaaggaacctaaggaacttttgcgagacgaatcttttgagcctaattatgtcatgatttgataatatggtactatagtaaatatttgccaatgatggattgattaagcttaataaattcgtcttgtagtttacgtgcggaatctgtaatttgttttattattagtctacgtttaatacttcaaatgtgtatccgtatacttaaaaactttatacccaaagcactaaacacacccttaggatttctttcttttaactttacttgacggagttgcattgcttcagctcatttagccgtatccaaaatttaaaatttgaaattaaagttaaatttcacattgatgttttaagtcgttaaaaacacctataaaagttgttcctataaataatattttatcgctaataaatcttttggataatcagttctagacgaactgatggtcgactataaagaaaagacaattatatacataaaatttgtagtaattgaactacatactgagaaatttcggctacttcttaggtccaacaatataagcatttctaggttatttttatcagattataagttgaggtgattaatatggcaagtactcattccaacctaaacttgacttgtatttacagctaattttatatgttataagtactggacaacacgcccgttgagatcgaatgtctggtgacttcataaatattaagatatctagctcggtttttaaagatacttataaagataaaatatacatgtgtgcatttatagaagtttaggatcaccgtgcacgctcacttttactgattccagattcatatctgaatcgtcgaaagtttgtgcaagtcaaaatcttcgccgggcttgtccaagttgatttagaaatcatcacaatcaaaggcatgctaacatcgattacaatttacaaaacgccatttaggtgatctctcagcctgatgtttcctcagtcatgtacaacttttaaggggcggaggcaaggaggcaagcctagggcagcttgggcataagccctaggcttgccaccataaacttgcctaaatccttttaaatcaccatgtattttttttagaaagccaatatcctattagatgagccctacttaagccctaggcgtagaaaatttctggctccgccacttaatacaagtacaacagctctgcaaaccgcagtcaattccattgctcttcatcgattctttggcttttaaatcactcctggaacaaccatcagcgctatcagttagatgctggatcatgatcaccaattttacaggcgaatgcggcagcagacatgtcagatgttacatgggaacttttttcctgacgctttccaagtgcttcaggtgtgaaattaacccccgatctcctccgatttctgtggagaaagattaaccgaacaagaaccaacaactagctagcatgatgcgtcgatatagcttgagagaggagccaactgccggct

SEQ ID NO: 62516 - DNA, 1939 bp, Oryza sativa
ctggtacaacatcaatacaagttaattagcatttagcatccacaatctccttcaaacgaaataaaaggcacctacaaatcttgaaggccaaatgttacttgatcatgtgtttaagataagctaagaattcatccaaagaaacgcattagattactagcatattgcccatgagttgcaaggatattttaattaaagaaaattattattaacccattattaacatatatcatcttttaatttacatatatatatatatatatatatatatatatatatatatttgttaccgacatatgtattctctaggctccacactatctttttttcctttccataaaaaataaggagttggtggtggtggtggttgacatatggaccatacatttccttttttttttccaaatagtagggagttggtgttgagagtggtggcagattcaccactcaccactactctctcttttacaggagtatcgatactgttcaccaacactagcacccattttacctgctctctgttttgttatttttgaacaagttgtgtgatataactacaacagcagaaagcactaaggttaatatcagctcacttgacacgcgacaagcacaatccaaattccagaatctacacaaatacaagcctataatgtgaattgtcattggtatatcgctggataatttgattgtcattggaatacacacacacacacacacacacacacacacacagagagatgtaaacaaatcatcaaactctaccccaaactaaaaatttatcaaattatcaaagcaacatatcattggatcattggatgtattccatgtttcttctggaaaatgaaaaatcaggctaaagttggttcattgtcaatgccttataatatacatccaagtcaaactccattgatgcaattatttggggattttttttcaaatttatttgatgaccacgtaattaggattggcatgataaatggtacagcatgtatgaatagtttgctttgatttaccgcagtaataagagggacaacaacagaagtagtcagtgacaaattgaataagactgaatcaagcagtactacagtagcatgagcaaattaaaggaagttaaaaagaaagaaaacgtactagaaaaaatggtcaaacacttctacacaagaatacctttacacagatttcggaaagctgcacgctgaagtttcacagataaaaattctgtataatatctccattcacacggatataaggaatatgagcaatctttggccagtaaaagcccctactcttgagccacacatcttcattattttccagttcatctgaattattcttcagccagtcctcttcttcattctctaaccactctcccttatcgttcagatgatctgtagcactctccacccactcttcctcatactttaaccacccttcccagaactcacatgttttcttctgtcggtactcgtttatcgtctctttatgccattcccctctcttcttcttcacccatgtctctccatcttccttctggcatcgtgcctctagtataggtgagcatcctaatatttgtaactctcttaggttacctggtaggcctttcaatggtagcgagtgaatttggaaacatgactgcatatttaacttcttcagggatgacagagtgaccaagtttgatgggagctgccttagcaggtagcaacaagagaactcaagctcttgtagggatgtaatctgctcaagccacttctcttggtgaagagagatcacatcgatcttgtggagacacagagttcgaagtgctgaaagcttgcaaagaaaattatcaagatctgaagactgggaaaggttatccattgtaaggtcagtgagatattgtaaagtatgcataaattcttctttttgcggagaaccgggaagggggagttctctcctttttgta

SEQ ID NO: 62517 - DNA, 867 bp, Oryza sativa
actcccggttatttcacccgggactacagatagcgatctttagtcccggattggtactcccggtttggaaaccgggactaaagggggttacgaaccgggactacaaagggtttctccaccagtgtatagtgtatgttaaatttgtgtcataaattggaggggtcataaatttctgccatttaacatagagaattttgtccttatataaatatgagacttgcaatagcaatgcgtgtggtttgcgaaatttctaatgggcgattgatcgccccgcgtgatcacccctcctcacgtgatttccttttttggcaccgcattacttttctattttagtaaatttatgcatctaaagtttatacacctcaagtttacacatctaaagtttatacacctaaagtttagagacccaaagtttataagtcaaaatgcccgattcaaatttgaatttaaatttaaatattttatatatatattatttctatatatctaaagtttacacacctaaagtttatagacccaaagtttttaagtaaaagtttatatatccgattcaaatttgaatttaaatatttttatatatagtatttatatgcatctaaagtttatacacgtaaagtttacagacccaaagtttataagtcaaaagttgatatacccgattcaaatttgaatttgaagttaaatattttttatatagtatttctatacatttaaaatttatacacctatagtttatacatccaaaatttataagtcaaaagtttacatacccgattcaaatttgaatttgaattcgaatattagtttatagaatcaaagtttataagttgaaagtttacatacccgttttaaattgaatttgaattc

SEQ ID NO: 62518 - DNA, 2184 bp, Oryza sativa
cgacgctcggtgagctgacggagccgcgcttcccgcccgcccgctcgctcagccgcttccgatcggcgctcgtcaccacgcttcccaccgttgcccgcgccagatccgtcgcaccaccactggatttgtgcgcgtggggtggagcaccggccagatccgcatggggaggaaggcggtggaggaggaggtggagacgccgcgcttctggcccgccagctcatggccgcctactcggcggcggcggcaccgcccgaggtcatggagctgacaaagcccgccgcccgcccgctcgcgaatcatcccaacatccgccagcgcgcgccgcagcccgcctgcataagcggcaggtcatcgtccctgtcgccgttgtcgtcatcgccggcgtccccgttgttgttgtcgttgtcacgtgcaagcagcggcaagccagcgcggcgtggcgtcgtggcaagggagatgctgttctgcggcaccgagtacggccaccacgggccacatccatccacgccgaagctagggccgcccacgtcatcgtcgttgtcctcgtcgtcaagctgccgccggcgcgggaggctcgccctctatcagcaacgccgagtgccagacggggtccacctcgccgtcggcggcgacggcgagccacgcacccacgtcgttgaagagcgtgtgtagctcgctcgacggtggcggggagacgaggcggtcggcggtcgccaggcacgccgatggccgccacgccgccatccacgagggggcggaagaggagacctggtggggaacgtggggaacgaagggcaaatgtgtccgacaaaaattttctccactccgatctaacaccgttacttcaaaatgtgacggaagtactatagggcgaagaaaaatcggtggcctatgctatggatcgaaagtggaaattttttgtgctattttttggtaccgctttttttcctgtgctatggatcgaattttctctaacttatatttatagaatatgtaacggataatgacttaggtattacgtttccttctatattatggaatggcctaaagtcctggtttgataatattgtagagtagatttagaaaaccgataccgtattggttaagatttctatcttgtaatcatgtcccccccatcctatataaggtgggcaggagaccctctagaggcatgagacacaactagatcgtcagatctataatacacccggcagatttaaatccccaaacaggagtagggtatcacctctcattgagagggcctgaacctgtctaaatcctttgtctccgcatccatccacttttaagtctcgtgcgctacccctttatattgctgaaatattgtttcgacactatgggttaggagaagattgaaaagacatgtaaaacgagataagtcattagcacatgataattaattaagcattatttcttttaaatttcaaaatatattaatatgattttgttaaagcaactgttttataacaaattttgaaaaagaacaccgtttaaccgttcaacaaaagtaggaggaaaaacaagacaaatttcctctcaatttgttgcttccgaatgtagttacttgcattttttttttagaatgaacaatactggagtacttgcatttgaataaggactagggctctaataagtccatgagcttggacaccgtacctctttatcatagtaaatccagcgcaacacaaaataggctaggtcccgcctctgctcataagtcttgactagaatgaatggatgaaattaacattcaagaccaagatcacaaaggccgtcccttctttagtcgattgatgaatatataatataaacatcgatggcacatcttataaatagaaagaatctattacatgccactggctttgtcacatgtctacgatttgccactgactttgtcacgttctacaatatgctatcgacttttgtttaacttctacgatttaccatcgccgtccggttagtctccgttagtactgtacaaatttgtcgaaatgaccaaaatacccctgggacaaaacctttcaaaatttggataaaaattcgaaaatatcatattttaagtttttggctaaattttggatgtttacaatcttatgtttataatatgttattttgataattttatataaattttggaagtttttgtcctaggggtatttgggtcat

SEQ ID NO: 62519 - DNA, 2147 bp, Oryza sativa
gtcggcagcgtgggagcgtgggatagcgagctcgggacagatctggcgacggggcgttccaagtggcgacgaggagctcctatggcgagactgagctccgacaatggcggatcgaactccgacggcgcagatcgaggctgacaacaagggcagtcttctccggcgtggatctagccaacgcgagctcgactagggcggcggtctctccgtcctctctctccttctccatatacgcgtctctcctttcccttctccaccgctccgagagattgatgaggagtgatcgggtgaccattgtcatcgccatccccttccttatcgccaaggcagctcaggctgccgcctccgccgcccatcctccgacagcaacgtagattagacgttgttggatggcaagcttgaggtcagccactcagccaccattcccatctctctcctgcttttcggcctcgcttcacccttttctaacattttttgatgacacccttattaccaacagaggacacgcaaacctggcaaggtatggtctccacacccctttctcttccacgtaagcaatctatctacgtggatggataataccacacgtcatatgtatgtattgtgaatggcttaacgggacaatttaccctgctgaaacgtgcagctacgtgtttctgtaccaactacagatttactccctccgtcccaaaataagtgcagttttgcactattcatgttcaacgtttgaccgtccgtcttatctgaaaaatccctatgcatcaccatctctattgctattagatgataaaacatgaataatacttatgtgtgactaaatgtttttaattttttcataaatttttcaaataaaacggacggtcaaacgttgaacatgaatagtgcaaaactgcacttattttgggacggaggtagtagaaagtttctgtgcgatatacaaattagtagcgtaaaaagcgtgctaatagaaactaaagataaaatccgtattttaatccaccaatccgaaatgattagagacgccaaaaggcccactttactgtagtgacccacgagtgctccatttcctttccttcagtgtctcagtcagtggatcactgtgtcagcacaggcagaggctttgctcttgctccggtccaagccaaggtgggcgccccgcaagatatcttcttcttccccaaatcgaggacccgattgcggcagctccggtggccggagcagctccctggtcgacgcgtcgccgtctccgtcccggtcgctgccggattccgcgcgcgtgggcgtccatcggatggcaattggcaagcgctaagacaaatccctcgatcttttttaatccgttggacaggcggcaagatgattaattagcatgttctgtttgtgtcttcgatgatatctttccctattcaatttttgttgttgcagggtacccgcgctcgccgtttcatccggtgagcatttcgtcgagcagttggtaggcggggggagttcggggtttcttgattcatggggaggagctttgccgttgatttcctgcgctgaagcagttcatcgtccagtttcttgggcaatcgtttctagggaagcaaatgagatgtctctgctgctagacgcgagctctgttcctcgtttttaccattctcagaacttgacgattgagcatggcagattagggtcgtagagaaaacggtgttcgtgtcagcttcttgaggtcagagagccaagaagccatttgggtttttcttggttcatggaggaaatgggctctgctcagctttctgccctagctgtgtgtgtctgcattttcggatgcctagccatggctgatggccagaacgtcactggaggtgatggttcaaggccagctgagctgcgcatcggtgcattattcacatttgattcggttatcggtagagcagtgatgccggctattgagcttgctgttgcagatgtcaatgccgatccaggtgttcttcctgggacaaagttgagcgttataacgcaggataccaattgcagtggctttcttggaaccatggaaggttagggcttccttcttttccatcaatttttcttttatggaattgtccttaccaatttagttgtaatttacacattattctctcgctttcattgtgcatttgcaa

SEQ ID NO: 62520 - DNA, 902 bp, Oryza sativa
cgagcctcagctagagaagagctaacttcaagcatccatgttgctgggttatatccttctgtgatttttgggacccctggaattgcctgcaggagaacgatatacattagaagcaagtagcctttctttctttcttatttagtctcggattgaatacggttacccaagttctcttaattccatgcatgttccccatgctcttttaataaacatttgttctaggcattgagatagtctccactaaacatttgaacgttacttttctaattatatgttagcaaataaaaaaacacaacggtatataaatactgtcgatgagaaatacactaatattgttttccgtgcgatagatccaagcacttatattggtattcaagttttattaattattgctcaaaacaatagattacaggttacacatattctgaaatagcatttgtaaaaagagggactacagaattgtatatcttttagttttacaattacaaattacttttatctgagatattagtttttgaggtggtatagttgccctttgcctcaatgtcattaaaaagagtttgttgcacaattgtacaagcagttttgaagaatcaaccttagtactatagaaaaaaatatttatgagttccaacaataatgtgttctactccctccattattttttacttctgcattcagagtctccaatgcacatgtttgatagttgcattttgtaatcatataaaaatcattaaaaagatgtaactatatgaaagtagttctcgtgaaaagtctatttgcatatgctattgatttaagatggaaggttttaactgcacatgttctaaaatgatacagtcatggacaatgaaatttatgcctgaacatttgtgcatcactagaaagggcctaaacgacct

SEQ ID NO: 62521 - DNA, 1167 bp, Oryza sativa
aaaaaatagttcgagaaccgtggtatatccccccccccaaaacctccccaacccacccataaaaaaccggatggcagcaatcacaacttagcattgcttctcatagcaatgttcgtatactataagtgcaggttagttcagacttcagacacctatggtaattgttttttattttgttcgttaggtggtgtttgggtccatggattaaactttagcctttatgtttagacactaatttagactaaatatagattacttacaaaaataattaaataaatgagagctaattcgcgagacaaattttttaagcctaattaattcataattagagaatgtttactgtagcatcacataggctaatcatggattaattaggcttaatagattcgtctcgcgaattagtccaagattatggatatgttttgttaatagtctatatttaatacttctaattagtgtacaaacatccaatttggaaagtgctaaaaaattttagtcccttccaaacacccccttattatttttatcaaatagccacgtaagcgtcatctcaatagcacgtgggacaaagacccctagtcaaaggcgtcatgtcagccaaaaccagagacattgctaccgagggagctcgtttgcatagttgaagaaggcgccatgtcagccaaaaccggagacatttttatcgagggacctcgtttgcatagttgggttgtactccctccatattttaatgtatgacgccgttgactttttaatcaacgcttgaccattcgtcttattcaaaaaattatgtaattatcatttattttattatggcttgatttatcatcaaatattctttaagtatgacataaatatttttatatttgcacaaaaaatttgaataagacgaatagtcaaacattattcgaaaagtcaacggtgtcatacattaaaatacggagcgagtatatggttttcggataaggatgaaaaacagacttagcgactataagggaataagttaactaatcataaaccgtgcgaaaaagatccaaaaacatacggagcgacaaagtaagggacctattgtgaacttatttgagggataaagtcacttccttaactacaagggaataagttcacctgacgtccctcaactttatgttgagtttgtctgcggtcccc

SEQ ID NO: 62522 - DNA, 903 bp, Oryza sativa
ttgtgttgtgccaaattttactacttttatacctcacatggcataaactcatcttctagccaaaatataccatacttttggctcaaaagtttaacaaagtgcagcaactatcaaaaaaggcccagtactccggtactccctagtccctactttggcctagatgagtaagcaacgtgctctgctaagaaataagtttgcactgtcacgttctaaatcttaccaaattattgcaagccaaaatccaaacatatttggtaaagctgctaacgtgctttcggctatccctaccaaaaacgaatgccaaaatctccccaacgaaccaaacgaaatatgtgattaccaaatgtaggtacttaaagaaaacgtggactcgaaataaaactaggatgcaatcatgagaaattctcctagcaattttgtgcagaaaccatttgaggacatgtgcccatttttaggatcccagatcgctgaacaagtggagaaaagttcgagagatcaacatttccagtttccacattcgtccttccgcttacgccgatcacaaaccataacggtttaccaagaacttaaaaacaattaaaaaaagcttttacatatacattattagcaatttaaaaacaaatattacaaaaataaactaaggtaaaaaaaaccttaaaaaaacttagaattaaatctaatgttaattttaaaatccttaatacaccttaaaatcaccttctttttcctctaaggcccctttcgacatagcaactggtgaagattgagtacaggaacgcaaaatgagaaaatcattagtgatgattaattaagttatactaattgtttcaaacttgaaaatagatttatatgatgttttaaatcaacttttacatacttcctccgtcccaaaataagtgcagt

SEQ ID NO: 62523 - DNA, 1789 bp, Oryza sativa
cagttgaaaaccccaatcagtattgtttttaagtttgtggaggtttcctgtcaggattcttaatctaatccagattcagtttaacttcaggttgcaaagtcgtagagccatgctaaggtagctctacttccatgatatcatgggatgtgtgcaaattgaagccctaatgaatatctatgatctataaagaatacctagaaatcagaactttcctgtctttattttttcttcacagaacttcgcttttgtttattctcactaaacgtaagttgtcataagttatatttatcttgcactgaaagcttgtatatatgagattaacaacgattcttcctgtgcagcgttggagcttctggctaaggatgtagtcgctgtattaggtccacaatcttcaagcattgctcatgtcatttctcatgctgttaatgagttccatgttccgcttgtctccttcgcggcatctgatcctaccctttcttcccttgaatatccttactttgtgagggctacaacaagtgattatttccaaatgagtgctatagctagcatcatcaatcaatatcgatggagagaagtcattgccatctatgttgatgacgactatggtagaggtggcatcacagcattaggtgatgctctagcaaaaaagaagtctaagatagcctacaaagccaaattgccacctggtgcttcaaggactaccatcgaggatatgttgatgcatgtgaatgaaatgcagtctcgcgtctatgttgtccatgtaaaccctgactctggcctggcagtttttgctgctgcaaaatctttgggaatgatgagtactggctatgcatggatagcaacagactggctctctgcagtgttagattcatctgatcatattagcactgacagaatggaacttactcagggggttattatgcttcggcaacatgtttctgattctggcattcagcattcgttggtttcaagatggaacaatctgaccaggaatggaggtcattcaagctttagttcttacagtatgcgtacttatgattctgtatggttagttgctcgtgctgttgaagattttttgagtgaggggaatgcggtatctttttctgctgatccaaatttgcaagatataaaaggaagtaaccttcagttagattccctcagaagtttgaacaatggagaaagattactggagaaagtttggcacacaaatttcacaggggtttctggcctggtacaatttactgcagaacgagatctgatccacccagcttttgatatcttgaatattggtggtacaggtttcagaaccattgggtattggtcaaacatttctgatctttcagttgttgctccagaaaagttgcattcagaaccactggactcttcaacaaacaatatagagcttcatggtgttatctggcctggtcagacgtctgagaaacctcgtggctgggtgtttccatatcacgggaagccgttgaggattggggttcctctccgcacgagctacaaagagtttgtgatgccagataaaggacctgatggagtaaaggggttttcagttgatgttttcaaagctgcagtaggcttgttgccctaccccgtttcattcgattttattttatttggagatggtttgaagaatcccagctacaatgaccttattgagaaggtttctgacaacgtgaggaacatcccatatcataaaattctagatgttattgcagtttagtgtcttcacttgtactatatttacttatttctgtttctgtaccactcagcactttga

SEQ ID NO: 62524 - DNA, 1386 bp, Oryza sativa
aattaatttgttagagattagtaccatttcaggtttagtttttctaccatgtttttcgcgcacagtaagtgtaaacatgaaactagccaaaagtttttttttggatctcatagtccagattcatatccttctatctgttgttttacacaggagagaacacagttagtgcacttggtagatttgtgctgcttgtctggctgtttgttgtgctcattataaactcaagctacacggcaagcttgacatcacttcttacagttcaggaactcacatcagggatacaggggctcgatagcttgatatcgagtccaagttcaattgggtatcaagttggatcttttgcgagaagctaccttgtacaggagctcaatattgccgagacccgattggtaccactaaacagcccgtcagattatgcaagagcgctagagttaggatcaggaaatggtggtgttgatgcaataattgatgaacttccatacgtggagatcttcttgtcaaaatactgcaaattcaagacggttggccaggttttcacgaaaagtgggtggggatttgtaagtgacttggactataattgtatactagagatttcgttccagccttccaggatatcttctgaatatagtttattctgtttcaggccttcccaagagactcccctcttgctgaggacttgtcaacagcaatcttgacattgtcggagaatggcaatcttcaaaggatccacgatgaatggttaactgggacagaatgcagtgcagatgacaatgaggttggctcaaaccgtttgagcctttcaagcttctggggcctctacctcatctgtggcttttcatgtgtccttgctctcttaattttcttcttgcgaatatgctgtcaatacagtaagtacaataaccaggttggacttgactctcctgaaccagagattgtaactcgatcggcaaggttaactactatcaagtcaataatctcatttgtggataagagggaggaggaggtgaagaatgctctcaagaaaaagcctaatgacagtctgcagccaaggacaggaagcacaggagaacaatctacattaccaccatgacacatttatcactgcctgactgacatattcaacaaaatgcataattttgcactgggcttgctggcagcttcagaaacccggtgatgatttgttctggttctgaaggtcaaacctgtaggagctcctcagagtattttctctgaactctgaagcatgacaggaacattctgaattgtgcccaacagtaacatgtctgaatctccttccaacagctacttccaggagaagtagagcattggttgcaagttcaatttcaaactagttgagaagtttgaacctctgtcaagttgagaggc

SEQ ID NO: 62525 - DNA, 2097 bp, Oryza sativa
tctgttcaatgcaaacatgtggtaataaccatcacgtagttttaaagtatatgactttcagctgtgcatttttcatgttatgatacatggttcctgttttcaggcaaaaaccaccaagaagattgtgctgaagctgcaatgccaaagctgcaagcattactcccagcaccccatcaaggtatttttgcaatgtgaagattcaagctgaaaattctcatgaatcagtatctttttagatgtgttggatgctcacttacataattattctgtgcagaggtgcaagcattttgaaattggtggagacaagaagggcaagggaacgtctcttttctaaactacctactggatactgaagttgtgggtctactgtgcttcatacttcaatgttattaggagcttaatttaagcagaccatatcatgtattcaagtactctagcaaggattggctttctgctgaatcaagttttgttgcttaatgctcattgaatccaatgtgatgcatgtgtttatgttgcactgcaattttgtcttatggcagttttatctccctaagtactcggtgtctgtttttcgttatcttacctatgtttgcaatcctagagcgacccacttaaacgaattcctgtgacatgaatccctgagaggttagtctgatgaacttccatttttcagactgaatttcgtatatggttaactatactatgttttgttcaatatcttcgtcacgagatagaaggtatggaataccatggatggaggtgaattgtaagataggccttggtcttgtgattgttatcttagaaggtcgatactaatgtttggtcttgtggcgttagtgaaactgttttcgtagcaatgtttggtcttgtgatgttagtgaactgttttcgtagcattgtagtacttgttccattcttcatgcatgatttggataggttattgacaattgtttatagtaatgaattaaatattacactcctaaatctattatataattaaaggaatagaaaaaagagcctccacgtttactctcatggcttagaaattctcacattaatcggagaaaaaaaaacagagtccatatagaaatacaatttagaaatagctgaaattcggaattaaaaaataaggaatattagaagagaagactagagttcatatagaaatacactttagaaatagttgaaatttggaattaaaaaataaggaatattagaagaggagtatagagtccatatagaaatacaattaggaaataatagaaattcggaattaaaaataaagaatattagaagtagagtatagagtccatatagaaatacaattaggaaataatagaaattctgaattaaaaataaggaatattagaagtagagtataaagtccatatagaaatacaattaagaaaaaatagaaattcagaattaaaaaataagaaatattagaagtagagtatagagtccatataggaatttaaaactaactaaaattcggaaaaaaaaaaaggagcctctacgttcgctcccatggcctagaaattctcacattaatcgaagaaaaagaaaaaaacagacttcatatagaaatacaatttagaaatagctgaaattcagaattaaaaataaggaatattagaagaggagactagagtccatatagaaatacactttagaaatagctgaaattcggaattaaaaaaagaaatattagaataggagtatagagtccatatagaaatacaattaggaaatagttgaaattcggaattaaaaataaggaatattagaagtagagtatagagtccatatagaaatacaattaggaaataattgaaattcggaattaaaaataaggaatattagaagtagagtatagagtccatatagaaatacaattaggaaataactgaaattcggaattaaaaataaggaatattagaagtagagcatagagtccatatagaaatacaattaagaaaaaaaatagaaatttggaattaaaaataagaaatattagaagtagagtatagagtccatataggaatttcaaactaactaaaattcggaaaaaaaaaggagccttcacgttcgctctca

SEQ ID NO: 62526 - DNA, 14744 bp, Oryza sativa
aaaggagccttcacgttcgctctcatgatctagaaattctcacattaatcggagaaaaagaaaaagcagaatctatatagaaatacaatttagaaatagctgaaattcggaattaaaaaaaagaaatattaaaagaggagactagagtccatatagaaatacaatttagaaatagttgaaattcggaattaaaaaataaggaatattagaagtggagactagagtccatatagaaatacaattaggaaataactgaaattcgaaattaaaaataaggaatattagaagtagagtatagagtacatatagaaatacaattaggaaataaccgaaatttggaattaaaaataagaaatattagaagtagagtatagagtccttatagaaatacaattaagaaaaaaaatagaaatttggaattaaaaaataaggaatattagaagtagaatatagagttcatattggaatttaaaaccaactaaaattcggaataaaaaggagctttcaggttcgctctcatggcatagaaattctcacattaatcagagaaaaagaaaaaacagagtccatatagaaatacaatttagaaatagctgaaattcagaattaaaaaataagaaatattagaagaggagactagagtagttattacacattagtagttttgaaaagttattgcaaaatttaaaattatgttgtcattgtaatatattataataatataatgagaaaacatatatgctattatatgagagaaaatataatgatgctagccgcgcaatatgcgcaggccaccatgctagttattataaaccgaataaatagcttagaacgagccaggcaatgctgatgtagaaaatttctagtttgagaacagtggtatgcatatcccgaagttcataagctgaaaagattgcaccctaaatctaatgtattgtaattttcctgtactgaaaatgctgagggggggactacaaggagccaagccgaggcccgtcaccgccctcacggacgacacgtcgccagacagcaccgctagcgactgccctccgcggccaaggagcacgaccgctccttcgccgggaacagcacaccgtcgccgggacacacgccgccgcaccgcctccaccacgccccatcgcgccaccgcgcacggcattgttgctctcctccggccaggtccaaaagcagggtgccagatccagccacgggggcgccagatccgaagcttcgcgccgcgctgatgtcagcccccacctatcacgcgccgcgtcatcatcctcacgctgagccgtcgcgtcgccgaggaatggcctcgccgccgccctcacagttggccgcgcggaactccggtggcgcgctccggcggcggcgaggggggagaggaagggagggggcggcgggggctagggttcaccccctgtgccgctcgcgtgagagggcgacgcgggggtcgtgccggcttcgtactcttccaattgaggataagatgaactgatgtgataagtagtacgggattgtacttattttaaaacaaaatttgaatataaaatcatacttattttagaaggattgtagtatttggacttgggagtaattttactgttcttggtattagaaggtaccatttcttttatataaaacttggtatttctcgaggtataaaaaacatacggttaggaccgtaacgaactgtgttagctgtaggtttgcatctgttcccaaggtgatttaatttgagcaattgcaaatagctttttcttctttcactcggcagctgaatcttgcttggtggagtactcgggccgtgcacgttcatccacgggtttgatttgacattggtcatgagcgcgttttagtggacaaagtggtggttagcatagtgaaattgtcaacgcgagaagcagaaaccaattgctgttgctgtcgccggtaccaatactgtatggtgttcctgttccatcagaattcagtcgagtgcatggcagctcattcttgtggcccatcacacaattaatctccgacgatgtactgtacgtagtggagcatttagattagtaattctcgaatacattttcgtaagggttaagtgggcatatgtaacgtgttcactccttgttactatctctgttttcagatgagtgacatcatcagcatagtccgcaatacacattttatcatcataacaattttacactataaaaaacgatttttcgtgatgttaccctatattttacgctggcgtccatatgcaaaaaccgccaaaaaaacataacaataggtggggggctacggaccaccagcagaaaccaatttttgctgataaccacgctaagagaaatgcctaaaaaaactactctatttttcgagacgaacctcttaagtgtctgccagtttttcgaggcggacctcttaagtgtccgccagcgaaaaatctcattttcaccggcagtaggtaaggaggaccactgcgaaaaatgttttgggcgaatatataaatctactgtcccccacccccaccgctcccttctcccttcccccactgcgcggcccctccgccgcctctcttccttctctctcggtttcaccttcttcctcccttctccaccgccgccggctgccgtcgcctctaccgcctctccgcggtggtggggcgtggcctcctcctctccaccgctagccgccataagctcggggccggattcggccgctgcgacgatggtggaggccggatctgccgccgcgacgacgggggaggctagatccgtcgccgcgaccgccgcagggccactagtctctaaagactaaactatatatttaaaaaaacattaccaatataactttatgaaagagagtttctcataaaaaaaaatataccaatataacttttcatattttaaatatttttacgtctattaaatttttaaggtttcaagatttgactgcacttacaggagatactactatacaagaatcaacgagaaacgaatttttaagttgcgataaactggtagtagtaagattttgtgaacaaggataatgcatatctgtgtaaaaaaaatatatagtgcaaatcacatatacattgaaaatctagaaactattgtcacgagtaaaatttttaccaaccaaacggccacaatgtcgcgcagggcttatccggggcactactgcccatgggctgaaagtgcggccacaagcccacaatatcttgcggggcttagccggggcaccacggcccatgggctctatctccctcaccagtaaagccctagcctccaagaccgcacccgtataaagctgcagacctctctctccttctcctcccccgccaccgccgctcgcctccgaaaccctagccgccccctccccgcggccgcgaaaatggtacgcttctccctcctcctcctcctcctcctcctcccctccgccgcacgacgggaagatcgcacgcgtgcttgtcctcgtgccagtccacggctccgcgcgcgccgtctttctcatggtctttctcgatgggtaggatgcgttctttattcatgttgatctgccgtagatggggggatcttgagccggaggagtagctagtttctttgattatgcgttttggggtctagcggattttaacatgagatggtttctctttagcgacatttttttttgttcatgttgatgtccacggtgattgttctagttatgtcatttttatcttcaagacttaaatgctttgaatcgccggtatagaccagattattgtcgtgaagatcgacgtattttccgagctgaccctctgcatgctgaaaattttgtagtgggttatatctagattatatgtgtattgttgtcattcaattagcacttaaacttctgtagcatgaacattttcatcattttcctgtgaggacatcggatgagttcctttttttttctcttcttgttctaaaattgttcggtaatcttgtctggctttgactgatgggctccaatgatggcatgaaatctttgagacctgacattcttgtgatgacaaacataagcatatttcctgagacccaattgaggttttaaccattggtttgctgaatgtgtcttcactgttgaaaaatttgtacacacatttgcttcaaattatgcacatttgattattgtttataggcctgcgatgtccattccacattcagtatttgttaagctgagtgcttttgtttcaaatttgttttgtataggtgaacgttcccaagaccaagaagacctactgcaagaacaaggagtgcaggaagcacacccttcacaaggtcactcagtacaagaagggtaaggacagcctgtctgcccagggaaagcgccgttatgaccgaaagcagtcaggatatggtggtcagaccaagcctgttttccacaagaaggtactgtgacagtttatatatgattatgcagtgttgtgtgtgactctctgttcattagaaacgtacggtgtcatgattgatgtagcagtgatatgtgtctgtacaatgcatgtggcaataaccatcacgtagttttaattgcatgtggctttcagctgtgcatttttcatgttatgatacatggttcctgttttcaggcaaaaaccaccaagaagatcgtgctgaagctgcaatgccaaagctgcaagcattactcccagcaccccatcaaggtattatttcattgtcaagactccagagctgaaaattatcatgaatcattattttgctggatgtgttggatgctcacttgcataattgttctctgcagaggtgcaagcatttcgagattggtggagacaagaagggcaagggaacatctcttttctaaattgcttgctacctactggatactatagttgttggtctactgtgcttcaatatttcaatgttattaggagcttatttaagcagaccatatcaatgtattcaagtatcatcgtctgacatttactctagcaaggattggctttctgctgaatcaagttttgttgcttaatgctcgttgaatccaatgtgatgcatgtgtttatattttgctgcaattttatcttacgacagttctatttaccttagtcctcagtatcccttttctttttttgttatcttacctgctgtcttttgattagtagttagcaaacatagagcgacccactttaattacttcccgtgacatgaatatgacctcgagagattagtctagtgaacttcctttttcagactgaatgttgtattgttaactgtactggcgtttggtcagtatctttcgaaagagatggaatgtagggacgtaattttattgcaagataattcatttgttcttgtggttcagtatcttggaaggtcttgtgatattagtgaattcttttcgtagcattgcagtacttgctctgtccttaatgcatgattcgataggctacgcaatcccgtttgtagtaatgaattaaaaattatatattattatgaaccgaataaatagcttcgaacaagctaagcaatgctgatgtagaaaaaaattagtttgagaaccgtggtatattccaaagtttgtaactgtcataagctgccccccaacccacccaaaaaaaccggatggcagcaatcacaacttagcattgctgctcatggcaatgttcatatactatgagtgcgggttagttcagactacagacacgtgtggtaattgtttttttttagttttttattttgtttgttaggtggtgtttggatccagggattaaactttagtctttgttttagatactaatttagagtattaaatattgactacttacaaaactaattacataaatgagagctaattcgtgagacaaattttttagggttaattggatagatgccattataaaatctttagttttgaaatataccgttactattaaactatttagaaacatgccattacaactttttcaggtattggaaatatgtcactgtacaacctttggatgtgtttaacaaaaattttagaccaaatcgctctcgtcttctcctttgtctccaccctctcctgttcatcttctttcttccatttctttcccttttggatctggtatcttagtattcttcctccacatctcctttctcggccagcaacggcggtgttgtgctgcaccatctagtttcccttcttcccttcgctggccgcatcaccaccttctcagtttccagcctccccgaggtctactgcaacaaccaagacgcggagcatgtcgttcttgaatgtccagcacccggacgcccaaggacgtgcccctgtcggtgcagctggagtcattcgcctacagcggcttcaccatggcgtggtccacgtccaccgattacgtgctcgtcgacgagcgcgccttgtgcacagggccggtcctgagttttcaagctctaggacaaaaacttacgtggaggcccctatatatatacataaactaatatatatatttatagtcttataaacatgtaatatttaatatttgatatgataaaattatctatatataatattttaaaactttcaaagagaaataatataatcataaacacttacttggcactttcaaaagtttcttctaaaatttcaatgaaatcatccgaacattttttccgttttcttttttcgctaccggatacatattttcttgacaatatgattaatgttgtgctaaaaaataatcattaattattaagtagtacaagctaataatttttgatctataaagaggaaaaagaaagatagagaaaattaccttagacgacgactgcgaggcgcgagcagccgatcggccgatgagggcgcgccgccgggcggttggcctccaatcgacgtagtcagccagtcatgcagagccgctgcgatttgctgccgattgccgtgtttgcgttgcggtttgccgccgtttaccgtttgcaacgcgacgcgaggcgtgatcgaggcgacgggaacggagtcagatcgcttcacttttccttcgctcctcttcgtcttctgtcttcgataccatacatgattcaggactgagagcgatgctgaccctgggggcgtcgtgggccatggcccatccgccatggggccccctaaattttgggggactcgggcgtgcgcacgggctgaccccccctagggccggccctgcttgtgcatgatcctgacaaagtgactattactgtgtactcctaatctcacagcagcaagaaacgggaggaagaagatgaacaacagaacaggagagatgggggaggcaaaggaagaagacgggggcaatttggtccaaaatttttgttagacatatccaaggggtatgtaatggtatatttccaatacctgaaaaattataatggcatacctccaaatagttgagtagtaatggtatatttcaaaactgaagaatttacaatggcatgtatccaattaacccaattttttaagcctaattaattcataattatagaatgtttattgtatcatcacataggctaatcatggatttattaggctcaatagattcgtctcgcgaataagtccaagattatggataggttttgttaatagtctatatttaatacttctaattagtgtccaaacatccaatttggaagggactaaaaaattttagtccattccaaacacctccttattatttttatcaaatagccacgtaagcgtcatgtcaatagcacgtgggacgaagacccctagtcaaaggcgtcatgtcagctaaaaccggagacattgctaccgagagagctcgtttgcacagtttgaagaaggcgtcatgtcagccaaaaccagaaatattattaccgagggacctcgtttgcacactttgaaggatggattgtatatggttttcggataaggatgaaaaacagactaagcgacaaagtaagagacctaaagtgaacttatttgagggataaagtccacttggacttccttaactataagggaataagttcacctgacgtcccttaactttaagtcgagttcgtctgaggttcctaatccacaataaaatctctacctctcaactaatcataaaccgtgcgaaaaagatcacaaaacagacggagcgatgaagtaagggacctaaagtgaactcattttgagggataaagtcacttcataactataagggaatataagttcacctgacggccctcaactttatgttgagtttgtctgaggtccctaatccgcgatagcaaaaatctctacccctcaactatcataaaccgtgcaaaaaagatcccaagacaatattgatccattttctccggttttgctgacgtggcatacggtgggacccacatgtcagcgtcctgtcttctcctcttttcttttttctttttttttcttcttgtcttttctttcttctctcttctcctcttcccttcttctcctagcctgagaggccggcgggcgggcgagcaggcgacggcaggcggtggcggcggtgtgcggagcaggcaaggggtaacgggtggcgggcgagcgacggcgcctcagagagggtgtggtgtgggcgtcgctgtgctgtggcgggcggagcggggtggcggcggtggggtgcagaggacgacgacatatggaagtgatggcggacgctgtaggggacgatggcgaggaggacgaagtaggccgggagaggatgactccgacgcgcttggggtttcaccaggagacctcgccttcaccgtcttcgtgccctcaccagagtcgttccaccgcgtcctcaggctgcggcgtcccaataacaacgttgccgatgggtgggtctcacattttccttctatttcacttacatgtgggactcacatattattttattcctattttgctaactaggatgccacgttagtgaaaccaagacatctatactgccataggacataaattgaacggttttgtatatttggggtgaagatttctggtattgaggataagggatggcaaacaaactcggtgtaaagttgagggacatcagatgaacttattccaactataaggcaacgcatcacggtgcatggcccatgggctgcgcattctggcccacaaagcagcacacgcaccagtaaaccctagcctccaggagctcacccgtataaagtcgcagaccttctccttcccctccccgccgccactcgccgcagcgtgtcgaccagacaaggcagcgcctccgaaaccctagctccccgccttcccctccgcggccgccaaaatggtacgcttcttcctcctccccgtccgcctctctccgccgcacgacggcaagatcatgcgctcgtgtgtcctcgtgccagtccacggcaccctgctctggtcgatttgtagggggattgcgttctttattcatgttgatctgctgtagatgggggcgatcttgagccggaggagtagctagtttcttattgatgcggtttcggggtttttagagatttaacacggtttcgcggtttctctttagcgatttcttttttcatgttgatataatgatatccacggtggttgttctagttatgtcatttttatcttgagtgctttgtgtgattgtttttcaattgtgggtagagaccagattattgtcgttaagatgcatgctctgaaacgcggaatttttttgtaatgggttatatctagattatgtgtattgctgtcattcaatagtcttttcttaatacaaggcgcaaccgtcttttcttcaagtaccagtatacaaggcggcaactgctcaactccgtacttggtgcatgcaagcattgaatggatggttgcatgagctcatgatattcggttcattagtttaaaggcaaaggatccaccactcggatgcttgcatgcacgcgcaaaaactgcaggacacgggtgcatgctgctttggcactagatgcgatgaactgatcaaagcgtcacgcattggaacgcgctggaataaatcggtacgatgggtagttataggttttcttgttctccgagtccaaacaagttatgccttgtattaaggaatggagggagtagcaattaacttctggagtaaacatttttcatcatcttccttgaggacgtgggatgaattcttttttttatcttgtgcgaaaattgtttggtaatcatgtctggttttgactgatgggctccgatgatggcatgaaatctttgagacctgacattcttgtgatgacaaacataagcatatttcctgaggacccaattgaggttttaaccattggtctgctgaatttgtctttgctgtcgaaaaatatcgattcacatgtgcttctgattatgcacatttgattgtgttgtttataggcctgctatgtgctttccaataaccagtatttgttaaatttgtttcatatttcttatgtataggtgaacgttcccaagaccaagaagacctactgcaagaacaaggagtgcaggaagcacacccttcacaaggtcactcagtacaagaagggtaaggacagcctgtctgcccagggaaagcgccgttatgaccgtaagcagtcaggatatggtggtcagaccaagcctgttttccacaagaaggtattgtgacagtttatatgtgattacgcagtgctgtgtgtgattgtctctcttcattagaaacatatggtgtcatgatttgtgtctgttcaatgcaaacatgtggcaataaccatcatgtagttttaatgtatctgactttcagctgtgcatttttcatgttatgatacatggttcctgttttcaggcaaaaaccaccaagaagattgtgctgaagctgcaatgccaaagctgcaagcattactcccagcaccccatcaaggtattatttcattgtcaagactcaagctgaaaattgtcatgaatcaatcagtatctttttagatgtgttgggtgctatcttacattattattctttacagaggtgcaagcatttcgagattggtggagacaagaagggcaagggaacatctcttttctaaactacctactggatactgaagttgtgggtctattgtgcttcatacttcaatgttattaggaacttaatttaagcagaccatatcatgtattcaagtatcatcgtctgacatttactctagcaaggattggctttctgctgaatcaagttttcttgcttaatgctcgtcgaatccaatgtgatgcatgtctttagatggcactgcaattgtgacttttgtcttatggcagttttatctccctaagtcctcagtgtctgtttttcgttatcttacccgagtttgcaatcctagagcgacccacgtaaacgaattcctgtgacatgaatccctgagaggctagtctgatgaacttccgtttttcagatcgaatttcgtatatggttaactatactatgttttgttcaatatcttcgtaacgagatggaaggtatggaatactatggatggaggtgaattgaaagataggccttggtcttgtgattgttatcttagaaggtcgatactaatgtttggtcttgtggcgttagtgaaactgttttcgtagcaatgtttggtcttgtgatgttattgaactgttttcgtagcattgtattacttgttccattcttcatgcatgatttggataggttattgacaattgtttatagtaatgaattaaatattacactcctaaattattataaaccgaataaatagcttaaagcgagccaggcaatgctgatgtagaaaatttctagtttgagaaccgtggtatgcatatcccgaagttcataagctgaaaagattgcaccctaaatctaatgtattgtagttttcctgtactgaaaatgctgttggatcggacagccgtggtgattggttgcgttcattttcaagttgtagccaagttaaataaagtatagaaggatatgcaagtagcaacatcggaggagtgccatcgcagtgatcctcccaaaaagcacgaaagaaacatcttcattggaacctaagcagctctggccttttgagcccagaaaagctatccttgattcaagcacaaaccgtcatttggttatatgctttctccaaatactagcatgagtaaattgcattggcggtacacgaacttgctaggtggaagcaatctagtacataaacttataaaacgctcattttgatacacgaacttgttaggtgcatgtgaatcaaggccaaaagaaaaaacaaagctaatcttattttagtgttaattaggatactacataaacacatgtgtgagaaaaatgctaagtacatatacatttgttcaataaaaaggggttaataaggcctaaagattgtatggagaaagacacaaaaatactgagaaatagtgcaaggggtagaacaaagaataataaagcacaaatgcatgtctcatgtccacctccatatgcacatctcgtcctaatcagtgtataacttagtaaaattgattatgatgtgtcattttgaccttgtttcacatgcatcgaacaaattcatgtaccgaaacaagtcttttacaagttcgtgtagtaaagtgcatccatctggcaatttactctactagcatttgaagctaaaaggctttggccttttggagcccagaaaagctgttcttgattccagaacagatcgtcatttttggggtatatgcctcctccagaatcctaaaattctcatttcatgtaaggaaaatcgcaagtgtccaacgctgaatccatcccagagatctcagtgagcaaattgcacagcgccagttgggactattcaaggattttcagggccatgccctgtacccatcatccatcacccagcaacaaaacaagccggaccgtagtgtgtcaagcatgcactgcttctgctctccgatctaaccggtagcccccaactcattctgaaccacaccttgtgttttggaccacatcacaaaattcagaagcagcagcagcagcagcaaagggtcaagcaaaaaatctaacagctttatttaggcagatccacctctctacatcatcatagtcatagtacaagaactcgacgaattcagaagaaacattggcagctacacctagagaaagaaaaatgaaaagaaaagaagatctaatatattacaagggatccttggatatatgctcatagcattgttacatcccgagcaccgagtcgcgacttgtggcgaaaacgggtgccatttccatgcttatgccattactgcttcgcctgaaaaaatgagatgttttttttttggttagagattcagacttatgttcatgaattggctcttttgtgaaaaatgtgatttggtaaaacatgtgcggaaaatctacctgagagtagatgaaagttccgagaatcgcaatggcggctccgagggcgttgatgggctggaccggcgtgtggaagatgatgatggaggcgacaatgacggagatccgcttcatggtgttgccgatgctgaatgtcagtggtgagatctcgtccaatgacatgtaggacacttggttgtacaagtggtagaacacactctgcgccgccacccacctacaaaaccacagagaaatccatggccacatgaatcagctggattatcacacaaaaatatcatcaaatcttttgatacttcttatttctctttcagaatgaactgaagaagatattgccgcttaggaggaaatgatagtgataggacgatcctatatctatattaattgataatggttctttttgtatagaatacttgagtgatgttactgaaagtacaaagtgttgcatgctgaaactgtttgaaagcttaggtcaagcacttatcactagaaattttttgcccaattgatacccaaaaatctcaactgacgtgatggttgtgacagtgaaacggtgagaagtggtacaaagaaaagcatgtgaggctcaccagacgaagtttggaccgatctcggcgacggctttttgccagccggcagcccacaccttgggcccctccatggcgaaggcgaaagggaggaggatgaccagcgagagcatggagaggcaggcgtagtagttcatcccgctcaccgacttgcccttcatccccttcttggagaatatgttccggaacacgaatgccaggttcgagatcatcgcccccatgaatcctgcatcgaattttcagcaatacacgatgaacagattgatgtgatgtgtcaggtttatgaacaaattgtgcactttttcgtggctggtgtatatttctttatctgacataagaaaacatatctttggttaatggacagttcttgttctgaagaattcttggagataatatctatttttttaatcaaaaagtgaggatatttctggtgtatctgctgcaagtatctccaggatttcaggtggagagacagagagatgcagagtgtttgctcactcaccaatcatgttgaaattgagctcggtgatggcggcgagggcgcatccgccgatgattgggaggagggagaagtagaccggcgccgggaagtgctcgccgaggaagaacctggagacgagcacgctgaacgccggctcgccgctcttgatgatgtgggtgaacgacaccgccaccttcgccatgctcaccgtcgccgccacgtgcccgatggtgtgcgcgatcgccacctgctcgtcccacaacgagcaaaaacgaatccccaaatccaacgaacgcgtcagagattcagaatagaacagaatcaagaaggaggagacgatggtgtccatggtcaa

SEQ ID NO: 62527 - DNA, 1767 bp, Oryza sativa
tgatctcatatattatagtataattatagtataattaagcaataaaatattagttcccatctagtcactccaacgtgattagcatctaccctgtggtagctaatgaaaaaaatgaggtgtgagtggatgttcagaatcctatggaattcccgcattttcacagggttgctatagtattcctacaaaattcctacacgtgcttcctatgaaccgaatgcatgaacatggccaaatccaaaggatttgccaatcctacaaaatcctgtgtaatccctccgttccgaacaagccctaactaaattgctgcacaaagtagtatctaatgtatggaaatgttcatctgtatatgtttcatctttactgtttgagaatccgtttttgctagaatgcatgaaacagaatgatcaaatcttagcacatctcaggtattcatttatgaaatattttctcttttctgataaaataatgacaggaatttttctaatactaaatcaacacattcatttgcacatatctatttttaccataccaatttattcatggtttggtacatataacagttgattcctcaattctttgttcgttgtgtgtatgatgttgaaatagctcaatgattatttctacattcaaaatagaaaaacatcgacaactacattttaattgttagtaagtgattttgtatattaattaatattttttcgagaaatgcatatttttcatgttgcgtatgggctacgtatcgttacagttgtgaacatgtagtactaataacgtatattttacgcacgtttaaaattgtgaagagaatttgcctagcattttcagggaagtgttttcacactcttggccacttggcattggcttgcctcttggttgttgggtggtacaatacgagggcttttcatttgaccgctgcttgtacgtatatatagcagccaaatgagttctttcgaaattctaaacatgctcaaagacttgcaaaatctcccaccttgcaaaatcaacatcatataatgatgtcaacatgcattttcataggaggatatatatggatactaactactccctaattaagctcagaattataagggcttacgccatcacgcgaggtgctcatatgaaccaataataaaatgaatatcatctgtttaattataaggagctagtactgtaacaaaactgtgaaaatgattaaaatttaaaaaatatactactaagttggtgtcgaatataattatttgcaaccaacggtgttctttcgaagtaaaaccggaaaacgacgtacccaccacaacggtacaaaacctaacactactggcacactactagtcggagcctcggaggaggtgagccgtcaacagaagagccatcccggccctgtgccggcaacgaccgtcgaccgctaattctcacgtacgccccgacccgagagagcctctcgccgtccgtccggtacagcgaacctcaccaccagcgtagccgcctaccagctgcgtttcaccttcgccctcgcgagcgcggaaggcggaagcttcacgcgattcacgccgacccgagaccgagacctcgtcgcgcatccgtcgtccgtttctctcctcgcgtacctcgcgacgatcgaaaccaaacggacgacgcgggcacactggcacgtcacgtcgacacgtcctgtgccgcggggccctgtcctgtcctcccgggctcctcgcggccgtccgctcgctgcgtgacggcgtgtgcgggtcacctagctagctagcgccaagagag

SEQ ID NO: 62528 - DNA, 951 bp, Oryza sativa
ccaggcgctgaagagttatcctttgctgctgagattcaacagcggcaagtgcagcagcagcttcctttcctaacacagccatgcttgctttgtgctctatcattttagattcagactgttgaagcttcgtagtgtgctcagcaagtggagcttctcgtacccgttgcttccttctagcaatttcagcagactgtatgacaaacaagagggttaagatacataatggggaaaagtattctatgaagcatagaagtagcaatagtaagattgcttgcttgcaatatggaacaagttgctaatacatacaaggatctcagcttcatgtctcatccggctataacgttgtgcaagaccacgagcatcttccaggggagcgcctgcagccatagccctcaatggatctatagtctgaaattcaaaataaatggaagtatatttgtaaaatacattgaaggaccaatgcaatactacagatcttaaatttctagagatctttaattgaaggctaagccccagtatgcactgaaaaagaatgacaaaaactgcatcttcaaaataatggtgaattggtgatcgcttgcatgacaactatataaatcacgtgcaccaaaaggtaaagggaaaatgttgtatggtgttttatttccaggcttagatcaatagacctagaaaattgtgtctaagagagaagatagggcaaaaattgggaccaggcggtgagacatcattactgcttggttttaatgcaccgacaagtttccaattattgaataggatgaaccagcataaaaattcggattccacaatcatcagcctaaaggacttccagcatattcaatatgctggactgtaaatgagatctctagtggtcccttccatcagtacacttttaggatatactccaatgtaaagatatgaactggatgagatccatcagtatatacatatcta

SEQ ID NO: 62529 - DNA, 1759 bp, Oryza sativa
tgacatacaagaaagatactagaacatcaatataaaaatactagagccctcaaggctgggcagcagcataatgcaccatcaaatgccaaattgaggcagctaccctgtgcctagcaccgacttttagaacactggtagtagcaaggctctttttgtagactagtagctcctcgtacagctaccagagagatacacctatctattgaggcatacaagaataacaaaagaagggttcaaaataccatatatatgtacatactaagaaaaaccaccgattgacaacataaatgcagggtacagagaaataaacattactgtgcacaagccagcaaaatttgtctgtgtgagaacagtactaattaacatccaaaaaagttacctgagaagataaaattctattaaattcttcgtactctttctcaacatttcttagagcacctccatacagagatgctgcttttgcaagggcttcatcactagcactactttcacctccatatctataacaatcctctgaaaattttgttcctgtgaccaaaagaaagaaaaatgtataccggtatcactcgtaagatgttgaatttggggggattcgagcagatcatgcaatgctattctttttgaaaaaggattccttgcatacatttttaaccattgccttgtcttcacaaaaaaggtctcaggctcaagaaattcaaatttttatttgatagtcatattcttttgtcacatattcatcctctgattttgcaagttgagagaacatttctcaattcccaaaagccccttcacaacatttactggcagcccaatcaaaaagtggtaataaatattatcaagttagcaggatccgataatcgatagcgaagtttccattctagtacatttagctaaagatagcaccattcatgatgagcacgtcctactcctattatgatgtcatcacatggtttttgtgggtattgtcattcctcgttttcccattggtgttctggccacgtgaaacatgataaatcatgctctcagacaaagaaggtgaagtttagaagtttggatcaggtgattttacagccagctcatccctcaaattaaacacctcatattctggaaggtagagaggttctatcatctgatcctcattaatattcccaccattcaagcataaaaatgatggaaaagcatgcaaatccaaacatgacataataagctaacagaggatggaaggcatgaaccacatacccacttcaacatgcctgattccaatagaaaccaaaccttcagccgctcgaacaatgtccttttggaaatcctgttagcatatatgcacgcattgagtttaataactgaaaatggaattcttgggaagtatttcacgtaatcatgcaaatattctcttctgtattaatgtcttaaaaacattgtgtaatgaactgaataaatcagacatgtcaaatgaaatacaccagcaatatatcaataacataaatgcaagattaatttgctgccagctgatcatattacataggtatgtattttatgctatctgcaattctccttccttacccttccagaacgagtagaagtgtacaatttctcaagctgttgatgtctctgtaattcaacttcatcaattacaacagcgtctgaatgttcatagcccgtagtactgaactgctttatcacagcctgaaatgtaaacatgtaagcaaagaagacttgaccatgaatatagcacatgaagcactagcagacacttcca

SEQ ID NO: 62530 - DNA, 6627 bp, Oryza sativa
caactcggccatttgtacgccacgttagagggtaaataacgagtccaccaatttaaatgaaaatcgatggtgagattatatagtaccatgtgatggcctaggagcatttgtagcagcgtcatatggtgacttaggaatattcatataaagtttaatgaacgtttagtatataatagtttttcttgctgcgaatagtagtaccgaagctttatttctttttcaatctaacgtacgtttgtatatgtacttatgtttttttcacggttagtatatatatacatctaatctcatggtttaaaataacgggtccgctaatttaaatgaaaatcgacagtgagattatatagtaccacatggcggtttaggagtatttgtaggaacgccaatatgaagacttagtactgttttgtagatcacaaattggatatataatttaaaaataatttgaaaagatgaacatttaaagatggttgatttgatatttatattatagatctagtttaacactgcatctataatttgtgaagtaatatatttcatctttatatcgttgatagttctattttaaagaccgtcgatttttttgatggtactaagtacttatattttattttggcttatagtaagtacgtgcatatatattttttcttccggcaaacattatgcacatgagaaaggtattacatatttaatagtaaaaaataacaggtccaataatttcaaatcgataacatatatggataaaataatggatcgaaaatcgttcaattgtatgtgtatatttgtgggccaatatatctttatattgtagagcgatatttgcttttttgatagtactaagcatgtatgctttattttggttgtcgtatgtacgtacataccttctattcctccggcaaacagtacagagaaagttattatatatatatatagatataatgtattaactgaaaatcgacggcatgtatatatctaatctaacggtataaaataatggtccaccaatttaaatgaaaatcgacagtgagattacctgtgccacgtggcagcttaagagcgtttgtaggaaatttaatggacttttagtatataatagatagatagatagatagatagatagatagatagatagatagatagatagatagatagatagattctacgcatacccttttttcttaaaaaatagtaagcatttgagaaattatttgtgttcaaagtttcaaaagatacgaccagctcatattctaaacattaaatatctaatgtacatgtgcatttcttataaataaaaacgtacaataatattatattggcactgcggctctgtagaaaattctcttgggaattactgcccattaattaactgatcattaattgtgcagataatatgagtgagatagagatatgggtgcgtcaacgacggacaagtatagctttgccgtgcatcgagagcgacacgctgtcgcgtacgagagtacgtagcgcgaatatttaagcagcccggcacaaacacagctaatccaattgctgtcttccacaaaaccaactgattacttagtactgtaacgtcattaatttacaaaaaggaacgtccaaactacgcacaaaaacagaaattttgtgcacaaaattcgcaaacaagaaccggaattttctttaaaacactgttcaaacgagctcacaacttgcatatatacacacagatagtatactaacccttagaaacgctcaaatatacaccatacccttatatattacatcttcaagagattagatcggtttatcttacgattgataaaatcattataaacgtctcctctcgttatcgacgggtatatcatctatcactaaaaggataattaaccgtaaatacgagctacaaacacctgtgtcaagtttacgatttacccagcataatcatcatcatagagttatgctgacacggcaatttaatcaggtcggcatctttgttctagcctgaaaacgccctacaagcgaaaatctgggtcgaaatggcgtcgagaagtgcagggtcacgatcgagtagtcgttttcaagtgttttcttttcttttgtaataagtaaggagacaatcaaacatgtactactaatattaatcgattccggccggctatgatcttcctcctaatcgtcccaaccgatgacgggatttttgacacgtattggctgccaaccatctcatcacctctgcattttcagaggttttatgaaattattatatatccacaaaataattaaagcttagggagttgggatccaggtactcggtttaatttacatccatgggtgacttagatcaagtttagtatagctaactaatagctctaaaacatatataattaatttaatagttaattcatacaatagttacctgtaaacatatattacactattaatatctggttccacctgttatatacatattatatcttggagtccgtgctatcgctggctataaatatgtagtccactgctcttctctcttaccccctccattccaaaatatagggcacaactaatttttaaagtggtttcataatatagggcgtgtatgcatgcatgtaattaattagcacattctctcctctaaattattattattttaaatcatatactcacaagatccttaattctattagttgcatgtattgtattaattaggtgattcatgacaacaatgagatattaattattttttggtctttgggttaagggtggttgtgtcttatattttggaacggagggagtattttttatctttttaaaatatatttatagttagtttatagtagtttgctattgtatctactcttaggattgccatcagaagaaggcgtggacaaatgttttaattggcgagagatgcttgatggtgtgtgtggatgtgtgtgtatgtccatcatttaaaaaaaagaataaatgtaatgttatactctcgaatgattgtgcttcacctcattgcatgtatgaaatgctcaccatatataagcaaacaaataatatatattttttatatgtccatgaaatttcagccaatgctttttacaggctcgctccgtcacatatcgtaaattttggttttgatctttctatacccacactaattaatacgcgtagtgtctcaagccatcgttacttaattagttagttaaacagataaggatactttacacatcaataatgcggcaccatgcatgtacgtacatcaccacttgctatttattttgtaggttttaataagaaccaactgcttagttcgaaagaaaattaaattagctaactaatgcatcaaatgatgttagactagtttagattatattagagcgtgggggtcacggttcagattgtagtgtgtcattatgtgcatgagtgtaagtcccacgttctgtcagcgttcaattttgagtcctatcttcttcgtagtattatattacgacaaaagagaattcaaatgacttgaactaactcaatcattcaagcgcggaaatcaggatttaaaacccacctttgtttagttaattcctcattaaaaaagtaaaaagattgagaaagatttattatatatccatcgaggtgtgaaattaattctttttaattcccttcatctcataaggagtaacccagaacaatctcgataacgaattggttaattttgcgtctacgatcaataccagttttttccttcacctgggctaggagtgtagattctccgacaaacaaacgaaattcatgttgaggaatgcaaattttgtcccccactctgatggcctttatcgccattggattctgttctttttctgatcttaaaggtccagccaacttgtagttatgctgtactctagtagcctttcatttgatagagacggtttataatagcaaatccaaatcgcaataaatcaaatagttgatgtagatggcaatctaaccaaaatttagatcaccacgagagggttttgaagcgtcaatagaatccaaacagtttatgcatagctggcaagcatttcctggcatgcgtatcatataattggccacaatgttttacagaattttgaaaaggaaatgaagttaaggacacaactgttgaagacgtcatttcttcagggtttcatttgcctttcactgttacaattgttcaagcacatgatttgacttctttttttaaaaaaagataatagaattcattgtgtcctttatttcatccaatctacaactcgttattactgcctccgtcccaaaataaacgcagccatgagtttttgtgctcaactttgatcgtccgtcttatttgaaatttttttatgattagtatttttattgatattagaatataaaacatgaatagtattttatgcgtgactattttttttagtttttttaaaaaaataataaataagacgaatgattaaagttggaaaaaaaaactcatggctgcacttattttaagacggagggagtaccaagtttgtagtttgaacgaacgcttattacttatcacagcttatggatcataagaaacctaattgaaacaccatcctaaagacatacaaagataacacacctctactttcctaactcacctttctcgtttaccgcgtgcacgcttttcaaactgctaaacggtatttttttaaaaaaaaaaattctatatgaaagttactatctttcaaatttattttaactaatactgaattaatcatggacttaacgcttcttcgtttcacttgctatggagtgagggttgcaacacaccttatatatgtttgtcctcctcaaatacgatacctaaaaacagagacaacactatatgtttgtcgtcctcaaatataaacactactataaaaaccatttttcctaacatagaagatcttattttcgaaggcggacatgaccctcagagccaaatgactatctacaaaaatataaatcggggtgaaatttaatgtccgtctgcgaaaatattttcgcagacggtccacttaagcggcgcaggcggaccacttcacaggcgccgcttaagtggtacgcccgcgaaaatagacttaatataaatagacaggcgggcctaaattttttctaagtcccctcacatcttctcctctcccctcccctgccctcacctctcctcctctcctctcctcccctcctctcccctctccccggccgccggccggaggcggcggcgtgtgctcccggcggaggaggcgaggcggcgcggtggctgtgctcccggcagtggcagcgaggaggcgcagccgaggagggcggtgcggccgaagttcgggcggcggcgtcggctcccctcccccctccctcccagatctggccggaggagggaggggggaggccgccggtggcggcaacggtgtggagcggcagcggcggcggcggtgacggcgctgtccgggcggcggcggcggctcccctccccctccctcccagatctggccggaggagggaggggggaggccggcggcggcggcgacggcgctgtccgggcggcggcggcggcatggagcggcgacggtgcagtccgggcggtggcggcgcgggccgggcggcggcggcggcggcggctcctggcgcgattttcttttgttcgttccttttattttcgcaggcgggccgttgccccaactgcgcagtcgtcgtggtgcaggcggacctctctctcgcctgcaaaaatgagttttggccgcctccaaaaatgccttttctagtagtgaaaaacaaattctcaaaattagagtccaatcattctactgattagaacttacacacatcaccgtctataattgacgtcgaaccaaagcgaaagatatcggaaactgaatttcaaaccagccgctcatgcatgcaaatatagccgcgtaacgcacatggaagccgatggcagccatcaagcggccaccgcatgaacacacaaaacgctggacaacgaaacgcctccgtcgtggttgtgagatgaggcggcggaaagttcgacgagagggacgagacatcgtggctgtgagattaggcatgatttgatcgtttgcctatagaaagttaatttagtacccatccatcttcatacataatgggctcaaaattatttagcagaatttaaggtcaaggtgaaattagtttcatgctattcagaatttacttaaccaaaaatagattactcctagcgatgcaaactatcaatgagcaataaatatactctaaactcaaggtaaaatatagagatccgaaatatccaatctaccatatagttcatattcattatgtgacacatccaactatctaaaaccacccgatgaattacatccgatggcaccggtgctcccacgcagatcgcgcctctcctgcagctccctccgtatcaatccaacggcccacgtcgctcccacctccctcaccccaccgcgccctctcttcgccgtctgacccgtcagccaccatgcgccgtctccgtcccccacgaagcttgcggctcgggtccgtcttgccaccgccgccatcgttccgctgctcagggccgggccgacgcaccgctgtcccgtgccgtcaccaccgtattcgtcgctcgggtctttctctgccgtctccacccgctcggga

SEQ ID NO: 62531 - DNA, 3056 bp, Oryza sativa
tcgggtctttctccgccgtctccacccgctcgggaccgccgcgaatcgtcgcccacctcgccgtcccctatctccaccgcaagaacaccgtcggcagcctcggcggtctactctgcgccggtctcctccgcgtcatctcctcgctcgtgccgcctctgccatcccctccgttcagcaccccccctcctccccccgtcttcccttccgtccttccgtccatccagcgcgctggcgatcctccacccagggcctggcgtcccatcgatgatttagggcgtcgcgggtcctccgttcagggcaccaccggccatccgtccagtgcacggtctccccaatccagcatacaggtgctacttcccctcagcgccaggtgagcaaattctgtttaatttggtatcacttggtttggttgtagtgtagcaattgctgcttaaatgatgaagaagtgcaaaccaaatatttctggaaggtactgcagagtttgattgagtgtttgaaaatatagttcgttcagtttgttgtatgtcttgaatcctgataggatcacctctgccaactgagtgcttctgacggagtcaagcatcttgatgcctgcaatgtttctggcttttgacattccttgcatgcttgacactcatccaatcggattgtaaggtggcttttctgaattttgtgatgatgaaatcaccatggtgtacatgttcactgctagcattgtgtggtttgtattaatgctacaaaatgccttgctgctcatgaactgcttgacaaaatgcctctcaatgttctatctaaaattctgagcatgttaatatgtgtctccccgtaagtttagatggtcataatttgtgctggttaaatatcctaaaagagttcttaaaaactgatatttgatcaaatattttagtgattctatcgtgcatattaattccctgtagaaatattatatacatattagtagagtagattatggagagttgctaaaaattgatcgccaaccgtttgaagctcactttgaagatctactgcgaaagatggcttcatgttaccagaagacaaggcaaggcatcaccacgtaacagaaagaagagtagagaaaaagaatgatatcaaccgccatttcggctgtgtttagtttctaaaattgatgagaagtttggagaaagttggtagtttggaaaaaaagttaggagttcatgtgtgtagaaaaattttggataacactaacgatgtccagcttcttctcattatgacagcaggagggaacacagatgctttttgtgtatttagtcaataactcagcttactggatgcttatattttatattctgcaatgtaaagagtagatagcatacttgagaatcattggtcgtcactgcattataattgtacatcatatatcctaggaaatattggatcaattgcaaggacatgtgtgcagcgtgagcagttggtgtgcatcttatcggggttaaggttagtgtttattgaaaaatcattgaattatgtttcttccttttctttgttatgttattcatctggtactacatgtgaacggcaaatttactttgtaagcattttcagccattgggtttaaaggtagacaacacaaagctctgtgtgctgtattgggttattgggcatatcctatggttttatgccagatatgccaaatttccctcttctgtgcattaatatagttaccaaatatgcatgaattttgaaccactgtttttttctctacatcaggatggagaaaaatggttatataagcaactaagcaatgtatttttggtagtgaagtgtacataatggatacagcatcacttgttatcctgatatatttatttaagatggttttcttgcatgtttggtagtgcaaatggacaccatcaaattgccaatttgccatgatcttggtgcgtgtatggaatcaagtagaatggtagtctcctgcaattgctccacgatgactgaatccacgcggaaggctgtccatttttggcagttcagacttagagagaggttagcattggcctattctttggataggtttaggtcatttatgtgttgagtaaaatttggctaagaagctacggcatatctgttttacgaatggaaaaaatgtagctattttttcatgtgtccttgttgcttgattggtcaggcaagttgccaagttattgctccgtattgcaaattcatcttggtaccatattaactttgacaatctgctttttttggtgtatcaataaatcaagtaaataatgatgcaatgaactcttctgatggacaagcaacagaaaatttacttgataactatattgtttggacgtatgttctggccaataatcttgattccttcttatatcagtccatccttatccttgacgccttatcagtacactgtaatgctcatactgattgtgctggctgagacctaggcgggggccaaggccttcatttaggtcagtacacaccgcctcaggaggtttattccttgtccggtacatatggttgggatgttggatccatttcatttatttctgcaggatgagattgtgaacaatggattatctgttattaggcttgggatgctggtctgatgcaaattactgtagattattcaagtcaaagttactatagtttttttttactgttggagttctgtttcagtgccaaatattcgctgagcatgatgttgtgttgcagtggtgccctaattgcgatttcaatgggatgttctagacagatgtgtggagtggggtggaggagaagcgtagtcgatgatggtgaaacacagcgtgtttgaggaacaaggtgatcgacttgaagggcgttgccagcaaccaggctgcttctttgaacaccttggttaggtaatatattcaagctatgttagatggaaattacttttatggaaataggtgcatttgtgatagcccatatattatttctttatagttattagtgcaattacaattatttagcatgcaagctaatagtacttctaatgaggctacaaatgcatatcatacttatatatgtttggccat

SEQ ID NO: 62532 - DNA, 3079 bp, Oryza sativa
aagttgtgttcgatgatcagttctgagcaactgagccccttgtagagttgtccccattgcagtggataaaattaccaagtgcctaacacacattccatcagaagtacaacttgggttttgaaagacaaaaaaattgctatgtaattaacaatgtataaaaattctatattgttctttttttcaatcaatcttgagtatatatctcattctcaaacatatatctttttctattatttgatttgaattatcaaatactgtcgtagcgttagcacatgcatattactttgctatgtaattaacaatgtataaaaattctatattgttccttttttcaatcaaacttgagtatatatctcattctcaaacatatatcgttttctattatttgatttgaattatctaatactgccgtagcgttagcacgtgtatgttactagtatttaaggatggagaaagtacttgttctttgtaacatatggattttgtagtatttttgtgttttaaagagatctatttaaacggaaacaatttgcattgagcattcgacgcgagacgaaacatcgggcggttacgccatgtgggcccgcatcgatttaaccataacggctcgaccttttcatcttccttaatcctaattattctcacattttctcttaccttcctagctattgaacaggttcatcgggatattggcagaaccgccgttgctggtggccacgactgcaacaatggtagcagggtgttcttgatctggtcagacgctagcttccggaaccacacgattgagcacgtattgtcgagggtggcagcgatgaggttgacatttgtaggggaggtggagctggcaccagaacctaccttaggagcactcctcccgatgctagtggctgtcgcccttccactcctcctgtagtcgccaagctgtcgcatccggttctacgccaccttcatccgcatgtcctccttcctcatctccggcaagtcaacaataatctcgtgcgcgtagctagccagcatcgtcggtctgattcgagagttacattttgttttgattcaatgttctgatttgagtgtttcattttgttttgttttcatgtttcatccattgatttcttggtgttgcaattagtatggatgttgtatctgactgaaatactttcgatcaagcgatgaaatattttttcctacttgatgaaacatctgaaatttttttgttgaaacatttttttatcgagtagtgcaacatgtgaaacaatatagtgcaataccatgtgatgttctatgaaatatcctacatccaattttgtagtgcttcccttatttatactccctccatctatttttgatagtcaaaatctgaaaaatttatttttgatagacatatttcaatccaacaacctatcatcttaatgactttctcggattttatgcgtgactctccattcttccacacaatattggctatatgggcatcgagaaatgtaaatattaatgaatcgcttgtttacgataaatgactagtagcatgtttaaatagatgataaatagaattacttatcattgatttatgtaccaagatgaaatacaatactatcaaggagctctccttttaatcgaaaagaaaaaaaagtacctctcttttgctgggccccacgaagaaagggagccgcttctgctgcccatggcaatggtggcagtggcgaccggccggcctgcaacccggcggcgtcgtctcgtgctgcgacgcgagatgtatgtatgcatcctccaaagtcttttttcgcggcatgcaatcctgaaaagtaatacctctgtctcacaataaatattcgtgcccaacatttgaccgtccgtcttattagaaaattttgtgaaaaatttgaaaatatttagttacacataaagtactattcatattttatcatctaatagcaataaaaataataattattaaaaaattttaaataagatgaacaatcaaatattaaacgtgaatatataaaactatatttattttgggacggatggagtagtctgttggctcgcgccttgatggcatggcatctttttctctcttgtgctgatgctgaccaagacggcacatgtgctgatgtgcctgcgtgcagtagtttctttggctggctgctggttttggctacatcaggccgtgtaatggcacatcatgcacacgcacgaatctgatggatacagagccgctagtccaagcagtactgctaatagcgggcctatctcccgtgctttcgtagctcctccctcctactactactgtgtaggagtagtgtgtggatggataggatacggatcgatggcactgtgcctgtctgttctgcacgacggaggacaagttgtgggttgcgtttccgcgtcatactccgtctctgccaaaataaatgtagtttttcatatcttacgttttcgtttgaccggtttattttatttgcaatttttttacgattaatatttttattgttatttgatgataaaatataaatagcactttatatgtgactaatttattttaattttctcataaaatttttaaataagacggatggtcaaacgttggatacggattcccataactgcacttattttgaaacagagatagtacgtacctagctagagtaagggcagttaggccttgcagtgagcggacattggttttggttcgttgtcataccggagctaggtcaatttatcatacccattcccccgcgaggctcctcatgccttagcaacaagctaagatagaggcacggtttgcgagccgtgttgggcgaggccatgtctctgtgacatggtctcgcccttcttattatgaagcttataatgatgtcagcttaattcgtcagatctaaaatgatggcgcaatggatgaaatcaggaaaaacggaacatgtatggtggagaagaaagatggacctaccaccacggatatcaccacatgaatgcaaaggagaaagaagatggatctaccaccacaggacactccacaacctccttctccctcctcacccctacccccaccagccggaaaagaagaaatataaaatgtcgg

SEQ ID NO: 62533 - DNA, 3194 bp, Oryza sativa
tcataggagtagcctcgtgtagttatctctagaaagatggtatagattgctccatagtgcaaatatagcttgagcccgtaggaagatttttatttcactttgtttatttgcccatcaatccttccgttgattttatttacaaccttatccaaaattgtgctgttagcacccttaattagacaaaataatttataaaaacctctaaaataaaaataatccacattcttactagtcattcttgctcccctattccatcatctttggccaccctagctcgttgtcgctggctcctcctcctcgcctccatcatatctacgcaccactattccaccaccacttccccgtctacggtcgttgtcgctttcccctcttattaggcagcaaattggatggacaagcttcgtggctgcacaaatcaggagtagcttgggtcgacaagctctgccgagttgggggcaactacagctaatggatttggcgttgttatagattggaagcggttcggactaacaagctccacggttggagggagttacgaccaatgggatttagcaatggcttgggccaacgagctccacaaaggcttcaaccaatgatgtctttggcggcaagggccagtggcggagccagaatttttccaaacctagggctcaattagttgaatgtatataattttgcctttatcttctagcttttgaagttttaaaatggaatttcaatgaatacttaggatcaggagtagggctgcagccctagctgccctactcttgtctccgcccctagcaagggccaaatatagttcttagatcttggcattgcctatccacaaatcgccaccgtctttagcaagcttgggcacttgcgacgtcgtcctattggtggcgacaacctcttctcaacagcgacggtggtcggcggaccttcctaatcatacgcgcattagaggtggcttattcctagtcttcattctcttctcctccatccctgtttgggacataacttttttcatggaaaacttgtggcttgtagaaggtactcttgttgtcttacactttgtaaacaaacttcaaagtcagtccctttcctccatgatggcatccgagcctacgtgactagtggggttactcctcttaggccatacacagtaaacgctctaatgtttacaggatgtctggatctaagattttctaatttttagagatttttttattttactttcaatgaaaacatcacctatctcatcgtgcacttattcgttcatcggctacatccaaaatttaggttttaaaaattaattttaagctaatttgaagctttctattacaatctatttttcatacttgacttttgaaccgtgaatactatcgatatggaagtcttacatataaattatttttattgcttagttggttttacaaaccgtagtctaatcaaggactcctttaatcaatcatcatagccgaattcgttggttgaagttttcccaatcatccttttatggaacgtttctttttctaaaaattctcacggctccaaatagaggtccttgtagaaaattgaatgtgttgttgcttgttgttggactgggatactatagagctcaaagcctcaaattacgtgcaagacgacgttcctactcctgcgtaccgctcgatgttggttggcctacgatgttttcgtgtcaaacttggtggcgcacgcacacgcacaccaagtcgatctctcgctgtcctacatggtcgatcggatactgtcagttttctttgtcctctacgcacaccaaagtcgcctactgctgcgcgatatacactgccaacgtactgcaaggatcccgaatcgatattggagtatgggctagcagtggcactgtggcagctcccggccggccctagctagcgtatgtcatgtcgttttacaccatataatttccaacttgtcactaagtgccggtgcatgacgtacctgcatgcagaggtttatactgtactgtactattcctatgtacggatccctccgttaaaaaaaaacgaatataggacataactgtattatttagaccttcaactccaaatttcaactttcgtttttcgttagcacactttttaaactgctgagcgatatatattttttaaaaaaatttcatatagaaattgtttaaaaaatcaaataaatttattttttaaggttacaataattaatacttagttaatcatgtgtaagtggtctttcttgttttgcgtgccctgaaaaattttcttcctacccatgaaacgaacgaagcgtaataattaatacattcgccttaaaatatcaactctagttcactacgaccatgaaaccccttttacactattaacctttttctttttttttgcaccattggattatagagatatgtggacatttttcaaataactgcccgcctatcaatgtattttttgttttggtccaagggctcgtcttcttctctctgtatcatccctctctcgtactgagtaaaaaaaacactcatgcttaacattaggagtatttacttatcacttaaaaccaagagtaaagtttttactctctgtggattttgagagtaaaaatattacaaacggttgaatcttatcagtaaaaaattacaagtggttaaatttaagagtaaacaaaatacacacaaaaaaaagtaggtggcagcaaggtcacaacttggcgaggtagctgcggcacatccacctgcgatctcgatgacagtttggtaagggataaccgagaagacaatgctaagaggtactgtggcgttgcgactagcgggagctagcttccgagccaacttcggtggcacatgggcgagtggatctggggtggcgcagcatgcgacgaggagcaggacaggtggggtgaggaccaggagctctcaattcagtgtccgggatgatgaggtggccgctgcttgcacatcttgccggtcaccggcgctgcattggtcattgctgctgccaccgctcgcatgcctcgctagtggccctaattccttgtgttgcctctcgcatgccttgctgttgtctcggtggcgaaaggaggtgggagagcgagagatgcagcgtgagagggagaatgggtgcagggactaaatgcaaaaaatggtgagaaaggaggatgtcatctggtgcacatatgttagatctaacggtgaagatgggggttgc

SEQ ID NO: 62534 - DNA, 1643 bp, Oryza sativa
caattattgtattattccatgcttccaaacgtataagacttatccattcttttgtttttttaaaaaatctaagtccaatttatagttactatgtgttaaattaagttgttgattagaacccaaaagccattgagggcggctagggaatgtatcccgtctgaacgggatacttgagattgacatcaatgctgacgtcattatacgtacgcggtaccacgtatgatacctacactactacgaaaacgatttttccgtgtggtccaaaagggttttcgcgtgcggatctcccgcccatctgcattgaagtgtcagcaaaaatccgattttttcgtgcgcacgcgaaaatctaattttcacgtgcgggtggcttatgtcgcaaaaaaaaaaaaaccaaaccctaacccaagccgccgccctcctcgtggtcgccgtcgtcggcggtggcgttgccgccttctgccgctaccggccgccgcggccggctcccagcagcgtcgctgccgcccaccgccgaatctgggcgggagaggggcgccgccgcccactgctggtcccggccacagccagggttttaaatttcaaaatacgattttatgccagtggggggcgaaattaccgaaatttcggaaatttctagccgaaattatttgaaaatttgactgaatttgaataaaatttgaccaaattcacaaaaacttgcaaaaaaccaaaaatttcgggcgagatttgagtatgccggtgggggtgaaaattaccaaaatttttgaaatttctaaccgaaatttcaaaccctggccgcagcccacaagcgaggccgtgctaccgtcgcccgtgagagacgagagagagatagaagaaatgaggataacgatgagtaggtggagaggataagatagaaatttttgaagtggttgagaggggaaaaatacctgaggagggtatttcgcgtgcggtgctcttaagatgcccgcatgcgaaaatttattttcgtgtggtccgcttgcaaaaataggtttattttttgcgtgtggactcttaaaaggcccgcatgtgaaaaccgatttttgtgtgtggtcctcttaagggtccgcacgcaaaaatgggaggacaatttttctagatgcggtcagttatggaccatatggaatctaacgaggggctcgtacaggaaaatcgttttttagcagtgcaattagttccaagacatgatatttgtgtaacaggtcagataccctataggtatcatgtcaaggtacaaaaacatgatacttaagtaacaggttagataccctataggtattacgtcaatgctgatgtcactgtatacgtatacggtaccatatatgatacctattggtatcgaacatgatacatgagtatcaagtatgatactttatgagtaccaagtatgatacctgcatgtaccagccatggtacctgggtaccaagttggtacctgtaggtaccaagtccgatacttatatataccagacttggtacctgggtaccaggtccaatacatataggtaccaaagtattatgatactactaaagtatcatagcacactaagaaccaaaaatcatatcttaccaagacagagctcaattaaaccaacaaagaaaattgattccgggaaaaaaag

SEQ ID NO: 62535 - DNA, 1485 bp, Oryza sativa
gctgattctgtgaacagtctgtagcatgtgccaggaccagttcttcctgcacgtcctgcacgctgatctgcagctgctcgactaactggaaaaacctgaagagcatccatacccatccgtggattgtacaccttcatctttccatacccagtatcaatgacataaaaaataccatccacagtgagcgaggtctcagcaatgttggtagcaacaatgcatttgcgagtgccctcttctgccttctgaaagattttggcctgcaggtcagcaggcaactgcgagtagatgggcaagatggagagcttgggtacagtcttggtggatgatgatatcagctgctccaggcgctcagcaagcgcatagcaggtagcctcaatttcctcttgccctgtcataaatataagtatatccccagggccactggttatgtggattgtcatagcctgcttcactgccgcttccacatagtcttcacatggtgttttgctgaacatgatatttacaggaaatgtcctgccaggaatatggaagacaggcactctgcggataaagaaatgttacaagattagcaaaatagaaaatggattcaaatcttactaggaaaaagaaacagagcaagttatcttaccctccaaaaaattttgagaatttgtccgcatttagggttgcagatgtgacaattagcttaaaatctcgtcgacgtgcaacaaccttcttcagtatgccaaacaaaacatcagtattgagtgatctctcatgtgcttcatccatgacaataacactaaaaaaagtaaggaaaggtgctttagcatttgggaagcagtattttgatactgtatttagttctatcaacggtaagagagctatcagcataccgatatttgtcaaggtcagcatctttcaaggtttcccgaagcagcactccatctgtcatatactgcccaaaaaaaatcccaaacagaagcagaaaccatgttagatctccattactacaacaaagcatcaatcaatttttttaatttcctaaatggcataacattgttctggcatgaagtgtgttgtgttcatttgatgtaaaattcataatgctaacaacctaatagctaatgctgcacccaaactaggctactaacctaagcatattctagttttaggaaacttcctactaccaagtgaaaagacaagtcatcaaccaaggagtatcaaaacacaagaagcaatatacctttattatagtgttgggactagtcatgtcctcaaatcgaattgcatatccaactttatgtcccaactcagtctccatttcttcactaactcttttagcaacactcatggcagccacacgtctaggttgagtacagccaacaatgccggtggtggtatatccatcctcatgcagatactgagtcagctgggtagtcttcccagagccagtttcaccaaccaccacaactacttgattttcacgcacaacctgctcaatga

SEQ ID NO: 62536 - DNA, 6588 bp, Oryza sativa
cacctctgttcctctgacagctccagatctcaacaactgtctatcctcccattgagcattatcagcagtcatctgtgataacttcttgctctgagcaagggtcatcagactgccatctttacgagtctgcacccaataaaaatagtaagaaatcagaatacaagacattctctacaagttaaagatatgaaaaattattacaaaataactatatttactgaaaaactaagtggataattcttgacatccaattttttgcaggtcttgctgcacatgggtttggcagtcttgaaaaaagttaaatgaatacaatttcctaatgatgatgcaattttcataatatacataaggaacttgaacaaggaaaaaacatacatctaatttggtggtattctcaagccttactttacttcttaccggtgcacttttacatgtctgagtacaaattatcggatgtttacagtaaatcacaaaatgcaagacatttttacaaaggcggagtcttgctagaagatagaagtatcagatccatacattcagtccagcgccacaatagcacgaccttatcatttactaattaatcagatatattcatggtttcatagaggctgtagctgcaataagttctactcaattactcagaacaaataagaacttatgaaggctaacacgaagtgcatggaagcacgggagatgtaaacaagcaaggaacttaccagccgctttggtaattgtgcttccctctttttgtaggaactatcatcttcaagatacatagaattatcaccatcaaacatggtgttgtgttcttcacaatcatacctggagtatatttgtaaaggttagaagaatgtgtaatcaatttgttgttgtataatgataagagaatgtcaaaaatcattgtactttcatatctctacactaccatgtctggatagaactatggcataaaatcagaattttgttacagatatatgaaaaacatcattgtgccaacttacttcagatgccattaccatttttagctattataaatggagccaataaatgcaacagcagcaattgaaaggctttgttgatcacttggtttgcaaatatattttttttctatcagacacctacatcatccttttgaatacaaaaaccagggaaattttatgaggaaagaaaagtaccacgcacgatcagcattataatccatctcctgcatcatttcttcagatatctcatagttgccatcggcatctgaggggcttctatcagattccctgtctgagataacagggtagaggttattgtcagaatgaccagtgaagaaacaaaatgagaacttgcaatatactataaagtgatccacaaacaacatgaaacttaaagttagttagacttctgtcagtaaataccaaatagactcaatcaagtctattgtttgattgaaagtacatgaaataattaaatgaattacatagtagcctaactgtaatactcttcagacagaaagaggcagaaaaattaaagcaacttagatcagtcacatggtaatttcgtaacattacttcagttatagtttaagtaatgctatacacacgttcagttcatagaaataaatatcgaacatccaatgacaattattctaaaaacacagatagagagaaaaaagtgaacaaaatacatgcttcattacatttatcattgtttcgagcactggtctaaatggttgaattaaattaccagcagagttaccacttctaaaaatcggcattccaggagattcaacattaaaagactgtcgtgctaaaaggaggattaatttctcaatagatgtgatagtgtttaggaatgtatgaatggggcttccaactctctacaatgtatatagcccataggactacaatcttcgtctactctacttcacctcctgggtgtatggatgtcttaaaataatcataccgaacttgcaacatatgagatgaatgcaaaaaaaaaaaacacctgatttttcctgtataaaggcatgttttgatttttcctacataaaggcatgttttgtgaaaacagaatcctgacttacatttgatgcagatgtagacgaaaaagtaagctggtgggatcttccaccagaacgtggataagaagacccttttgatgaaccagaagcgcgaattggtgcaggtgatggagatacgttatcccatggggatgctggatattcaaaacaacaatagaagtatgatttatttgatttaaattaaagaagaaaagtgcaaacaacattgaatagctgagcttttgttacctgcataacgtggcgtattcccacctagccaaggagacactaagcgtgcatcaggggatgcagctgcaagcataggagatggtgaaggatgttgtctatgggaatttgagcgatcatcacggtactcccgacgaggtgtatcttcccattcccatcggccactgccaatcagatcttgctaacaatttgcaatcacagccacaattttatcagcaaggacaagccaattagcctaagcatgaaaagaataagataacaaacatgataccaggtgttcttgagcttcttgagctatgctcatgccgacttcgcttgttcatgtagtcaacggatgtagatctctcacgttcatcacgcctattatgcgattctctatcatcatggtgtccccgccttccactgctactatagccaatggatgcagatctttcccgttctccatgtttatcacgggatcccctatcctcatagtcatcatatctacgaggagtgctacgagaatgggaaccttgagaacttctagatttgtgggtctgtaaaacgacatgaacagaaacagacttggttagtaaggtgaagagaaaataaaacagccagattctttatgaagttcccaaagtaatatgggacacaagtaatcactaacatcttgtcgataagatccatctcggtgactgggtgaaggaccccttccatcctcatcagtgatggtaggttctgaaaatggcgataacgctttagttacaatggacaatcatttgcatttgtaacatacaagagtgtatatatataggacctttgaaagaggttctctcatcagagttggctcctcgatagcggcgagaaacactgccacgatggccactgctcaggctcttctcatcactctccgcaggtcccggcttctcatcttcatcgattgaagtagcagctgccactaccttctgaggcggcggcttgaaggcattgccgccttctgcttcccgtttcctgtgcgcgaggaggtccaaacctgcaaaaaccacatctcagaatcagctcacccgagctctagattttgcaggcctcgacgatttctgagtcaaattcaaattgggatctgctcatcaagttttacacactaatctcgctcgcggaaatcgaactccctagcaactctagaaatccacttaaaatcaaaatttcctgaagtctcgtcaaatacagaagcagaagtaaaaccaagcaccaccatacctagggcggacttccccggcggcggccggtacatgaccctatccctgctcggcaggatcagcccctgcgcgcccgtgtcgtcctccggccccagggttgtcatcgtcgcgtccatgtccccctggaacaaagagagaggaagcgccatctcggcgtgagaccaaaagctcgctgactaccccaaaaccccaacgcgctcgaaacagattactcacctccatggtcgccggcgggcggagcggagggcggcctccgagcaccgggcggcgccggttcgactgggaatcggcggcggcggcggcgagagggaaagagaggggggaggggaagaggtcggcgggtggattttgattttggcccctccgaatctggagaggtgaggtgagggcgtgggggatttgggatttgttggtagcgggagggattgggatgtaaaaatcccaacgggagttttccacttgggaccctgtaggtttgatgttattacaagctgtgtttttactaggtcggttagagaattttgtactctagtgcaaagtaaatggtggtaacggttaaacataatcttggattccgagataattacttatttgccctctaaattattgaatgtattctctacttagaaaaaatgtccatgtgttgcaacgggtaaagtctattttaatcttattatatggtttagttaagataaaattcagtgtgggagtctgcttggatatatatatatttttagaaaatcatgagctgcagttaggaatccgatcgtctcaagttaacatacgagtttttttaaacatatttcttatatgattccttctgtattaccaaaagtgaacgattttaaaaactgactcaaatatggatatgtatttcaaaagcaaacgaacttaaaaaccgactcatacacggatgacgtaccaaaataccggcaaaaacatctttaatttttataatagtatatttggccctcataaaattggctccccttttattgtctcttttttctcaactttttttatttgcccttgagtggttcttcatttaaatttttcaaaaaatgcccatcttacccctgcatgaatagtagaatctaataaattattttctttaaacggaaaaaaataaaattgggatatggtatcataagtatatcttttattcgttgcatcatatgtaaatttttaaaaaaatcgtaatagtattattttctttaattaacatgtgtcatccaaacaacacatattgatgaataaaattatgaacatacagttttagtttcattaatgagaattttttttaaaaaaaagggcagattatgaatttatttggaatgtgtggtaccctcataccatatgggaataaaaagggtaataatgaaaaaggtgttaagaaattcttgagatcataataattagttggtgcatcattaccagttcaattacactcttcatcaagcatcataattatgaattttgtaagtgataacaaaatatttgccatgagagagcacctcttgtgaactaccaagggcaaaaaaaatacttttatggttctttgggcaaataaagaagaatagttaaaaatgaagggtgatgtcacaataaagggagagagagtttccgagagaaaataagggactaagtcaacttccatgaaaaataaagaatttactcttggctttccttccttttattaatttaacgtataaaaagtaacctttgaagcatgaagatgagataaatactaaaaccatttcggatatttttgtcctttttggaacaaatattgaatgttgagtaaggattgtattatagtcttaggcccagttattttcttcaactccaaatttcaacttactcatttttcgttaacacgttattcaaactgttaaatggtgcatattttataataaaagtttatatgagttgtttaaaaaaatcaaataaatctatttttaaattttttataatagttaatacttaataatcacatgttaatgagttttctcgtttcacgtgtgctacaaatctctctaaagtcatggaaagaacgctgcacaaactacatgtaatatagaacacattgctctatgtgtctctctgtcccagaaactcttgcctgcattcataactaaaaattgttacattttaggatggaaagaacggtatttattaaatactcaaaaaatatataatatttactttctactttataggatagtgaattgatgtttgtttgacataattgttccttgatttactaatcaaacaactttagatgggtggggataacacaaatgagaagattatggttgttcaacataattggctaacatcaaggccaagtacacaaggtttatgggtcctaaaataccttatattgcatatcttaatccattcttattctagcacggtactagtaaaacatttcatgactaactacatcctcataggtttgtatagaagattgatattttttaggttaattggatacatgccattataaatttgatgtgttttgagatatgccattataatttgtgtatttggatccgcgccattacaatttgcatgtaagttgaaacctgccactagtctacatattttagccgtattggacataattgcccccgtcttcctcctccatctctcgtttctgtgtaacaccagccgaagccttcttccccacctccggcggagtgctgcctcgcagtgacgtagtccccggcgacacgaccatacgacccctccgcgcggtgagacgatgaccaggaatccggcggcggagaggtattgcgcggctgcccgccgccgggagacggcgccggggaagaacttttgaagttgacgaggccggccacgatggagctccgccaccggtcgtgcgcagctacgcccgagcctccctgtcacagatccaccgacgccgtctagccggagcagtggtgcatcctggcccgagctccgccgcaagtggcttcgcccagatccagataaagcgagagagggggcgccgaatccaccgagagctggccggagcctcgtccgctccga

SEQ ID NO: 62537 - DNA, 5462 bp, Oryza sativa
ctttagatccattgagtctacttctcttcctcaatgatataacagggcatatgcgagcttttgacaaaggtagtaaaatgacatgtcccgctcaaatgttaagcccttgaatatcttggtcattgaagtggggtagggtgctttaagtttcttgataattagcccgatgattggttatctgacaatgattatgacaatactatgtttaataaaacaaccaacaaacaagataaatgatcaatgaaaattttcaaatacggcaatctgaaacaagtcatatatagaaggaaaaatgatgagggtgcctaaagcaacaagtgaatttgacaagataaatgagtatacatagaaaatttgagataaatataggctgtgttcggcaccccttttccccaaccactctcccttgttttccacgcgcacacttttcaaactgctaaacggtgtgtttttgcaaaaagtttctatacgatagttatttaaaacatcaaattaatctatttttgaaaaaaaatagctaatacttaactaatcacgcgctaatgaaacgctccgtttttcgtgtgtaccgttccgattgggaaaaaggatgccgaacacagccatagttggcgaggcatccacaaaaaaaatattgggctttcatgttttggtgaaaagtgctcattttgatcgtcatatcctaccttagtataaagttggtatctgttaactcataaagctcaatatgtaagtgtgtcagatcatcacccatatctattttttctataaagttaagacccaaagctgaaacctcagtattccacgtcatcgctaattcttagccgttcgatcggtggatgagatcgcatatgaaccgttggataagaaggtccccggacgagatgttgagcagtgtgtttatgcatgcgttaatttagaatgcatgtaacgcaagcatgtatgggtgagatgttgagcagtgtgtttatgatcagaggccatgggccatggttagtgccatttattctccttctaaatctctattaattcttctagattttttaataatcacatacatgtaactgaacagaaccaacgccatttgagaggttattggttcgatatggaaatgaaaattggtcacatattggtttaatctaaatgcatatatatgcagtagacccacccgattccttttgagcaaatgcaatttcaatttactaggcatttccatcagttatccatacacaaagattagtcttagaatactacaactgaaagtatctcatgtatttccgcagcaatatcaaaccacctttattttacttttcaacgatcaaatcctatatgatataaattgttataaaccccaccatcttaattatttgtagcttttttcaatagttgattaaaactgaaaattatacaagtgtagctattatttcttctaacatcatacaaaaactcccgcaacaacgcacggggtttcatctagtcttactataaagttaatgcccactaactactaaagctcaatatgcaagtgtaccacagcatcaccaactagcaattattatctaaaatgttttagatcacatgcatctgtgccatatcatcacccactagcaattattatctagagtattttaaatatcattcaaacatgacatatcatttacaattttattgtatttttagaactcaatatgtaagcaatgtcatatcattatctccacattattttcatattatttagatatatgcacctaccattttctataatgtataacatgcattcatctacatatctcacggtaagataggataagcaaagttattgctttcttatgtcctccttattttgactttcaacattgcaagcaatttgtagtaaatgagaaagataactataacttcgacgagcaaacttgtttcatctatgcactggtaccaacactctttgcatgactttttgttaacaacgtatacgtcgtgctgttggccccgtctaccagttgatatgccaatttttgttgagaagtaattgttatgtacaagtcatttaaagccgttgcatgtcaaccaatatatagccatcttaacatacaagcgcagtaatcctatgtgaaaaacataacgaaccactacatttcaatcgaatagggtatatttggtgacaatcaatagcacataattcattttttaatacgttgatgaaaaaagaatagagggagtatatgatattattgagctaaactaagattagttcaaatactcatcttaaaattccttagaaattaatgtagaattgatatttcgtttgttccaaaatgctatcgcgcatggaaagcaagtcaaggcgagggaacacctgctcccattcttcggaaactcgaggttattcgcgcaaaatctcctcccgtcggtcgcccgaggtctgacctagggttccggcgactcccatggccggccgccaccgtaacccgccgcccccatccttccctcgcggcggcggcgggggcgtgggcaggggccaccacccgcctcctccctcgctccaccaccaccgcctcccgccgcctcatcacctcgacgacttccgggagccgccgctgctccccccgcaccaccgcctcgacgacttccgcgagccgcaccacctgccgcccccgcaccaccaccaccacctcgacgaattcggcgagccgccgcgccaccacgtgttcgcgggccacggcggcggcgccgggccccccccggcgccgcacgtcgtggcggcgctggaggagcggctcggcgcggagatcgaggaggcgcacgtgctgcttggccagaaccagcggctggccgcgacgcacgtggcgctcgtgcaggaggtctccgccgtgcggcacgagctcggccgcaccgctcgcggccttgccgctgcccaggaggaaggcgaactccgtcttcgcgaggtgcgatgcttttctgatgcgctgattttgtctctgttttttttcccactaaatccttatgagaaaaatcgatctatagcacagaatcctgatgcttatcccttgcatatatttggtctgtttagttcggcaaaactataaattcctcttgcaaatttagttccaactttgacttcctgactcaattgcgctaaaattttattgcggtgggtctgtttgaagtgattatgcaagcataataaccaatgtcgtctattttggaaccctccaaattttgctttgtgaaatattaggtgcatgataatgcgggtctgtttgaagcgattatgttagcataagaacttatgttgtctattttggaaccctctaaattttgcgttgggaaatactgcatgatagtcggagccagtggtatactgtatttgccttgcattgtgcctttgtttgcaaaggtgagggattcagtgagaagaaaattggaaagagggcagtgtaggtacggtagggttaagggctgggcttgcaagcagagccactacaatccatcgtattcttgttttggtagtcttgcaagcagaaccactacaatccatcatattcttgttttggtagtcttcatccaccttagtgttgtttccatccgtctccccctatgctgataatgcacggagctggaggtcagcacttagaagtgcaatgcccgtaactccataagatgtgtgaatatccacattcatgaatcctgggtatggattttattcacatacaaggtgaaccgtgaactgctcacttcatttgaagtcatcttattcttctccctcttgcaagattggtaagcaatggaaatgcggcagggagggagataatgacgagtgagaaactaagaatagaggggagatggcagcaagctagagtagacaaggcgcatgtttatgccttttcgatgccaagcacaataactttccccttcggatgccaagtttgcacaacatttgtccacaagggaaaaagttcattttaatatttgacaaatatgcaacctgtcatggctaagttctagattttcttagtgatacactgaaatttgcatatcataattaatgagtaaatttaaacagcacagagcgttctccctataaatccagaattttctctatgcatgtgtttagttggagggattttggtgggttgggagggggccaacccatttttgtaggtgtttggttgaaggactaggtggaatgggatgaaaccaaaaaggaatattccatcaatatttgggatgagacggtccgccagaaatggccggaccgcgcctatccacttcacccgcgcacatcacgtgacccgcacatacctccatccatacagtgaccttatccttcccagccagagtctattttttccctgtttttacccacccagcgagagcgatgcaacaggagcgagagtggcgatggtagcgtgcgcgccgtcagcgacggccgccactccttcctcctccctcctccatggtggctgccgcgtgcacgcaagtcagcaacggccatggctccttcctccctccatcatgcgtgcgggcgagctgccggcggccacgtgcacaagagtcagtgacggctgcggctccttcatcctcccttctcgcatcctcttgctcgttgctgctgcttgtcctcgcatcctctctcgtcaactgctacgagctgaattctggagctgaggagcagagctagcttggctgtgatgcttgattcgtgattttcgatttctgatagtggatagacatcaccaaagagaaagacatctacgtatatgcaaattaatagctctagcagctctaccagtatagtcaacatgatatatagttgtgaaaatatgtgacggtggattgacatcacaaaagagggcatttttgttagaaaaaaaaaaagctcggtgtgagaggtaacctcactaactcaatgtgaggaggtatctctatccaactatcccaactccatccctccatccctccatccaaacaggtgataggaccattccatccctttttatccctcaaaccaaacaaaaaaatagggttcattcccatccctcaaaccaaacagaaaataaatgacagggatggacccaacccatctcacctcgccctcaaaccaaacacatgctatgcgaaaactctgtttattggagctgtgtaagtattttcacactgcttgatatgatgtttgaaacttctggtcgtacaatggcatatgtaattctttccccccaaaaaaaatcttaactgatctgttcttaatatcttatttccttctattttccccaattatttccacatatcatcttaatccactgcctttaaatacatcatacttaaatgcatattttgtgttgagtataggttcaaagctgcatatctgagtgagaaaggttcattgaaattttcagttgaagagaaactgcattgtttggtaatattttcaaatgtggtcatgtcaaagctatgtctctttgacc

SEQ ID NO: 62538 - DNA, 1371 bp, Oryza sativa
agagcgatgtgtatttttagtctttttgcaaaaatataatctgtatatgcaaaattgttggtgttatctatttcccactgaatcatcttagctatctcctttgcacttgtgagaaaacaatccatcgctgttttgttttgccattctcttggttctatgaactcttttggtttgtctggtcaagttacgatctattataattaaaatttgaaatggaatgagctcttactttttttttgtccaaaatgaattccagttacccctggagtagtagagagagtgaaattccaagaataaccttatgtttttcaaccttatatggttgtattatttgacctgcagatctggcattgaggttgagaagaaaggatatgccgagagctatgagcagggacaagagatgcagaagaaattgatatcagtggcttctgaagtggagaagcttcgagctgaggccgagaagaggtcacgagctgctgtgtctggaggcaatcaaggtacttaacaaactctggatgcttatttttctctagtactctttttagtggttcgggaccatctgtgttatgtagggatacttaatgttttgaaatcagatcatgtcaaccaaagggcataatttgtaaggttgaccatgtagtttaaatctctttccgtgttgcacatctggaatataacttcatcatgacatggtgctcccatcctgcagtgtacgtcggaggctatgggaatcctaaggccgcatatgccgcaaatccttataatgctggatacaacataaatcaagtatgtctcttattctttgtttccgcaatacctatttgcatattctttcatcctcatttcttgctacttttgaagccacatccccaggcaaacactgctgattccggctcccagtttgggcctggctcaacgcacgctccctggggtgcctatgacatgcagagagctactggacggagatgatttttttttcaggtgtgttcagcaaattacaaaagcatacttttctgggacaaacctaacagctttcatgcaatggtgaatcatgaatgtattacttactagtatactctactgtgagttgtgctgtacatgtattacctccgtttcaaaatgttgcaacctaggacgtgatttatcctaatacaacaaatctagacaaaagttctatccagatttgttgttctacgatgggtcaaatctgtcaaatcccatgatgctgatggagactgcagatttgcgtcgatgtgcattttccacgctagaggcatccatttctggcgcagcaatctctttcgatcgatctatggacgagtgcgggcgagattcgttgagaaacataatggatgatttgtgatgtcggaa

SEQ ID NO: 62539 - DNA, 2915 bp, Oryza sativa
  unsure (1)..(2915): unsure at all n locations
attttgccgtgtcaaataaaatataaaaaataaacacatactaggtcagcgacagaaccaccagccatatattccattactatccacagtttcgtttgatgaagatatgagccataatagtcagttatatatggacaacggcattgtgacaaaacagatatctcctgcaacatgaaattaatcctattaggaattaggaaataaattatccacattcaatttgatctcatcatatcctgtaattgatacagcgtataaggcgaaagaacaaccttttggatgtcttcaatgtcatcctcactgcatagaattaaaggacatataagtaactaatataaaattctggtagtgtagaaaactatatcaaaagaaccaggcaaatctaaaagagcaaacagaatacaccactttgttactggtacaagaaatatattagcaccagtacacaatacaccttttcttcttgcaataagccaataaaaaaaggatatcatgattgcaaatggcaagaaacatgttggcttatatgccataaaacctgatataatatggtaaataaggagtcagagggaacttcagtgaagagactcacgcttcttctaaatcgataacttttattgcaacttccttatgcagttccttgtcaaacctatagaataaatgacaagaaaacataaagtaagaactgaactttactgtcacagaaaaagaggttagattagaagaaaggtcatggagaaaatataaggtaaatctttaatctttaaaaaagccatgcacaaaatgaggcatgagttagagcatcatcatcacattcactcctgatcgttggattcgaacacaacaattgggagtgcagaaagaaatgtactcaacaaatcctatgtaacgactataaaaatatgtcagtaaatcaaacatcctataagctagtactttctataaaaacgagaaaactaaagttccaagtatattgtgtgattgaaactttccacgctaaattgcacaaacaaattacatcagcaaggcatggaattgatcccggtttcaactgatatgtggaagagataaagatttaagtgcatgtcagatgtaacccttatgtgtgcactgtggtaccaacacaagtttcttactttgagatgcttacaacntcggagcgagattgttttttagttcgtcccataccagatttatgtacttaaattaaatagcatataaacttggccacatacctatcttagcccaagcatcatgcgaataacaaatttttcaggataatccatatgatatttggcataagtatcatggagatctgtgtctcaaacaataataatcactgttgtataagtcggaatactggtgtccaacgggcaaggtaccactaagcaattactcataatacagataattattcggaattataccgaaatttaacattcatctatactcctttaaaagaagaggagtggtgtgggcagtgaatatgccaccccatctactccgattgtgaattttgcaaattacccccttgaataccccttggacttcttaatattagaaaaatcaaatctaaacggatagtcacatataaaatcaaattaacgtcagtattccctcagcaaaaagttgggtagcacattcatagaaaatatatatttattttagggaaaattatagtttattttattttatttatagcaaagcacaggtatttatctagtacaaataaaaatatatatgtgcccagttgttcatttttggagatatttaaaaacattgggttgaactatacatttgtacggtgacaaatcaaataaggaaatatcatctttaatatgtaactaatgatggtttcagtaggtagacatgtggatcatacattagctttgcaaccttctcaactgcaaaattcataaacaagtgtctgctacacatcatgctatcatcgcatactagcatacaaagtggaaactcaaaagcagcaccatatacctgaaacaaagtgcaaactagacatggaagcaacgtatctgcaagcatgaacttaattggccaactgcaagctacgggcacatgcaaactagagaagatttgttggtattaacacaagattgagcagctcaatcagataattaaccattaattgaccaattaatcggtccagccagtcgttttaacgtttgtatagcaaaaaaccatacccagttacatgtatgtgatactttcctttccgtgtacatataaacggatgattatacagccggatcataataacacatagtcatgatacagattagtatacctaagctatctagtctagttcctcgttactaataagattctgaccagttttaccaccagaaaatacaaactttccacgaggctggaaaaaaaaaacaagttccggtcaagtggaaggaactgccgtagcatattccctacgcggacatctttttgcaccagatataaaccacaaaatcaaggtatagaactcatggcacgaaccctgccactcagctaacacggagaaattaaaacagatttatctcattaaggcactaaactagcatttcttttgtttccctgccacacactcgaaccgcatacctttcctcgcagatcctgatcgaacaaccaatggcacctaactagccgcgacacccaaattcccccccatgaaatgcggagaaatgcagaatgctacaccgtctcgaagcaccccaacgctcgaaacgcccaatgccgctcgccccgagagcgaaacaagacgccaccgtcgcccctccccacctcctccccccaacacacatcatcgtcccgaaatccgcgagcgtgaaacacgagagagagagggagaggaaggtaaatccgcgaaccaaccctttgtagacgtcgccgaaggagccgcggcc

SEQ ID NO: 62540 - DNA, 4322 bp, Oryza sativa
cgcgtgggagatctggaagactggtagggtgtggccacggggatcgggggcagggagggaggcaccggggagtagggacggcctaatgttatacgggactcttgtggcaaatgaaatgggctcctcccatgttgattttggataagttaattttacaggtgtttcactcccttatctaatgttttcattttcatttaaaaatatatatgtttgctaattttacatatttggaatatcctatgtcctcttttcttcaacttcggtttcccacttccaccgcttaaagcttgatggataaagtggcggtctctcctaattatgtttgtccatcatgcctactagcaactcagcaataaaatgcgtcaaaaaagaagtaagtcaaactcatgagccacaagagcattggtgaagataaatggagctcgagcttgagatggcactctaggcaatgcaaatagagatcgagctcagggtcgtatcgatgtcgttaatcttagtgcatggagcggatttggaggacagatgagtagaaatgtaagatggcaatgacaagctcatgaagaagcatgagcaatgtggtgcaaccatctctaactccaactaaacagatatgggtgggtggatagcgccgatgtctcatgtggaggcgagtaggatggcagcaacctttttcgaactccaaccagctggatctaagaattaaataggaacaacatggcaacaccataatttgtggagactctcggctgcaaaattcgagaaccgtcgttgctttcctctatggagaagcttgagctcaagccttgggtggcactggcagagacgctcgagctacaagtatggtataggtagatcttgaacttgatcttaggggaggtgatgagtagattaaacttgatcttaggggaggtgatgagatgtaaatgatggtggtggtgctgcataattggagttagagaagagagatggattaaggatgatcatagtataaaattgacaaacatacacagcttgaagtaatatcgttaaatatgggtggttcaaaatgaacattggtaaaaataccataatcaaccaaacctaaggggaattagaggtgactttgactcaaactacctcttgcaaatttacaacttacacttgcagtataaaagttcgatattagatggaggctctaaaaaattattcaatgtgtatattagtatattttaaacattagcataccaggaggcataggtggcttgccccccgaaagtgcttgtacaaaaatccattaaaattatatgaagaagattggctagctcgatcggtggtttggtttaaaaatgctctagtaacaacatttcctttaatcaaattaagatttgttgattttttgactggatcggttctttagctcctttctgaatttggtctcaactaattgtatagaaaaaaaaatgaaccaaactaaaccatttcaagcaaaggtaaagaaaaagtgaagctgacttatcatcaacccctttagatactgagtagttggattgaattttgaattgtacaatggtcctccttttgtggctggacataaattgcaccttcaatgatggatttctattttccaatccatcctataaggtggtaagcaaacaacaattccaaatacaagttgagatggactcaaaagctaagatgtgattacatgacttcatgtctatatatcgtggttgtgcatctagcttataaagattcaaatccgatttaccaccggtatatatcaataatctttgagtaattacacaaatgcatgtttggtaggtgagtacatgtgcctcaaacaatatttaaatgtgtgtaaattacacgcacgacacatacgtgcgtgtatatcgtacaacagcgttaatgtgattacaaccgtataaaataactccctctcaagggaaaaagagttgaggagatacaacaaacttaaggcacctttggattaaagaattttcatatgaattttgagaatccaaatccttagaattttttcttatctaggttgttaacgtaagattgaagtatggaaattcctttgaatcacattcctatacgttaattccatatgaatttaacccatgacctcaaacctcatttttattttttcctttgattgcttttctttttctaatctcagctttcctagtataaacatatcctctactttttctttgtgatgttttctcttccacatcttgtgtagctgcaagacgcgggagatgggccccggctgcggacggggtgccggaatgaacgagcgagcgtgggccccggccgcggacggggtgccggaatgaacgagcgagcgtaggtgagtgccgatgactaccactagtggagctcttattggctgtggtggaagagtaacatgagggattgtggccaccaccatccacactaaagtcgtcgccctatttgaccgagaagctagttagcacggtgaaaagtagcaacttgatcgatcagtcacctacacccacactagaagaagaatggcaagaacgagtgagctatatatgtgggaaggcgagagccacgatgccggccatcacgacagtgtggggggatacaggtgtgacgttgggcaaggcggcgtggtgattgggtttgggtttgaggccgccccggtgttgacagcaatgacggaggtcgggatcgactggagcgacattgaactgccagctgggacgaccggtgtcggtgtgagagggcgggcgtccaacgtcgatctactgaagccgaggcaacgattttttttttttcgtacgccagaggagcgaagaggatggcgcacatcaggggcacccatcttgtgtgcgccacatgtggatctggcacaagggcgaagtgagacgaagcacatgggatcaaatgggggtgatgtgggacccacaaaacatgtttttaatcgctagtactggctgcatgcaagttgtttgacatgtgaagttgtgctaccgcccggtgccagatttatagctcgctctcttctctttccttaattatctccccctccacctaggaatatgatgacattaaagtttttggagcctgctgattcatcttattgtatatgctcttaagaagtcaattgcgtcttctctctgtctctctctcctttagaatcaatccaaattcaaatattatttttctgttagtcattcaaacacatcatcttttgaattatcaggtgttatcaacaactattgttcctgcaacagttgaaaaatagctataacctaccacggtgttcaattgatgcagtcgcaacaacaatcccggtcgatcaagcccacaatgttttagattcttatgagattcgctagcaaactactccctccatcccaaaataaactaacctcataatagaatatgacgcatcctagtataaatgaacatgatgtctcacgtcctagtacgaagttggtttattttgggacagagggagtagcatttaaattcaatgcttattttatttttaaatctagcgtagtcatcaaatccatagtagtcaaatcaaatgctacataacctgaattcaacgatcaacgacatacataggagtaagtaccagtaccagagctcttcgaccgtctgcctaagcctaacacacatgacacatggacaccgaacacaaccgtagttcactgcaaaggtagcactactggtaggctagtagcaaagctgatgagagcagcggccgcagattcacagcacgatggggtcggacgactgcgagcccttccctcccacgcgcctgaacctcttcgcctgcacgcagctccggcggttccgccgcaccgcgccgccgccgccgcctgatcccttcgccgccccgtcctcctcctcccgccgccgccgccgccgccacttctgctcctcctcctcctcctcctcctcatcctgctgctgctgctcatcagaccgctccttcggcggcacggcgtcgtcgtcgtcggcgtcgccgcgcacgatccccggagcctccgcgtcccccgtgccatgcggcgcttcctgctcgcgcggtggcatcacagccaggggagggatcaccgcgatcacctggggctggggctgtggcgcggcgtcgcctcgcttaagcggcggagcaggaggggaggcctcgatgagaccgcggatcctggacagggacgtcgccagctcggcggggaggcggtgttgctccagaaaccgcgcgacggtcgggagctcctccctgacgccctccacctgcatgaaccgatccaatcgatcacaacaacgaaacgcacgatgcaatcacccgaactgaaccg

SEQ ID NO: 62541 - DNA, 5800 bp, Oryza sativa
caaacatgccagcaaattcgacttctgtaagttgtaacaatgataacaaagttaattgcgaatatatctatactaattaaaatttaatttgctacttttattacaatttaaataagtaaaatttgagcttgcatatttgtaggataacatattattacatatgaatctaccttgttattttttttttaatttttttataaccatttagttgatagtatgtagcaaaagggtagatgtccacctaagtgattaaaagtgtttcaccgacaggtagttttaccacggatatcaggctgagcccaagggaagctcgcgccatggtcgccggagtgaaaacatctgcggcggcggcggcggcggcatctgctgtatgaccatgatcaccaccatctgcagcgttgatcagctgctggaaccgttcgatctctgaagcgtacatcaggctccagtccactgccgggttccacagctgccgctggaacgcggggacatcgttgagcgggcgatgctgttcttgcccaaactggcgagcgaaccggtccggggcgtagatttccttgaggttgaagctgaccagccatgttctggagaagcagaggttatccggagcagcgcaatgcttcggaatggatgcaggatcaacgcccttgtagggctcccagttgacctgaagttgttgttcatatcatcatatggtctcaaatcaaatggcaagggaaaggatgaaatgctgaacacaaaactgtggtgatgactgatgagaatcacaactcagatggatagacttttacatcagaaacttgaagcaggccgaaggctttcctgatgtctgaaacgttcttggccggttgagagatcgtgctccctgtccacttgagtactcgtgggaagatgtgttctggaggatcatacatgtcagggcgcaatgccggaatatactcatatatccagccctacagacagatattcagaatatatcagaacattttcgcaatggacacagtgaaggcacaagtcacaaacttggtctgtaaggtaaaattttgtgagaaacaaaaatggagaattttgttatttcctatcatctttatgccttactatcaattacaattctcatgttgaagttcattaatccttttcagaaaacatgaacagatcataacaatcaaaatagttttttgatagtttcatagaactggaagatcatttcctactcgaaattcaagtgatattttcctatacaatggttttgttaaacataccatgagcaaagccgcgctaccgaatagcctttttctggcagaatgggccacggcgatggagagagccttgtagagatgagcaagagcagcagcaccccaagcatattcctgtaccttgtcaaagtctgacagaagtggcaaatactttggtgagacatagcccctgtccctctctggaagtaaggctgatccaatcaagaacaggagatatgccctggtgccatacatggtctgatcattggtggggcgttccgggatccggctaaacttggattgcagccaagagagcttcacatggctgcccctgcagtccctgcaatcaggcacttgccccagatactggaagcagaggtcttcgaccgacttgttgagcacagctccggttgtcaccacacggcctgtcaccggaatccccagtatgtaggcggcgtccctgagtgagggtgccatttcaaagccattgagctgagcagtgttggtctccttgctccacagttcgaagaatgccatgagcgcgatgcgatcgatgactaggcctgctgtgtgtatcaggttgccgagcccgcttgcatcgaccaattgttgctgctgctcattcagcttccatgtgtcgagtctctccgtcgtctggcatacggttagttcatgggttccctgtatgtttgagcatcaaaatgttatgatttaggtacaaactatatatcacaagagccaaaggaaggttcagcaaattggtgtcgcttgctcgttgttgataaataataattacctgaatgacgcttttgtttgttggttctgcctctgcggattccatctggttccattaagagaaggaatgttatgtggtaagtgtgcatacaatccaagaattgctcgcagagaaatttcagtttaagcatccaggttaagtacggcaagaatttgcataagtttgataacaacttaacaagtcctcaatgagcggtctattgcttatatgagcaactgaacatgtaattgagactttgttcccctcaaggaaatgaaaaaattaactagcacagaatctggaaactttgacattggtaatcaaaaggactgtatatatcaggcatgatgataataaggctgggaaaaactgtagataccaggtttgattcactaaagttcaccaaaaaactgtagaagtttttaaacagatgacgtgagctctacccttaagaggaagagaactgcaaccacaaagagcaaaagcactaggaacaactgctttaaattttcttcagaataaggagaaagcaaaatgccaggattggccacatacaaggtacaaaaggacagcagcaaccagccaagaaaccatcaaagtttacctgaacaaaaaagatacgttgtgaaacaggaactgaactactcatctaatcaactgtaaaaataaagaaacaaaatctggaggaaaattgaatcgaaatgacgtagatgaagttggttgtgcgcctaacagcagccatttccatcatcttaaaatattgcagcagatgaggaagaataccagcactaaattaacgagtatacacttgatcaagaagatggtataccattttaatcatagaaaacatcacacaaaagagggggaacaaaatatcgaagaaatacatccgataaccatccatttccttctaaaactgactaggaagagcaaaataaaattgaccgctatcctctaaaacccaacccacaaatatggaaatcgggacagaaaacaaagggaaaggagaaaaaaaaaactgaagaccatagatgagatggaacccttacacagaagctggagaccatccatagcagttgaaaaattcagcaggaaaacagaaacacacaccccacacaggcgattcccagtcataagcacaaggatgaaatgatgaaagaataccaaaatgcaggagcaaacaaagcgatccgggattcaccatgaacgaaggagatgcaaggaaaaaaaaatactggcatatcatatcacacgatgagagtgatagaaaagagagagcaaactaaccaggatcaatgagtagccgcagcagcgagcgagaggcaacaagagcacagcaaagaaggcgaagagcttcttctatgcaggcgagcgttggttgggcaatgaaagggcaggcgatggcgattgccttcgtggttgccttgcctccaccgctgacgtgtggggccccccgtgccagaggtcgctgctagggcgaaacgtggcgctctcatcactggtagctttcccatgtagaatgatcactgatcacatggtaacactgtcctcggctagccactgcctcgccaaatatggctataggagccttcaatggtgcactgccagcatatcaataagctggttttaggatcaacagcagcaggagtagctggtgcaacaaacaatccaagcgtacaaggctgatgaattgatgtgatagcacagtaggctctctacatctctacttggatcattctacaagcagtcaaagcttagcatcattataaaatcaccaattcaccatgttgcaagagctgcagattaaacgggagagggcacaatccagttcacgagcaacacagttaaaagggtcttggtggcatcatctacattttgcccaactacatggtagagactagagagagatagtattaacaaggagataaagcttgcaagctctgcgcagtgaatggcaaggcgctaccagcaaaaagtctacgacgctacataaaccagttaactgtcagcagcccaagtttttctgctactttgtacataaaccatggatgatcagaggaagatcgggttggtcgcctcggctcccaccccgtccctgtgcttgaacattttcagctgcacacagagacgcccgctccttcggaggttctcggtgtccctggggagccggatttcgtcgcggtcttgctgcctccgcttccttgattccggcgagctcgagtccagcgaggaacaggacggcgtcgtcaggtgggagttctgccagaggtccatgaccccttgttccttgaactcctccgctccatcgagcagagggacggtgccatccagaaccatgtcgcacttgctatcctgataaggtatcagcacggctgggaatcggtccgcccttgagttcggagggcttgaaggatcttgaaagaatgacggcttccccctctttcttgggttctttgacctgacattgctgtcctggccctgccctgcttgatctttctttcggctactctgtggtggggagtaactcttgatcatcatacccactctctctagaaagcttgcaacttccacagggagtaactgtccctccaggtaacgatcaattactggaaaatcattcctcagatcttcaacctgcatctcacaaacagcaattacaataaggaccactatgcaagcaaaaacatatgaaggattagcttcttatttgtagcttaccattgaagagaagttctgagatgtgctccgactacatcctgcagcatcttgtttagttatagactcaattgggagggagttgatattggtttctgcaggagtgaaacgacagccaaccaattgatggaactcctcgatttcacgagcatactcaaccctccagtccttccacttgctcccagttcttcttgcccacatgggcaccccatggaggcgaccttgttccctcccaaactgcctagaaaaccgatcaggtacatacacctcttttatgttaaagctgattagccatgtccgagaatagcagatgttatctgctgcaatgcaatattctggaataattgcaggattcatgtccttgtaaggattccagttgacctgaaaatataattaattaatataaaataacacaacagcagttaaaatctttgttataaatctataaaataggtagacttgcacttgcatcagaaaattgaagctcatcgaaaacttttctccattccatgactttctttctctgtccacgcgttgctcctccaaagttccatcgacaggcccggggcagcaaggtgttctgattcttttgttggggttgagttaatggaagatattcataaatccaagccttgagagaacaaaataaatctcattaacaaagataccaatatcatcgacaatcattcaaatttattcaaacaagaacagtaccatgagcaaagttgcactgccgagaaactgggtagtagcattcggtgttacagcaacagatagtcctctgtacaaatgagcaagggctgcagatccccaggcatattcacgtatctttctaaaatcagccagaagaggtaaatatcttggtgatacaaatcccctcatcgtgtcaggaaataaggtggagccaacaaggtaaagaaggtatgcccgggtgctgtaagcaatctcgttgatagttggattttctggcaattgatgaaatttcctgtacaaccatgtcaatctgattaagccacacagttgctctccatttccagggctctctcctaagaaatgcaaacacatccgcctcaca

SEQ ID NO: 62542 - DNA, 1360 bp, Oryza sativa
atctagccggttgcctccgcacctatataaggagcaccgggaaaccctcattcttccataagcgccacgtgctattcctacgccgtgctgcgcactccaatacagatctaatccactcatctggactagggtattatctcacgtcgagggtctgaaccagtataaacaattgtctccatctctcctagatctagtgcaccctataaattatattgccgatcataagaatcgacattcggctttacagcttcagccttatgaaaaatcaccgtgtaaagatagcacacaaaatctcaaacagtccagcacaaagcccacattttcagaccattgaaaaaccaagagaagacccgcacattcaagcataaccacaaccagaaaaacatccgatcttagccccatcatgatgctccagcacaatgaaaagagaaaaaaaaaggaaccactctacttccatgaaagtttatcccatggcactctattaatcgctgccacacattcagtgatcgaaattaacaacaatctataccctcaaggccacaacatatccagaaaaaaaacagtactaagaacagatgctatgtgctaaacgcacgctaatttcccacagcatttcattgcactcccccaagccatctaccacgggccacgtactacgaaatgctaaaagaaaaaaaaaacctagaccatggaactcgcacagatgcaccaaaaccgctggatggatggatcaagaaccaccaccaccaacccacccaccaagaaccgaaacgggttacaggtacccctgatctgagattgcaggccctcctccgctactgtagcgacggaacgaggcgtaggaagtgcgggaggagcagccggtcaccttactcgccggggaaacgcgccgccgccgccgccaccgccgccgacctccgcttcggagcggaggagaggttggagaaagcgagcaaaatcttcgggaggggaaggaagaaagaaagaaagagagagagaaaagcttatcgagtgcgccccccacccttcctttgccaggtgggccccacaccttttccccgcaacccccatttgggccccgcgcgtcagcgtcccgagcaccccgcggagccagccagccaaacggttcgagccggaccgggtcaagggcttcctctttcctcttccgagttccgaccccgtcgcgttaaaaccctagccaccacaaccacgcactcctcttttttttttccccttccccaccaccaccaccgcgctttttcgccggaaaaaaaaaaggggaaacccggctgcggcggcggcggcggcgccccgcggaggtagggcttgaggtcctgaggtctctcctccgtctcgatct

SEQ ID NO: 62543 - DNA, 3804 bp, Oryza sativa
tcctgcaccccctgcgctgatgatgcaggcagatcaactgcttcctataacgtcttggcccatgcattgttatcatcgaatggccttggcacagccaacattgacacttacccagcgctgtgggcctgcgagatatggtgagaggtatcggtgtccgatgtctgttaggcaggagcggatgtgtggtgaatattgacacgtgaaaaaaaattaataagcaagtcatatctggttgcatgtatgagaagtttaatgtttttgccagattctatgcaattttgtttgaataatactctcgaataattatgtacaattgaacacctcctgttaattaattgtacataagcaattctcattatttctatgttctgttcctgtttgtgtttactattttattctggcatgttaaacagcttgcctctatctgaatcttctggccctgaaaagaagctaaaattatttttctttgtcaagaccaaaaagtatttattcaaaccaaacactatgaccacacaagcttgtaagaagagaagagcagtttatataagcagtgaatcagaagactctggtacagactctgaggttgagggaagcaaactctccaaaaaagatggggtcacgtcagtctatacatgtggtcaccagccaacctctaagaataaggttgatccgatgaatactagcaagtcaaggcagtgtggaagtattctgaagaagctcatggatcacaaaagtggatggatttttaatacaccagttgatccagtggtatatggaattcctgattactttgatgttattcgcaatccgatggacttgggtactgttaaaaggaaactcacaagcaagcaatattccaacccttatgagtttgcagcagatgtgaggctaacattctcgaatgcgatgaagtataatcctccaggaaatgatgtccacggaatagctgatcaattgaacaaaatatttgattcggaatggaaattattggaaaggaaatggaaagacagaaatttggtacaagagcagccatcactgaaggtattaaaggctcagcctgctgttaccccaaaacctgtgctacctaagggggtgactgcaggcacaaattcagctgtgagcaagacactggcaactgcattatcctccaaagtatgatcacagtcatgtaccctcattcagtgatttttcttcttgggactttgatcaaagtactgctctctttgcaggtaaaaattaaattttctgtgcgaggctctgagctgacctcttccaaaggtgtgaatagaataaactctatgcatacaatctttccattgttgattgtatttgacagccattaccaatgcttttcaattcagacacgcctttgcaagcagttggcagaagagacggcacaattaaccaatctctcccttgcaccaaggttttgggcacgagctcctttgtttatacttgagtattcttatctgagtcttggtatcattagctaaacaattgtgtgatccccctcttgtcttgtcttttatttttaggacaatgctaagacaccaaggatacaatcaagtgaggacagatctgaatcaactggtatgtttatgatttccacgtaattttatcccatactgttttattttactaaagcactcaattattatcttaggaaatgaattgcggccttgcgatgatgcttctacttcacctcttgcttcttccagacaaggttggacatgctatctatttatccatctatttgtgcatgttaatttgcatactagtatctctgttctcaaaaggatgatgtcctagattcattgcaaacacagtcaaacctcaaaaatcttaaatcattaataaatgaaaaaataccaggatttaaaaatcatattagtagatttgtgaggaaaaactgtcatatggttatattttaaatattgttcccatactatcataaaaatacaaactgattccatttgtcatccttgagttttcggccatggcgcaattctgtcgatttcctgcacgtgatttttcggtcgtctcatcattgtttgtttttcatctgagtcctgtgcacactgtggtccgttgtctgcatccgagacccactcacatccgttgtccaacgtcccacgcatgaccctgcctcaccttggccacatgcacccctcttccgtgtgcccatggtgctcccctcctgatccatcctttcctttcgtccatctccctcttcctatgctgcgagaagcagagctgccacaagcagaggcaaagcacagagcgtgattcacttagctaagctgaacatgatcccttaatttttctccatcagataagcatcgagaagaagtggaacaaatttctggattgattcattgtttatgtgagtagttctcaagtctggtttagttacattacgtaaatgtttctgatccacacccttcttttcgtaggacgatgaaaaagaatggataaagatcccaagaatacatagtttgatctgaatactcataccttgagaatagcacatctacaagtaggatttcctctgtgatcgtaccaaaacatgagttccatttggattttcttttttatcattggatttcttcaatgctatagtgtcattcttctggcgcttaatgctatctattcccaattacaattgtgtacagccctacacccgttgcaatgcacggtcattttgctagtaaatatataacttgagaaagtaatgataaaacatgtgcattggagactgccgatgtctctaaatgacaaccatttgagaacaaagggtaataactttatcatctataatttccatatgtgactttgctaatatatagcatcttatgatgtgaattttcagaagaggaatattcgcctgaagaacctttatcaccaagcaaggctcttcgtgcagcaatgctcaagagtcgttttgctggtacaattgtcaaggcgcagcagaaagcacttctggatcatgtattatttctgaaatgtgtactgaaatttgtagatttcaattaggctattccttcgcataggacaagttctagtctacgtctgtgtagctcttgctgatgtgcttttttaatctcctaggggaagaaaatagaccctgcgaaattgcagttagaaaaggagaggctggaaaaaaggcagcaagaaggtaagaatttgcttagcctttgatagcagatggcatggagctgtttgattggcaatacattttttctttaagttcatcaagcattttgatattttatattcgcatagagttctcatctggacttaatatgggatggctgctctttgtgaaagaacttttagaacacattacggtgaaacttgattgacatctcaggcttcgagaaactttgggatcaaaacagtccgtcgagagactttggggaacataaccccggtacatgctagagaattgtttgaacagtacagtgtcccacatagacaagtttgttagtaggtagaaattttatagcaaggcatcatcaagagtcgttttttaacaagtcgatcaggcttccgaccatttttttgttccttgaagcaaataaacttaagatttggatatatagaataagaaaaaagagtaatctttttaccagttgtccccacatagaccacaggttggctaattcaatacactgcttcatagtaactttttgagtcaattcatatactttcacgctgtgaatactcctggtcacatcggatctatatctattttggccaaacgtaatcttgtttcaatatatcaaaactgtagtaattttgtta

SEQ ID NO: 62544 - DNA, 704 bp, Oryza sativa
ccaatagtagaaatcttcacccataaactatacaaaaccatgtaatttgggtccgataatagtatagatgtttgattttgctgacataatatcgtagtcagtaaagtaaacataaaaataatatgtgcgtcccacatgtaactgaagtgagaagaaaaaatattgggcccgcgtgtcagtcccatcacctttcttctcttttcttcctaagcctgggagatggggggcagccgataggacgggagggggggaggaggaggtcggtgagcctgggagggagggagagagaccaaatgcgccggcgggagagcggggagaggaggtcggcgagtctagaagggagagaagaggataggaggttggtgagccttggagggagagagggagagaggcggtcggccgcaccggcgggaaagtggggagagacggtcggcgagcctaggagggagggggaggcaccggtggaagagggaggggagaggtgaccggtgaggttgggagtcatgttcgctgccgctaccgcaatgacgacaaagacgatgacgcacacgcgccactgcgcgcgcccaccgttccaccaccagccccgtgcacgaaggcagcgccgctcagctccagcccgtgcgccatcattgccaaggagacgaaaaccacggagcgcagctcctttccgttaagccactgcatgacgcggtcggcctcca

SEQ ID NO: 62545 - DNA, 944 bp, Oryza sativa
ctgaactggttaagttccttgcggtggaactacccacctaagtatcctatatttgatacgtgtgctcgtatttacggctaattattttttcagtggtagataatgtaattgttgatagcgagacacctctctttcgttgtaaagttgttagtggaaatctgatgcacgccagtttcctactattaatgccaggaaaagaaaattgcccatttccatgagtggtacaaggggaacaaaattaatctttacatagttcccttcaaggcttgaataactttattaacatcgtttccgtatgaacattttgcttatctataaactattaacttatctccatatatatatagcatcttcagaaggatcctggcaatctcctcatcacaacaaccatgtgatcatatgacagccagaacaaaaaacaatggcagtcttctcgcaacaacagcaatcatttgaccgccaaacatcccaattgtgctggataatttgcagagttcaacagtttcagaccattttcctcccagccttcagctattacgctgtcgttctcgaatccggggacaaactcatcaaaatctgctaacgatttaagttgcctgttcagtgaagctattgtcttctggcagtctgccagtttccctgctgcacgagctagctctttctcctgcagaaagtggtgacatctcattagtagcatacaaactaaaagttttagtgtttgtcacaaggcttgattttgcaatatatatgataaatcactgaataaatgtacaattagtactatgaaattcacctttttaatgtgaagttctttacttgccataggtttcattggttggctaagagctctgctggtaaattgctctttcaaattctgacattgcactccaagttcagaagattgtgctttctctttgtgaatttcctcctcgagcaaacggatc

SEQ ID NO: 62546 - DNA, 5249 bp, Oryza sativa
ctggagcgaatttctgatcagaaaagaacgggaactgtccaaaatgcagagctgttgggggaaaaaagaggaaatggcattacctgcagccttctgcattcggcttcgagcttggctatcttcttgatgctctcaagctgctgcttgctggccgtctctgctgccctcctgttcagctccttctcgatggtcctgagctccacctcctccgacatggccagcagctgaaccttgagagcagagttctccttctccaaggaggccagccttgagctcgcatcagtttcagcgttcaccgagaactcggacttcgcctccagcttcgccttcagctcgactactcgcagctcgaggtcggccttctccgactcccattctcgcgactgctgcgctagcgcgtcctggatgccatgatccagctcttccttggcacgccggagttgcctgacgcattccttgagggcgccgtcgaggtgaacgattctgtcttccagtgttgagttcttggcagttgcagcgttcagctgggtcttcagtgatgctatctctttctcggccttctcccatcctagtaggagaattgcaggtttttgttatgaagatctggcttgtcagttgtcagttctatttatgcatgtgtagaaataacactgtttctaggatcagattaaaaaaagaactctttctaggggattaagcttttgcttcaaatcattagtacattattcgtgaaaaaaatattagtacataaaacttaaggattaggttgagaggaccttagaataagaatgttctttttctaagtcagggaattgataaaactacaaatgagcttttggaccacatgatcagtacaaaaaattaaaagcaagagacaaggaacatatctgcatatgcatatgcagtatatccaggtccaaacagagtcatttcttaaattttttggcccagcgaaaaacaataatttgtttgaatttttgcttcatgtactgaaactgtacgattcagtcatgtttaacatcatacctagaacagcttcctccgcaacttttgaatgctgcttcacaagatcatcttttgcacgtatgtccaaaactgcagatgacagtctctcgctcaacaccttcaccttcacattgtcatcctgcgcttccttcgacgagatctccggtgattgaactgagcttggagaactctttggagtatcctaaccaagaacaaacaggatcaaacattgtcctgactagaaagtgcaaaattaggaggctattcatgcaaaatttcttgtgaacttcagctattagtcatgcaacagtattgcagaacaaagggagtggctgaagtaacaataagaaacctctattggatgcatctgaaaatttggaagaatcaattatcaaagtattaaatactgttttttttctgacaaaagcaaatgagcacgtgaagtacgacatggtactttctgagatcatgttcttgcatgattcccaacattatgctcagagaagcacaatgattaaggggattcttaggactttgagcaccattactccataatcatcatcatattaacttctatacaataggacacccctaattaaatgcacaactccatcagaattccagacatttctttggaggtacaggtagagctgatggtcaaagatcaggaattcacaagtaaatgttgcacatgaacagaggtgagagagagagagagagagagagagagagaggcatcttgattgctctgtgccagcagacacattatgaggcatttgggttgggcaaagggtgatgctgcagcacatggagatggatggagtggccaccaaagaaaatgcatcttgccctcatgcaagccataattcctgcagagaaaagctagtcccaactaacatcacatccttgttgtccatggataggtaaggcttgtcctataatcccttcccggtatagaaacaaacaggacccctctctctcattctctccttcagtttacaggcctacccaaaaactgtgacatatgatcatggactaattgccagtgtcacctaccaaacaaaggaagggaaactgaatctatcttacagtcccctcattttgtcatgtggctagtatgattgggagctgctatgtggatgtctacgaggatgtcgcaaacgcgcgattttcgcgatatcaccagacaagagaataaacctgctaggatggatgaatcatcaaacagaaagaataattcttgtaccctacatggtacaactaggattggtcaggaagaactgagctgtttttatgcagaggaactctgatcctccatcaaaatctttatctaatgccatcagagcttcaaatcttaaagagttcacatctgcaacatggtggtagattaccaaagcttccagcctctacagatctgaaaccggatgaaacctcacatgtttgccatatcagatggacccttattttctctgtactgcacatgttacatgatctgttcaatggaaggagcgtagggctcacaaagtcaattgacaatcatcaattcgtttgagcatgcttgcacaacactcctagacactagacaggtattatcattcttcaacatttgagcctcttttactgttacccagttactttttcctgctccttggacccattggtagtttgagaaatgtgagataaacatgcggaaatgaccgcgatttcggaaaaaaaatatgaactttattttccgagaacacgcagaagagctgcgtgtctttggattggtaggaaaagattactgcccaattatcgtgatattctaatattgcaagtagtacctactgtttgactttaaattgtgcaaatatgtataaacttctgaaatgtgaatgcagtatacagggagaagaagaaagagagtgacttgttttttttttctcacctgttcatcagacagcctctcggatggagaagaaaccgagctctcggtctcggccgggctcttctccgtcgatctccgccgccatagccagctccggcgatccatccctggagctctctacaccattcggctcaatgccgatgcttctgcgcctcaatctctctgcttatctcactgtcttcctattcagcaatccaaattcgatgagttcatttttttttctgaagaaaaaggaaagaaattttgcctcttatattaataaagcaggaattcgatgagttcatggtcgcacaagaaaccaaacacacagaaaggaaaaaaaggagttgcagcttttgtatttttgtccgtccaagaacacaatcaaaaagccttcaaaaagtcaacttgatacagtccagtgaccgtgagacaaaacctccttgatcgagacatgaaattcagctcaagttcagaagtttatcagtgtgcgacgaactcacccagaaaaaagtttacaaatcctaccaaattaccatcccggcaccaagacctatcactctatcagagattcagagccaaaatttcacccaatgcatccacatctaatcagagaagaaacaaaaacagaaagaaaaaaaaaagaaagaaaccatcctacctgccatccatggagaatgaacagaaaacaaccatcagatggattagctcgtactgggccaatccaagaacaagcattgcatatcgttttcacctcaaaaaccacccaaatcaacccgaaagatttcatcaagaaaaccaaaaatcccagaacacgctcccctccactacaaattaatcaccaagaaatgggagaagcgaaggcagagtccacacgaacaggacatgaatccaagcagagaagaagagcagtggagcagcagcacacgcacctcccggaggaggccgagaagcgtgacgagccgcggccggaaggaagcgaggcggcgcgatacacgagacccgacccgctggattcctcctcctactcttcctcctttacctcgcctatttaaaaccgcgaggtcggagagtacaaaaggagtgtgaaaataaatacttgaaaaaaaagagagaggaagaaaggtgtggcgtctcaatagggagaagaaagaaatggaggcttcgatgtggcattttcacgcgagataagggtttgatgaaaaaaaactgagaaataggaaaaaaatacagtattttaacaatgataagggcccctttgaatcaaaggaattataaaggaattttatagggttgaaatactataggaaatttttccacgtagccctttgattcaaaggattgaaattttccaaatcctacaaaattcctatggaatggcttgttgcatataggttttagaggaaacttagcaagaggtccaatctcttggtaaaaatcctttgagtctatctctctcatccgattcctgtgtttttcctgtggtccaatcaaacgatcattcctgtgttttgtaatcctctgttttacacttacattcctgtcagaatcctatgtttttcctattcctccgtttttttattcctacgattcaaaggggcccttaatagtgcaaatgttgaaaatataatcataactaactgggtgacccgcgcaattgcgcgggtagcacccaaacaaaatcatatatttttttaatatgattttacttaaaatttattaaatagctatctaattgtcttaaaactttgaaggactaaaccttatcatccctgacggagcgtggagctcctcaccgggagaccgcgcaggcccccctttgccggttcggccgggggcgctaagtgaggttcttcgccctcgatcgatctggagaatgttcgcgagagagcaagtgcacgagacacgggcgatgtagacaggttcgggctgctgagaagcgtaataccctactcctgtgttctggtggatctgtgtgtgaaggagttacagagagccggagagccagagagttcaggctccagaacccctctagcctccttttttcttctttttttctttcctcctcctttttggtgggcaaggtcctccttttatatctcaaggggataccacatgcaccacttctacctacttttcttttgggtggggacctaccctatcttgaccaaaacttagcttgcaccttcgcctggaagttaaatcacaacttgtccttgagtgaggctcagcgccgtcactcgcctgacaccggggatctccctgttactcccttattaatgggcggagatttgccatggctgctttccaaatgaccatccgacgaaatgggtcatac

SEQ ID NO: 62547 - DNA, 14905 bp, Oryza sativa
aggaagggatttgtttccttcctctcgtcactcttccctttgcctttgccacttgtgctctgactctccgtttccggcgccctacccttgccatactcgctcgctctcaagctcctcctccgccggcgtcatggcacggggctccgcaccgctcgagggtagcgtgctgccgccttcccgcatcgtgagcgagaggcaggccgggctgccgcgccgattcatgccggaatctgccaccggccgggaggtggtcgcgctgggcgagggacgcccggcgccgcattacccggggcggtccgtcttcttcctctctttcgtaatggcagggctggtcccgccattctcttctttcttcatggatgttctggagctttatgatctccagatggcgcacctcacccccaacgcggtaatgacgttggccatcttcgcgcacctatgcgagatgttcatcagggtgcgcccatctcttcggctgttccggtggttcttcaccgtacagccggtgttgccaccgtcggtagtcggtggctgctactttcagctgcgggggccagtgctgaaccgctacattccctgcgtccttcgcaagaagtgggacgactggaagagcgactggttctacacccctctcgccgacgaagcgcacctccgacttccgagccagcccccggcgcaggcctccagctggcgggcgccggtagatctgggagacggctacgacgccgttcttgaccgcctggcgggtctgcgatcccaggggctcacgggggccatggtgttcggcgactaccttcgtcgccggatcgcgccactccagcggcgcgcccgggacgcctgggagtacactgggtccgaggactacatgaggacccaccaggggggcagatgggactgggcccctgaggacttcaagatggtggtccaacaggtgctgaatctcagctccgtggaggcatccctcatcccccaaggtgtcctccccctctgcagcgatccagagcgcgccaacatcctgactatcatgcaggaggtcagggcgtcaggggagcgggctcctcgaggccacgatggcgcgggcgggagccgcaggggggaacaatctaccccgggagggggtcgtgcttctgggccccgtgatgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgagggggagcgaaaaaagaagcggctccgcaagatggggggaccgaaccatgccggggaaacctcatctcccccccaaggtggtcgtttagccgacctcctcgcaggttcgtccccgcgcccactgcggccgtattcattctcccaaggtgagttttcacttacccgttttctttttgtcttctggtttttcttccgctttcagcgagattccgtcgcgcccccctcgccattccaagtccggccagtctgaggccgaggagacagcgaccgcggaggcccggaggcgggaagctgtccggcgagaagccgcggaccgcctccgggaagctgaggaggctgcccaggaagccgtccgggttcgccaggctgaggaggccgctcaggaggaggccagactccgccgggccgggaagtcagcccgggaggcagaggcgacacgcgcacgccaggcggcctgccaagcccccgacccgactccgcccgaggcaacgacgacttccgaggccacccacgacgaggccgcgggcgcgccgctcggacccgacccttcgggcgacgttcgggacgagccagcctcgggggacgcccctgagtccggcacgtcgattggcgggccgagccgcacagcgcccacaccaaggcagctctcccctctgccttccaccgccccactgaacacagagcccctcctgcaggccctggccgccgcgaacacgacggtgctggacgggttaggtgcccagatggaggtcctgcaagcagagcgggcggaactcgacgcggcgtgggcgcgcgtcgaagaggggcggcgctcggtggaggccatggtggaggcgggccgcaaggcataccgccggcacgcctcagagctcgaggcccgtcggtgggagctggcggagatcgccagggaggtggaggaggagcgggagactgccctcatcgccaccgccgtgctcaacgaggcgcgggacgatctccgccttcaatacgggagccgggtggcggagctagagaagaaactcgacgccgcccggggagtccttgacgccgccactgcacgggaacggcgggcgacggagaacgaggcggcgtcccggcggcgcgaagtggcccttgaggctcgcgccacggcgctggaagagcgcgcccgcgcgagggagagggacctggcggaccgcgagaccgccatcgctatccgggaggcaacgctggcggcgcacgaggccgcctgcgccgaagaggagtccgcactccgcctccgcgaggacgcgctcaccgagcgggagcgagctctcgaggaggccgaggccgcggcgcagcggctggcggacagcctgtccctccacgaggcagcgcgggaggagcaggcgcgccgtaatctggaaggcgcccgcgccgagagggccgcactggatcagcgggccgctgagctcgaggcgcgggcgaaggagctggacgcgagggcgcgcagcggcggggcggccgcgggcgacggcgatctagccgcccgcctcgcagctgtcgaacacaccatcgccgatctgcagggcgcgctggactcgtccgccggggaggtcgaggccctccgcttggcgggcgaggtagggctcggcatgcttcgggacgccgtctcccgtctagaccgcgccgggcggcaagcgggcctctggggcgagcggaccgcgaagtacgccgccaaccaggggggcctcgcccagcgcctctcagagatggccgggactctccagcggctccccgaggaactcgaggagacgatcaagtcatcctcgagagacctcgcccggggggcagtggagtttgtactggcaagctaccaggccagggacccggacttctccccgtgggcagcactggacgagttccctcccggaaccgaggacgacgcgcgcgcgcaggtccgggacgccgccgaccacatcgtccacagcttcgagggtacggcccctcggctcgcgttcgccctcgactccgacgaggagggcggcgacggtggtgtggacgacagcgaccacgaggccggcgacccgggagcctcgaagtgagcccccaggcccccgccaatcttaaaagtttttcctttcttcttccgaggccttcgggcccccttcttgtataaactaatttaatctgcaatcaaacaaagaagaaatttctgtgtcaattttatttgttgtgtgtatgagacgaggatggtctgtgccgcggtccttctgtgtcttggcttgaacaagggctcgtgcccaggtcccagcttcaaacggcgggggtcggggctagtgcctggggagatccacgtgtcgagactggccaggccgggagcgcggtgaccgagggttatggggacccgattgtgggcctttgccgattcccccccggagttcaccacgccccggggcacggctcggttctgggccccgtttggcgatttccgccggcccgggccaccgagggcagggtcgagcacgagcgtgctaattcaagccaagactcttcaaaaggaaacaatggcacagacacagtccttaggaaatcgaaaaagcttttattgaaatacggaagagaaaaaagataagtatatgcatatgtggtagcccccggccaaccctgcacgcccgaggggggtgcggggttggcccgagcccgagacctgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttactcagtccagcacgcgtttggacgcggcgtaggacgaggtcgtctacgcagagtgatcgggcccggacgtgacgctgatggtagcgccgcaggctctgctggtagcgcgcggctcgaagggccgcgcgccgccttcgttcttccaagtagtcgaggtcatctctgcaaagctgatcttgatcagcctcgcagtacatggtggcccgaggggacctcagggtgagctcggatgggagaaccgcctccgcgccgtagacgaggaagaaaggcgtttccccggttgctcggcttggcgtggttcggtttgcccagagcaccgctagcagctcctcgatccacgagtcgccgtgcttcttgaggaatttgaaggtcttggttttgaggcccttgaggatttctgcgttggcgcgctccacttggccattgcttctggggtgggtgggagaggcgaagcagagcttaatgcccatgtcttcgcagtagccaccgaagagctcactagtgaactgggtgccgttatccgtaatgatacggttaggcaccccaaaccgagcagtgatacccctgatgaatttaagtgcggagtgcttattgatcttgatgaccggataagcctcgggccacttagtgaacttgtcgatagcgacatacagatactcgaacccgcccggggcccgtctaaacggacccaggatatcgagcccccagacagcaaacggccatgaaagaggtatggtctgcagggcctaggccggctgatgggtttgcttggcgtggatctggcacgccctgcaccgccggaccaggtcgaccgcatcgttgcgagccgtcggccaatagaaaccctgacgaaaggccttgccaaccaaggtgcgtgaggcagagtgggctccgcactcgccttcatggatatcggcaagaagctcgatgccttgttcccgaggaatgcacttcaggatgactccgttagccgcgtgccgatagagggtcccttccaccagcacgtagtgcttggagatgcgctggacgcgttcactcccttcgcggtcctcgggtagagtcttatctgcgaggtacgcctggatctcagcgatccaagcaatcaatctaagggagctgggagcgctcccctcgggtcccgaggcctggactccgacgggcctcgggggccgttcaggcgcgtccgtctcccctagggggtcgggtcgcgccgacggctgggcaagcctttcttcaaaggcgcctggtggggtctgggctcgcgaggaagcgagccttgagagttcgtcggcgaccgcgttatcccgtctgggcacgtgccgaagctctatcccgttaaaatggcgctccatacgccgcacctggcgcacgtaagcatccatctgcgggtcagagcactggtactccttggagacctggttaacgaccaactgagagtcgcctaacaccaggaggcggcggatccccagtccaaccgccactctgagtcccgcaaggagtccctcgtactctgccatattgttggttgcccgaaagtcgaggtggaccaggtatttaaggacatctccgctcggcgaggtcaacgtaacccccgcaccggcgccctgaagagatagggagccgtcgaattgcatcacccaataggcggtgtgaggcagctgcgaagggcccgagctgacctcggggatggagacgggctcgggagccggtgtccactctgccacaaagtcggcgagggcctggctcttgatcgcgtggcgtggttcaaagtgcaaatcgaactcagagagttcgattgcccatttcaccacccgtccagtaccctctcggttatgcaagatttggccgagggggtaggacgtaaccaccgtgacccgatgcgcctggaaataatggcgcaacttcctcgaagccatcagaatagcgtaaagcatcttctgggcctgagggtatcgggtcttggcgtcccgagggcctcactaacaaagtagacgggccgttgcaccttttggcggggccgatcctcttcgccaggggccgcatctccagggcgcttttcgtccgagaggccgcgcggggcgcactcggcttctgtgtcgacgacctcggggtcggaaggcgacaggcgcggccttcccgcagtggccccggggccatcctgggggtcgggggcgcctggcaccttcggacaagcgggcagagggccagctccgatcgtcgggggcctcgggccaccgttcggctcgggggcctctcctccctgctctctcccgggtcgagtcgacacaaggtggggatgcgcggagcgagggtcgtcctcgtcgcgctccacgaccaacgccgcgctgaccatctgcggagttgccgccaggtagagtagcaacggctcctctggctccggggcgaccaggactgggggagaactgaggtacgccttcaactgagtgagggcccgttcagcctcctccgtccagataaacggcccgaagcgtttgaggagcttaaataggggtagcgccttctctcccagcctcgatatgaaccgacttagggcggccatacagccagtgacgcattgcacatccctaagcttgctgggggggcgcatccgctctatagctcatatcttctcggggttggcctcaatgcctcgggcagagatcaagaacccgagaagcttgcccgcaggcacgccgaacacgcacttgtcggggttcagctttatgcgggcggtgcggagactttcgaaagtttccgctagatctgagagtaaggtctcctggttgcgtgttttcacaaccaagtcatcaacataggcctcaacattacgtcctatttggctacccaaagaaattcgagtagtacgttgaaaagtaggacctgcattgtttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctctcggatgaatccggcctccagaagtcgcgccacctcctcgcggatgaaggcttgacgttccggggcctgccgccgcactttctgccggaccggccttgcgcccggccgtacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaacctgcttgatcgggacctcgtcgcacgtgatcatccgctgcctcggggcggctgggacggaggtgctgagcctctcgtcaccacccgcgggcttggatgccacggcgaggtggtccgcgcgctgctccatgcaagcaagcgcgactttgaggtcgccatggacggtgatggggccaccggggcccggcatcttcatctggagataggcgtagtgtaccgccaccatgaacttcaccaacgcgggcctccccaggaccgcgttgtagggcagactgaggtccgccacatcgaagttcacccgctccgtgcggaagttggcggaaccaccgaaggtgaccgggaggtcgatatggcctagcggccaagtgtgccccggcgtcacaccgatgatcggctgggacggccggagcaccatccccggggccttgatggcgtcaaaggcagcgggggaaaggatgttgagggctgcacccccgtcaatgaggacacgccccaacttcacattgcaaacggtgggagaaaccaccatcgcgatctgtcctccccgggcaacgcacggtgggtggtcggtctggtcgaaggtgagggcaacctccgaccaccgtgcccgccgcgtcgcctcatgggtaggggccacggccagaagctctcgcttcatggccttgaggctccggtgagaagcgtgagcacacgctcccccatcaacggtggcgacggtggcctcaggctcctggaaccctaggtcatcgtcggcatcgttgatgtcctcggcgggggccttctgcttggcctcaccacgccggttgccggcgggagccgccggggtattgccctcacggcgctcctgcctcctctcctcctcccacttcctcgtccgctcagccaaacttttgaccgcgcggcagtccacgaggtcgtggagggaggtattgtgcacggtgcaccacctgccggtcgggcgctccctactgggagcgccggcctccttctttttgtcgctcgcaggcctcccctttcgggtggcccacgaagcgccctcgacggcgaggacgtgaccctcgtcgtcggaatgggccgacctcttcttcctcctcctgtcccgccaccctgaccgagcagcgggcccgggggcggccggagctgccacaccggaaccggaggagttccaggtccaggcctcctccttgcgagccacacggtccgcgagctgaaaaagctccgcggtggtctggggctccttggaggcgatcttctcgagcatgcggttgtgccgcacaccccccctgaacgcgtagatcaccgcgtgtgcagggatgcacggtatggtgttgcggacttgacaaaaccgctgaatgtacgagcgaagagactcatcgtcccctcgctgtaccgcgtgcaagtccgcttcttcacctgggcgcggatatgtgccctggaagttcatggtgaactgctggcacaaatcctcccaagagtggaccgacgcgggtggcaagttcattagccaaccccgcgcctgtcctttcagggccatggggaagaaattcgccatgaccctgtcgtcacccccggcggcctcgatcccaatcgtgtagatctggagaaactcggcggggttgacgcttccgtcgtatttttcggtgatggtgggccggaaccttgggggccaacggacgttccgaaggctcgccacaaaggctcgacagccggcaccgccaaccggggacacggggggctggcccccgtgcccggaccgaagtggcgctccggacgaggaagcgccctccgatgcgtgggcagcacggcgatcattgcgccggcgcttgatattgaagcgggcatctggccccctacgcacatcttcttgggttagaggcgttgacgagggaatggcggacgaacggcgggtaacggccgccgctcgcggcgccctccgcctcgacgacacggagccagcagtagcaacgccagtggccttagtggcggaggaccgccagccggcgcgtaggcgctgctgcgccgtcatgaccaaattggccacgtcatctagccaacgtcgggttggagtctctggatcagggatgacgggcgggtgacgcaggagcgcgcccgcagcctggagcgcgccctggggcgtgctgccatcaccgtagacgaggagacgacgctccccgtctcgccgtccttctccatcgcccgcgtgcggcgaagtcgcggatctttcgacctcctcgagcgcctcctcccgcccaagacttcggcgagagggggacagtggagtacgagctcgacggcgcgggttctgctccccgtcgtcaccgctagcgctcggagagagattgtgcgccactgcccgttcggccatggggctgagcaggagaagcttggcgcacacgaaagaggacgagggcttagaaagacacacgcgccccctacctggcgcgccagatgacggagcgtggagctcctcaccgggagaccgcgcaggcccccctttgccggttcggccgggggcgctaagtgaggttcttcgccctcgatcgatctggagaatgttcgtgagagagcaagtgcacgagacacgggcgatgtagacaggttcgggccgctgagaagcgtaataccctactcctgtgttctggtggatctgtgtgtgaaggagttacagagagccggagagccagagagttcaggctccagaacccctctagcctccttttttcttctttttttctttcctcctcctttttggtgggcaaggtcctccttttatatctcaaggggataccacatgcaccacttctacctacttttcttttgggtggggacctaccctatcttgaccaaaacttggcttgcaccttcgcctggaagttaaatcacaacttgtccttgagtgaggctcagcgccgtcactcgcctgacatcggggatctccatgttactccctcattaatgggcggagatttgccatggctgctttccaaatgaccatccgacgagatgggtcatacctacctccactccaccggaagcagatgcatcgtgggagcacggttgtctgccgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacgtgccaactccaggagttcccacgccggcttcggctagggacgagtgcctggaggctctcatcattccgacaggacggggcgaggcgtgtgtcaggccgcctgttgccacctaacccgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacatgtggcgccaaacccacagggggtcggggcgccccagctctcggggccgaaacgggagcggcccgacccctcggggagacagagggagggacggccacatcaccctcgggcccgacccccccccccccccccgagggggtctggccacgtgggtgactgcagctgccccaaacctctagtcaagatacccccggtcccatgtcaccgacaatccccatgtttctaattatatagttttaaaagtcacaccagttgctaccacttatgtcatctcctcctttacttgcttgctcgatctaccactatttctattcattctctttggaatttttaaaaattggatcttatagttttaaaagtttattgtcacgttgggtttcgtttttttaatttctatatgtcccgtcaaacgttgccattatactcctctatggcctgtccactatctcttctctttattatcattgagattttaaaaatcgaatataattatcgtttgggttcatttttacttctagaagtcctgccaaaccgttagcggctttgccattgtacttctctacagctcgctcgctgcctcacttttttattgtcattgagattttaaaatcgaacatgattatcattgttttttttttactttttagaagttccgaacctttaaaaattagggtttcattttttataatttttagaagtcccgtaaaatgatgccactatgcttctctatggcccgtccgccacctactctttattgtcattgtgattctagaaatcaaacataactatcgttggaatttatttttattttctagaagtcctgtcaaccgttggctgctctgcaactatactcctataaaccccgctcgttgcttctcctttttatagtcattgagattttaaaaatcgaatatgataatcaaatggggtttatttttttttactatctagaagtcctggcaaccgccttgctcgttttcttcatggcctgctggtcgtccctccttttaatcgtcattaggatctatttggtgttttatcaacagtttttatatgttgtatcaaccgtcaccactctactcttttataggtatgttacttaatttatctcgtcatgtgttttagatggtcttttctttcaatagtctttatttttatcacaaattttagttatttataaattttattcctaattgaaatcttatttttatttttccaattttagaatttatttttttttcaaattttaattaatatcatattgtgttcttttaatttttttatttttttattttcaatttcagttgtttcaaaattgtattcctagttgaactctcttttaatttttctaatttcagatattattttattttttattctgaattttcattaatcttgtattaggttcttatatggattcttctttcaatattgcttatttttaattctgaattccagctaattttaaattgtattcctacttgaaactcttcttttatttttttgctaatttcgaatttttattttatttttattcccaattttaattaatctcgtattgggttcttatatggactcttctttttaatattccttatttttaattccgaatttcaacttttttaaaattgtattcctacatgaactatcctttcttttctaattttggattttattttatttttttcaaattttgattaatctcgtattgggttcttacatggaaacttctttaaatattgcttatttttaattccgaatttcagctatttttaaattgtattttttacttagactctccttttttttctaattttggattttattttatttttatttcgaattttgattaatctcgtattgggttcttatatgaaaacttctttcaatattgcttattttaattcctaattttagctatttttaaattgtatttctacttgaactctccttttctttctttttcttttttccgattaatgtgagaatttctagctcccagagtgaacgcagtggctacttttaaagctgttttaataatataatagatagatagattcggcatattttaataaaaaacaagatactaaacatgacatgtgaataacaggaggatgatcaagtgatagtactaaacacaaacatgctaataacaagaataatatcatctagtaacatgttaacactaaagtgaatagagtgatatgcggagaacgctccggattcaaaggcgatggtgttggtgttgtcgctaccgttgccattggcgtctcctccattccattgctagtcgacgtagaggaagaccgttgctgttggcgtcttctcctccattgctgctcgacgtagaggaagaagaacctggcgtagaggaagcagtgtagagagcttattgtctatcggttccgctttctcataaaaacagaaaagacaagaaaacgagcggctggctcgccagccccgttgctccgctccgctaactcggcccggttggctcgactcggcgcacgagcgcgcggtggcagttcgaccaccatcttaaccgctcgacatgtgctctcatttagcaacttacttctcattggttccaaggtgggattaatcttttaacattaattgtgtgcctttgaaattagtatgattaaatcggggctagcccatttaattctaacaataaatatgcagattacaaaatacagaaaaataaaaaacgaatgtttgaatataatgtgtaaaagagtaggaattagaaaaaataagtgcttaaatatactgtatagaaagaaaagtaggaatttgtcgacgggctatacccgcagacgggatttgtagagtatgggaatcgttggaacctgcagacgtgagatcagatcgagcagacaaggaaaaagatttatactgatttggaccctcaaggatagtaataaccctaatctagattatatggatttatggatggaatatcaccaagattacaatgaggaatttcacgactagactaatccgccgactagaaactgtcgaggacggcccgaggagatctactcggcgaatacggctatgacttcctctggattgcttctcaatgtagctttggctatggcttgtaattcgatgcccttccctgaatacgggggtcttgtatatatatagtgtagatcatatttttccctgaataggatttgtcggtgatatgggtccggggtatcagggccatagagaggaggctgcccccgggaggctgcccccggtagccacatggccctccccctgaggggggtcgggcccgaggcagggtggcgaccgccccctccatgccttggggtcgggttacctcgacacccttcgcacggtgccgcgtgtgctacgataggtgggcgcccccagcgcccacctaaccgtatttaaggcggtgtgagcgagcacaccatggcgcattaaatgcacaccgccttaaatgcggcgcatggtgcacctgactggactgtgaccggtctgcgaccggtcgaatgaccgatgtggacagggtagtgcgcctgcgcactggttgcatattaggcggtgtgccgcctgacaccccccgtcacgtcgtgatgaggagaggctgcttagactctcatcaagaccggagacggcttgcctaacccggtcagggtagaatttccgtttcccagcgcaagtgaagacccaaaaatcttcactcattaaatgccgaatgacatgcgtgtcccccgtgtcagactgatagatttgacgggccccacgccatagcaaggcatgccagagacttccaaggcaagcaacaagacatgcatttaatgtgattatcctccctgaataggttcggtggg

SEQ ID NO: 62548 - DNA, 733 bp, Oryza sativa
cgagaagtaaggtcacagctattggacatactgaaaaccctgaagatcccactgacatcatgccatatggaatgggatgtggtgagaaaagccatctgctctgcatacttccataatgccgcgaggttgaagggtgtcggggagtatgtgaactgcggaacgggatgccatgccacctccaccccagcagtgcactctacggccttggttacacccctgactatgttgtctaccatgagcttgtcctgacgaccaaagagtacatgcagtgcgtcaccgctgttgacccgcagtggctggcagagttgggccctatgttcttctctgttaaggaaaccgacacctcgctcctcgaccataagaagaggcagaaggaggacaagaccgcgatggaggaggagatggagaagctgaggcaagaacaagccgaggccgcacggcttgagaaggagagggagcgagagaagagagctaagcagcagcagcaagtttctatgccgggcttgaagaaaggctcgacatacttgaggcccaaaaggatgggtctatagatgagaaaacttgatgaaagtattcaatgtactgtgattttgttatatcgagggctcttgtacaaatacagctacgctgactcctgagctattgtagtatgtaccattctgcatgtataacacatggatgaatgtaacgattacgccacatttggcaagtctgcaatgctgtaatgatcctt

SEQ ID NO: 62549 - DNA, 920 bp, Oryza sativa
cattgacactactcattatacatttgtttcttgaaaattctttataagccccaaaacacatttatttacgctcttaacatttttttataagaattaggttgaatttgaaggacatttgtgcttagctactcagctgcatgtaaaacgagataaaccattagcacatgattaattgagcattaattatttcaaacttgaaagatggattaatatgatttttttaaagaaacttctatatacttcatttagcaatttgagaagcatgcgcacagtgaacgggggaaagtttcagccaacattctgaaacgaatgaagccttaaccttaatattggataatccaatctcgaatgagttgtgtcatcaccacattttatcagtttgatctttgtacaactcgagacatgccaaactcttcactgtattgatgacatgctgcaggctactggtgacaagtttaacggaccagttgttcatacattccttgattccttgatgcatctcgaaaaagagctacctggatcttgtgaggtgctgattggcagaatgctccatcggctagggaggtctgagtttcacttgtgttctctcttatgcgctcctctgcttaccttacccctgtgctctcctctgcttaccttacctctgtgctcagcttgtagctcatgatacctccttgtttgcagctcgaaggagtcctcgctgcaaagtcttcaagagacggcgacatcagttttcgcaaagaaatctgaacctccctctgaacctccaagtaacaagaaaatggctaatacaccttccttggctgcccctaccgtaagccctttggcgaggttccttcttacaaggtttgtttagagaaattgtttcccttttcttattattgctttcccacaacaaaaagtgagttgatgccattggt

SEQ ID NO: 62550 - DNA, 3602 bp, Oryza sativa
ttcctccaaaaagaaattatttaaactttttccaatttaacttgttactccctctcctaaaatataaggcatgtaagatttttattctccaatgtaaaacttttatcatatagaagagatagaaagatgaatctaatgtatttttgtacattaagtagatatatggcacattcgttgtctttgaatgtcacatttatgttaggccgcacttatattaggacgaagaggagataatttatttaaacagaccaaacttaagattcttcttctcagctataagaataatatttgatttgattgagaatgtttttaccgaaatgagaatgtgagctgactccagtttgagataatgtagaacatgacaggtaggagtagtaattagtaagactcgcctctcccccacagtggcactaatctccctgggcctagcatgtcagtcacaccccacaaaaatagccgttgcgaccccgcgccggctccgagccgccgacccgttcacacacaagcgccgcacacctccctttgttaaaccgtttaaaactctcccgaccgttagagcctcctccccctctatccccccaacgttcgtctcctcttcccccgatccaaccaccaccaccttcttctcctcctcttccgctcgacgccatcaccacgcacttgagagagagagagagagagagagagagagaaaccctaagcctcgcccgctatccagccaagcaccgatggcgacggacgcgaacccggaggcggcggcgccgccgccgcagttactggtggacgagggctacgagttctgcgcgcccaagttcttcgacttcgtctgcgacgagacggaggaggaaatccgcgccgccgagcgctggttcgaggcctccgccagccacgccccttcccgtacgctccccaatccccaccccgccgcctcgatcatccccccctctcccgtgttttgctttttttgcgctgattagggctcttcttcttttacctgcttgcagcgttcgctccgaggatcaaggagtcgagggcggaggtcaagatcgagagcctctgcgacttcaccgacgcggagccgattccgaaggtacgaagcagaaagctgcgggaataaccccccaattttgccctaatttctgtaaatctccccccttcttattgtccgttggcctctgcgttcgtcatgataggaggtagcagtggaggaggcagcaggaagcgccgccaatccctcgcagaattctgatgggtaagagttggagaactaaagaaattgtttatgatgattcgttgtgatctgatgaagttaatcgatttctcgtgtgtttttcatcttcacttttggatgttcaggaatgtgcaacagaataaggacggctccatcaaacttgtacgtgatttcttgatgttttcatgttttctatgttctcagtttcagtaagtactagtgttgggtttctagcagctcacatcctgaattcttcaggtccatgaagcaaatcccagtgaaaattgtgtcactgacggcgatcataagcaccaagaaaggtgcatttcaagacctcaatttgttggttcattccgtttcttgctggttttggcatgtgaatgactaattggttgttttgggcagtgatgcaatgttggagtcgccaccagcagaggaggatgagaaggaatcgccaaaatccttcgagtttgtcccttccaatgcaaaatgtaagttgctagttatatatgagcaatggcagtggggaagaactctgatccctggattttgatatcaatgttgcatggctttagcagcagatgttgcttctagcacaccgaagattcagaggcctccacccgtcaaagctgtcactacggtgcctacctgtcccaagctgacagtgaagacagaagccttcactccgaaggtgcaggcaacgaactcctccagaggtcttgcacccttgactggctcaagggcacatccatctgctttgaagcagtcgatgagcgtcaagaggagtgtgatcaagtaagagtcatgctcactcataaaaaaatatattaatctggagattattttcttactaatgtctgaattgttggtttttcagatgccctcgtgagttgctggctgggaaggccgctactgctgcgaatgaaatcgcacaagaaaatcaagctgtcaagagacagaagcttgatgatgggaggacaagacaggtaatactgggatgagattaaagatggcacttcaaatacatgtgtttgcgttgcgcgagatttctgagaaacattgtgtttgccgtcgtggttagatactgaacgtgaagacaaggaccctgcctcacaaggggagaggaggtggtctagcaggaagcaccgagatgagcctgtcggccatgaggaagcaccgtgacgattcacactctctcaaggtagctcccaagttgctcttctgactcttaaatgatagacttaattgtaatgtttcttgtgagaatgcaagtataatgtgattttgttattgtgagcttggcacttagcaacttttgtttctgccatgtgcaggaagtgactcactatatatcggcagcagagatggtaaagaagttcgagtctgggactagagagttggccatccctcacaacagatcgctttctcatgttagcactcatgtgccctttattattaattttaaattgtgtgcatttctccaattttattaatatacatgtcttctcagtcttgttgtgggtatttggttccatacaaagaccgatgtcctttttgtgatactgatatctgcatatcaaatattgcacagttattacatctgaaccgttgacgacgaaatcattattggtactaagaattttgacatattgcaatttgtgcacaatgcaggaggatgcagcaaccgcattacaaagaagaacaaagctgatgctaacaaggccaaaggaacctgagttccagacctcccacagggtccgtgctgtcagagtgaaaagctctgctgagctagaggaggagatgctagccaaaattccgaagttcagagcacggccgtttaacaaaaaagtgagaaatttgtttgctttggttttgattatactaactactcaatccaggatctgaagactaactatttgtttgcttctcctttcagattgcggaggccccttcatttcctcctcttccaaggaaagctccacagcttcctgaatttaatgtacgtcttgtttggctgattcagaaatttatgagctccacagctttgtttggctgattcagttattcctttccaacacctacaggagtttcatcttaaaacgatggagagagctacacgacatgcagacacctgttccgaagcttcttccgtggggactatcagggtaagctcccttcacttaacctggttgctaatatcagtatgtaaattcttcttcttattagtctcctaaaaattaaaattcttggcattactgaaagtttaatcaaatcttgcagagtcagagcagtaagccactgaccttgacagcgccaaaaccaccccaacttgagacagcattacgagctagaccaccaaggtttccctttg

SEQ ID NO: 62551 - DNA, 7556 bp, Oryza sativa
  unsure (1)..(7556): unsure at all n locations
ctgaacaaaaagtctccttatcttcttgaagcttgtacatttgatacattgattgcattgtgcttcaaaacatccagtctgaacatcatttcttgcagattctcgagagcaagggtgatattggtgtgtttccacatctaaaggctcaaccaacagcccccaaggaattccatttctctaccgatgatcgcttgggtcctcctgcagttgtggatctatttgataaggtgagggttctaagtcatgctagtaagctcattattttttttccagaaacctttcttctaagtccttttctattttgtagctctctctttgctcagaatcttcatatcatagcaagaaagatgtgcccagattgacaataccaaaccccttcaatttacatacagatgtaagcagtatgaaagttatttgttttcccaacacattgcatttacctatctgttgcaggcaaataactttgttatccatgttacaggaaagagggcatgagaaagagaggcagctagctgcacaactgctgcaaaagcaattacaggaagagaaagccaggattccgaaggctaatccttatccctacacaactgactatccagtggtacgtgcaaagtaacataccgaatattacatgtcctggttgctgaccatctcatattctgctagccttaacattttctctctctcagataccaccgaagcctgaaccaaaaccatgcacgaggccagaaggctttcagttagagagtttggtgaggcatgagatggagcaacagaggataatggaagaaagagagaggatggagagggaagaggcccagaggagagtagtgaaggcacaccccataatgaaagagtaagccttcacattacggtttctcttgtcccaacagttcctggtttcccttataagatgcatattaatactgttaattttgttgcagggatcccattcctcttccagagaaagagaggaagcctctcactgaagttcaaccacttaagttacatgttgatgaaagggcggtccaaagatcagaatttgacaatatggtcagcaaagcaagcttgttctattatctggtttggaggagcctgccaaattggctgaatttactgagcaattcgttgtcgtgcaggtgaaggaaaaggaaataacttacaagagattgcgagaggaaaatgaattcgcacaaaaggttattattttcttatgccttcttctcaaaatccctacattgttggatgcattttcatctgttctggcaactaacttgctgtgatcttttcatgtgaagattgaggaagagaaagcgttgaagcagctcaggaggaccttggtgccacaagcacggcctctcccgaagtttgacagaccatttcgtccccagaggtaagagcagaaacggccaagatttttgcctacaatgtcatcgacctttccgtttcatctcacaaacgtgaactcgttgtttcgcacacagatcaaccaagcaggtgacgaggccgaagtccccacagcttcaggtcgaccaaagaggggcaagaaggcacgccttcatcagatgatccaactctccggctcatcttgttgtcgtctatcggttacccactggctgctgctgttttctcttctgttcttgacgtcaagatcatccccaattctcgcagcgattctttctgaccaatacataaataggccgatccaatcctgttatatagtcagtcaacacagctgacggcgtgtgtatgctcctttagggttctgctgatgcttgactgcattattgtaaattcagtttgtgtgctgtgtgtgtgtgctgttcgatgaacgacaataggatgacaccctgtcagtgtcctcctcgtctgtttcgacgaatgcaagttgtattcattatttgtttatcatctctgaactatcctggagttctgtcgatgttgaataatctaattcatatctcggcacttggaaaactctcgtgagaaacatatgtaccaagaaaaactgattcatgtcaacaacctagcattctactccatcatccgtttcgaaatgtttaacgccgttgacttttttagcacatgtttgaccgttcgtcttattcaaaaaatttaagtaattattaattcttttcctatcatttgattcattgttaaatatatttttatgtaggcatataattttacatatttcacaaaagtttttgaataagacgaacggtcatatatgtgcttaaaagtcaacagtgtcaaacatttcgaaacggagggagtatcaatgttttactcatttggacatatggaagttgtactcattttgtttatcatttcagatttctatcaacgttgaacaatatgtaaggagttaaggacggcggctggaagcagaaatctgggcatttgaaaaactctcccgagaaaatagacgaatcctgtgaaaacctgtccaccaaattcacatccttctcatgaatcatgtaaaaatgaccggtcaaaaacttagatgcatgatcacacatgcccgtatttcatctaaattttctcccagaataccgttcgcgattctgttcgttgatagtacgtcaatcacattgtcacatgctttcccccaactactgctgacgggcgacgagccgacgactcttgacttgcgcaaaaccattgggggatttcgcttacgaaatcaatccactcagcagcgtagactcgttccaaagatactacgatttggataggccggtggtctggatctggacacaaatcccatccgtgtaattctagtatttctctccatttccaagattgatcgatgcatgtgtagcagaaaataatgatactataatccctagcatttgacatgttctttggattgaaaatataggtgaatccgctcatgcgcttgagctttctatgcgaaagttcgctttgtttttgtcaaacttttctttcgaaaagccacatgctttcggacaaaatatatccctttacgttttgtgccaaacatttctttttgtcctcttactatcagacggaggtgatagcacttcgtccaaaccgcgtttggttcaacgttaagccttaaggcagtccgggtaattaaccttaatgtttcttttgttttaacatggtaccttaatatttcttttgcagggatgattaaacttaaatctagttgggttaattatagcttgggaagcaccgttgattcatgtgaacttggttcaatttttcttaaacaacacatataggtatagtgcgatatttcgtatggatagaacaataaaaaaaaacaagaatatagccttgggaggctatagcctggaaaaaaaagcaaccacaccacacgtttacaatcagacctcactactaatgaactactaatgagatagtaatacgacatctcgaaggaaaaggattttccaaacgacgacttcaagaacgatatgacactgagatgccagcaccgtccatcctaggttcaagacatttcacctagaggaatccatcagggggcaaaagagatcactcaataataccctaaggggaaaagtggcgctcgcaagcgtcgcccttgctagctcaaagaggctaggctttcgtttgtaatcttcctacttcctcgtgtcaagatcttctgctggtcatagagaacaccaccaaccacactccttcgacgcacagccaccgcgccagcatcttgctgccagctgaccatcgagtagaagctcgacatccgacgcattccaaatccatccacacggttaggttggagggcgagagagaagaatggatctcctctccgcactaatctgccaacgaggccttcttatggtgtcgtcgccacaagtggccttcttatggtaggcctgcaacgcacacctcacaaggccaccgttgtcactgccacagctagactgctagcgtcatctcaggccgcccatccgcatcactgccaccttgtcctcgccatgcaccgtaccagctcagtttgccgctggccggcctgcgcctcgctgctctcaacctcgtcaccgtgccggcctcctgccaccgccggacacaccaagcttgcgtcacataggcctttgctgaccgcaacttgcttctatcaccaaccacgtcacgtcagcctcctactccaaatgtcgtcatctacccgctgtagtcggctgcgtcaacctccttctcatccgctgtcgtagcttccagcaccggcctcttacttccgccaacgcaggcgtcccgcggccgccgacgctgtcggcccgtagccgtcggccttctactgaggccaacgccgcccatgccgaagttcactgacaactttctgagctttgcgtcgcttcccccgcgctgtagatggagtgtcgtcgggttttggccccgccaccgccatccttgcttgtcgcccggttttccaggcggtgagctccggtggcagcgaggcatcgaggagggtgggagggacggcggcgggtggctaggatttcgcttcgagccgtctgtgcgtgggtgacacggatatctttcttccttttcggttcaaattctgatccccacaattaagaacacatgggaccatgagttcactttgtgtagaagtttcaatggggttcacgaatttatccatggccccctccatccatctaatgcgttaaaaaaacacacatttacggatatatgtaattgttatatacatgtgtgttgatgtgcttgtgtgcatttcccattaatataaagtagctcgaccagaatctcgtgtgtggcaactaaccttagctatcatggttgtcgtcggcttctatttaagatgtaaattgcccatcatttcattaacttatggacgttttgcatgcctagccaccttttaacaagaataaaaatgggttctatgggaaaagtaggcgtagtggtgaccggtgaagctgtcacccatgggtgcaagacttaatactatctgcgctttcaatagtaatttaacgagggcaaatatttgctactgacactacttagaaaaaaatgttttttcaggcggtcaaaacatgttctcacaggcggcaaaaccttccgtctatatctaaacgacggtaaaaatccctaatttttacaggtggaccaaagcactgcctgcaaaaatcagggggcagtttgaatctttccagacgctgtaggtgctacagtagtcccgcttgtaaaaataccctcagcgccaaaattttttttctcgccaaccccacccgtccctaggggcttcaaatcacaaaccacaaattctcacaaatctcatccaagaaacaaaatccaatcacaaacattgtaaagttgcaacacaaaatcattggattcaaatctacagcaagttaacaacaatgaacatgtaaacttaaaaaaaaacacgtcgtcatcgccggcgaactcctttgttgtatggggtggccgccgccgcctccctcccccctccagctggatctgggaagggagggttggggcagcgagctagcgacgcagccggcgctagtcatcgtcattgcgcagtagggccgtcgtcgtcctgcggtagtactcgtgtgtatagtagtgggatagaaaaaaacaggttatgaggaaatgctttgtgcacgtgtttttctctttaaaatccacaatataatagtatgtactcgatgtactaaatagttaatacatatagaagtttctgatacatgagaactaggagcgagaactaggttcttatatgagaaatcatccaagaaagtaattttaagagggcttaaaaaagaaaataatgaaacaacccatgatcaattnnnnnnnnataaattaagttctacaactcaaattcgaaaagactggtaaggcaacgagcaaacaatgaaaaagttcgacggttcatatttttttttactatagatttgtatcattagatttatcatcgaactgctttaataacatacggtcataaatattcgacactttagtcaaacttttgaaatttcaaaataagtttttacaaaatctaataaatttatgaataatattttaggtaaatttaagtgcacttttttactttctaaaattaagtgtttcaaatggttgagatttaaaaatttgcccaataatcaaatataatgactagagatcggagagagagagtataaagatctgaaataagaaaatagacaatagtagctatagatatatatatgtctagattcatttagatcaatatgaatgtaggaaatgctagaatgacttacattgtgaaacggatgaagtaattcaattactctagatttatttagttattctcatgaaacctcaaatttcagatggaaaagaattatgatattatggtaatatttttgaggtaatttaagtgcacctcttttaattttgaaaattaagcgtttcagatggttgagatttaaaaaattatccaaatcttacatgaacatcaagtataatgaccagagagcgggggagagagtataaaaactcgaaacaagaaaaatagactgattgtttgtttgtagctaatgcactaaagccataccaagagaaccgatcccaatggtaccacattatcgccgatgtgcaaagtacaaaggagttgctagcagaggtgaaatatcgtcatgtcgaaagaggttcaatagggtactcatgagttagcgcagctgactagtagaacgaagcattgtgcactatggtgggagcatattcccacctgcattcaaggccttgttctcaacgattgaaataactttgttctcatcagtaaagctttctctttctgaaaaaaaagaaataagaaaataggcaatactagctattaaaacataattcaattactctggattttagttattctcatgaaacttcaaattttcagatggaaaatttcacagggtcatctgtcagttctgtcgcatctctgtccacagttgatatatgaaaagaaaaatccatcctgaatagaaaaagaaaaacagaaaaaaaaaccttttgtttttccttttttctcacttgtccctacttgaccagtccttgtccctatctcccctttctcaggtcaaccgattctatccaagatccagtccccctttctccttccttccttcctcgagcctcatttcccccccaatcttcttcccaaaagcagctccatccaaacccaatcaagccccactccccaccaacccccttccctcaattataagcctacaactactgctgattgcttcagactgatccaagaaagggaagtttggttgtggtgcagagaggtgcagaagggggagggagggctctgaattttcaagaaagggaccatctttctgctgctgctgctgtccgggttggtgcttgttgaatttgaggctaaagaagtcggaattggaggttttgtaagagggaaacaatggctggcaaggaaatctaccacaagatgaaggacaaggtactgagtaatggaggactggaggatggggattcttgtttgttcttcctttggcctccatttccctttcatgtttattgtttttttttatttt

SEQ ID NO: 62552 - DNA, 1194 bp, Oryza sativa
taaacataatgagtcccgatgccatgaaactccgtgttgacgttagattcttggagttatcatgtttctcgttcctactagcagaagcaggaaacatgtatcagtggagaaaataactactgaggaaacaaaacataactcgtctagaccagtagagagacaagcatttcaatatgttggttatgggaatctggtccatttcaccataaaacttcaagaacacgatctccggcttttgccggttaagcatgaattttattttatgcttagatttttttggatattcttttttatgaaagcttttggaactcaagaactcgtttgattgacgttgttccttgggagttttagagtttgcagcctggaaactagaagttatcttgaaatgttatactctactcaatgtagaatacacacatcactaaatccagactaaattcattttggtagactaccttatgcaccttctttgtgtttattcttgctgtgatgcaaccaatgtcaaaaaagcgaaaactgtttttttgctccattgtgctggatgttttccgcaagcttatatatttgctttgcttagtgttgtactattagcaacttaacatgcttgacgaacgattatgttttgtttaacaggtgaaagatgcttttagttcgtcaggaccagaaacagggaaaggaaaaacaaaattgtcaggcaagcgtgtcaagcatggttaccatcttgtgaagggaaaatcaaatcatccgatggaggactatctagtggcagagtacaggcaagaaggagagcatgatctggggctgtttgcaatatttgatgggcatttgggccacactgttccagacttcctgcgctcacatctctttgataatatcttaaagcaggtaatatttcaaattcaatgtcctgttaataggcttagcctcaatacttgctgcattgcctacatgctcagatagtaagattgttttgtcatcatgcgtcaattgttccaatattgtatttttactagctacatgtcctttgatttactatggataaaaatgaaccatccaagttctaatgctgttcacaataaatagttgtgtcattcattttttttgtcgttttaaggagcatctgacagtgtctgtacttacagtaaaaataacccattcgctatgtacttttatgtgttaaattctgagtttaga

SEQ ID NO: 62553 - DNA, 12072 bp, Oryza sativa
atttatgtccttgtatgactatatactagccatgtggccctcaatactggccatctatttgagcccgtttcattggttgacattgcatcagatcctaagtccaggatacaccctaacactaagcatacctatgccaatattgcattataattaccagcagtggcgtacacagaccctactcttaactgcttctatgctgatactgtcacaacatatgagatgcaatctatcgagcttcaattccaaaaattttttacttgcaggagatgtaccgcgtgttgatggtcagcttgcggttgcaagggcatttggagaccggagcctaaagaagcacctcagctcagagccagatgtggtggaggaacctatagacgagaatactgattttctaattcttgcaagtgatggattatggaaggtgatgcctataagctcataccaaccatccatgatagattacacctaaatttattgttttgcattctatatgcatacctaacctaagctcaacaaactggagaccatgtcctaccttatttaattctatatacacaccaaatctcagaatatgcatacatgcatgcactacattatttaattttgaacatgaggtactggaggttgagttttgtctaacaggtgaaagtgcttattcctacatttcagctacttcctccgtcccaaaatataagcatttttagatatctacacggtcttcgagatgctactttgaccaacaatgtctataaaagtaatatgttttaaataaaaagagttgcatattatgatagtttgtttaatgataaatctagcaatatcaaatttacatgattgatctttttcattattttgctattaatagtcaacatttaaaaagtttgatttggcactattctaaaaatgcttatattttgggatgaatgaagtatgtaatttggcatgcataagcacatcctgactcatgagttgcgaaccttgatttttctattttcttaagctgcatctatgactattgcatgattgtttttttttttgttttagttgagttctttactctttttatgctagttttcccaactcacctcgctcgttttccacgtgcatgcttttcaaactgctaaacggtgtgtttttttgtaaaaaatttctatacgaaagttgttttaaaaaattatattaatccatttttcaaaaaaaaagttaatacataattaattgtgcaatagtacgtgctccgttttgcgtgccggggaggaggggttcccagccttaatgagctgctaagttgcattagcgacgttcttttatcatatgcaacgattataatttcaagatcatacatatccaggtgatgtccaaccaagaggcggtggatgaaatcaaggacttcaaggatgctcaggcagctgcgaagcatctgacggagcaggccgtgaaccggaaaagcaaagacgacatctcctgcatcgttgtaaaattcctctgctagcagaaacagagtctcatacaagtgtacaattgctaccatctgatggtttcagtgttgttacttttgttgaatattctggttagtcttgtcgaacattgccgattgttgaatgccccaatgggacatgttcatatattatccctacaattccagtggatggttcattaattccttttgccctatcactttttctttatcaaaattctctcaacgcgaaaaaaaaataaattgctgaatttttttatctcaattctgaaacaaatgcataacacaaacatgcaacaaaaattgaatggcctgaagaaaaaaaaaatgctcgcatggggaactagctaaggattaccagctgagtctaaatgtaagcacaacgtttggcttaaaacagcaaacaaaaaatattttatgaataggacttatatatgcttttagcaatttaaaagtaaacggtgaaaaataaactataatgaaaaactaaaaaattcaaatttagagtggctttaaaggctgagttcagcaagggagttagaatccttccccttcaacatataaaacggaactgtgaattagcgcataattaattaattatatgcttaaaatttttcaaaataaattaatatgatttttcaagcaacatttctatagaaaactttttcataaagcacatgtttaataattgaaaaagttaaatcaagagcgctctcggtttcctcctatcgcgcgacgcatcttatagccgtctatccgtgtcttcgtgctgttggagagacacgattgcttcatcaaagtgaggaatctgtatagcgtccagtattgctacaaaggacaccaccaatcatcaaaactaaagattggctacactagcattgttattttagtttagtttgtaccattatgctgtactcaaaatatacgataaaacgagtctaacattgaatatatccaaacattttaaataattacttcctccgtttcatattataagtcttataatatgaaacggaggaagtacttgaatcgtagaagtaacttagctctgcaatagtaactacgagataccctttttggaaagaggcgcgccttcgtacatatgctaattaggagaagagtgagttgcgtgtttaggcaacgaagcgacttcgtgctacgtagtcgcgtccccatttaataatttaggaagcatatgcgtgaaaaaaaagagagtgttgaacccacggtcccacactagtcactagcgtggaaaaaaagggagtatagaagtaggaaaaagtgtaccggaggtccctgaacttgtcaccgagatacgaaaatgtcctccaaccgcaataccagatatggggggtcccctaagtatgcaataccggtcacccgaggtcccagggcaggatttctccccgatttgtctgacgtggcagcggttttgtccaccgtggcgctttgacctcggtcgtcgtcgctgacttagcagcccggtagttaggacaacccgtggcgcactgaaggggcattcacttcacttctccctcctctggaaaccctagatcggcgagggcgacgcagctagcgatgaaggcgattcggagcaggctgcggcggacgggcggagtgtcgtgcaggcgaggcggtgaccggcgtgcctctaccgtcgactacctcgagctcgaggtggatctgggggcggcttaggcgcggcgaccagcagccaccttgggcgacctcgaggttgcatcggcgagtacccctccaattgggaatccgaatctggcaggtattacctttcgtagttaactgtgtgtgcttgcatggtaccagtgggatttgggaagtgaaattttttatattgtgagatgccttttttatctgggatttgatgtaagttgggagttttttatttaggtatgtagttgattagaggttatttaggcttacctctgtgcaaaagtttcgatttggacatggtatgcatgtgtaggtcaattataatataccctaaatcagttttatatgttgtttagcatgaaggggatggacgtgttggacactctcgtggttaggtttcatatgaatggggtttttctgttagatgggagtgagaagaagtattgcggtggatctgaggctttgtcatatgtagatagggataagatttccttgtcggagttatttggacacctgaaggagcattgcaatatgttgtcagggacaatgctccactggttgtttcctggtagggatttgcaaacaggtctaagggctctttgtgatgataaggcttgcaaattgatgtgtgattgtactggagaattggaggtggcagatatgtatgttgaagagcccaaaattgtggatttgtgtgataagtctgatgatgagagtgatttatgaggtagagatggaattggaagttgagagtgaagaagatggggaaaaaggggatgtacatgtagatgcatctaaagggaaagaagttgacaagggtaaagcaatagcagaggaggaaactgataggaggatagttttgtaccaatctgaatcagcacctctagttagccatcaaccttttagcagtgctcccaaagctagccatgaaccttcagacagttcacccattccaaatcagccaacatatgacactgaacccatagctaacgatccaccttctgatagtgatgaagatagtgactatattccaggggatgaagctcagtcagatgatgatgaagaggctgctgagatagagaaacattacaagaaggtcaagaggaaggtgaaggcaggacagctagagaacctggatgacttctttctagagaggggacaaccaagtgtgcatggtggtgttgaagatgcagggaatgaaaccccttatgcaaacagcgatgaggaggactcagtagatgagattggtagtgatggggaggtgaggactaagagaagtaaggaaccaaggtacaagaagagtgaaggtgtgcctaagtttgaactagggatgaagttcaactgtaagaagcaattcaagaaggctattacaaaatatgctcttgcagagaagaaagtgattaactttattaaggatgatgggcaaagggtaagggccaagtgtgattggcataactgtccctgggtatgtttgctatccaaaaattctaggtccaacagttggcaaatagtaacatttgaaaatttgcatgcttgtccacctaggagggatagtaggctagttacctctgttagaatagcagagaagtatggaaacttcatagctgctaatccttcttggctacttgctcacatgaaagctattgtacaagaggaaatgtttgcagatgcttctgtggctaagttgaagagagcaaaatggcttgtgcaaaagaaaaagtttgaggctactaaggggcaataccagcagttgtataggtatcaactagagcttcttagaagcaaccctggtagcactgtggttatcaacagagagattggcatggttccaccagtctttaagagaatctacatatgcttggatgcattgaagaaaggtttcatagctggctgtaggaaagttgtgggactggatggatgttttttcaagagggcaaccaatggagagctgctgtgtgcaatgggcagagatgctaacaaccaaatgtaccctattgcttgggcagtggttgccaaagaaaacaatgaggaatgagattggtttcttgatttgctttgtggggacttgaaagtggggacaggggcaagctgggtattcatttcagatcagcagaagataatatcattacaaactgcttttttcacttgtaaatttccatcacatgtcactgaacctttattttttgtatttccatacagggtatcctaaatgctgttgagaagtgggcactggaggctaggggtggaaacgagccgagccaagccttagctcggctcggcttgcaatggctcgcaacaagctaggcttggcttggctcctctcggttagggaaacgagctaaaacatgagctcggcttggctcgtttcttggctcgagccagctcgagctagcttgcaagccttccgttgaagctatataatttgtaatcattaagaaaagcaataacaaatcatcaacatgtaaaattaaaataactttatatattcaattcatcaagatctagacgataaattacatattaacaaataataactccactacaaaataaaatcatccatataaatatatgatggcctaggctcacgagccagctcgggcttggcttgttttagaaacgagctgaaaaggaggcttgggcttggctcgtttggcattcaagccgagccgagctaagcgagctcgagccaagcctgagctgagctcacgagcccgagctttttttccacccctacctgaggctgagcacaggaactgtgctaggcacatttatgccaattggaagaggcattttcctgacaagcaattccagaaaaagttctggaggtgtgcaaaggctccctgcaggatgttattcaatcttgctagggcaaaacttgctcaggtgactcaagctggagctcaagccatactgaacacacaccctgagcattggagtagagcctggttcaggttaggttctaactgtgactcagtaaacaataacatgtgtgaatctttcaacaaatggattttagaatctagattctatccaatcatcacaatgcttgagactattaggagaaaggtcatggttaggattagtgatcagaaatcaaatggtgcaaagtggacaaatgttgtatgccagggattgagaaaaaactaaatgtttacatagctgagtcagccttttgccatgcaatttgcaatggaggtgataattttgaggttaatcaccatgaccataggtttacaatacatttggacaaaaaggaatgctcttgtaggtattggcagctgtcaggactaccatgccctcatgcaatatcttgcatttactatagaaccaacaagctagatgagtacatagcaccttgttactatgtggatgatttcagaagcacacatgtgcactgccttcagccagtagagggaatgagtgcttggccggaggatgatagagaagcactcaatgctcctggatacataaagatgccaggaaggccaagaactaaaaggaggagggagatgcatgaaccacccaagcctaccaaaatgtccaagtatggtactgtcattagatgcactagctgcaagcaaattgggcacaacaaatctacctgtgcaaagcatcatggtgcaagttctagcaacctaggcagttctgagtagcttccatcaccaagtcaacagatggtgttatcaaacacaccaggcagttctgctcaaagcaggaagaggaaagctgtcagccttactacaacaagcaccacagaacattccaagagcaaccaatcaaagagcaaggtaaatggcaacaatttttcactattttcactttcgctaactttacctaattgccatactttcccactacaggcagcaatggatagccaggaagtggtcagggttgctgcaaaggccaaggtttcaacagctcagggtggatctgctagagtagatcttcaagcaatagttccccattcaaacagctctactactgcgtctgtgaggctcacatctggcaaggcaactgtcactgtctcagctcaagagcctacaaaaaacaagccaaagaagagagctggaggattacttattcttctgccctgggaagcaaagaagctttgaatgtgccattgtcagtaatgttagtgcaatatttgaacttcttttgtgatgtaatggcagactatttagccaagtaatctgtgatgccaaaatgtttggctatgtgatctctatgatgccatgctatttggctctcttatcagtgatgtaagacaaattatttatgttgtcatgccagactgttaggctagctatgtcacttattatgtgtatttgaatgtcagacaatgaatgtttgcttatctgttactgctggaagccaaatatggagtcacattttgcattgtcatgaggtttgctgcagaaattggcaggtttcatacactgtttgtatttgtttcatttcctgctgacatggacatttgctgcagaaattgacatgtttcattcactacacaaatggatttttcatacaccgcttgattttgtttccctgaacaaacaccaaaatttgcacaacctgatacacattgcatgctgattttctttcagattccatattgctcttaacacccactcattcacaaatttaattccaactggatagcacaagtgcacaactgatacatacatattttgacacatcaaaggaaagacttgatcacaccattcagtccacatagcatatagacaacacacatctaacaccacacatcagtccacacatcaacatgtctcattccttcccaactaacaccacaaacagcataaaaatacgtgacagcatacagattacaaggatttttttctccttctctaacttttgattcctagccttcaagcttctaattttttcctttttcacagcaaccatagccctcacatcatctatttctctcctctctcgctcccccttagcccgactgtcttcaacttccttatgcaacaattccttctccctcctcaacgaattcaccatgtcccgcaagtcattcaatagctcactgatgaaactggaagtcgggtcgtcacaccatgcccagaaatcacaccccccaacctgaaaccacaaccctacattcaaatcccaaaccgtccaaatccaaattcaacaacagaacaaccaaaagccctcacttaccctagcatgttaacacttgtagtatcggcgcccagggttgtccgtgctccatgagatccacctcgccgctttcgccgggcatcggcatcggcacatcaccgcgggttggtaatccagaggaccaacccggtaaggcacgggagaaggcttccactgatgggaagacgacgagccgtcgctcatcgagctcgacatctccgtaccgccactcgccaagtcgccgccgctctacaaatcgctgccgccgccgccgcccgctcgctagggtttcggtgtttgggggagaagcaaaccgcgccaaacatttccctcgttatatcctaactaccgggctgctgagtcaacaacgacgaccgaggtcaaagcgccacgatggacaaaaccgctgccacgtcggacaaatcggggagaaatcctgccctgggacctcgggtgaccggtattgcatacttaggagaccccccatatctggtattgcggttggaggacgttttagtatcttggtgacaagttcaggacctccggtacactttttccatagagaagaagtatataatacaattttatttttttgaaaaagccatcgattctgtcgatgccgcagtagagcccattgggccaaacctggcccaggactagaatacgcgcgggccaagaaacagggcgccgtgtcgcacgtcgaaaaccctaaaaaaaccaccgccctttctccactcctcccgacgttgccgcctccgcctcctccccctccatcgccggcggccgcttctagccggagagaagaaggcatgccgcggacgagcgtggtcgagagcccccggctgcccgccgctccgggccctcaccaccgacatcctcggcctcatcaaaggtagcccgtccccacccttcccgccgccgccgccgccgcggcggcggcgtgctggtttgcctcctccggtgagagggctgatcatgttttgtggtattcatcctcaaccgcgcagtcgtggaggcccgcacgaagccggcgggcgtcgccaaggtcgtcgagacgtggggcgcgcccgacgcgccccgcgccgtcctcgccgcctcgctcgccgaccgcgccgtcgaccccgtgagtgttcgcgacctcccgttattcctccccgcggtaattggtcagagtatgatcctcactgcgttcctcgcttcttctcttcttctacaggttttggccgtggcgcggaagaacggcgtggtgagcaacgcgtttgcatttggagagctgaagcactcgttgagcatttttgtgctggttgtttattgctgtgggttttgtgtgtaggttgagctgctgaatccactgaatggggagactctcgcaggcgtcaacgctgctgctgggcgggcggcaccggctgatagttctgcagaagaggaccccttagccacgctgcatctcttcagaagacatgcgctggactcatccatgtaattttcatttgatgctctttggcaatttattgtgcacactcaatttgccatgtagatatgggttatgaatccacctgcatttgtggtctccatgctttagtgttctttcattttgtagataatggcatacttatgatgtattcattgcatatgtcaggttaggcacatttcttgcttgtacagagaaggggaaagcatatgtcaagtctgtcgcaaaggaaaatgcatcctcggacatggctgttgggccatcaagctcatgggatgtgagcaattcgggtacagtgcaattttcttcagtggatgctggtgaaagctacgcgatgttcggagggtgggtttacaataatctttatattcattatgtagcatctaagtgtactataaaaaaatattgcttctgattactaactactcaattggaaacatgagtagcttttatgaaggttgaggcgctaataataatatttcattttaggaaaggaatagaagtcaatttgtgggatatcacatcttgtagtaagatatggtctgccaagtctgtaagcactcactgactcacaccttttatcctttttctgggtctacttgcacttttatctgatgttatagcagactgccacgcattaactacttcattcttttttttacctgaagcctcgaggcaacagtcttcagatattcactgcaccttggttcactgctggaacttttttgtgcaaggatgaccatcgtaaaattgtagcctgcacaaataatcatcaggtattgctgatatgctaacaaaaaagatccattttcaactagtttggtcaaactgctctgtttctgtattgttgtctcattgaaactgatccaactttataatggcaaagcagaatgattgcaattgattagttttttcatgccagttagttgtcatgctgtatagtttcctcgtataataaatcatgaaaccgatactggattatgctaaataggatgttctcatacatcagttttcatctttcaaaataacactgcattgatgaggttttctcaatatttgtacctgtggtgcttcttctgattgttaggttcgcttatatgacactgcttcccaaagaaggcctgtaatttcagttgattttagggagtcaccaatcaaggcagttgctgaggacccaaatggacatgctgtctacattggtacaggaagaggggaccttgcttcctttgacatgagaacaggtattatatgatagtagctggtgtgtgataattcttgctgatggcacttggaagtcaaaatacattctgaattatattttcagagttgtagcttagtttgaattttgtatctagtatactatagttcaaataaaaatctcttttcattttcgtactctaaagttcactctggcatgtgtatttcattgtactattttttggctaccatgctctgatgcttacataggtggtacaacattggttgtttatttattttcctgatcgattcatagttagttcatcatgtgctatatggatacatttaactgcctggagaagttttatttaaatttaacttaatattctgcaatgagcttatgcatcatgcacttttttggaggaacagagaaaacaaatatgcatctctgtgggtttccaggaacatcaactgtgaatcaaaaccttcggttgaatattcttgctaaaaatgcacctcctcaattgattcctgtgtacatccctcaactatagcatgaataaagttgtgctgttatggttcttgtactaacctgagcaaatatgccaacaaattttcaggggatttgagactactaaactatctgtgagtgatattgaaataccagataaattggtttcaattcaggcgttagaaagatatcttgttcatgtcccttatcagatatcaaaagatgtttgattattgtatgcttacaacattctagattatattctatgtaaattccttacactttgcaatcggtattcactttttagttctttttaatgtatctatttacagaattaactttagcttgcacccttttcccaggaaaactacttggttgctttgctggtaaatgcagtggaagtattagatctatagttagacatccagagctacctttgatagcatcttgtggtaaggctgcatattttgaaaaaatatttttccaattatttcatattcatttattttgagcgcaaatttattggttacatgtatttgtcttgcacacctttactagtctaggttattctgtttg

SEQ ID NO: 62554 - DNA, 721 bp, Oryza sativa
catataattcatctatcaccattgagttgtttcatttgattcttatcctttgtcacttatcctgttgaaggtagaagcagaaaagttatttcatttgaggttagctgctatacttgatgatgttgaagctgaggtagaattttcactctgcttatcatgtaaactgtcaaaatctcttgcatttctgaattttgcataattcttatttctagatgtcctctgaaaagcaaaagagagaatctgcaccgcctactattcattcccataagcgtgctgagaaggcccagtacttccttgctgaggttaacatgagtaactgacattaccaagcaattataccatattttacatgtcatgtgcattgaaccttcttgttgctgcaggcggtgcataacttcaatggtaccacagaaaaggagttgagtttaattgttggtgattatgtcgttgttcgtcaggtcagtgtcctaataatcatttcatctgcgaagtagtgtgataatcagtttaatcactgcccccattgcccgcagaaagaatcttaagtgattttcaatagtctctagactagatgaccaattagtgccttacttcctctggcaatggaaccaattagtctctggaggcttgtcctgatcatgtagtagctagtgattgtccttctttcaggaataaattagcttgtcaatcaacgagggaataaccagatgatgtacaaagt

SEQ ID NO: 62555 - DNA, 5530 bp, Oryza sativa
cgtcgatgaggccagcatgggcgaagagaatggccgacctgctacgaccggacggagagctcatcaccctcatgtatttggtaattaatcgacggtatcaacatgtctaaagataataataatatcagccccgataagaactaaccaaaattaacctgattttctaaatttgttccttcattacatatttacatatgcatgcaggctgaaggacaagaggccgggccaccattcaatacaacagtgctcgagtaagatcatgcatattgatctttgtacaaatgaaaaatgaaaaaaaaatagatgtcacttgatcatcagaaaaataaatccgctttcccatatagttatatgttccacagacacgtaactgttctccagtatatagaaatctgatcacaagtctgctataccatgcatcatgcagttacaaggaggtgctgaacccgttgggtttagtcattacttctatcgaggacaatgaagtcgcagttgaaccacgaaaggtgattagttaacaaagaacatgaattattacatatcaccatattgcattaacattatttgcttattaaaaaaacatttcggttctactttactcaactcatggcctataacatctgctgtatgtatggagtagtagttactactccctctgttttagattataagacattttgactttagtcaaaatcaaattgttttaagtttgactaagtttatagacaaatatagtaatatttataatactaaattagttttatcaaatcaacaattgaatatacttttataataaatttgtcttgggttgaaaatgttactactttttttataaaattggtcaaactttaaacactttgactttgactaaagtcaaaacgtcttataacctgaaacggagggagtagttagctagctatgtaccacagtaaacccaatctgatgatactttaacctcgattaatttccaggggatggagaaaatcgcaaggtggaagaggatgacaaaatccgactaataagatagtggaggacgcgcgcactccttgttcgcagcataatatgtctacgtcacccgcacatgtctctaataaaaagaaggaaagaaggaaaaatgaatttaatgggcctgattcgagcttgtgcatccgtgtaaatacataatatagtgtaattattctatacatctctatgcaaaatgtatggcgtggcttaattgttacagtaaattaattacttttgtcttctattactactctcgaatagatctctttccctgtgaattacaccattatttagctcactcctctttctaaatctgtttctcaaaaaagaaacttcttttccctttcaactgattggattttttaaaaactgaattggtcgtcaattatgtggcactcttatggagtaaatatttgccttccaataaataggagtatgagtatactgtttccaaaaaagaatagtataagtatgttccgtatgctattgaactgcgttatagatctgtcatcttctttgacaatacattgatgaatttagacacaaatgcatagagaatggagcaaactgccatcagaagcaggtaaggattgccatacaggcgcaacaagttgatctcacagccacaaggccacaacaaacggtgtttcagtctgcttccaacaagcaatgcacatttttcctaggtcggtttccttgatttaaacaaagggctattcacacatgtaatctacatcaccattggggatgtccttgggaagtagccatgttaaaaagccctcattggtgtctcctcttagcctctgggatgaatactccacaagcatgtcccacaactcgccaaccgtccacctatggcgcaatatccactgggtcacctgtcgcagtatgatggggcgaaaaaaaaagagaggtatgaacataagaacaccagaggcttagcaaagaattgctgtatggattaacataaattggaagatcatgtctccaggttgaacatcacagtaattgtttttattgtgcaaattattttattaaactttctaaatgtgcaccagaccacatcaatgactgattcaaggagacactctattggaggatctacaccccttaaccccaaaggatatagggtttttaagttttaccactaaggccttgtcaagagagagggattacaggagattgaggggaaataattcaaaaccacgataggtgtcgaataaatcccctctaattccccttcaatcctcttgggaaaggggttgaatgaacaaggcccaagagaattttcatctcgttttgtcactaagctgaacatccctctcactttttccactcaattgaactagccccagtggctgaaacaaaatagacggcaaatctgagatatcataatttcctagtggcaaaagcaaaagtatccaaaggctagaaatcatagaatacattcacagagccatggacagcacaagacatggagcttacaattattcttaagattttactgctaaaatgaaacaagtactttcgtacagcaaacataaaatgtaggaagggtcgaatagacatgcattacctcttctaatcttttcagtgattcggactcaaaagtgtagtagttaataaaagatcggagtgcctgaaaagcaagaacatacatgaacactccaatgatgtaattacatgaaataatcggtaaaaatttaaattatcgaacattttcgctgtacctgtgatgcagcaatccattgaatcatgctcttgatttcagggtttccaccaaaagccccgcaaccccagtttccagttgaaactcctatgcattcatcaggaatgacacttggacagttatcctttgtatttaaatcctgaaccatgtgaagaaagttaagacataactagaacagactgcttaagtacttctgatgccatgatatgcattaagttactgcatcaatctgaacataatactgagcatattatgtcaggtcttatttaagatcatataatcaggcaacagagtgtggatttgtttgaatcgcccttaattacttcaatggtttacagacagaacaatgtgatagggacaagcagattccgataagtcaatttaacttaagcagagaatgcaacgttgactaatagaccatgatgcttgtcacttgtcagtgcttgaattaaaaagtgagttttgttaacagcaaactcctgaggtatcattgctcaaatacctggacaagctttgcacagagctgatgatttgattgatccaaaaatccacaaaaagccttgttcacttccctgcgtacagatttaccataaataaaaatagtagaagaatgctaaaaatatatagtatttttcttagagaggctgtgaatagttgaaatgacaggtagctagtaaaatatgaaagttatacagatttaagtgaaactgagtgaaacaagaacaaggcataccttagaagaccactagattcaaactgtaacctagttggacagtccaaagcatcaattgccactatcctagttttccgtctacccatcgcatcaaagggtttgctatctaagtagtcaccagtaaaacggaatgaggaaccatacctgtaaaaagcaagttaagagtttataccacgtaaaaatcatcacaagttgtaaagaaaagcatccataaatcacgccggttgataattgatatatgctgtggagtttatttcaaccaatgatctagatcaagaaatggtggataagtgtttaaaactaaccccatgtactgtgagaacctttctgcaccaacaatttctatagcttcattatcttccattgaaaccatgaagagcatgcccacgatcaattctgggtttatcatgaaccggatttcttccttcagcacagaaaatacatcattcataagggaatctcgaaaacatttatatgaatgtcattttttatacaaaactgagggcacttcaattcacatcatacacccatgcaattaaaaatcagttatgaagcgtcgtgactaatttcccaagtacacataatatgacagataagctacataaaagaatgcagcaatgtgctgtacaactgaatgatttgggaataaacaccacataactaatgcaaggcaagctccagatggaggcacttttacagagttgaagatcaagggagtaagatctgcaaaagaaagaaacctgcacgcagcctctggaaagtgcgccacctcccaaatatctatttgcaaagtcaacttcaagggcttcttgttcctcatcttctatcaagcctgaggaaaatacctactaatgaaaataaacaaaacaatcagcaggtttcatcacaccagttaaaacatttgagatgtttgaataatcataaaggcaaaggaacgcccaatttttatcttgataatcatagttttatatgatataaaggattgttgatgggttaactaatttaccatctcttcacaagatttacttcttatgtaacaaaagaaagaagtcagtaaaagggactctaaattttgaaacgcacccggaatgtgcaaaggggaacaccagatttcatccaagtatccatgtcagggtacgtaatgccatcagattcaggacggcgaggaagaaccttacgctcaaacgaaacggaaccagtaggtgtagaagcggtcaccctgtcaaaatagtgaacaaggcacctcaccttctgctcctggctttgcctcgaattataacacagtgccctatggatcaatcagtaaaccacaaaagcataaccaataagctcgaaaagttcaatcatttagcccaaatgtaccaactctaagaaaactagatcaaaatggcagtggaattacgcaaataggctatcgaaattgatcgccgggaggcacgcctcggccctatcggcggtggggaacaggcagaagagcgcgcaggcgagcagcgcggcggcgagctcctggctgaggagcacgagcccggcatcctgcgagctcaggatgcggagcccgcgagcctcgtcgccggcggcgcggtagtggccctcgagcagcgtggggaggcggaggaggaggcgggcgagggagggggcgacgtggtcgaaccagtcccgcgcctgcgcccgcgacaggaggtcgtcgaagaagagcgcgaagccctcggcggcgcggcgcgggagtgggtcgaggttgagcgcgaggcggaggtcggtgagggcgtcggcgaggacgtcgccggaggagacgcggctcacgtcggggcccagcgccagcgccttgagcgcctcctgcgccgccggcggccagaagagcgcgccgccgcggagcacgacggggaggtagggcaggatcgagcgcaggtcgccgcgcgcctccattgctgctcctcctcgagctcgaccttgcaatttgcatgaaccccccggaaatcgaaaatattttcgaatcagtctcgcttggatctaaatgcaattttcgtcacagcttatccgttccctcttcgccatgggacgcaatg

SEQ ID NO: 62556 - DNA, 10121 bp, Oryza sativa
cttcgctcatctcggcattctgccggacggcgagtttgagctagcggcggaggctttgatccagatgttgaagcagggattgaagccaaatgagcacacaatgacaaccattttgacggcatgcccaagggttctcggtcagcagatacatgggtatttgatcaagaaaattggtttgcggtcgcagagcgtctactcgtcgactgcactgatcgatttctattcgagaaacggtgagttcaaactggcaaaggcggtttttgacagtctccactgcaagaacgtggtttcatggtgctccatgatgcagctatacatcagagatggaaggctggaagaggcattgcaagtgttcggtgatatgatttcagagggtgttgatcctaacgagtttgcactatcaattgttcttggagcttgtggatccattggtctggggcgtcaactgcactgctcagcaatcaagcacgatttaatcacagatatccgggtgtcgaatgctctactgtcaatgtatggtagaactggtcttgtcgaagaactggaggccatgctcaacaagattgaaaatcctgatcttgttagctggaccactgctatttctgcaaacttccaaaatggttttggtgagaaggccatagcattgctttgtcagatgcattcagaaggattcacaccaaatggctacgccttctccagtgtgctgagttcttgcgcagacgtggcatctctggatcaaggaatgcagttccattgcctggctctgaaactgggatgtgactccgaaatctgcaccggaaacgcactgatcaacatgtactccaagtgtggtcagatgggctctgcaaggcttgcatttgatgtcatgcatactcatgatgttacatcttggaactcgctgattcatggccacgcacagcacggtgatgcaaacaaggcactggaggtattcagcaagatgcgttccaatggcatcaagccagatgattcgacatttttgggagtcttaatgggttgcaatcactctggtatggtagaggaaggagagctgttcttcagactgatgatcgatcagtacagcttcacgccagcaccttctcactacgcttgcatgatcgacatgctgggccgaaacggcagattcgacgaggcactgcgcatgatcaatgacatgcccttcgagcctgatgccctgatatggaagacgctgctggcatcttgcaagctgcacaggaatctggacatagggaagcttgctgcagacaggctgatggagctttcagacagagactccgcgagctacgtgctgatgtcgaacatctacgccatgcacggagaatgggaggacgccaggaaggtgaggaggaggatggacgagaccggcgtcaagaaggacgccggctgcagctggattgagatcaacaacgaggtgcatacgtttgcttcaagagacatgtctcacccgaactctgattccatatatcagatgctaggagagcttgttgccgtgatgcaagattttgacgaacttgaaccgtttgatgtacatatatgctgatttagatgccactccagatagtatcaaagaaagtaaagtttctttcttttcggatcaagaaagttttatgtgctgtgtttgctaaataaaagatgtataccaattttatttaggtaaggggagggcgtatgatcaaattgcccttgtgtatatatcaaagcccaaaggtttcctcttttggcaggcggcaccactcctcctcatcttcctccattaatagcggcggcggcaggaggacgcacgttgccgcggtgccgccttcacttcttccccaacaccaacagatcgagaatcatggttttccaatgttgctttactgccatgggaaagatgcggaaatctaagaggacggctgatataatctcacaagaagctccaagaacgaaggagagataagcagtactaagtcattgatctcaggtccgctggttttcctattttctgcatatcttcttgtaccgtataaccctatttgagtactaacacttgtgttgtatgtatatatggcgttttaaccaggcgacttaaattcgggctctaatcaagatgtctgggctattctcagtgttgaagttgcatcaaatttgtctaaaagcgttgtctcactcaccttgtctgatggtaattatatgttttgctattgttatacattgtcaaatttatatttgaacaatgtcccctgttataaatggtttaacctgcgatcttgtgtaggaaacacactgatatatgcatgctcgggcatagctatcgagtgccaggaggggtctggtacaattttcctgacctcggctagtttggtaacagctttctatgatactgaagaagtctatgataacttaaaggtggtgcttgttgtcatcctttactaatttttgcttgtttgcttaggatattttgtgactcctttcttgctttgccattatagattgaagtgcgccatgaaggcaatgaagtgctcaagggttatttggcaaaatatgatttagacaagaactttgctgttgtctacaccatggaatctcttgatgttcatattgtacttaccgaaaattcgagggataggtatatcaacaaaaagttagtagctgtagggcgtgacaaacatggcgtattaatggccaaaagtgtgatggtggctggttgtcgtgattcaaacagatctgaagatagcaaagaaattaggttgatctctgaggtaaactcgcataatgatacaagcacatcttaacctttttctgtactatatctatatgcactaaactttattatcaggcctgtaaaagtggaattttttttctatgtgaatgttgttcaatatcacttcctttgttcaaatggagtccttgttgaccatcactttatatttgtgttaggactgggaaggtggaccgctttttgattttgatgggaaatttgttggcatgaatcgtttttcggttatggatagaacatctgtcctgtcatgggtctcaattctcattattttgaagcattatttgccatccctgcaaaacaggattcttaaacggttacaaaatgtcaaaagagtcaggtatgtctttgcttatgtttgatcctcattggttcacccactttattaccctgcatgtgttcatacggtaggctggtttgcatgtcaaacaacatatgagcgaatttgttcttcaatgatctggattgttagctgctgttcctttttataggtcctcaaaacttcagatcctcttttttatctttttcctttttctccttgcctatgatgctaccctgtaggtgttggcattgtgttatgcactggtatgacccgttttacctttgggttggtgttcttctgcagggatggagagagacccacaggtgagctacctgactatcatcaagaaggtgagcacagtgccatagtgccataccttggcaccaccaaacatgcatgcaaattttggttgtatgtaatggtatctatttttaatattagcttttacatttgaactttctaattttacatgaacttatcgcatttagttagtgtatctcagcgctaatcacttggccttgtgcagcaccagtacatagatgtggtctcaacacagaacagtttgggtatctaaactccatgggttatcccaagccgccaataaatgtgttagacggtgagtcattgtttgtaaatttgctaacttatcgcgcatcacatctttctacagtttactactacgaattaatgactattctaccatgtatcttctaccagatggtatgattttggctaattcttttgaagagacttttggagatttatgtggtgaagatctttggagtgaaatcaataaaaaggttccttgtgacatacatcaaaatgttgttgcacttgcttcattcaaaggtgattttacactaattaatgtgctatattgattttcccatttcatatttgtattcggttgtcactaataaataataatcaaatgtatgcatgataatgcatggtatgcaggaaaaaggaggtcttttgcatgcacggtttctttattgaatggaagggatgtacaactattctgacatctgcgagcttggttagagagtctgatgatggaaacaagattgatgaaaacttgagggtgggtgctaatcatgtagctcctcctaattattttgctctttatttttaagtctcactcacttattcatcaatttatttgcagattgaagtgttgcttccaaacaaacaacttagagaaggaacactacagcattatagtttacactacaatgttgctctagtgagtgttaaggacaaggatttccatgctcgtccagcaaatattcagcttgatcataatcatggacctggagtagcagccgtagggcgttgcttcgaatcaggcaaattaatggctgcacggacggatgttgttgattggtcgggcacacttgattgtgagatgttccttatacgttcctcatgcaaaatcactaaggtacataccgctagatagctgttgattttaaatctctagcatgtttttacatgcacggtgaaaatttataaccatcgcgttggtttgtaggcagggattggaggacctcttgttgacttagaagggaaagttattggcatgaacttctatgataagaagataggaaccccttgcctgccatggaatgtgattctcatggttctggcatgttttgagaaagaaaagtattcgtagatttcttttctttttttttggttatttaagtgcttgcaataaaatctattcgattgtgtgtttgacagtagcggtggtgaagttggcagtggtagtgatccatgtggtgcgcctggctggaaaatccctcgagatgagagtgtcaggctaaacaggttggttttctgataaatctcaacagttaacacttaacactaccaatttacagggtctcatattattttctgatcgcattgcatatattggaactaaactaataggtggcctgtgcccctgccatattggcgtcctcatgacgatgtggatgaacaagaacccccagaaggctgtgagcacatctacacatacataaatggtgaaagatattgttacaggtagaatctgcttcttctactctgtctgttggatctactacgacgccgtttgctagcggagcttgctgccgtgattcaagattttgatgagcttgaactgtttgatgtacatatgcagatttagacgccagatgtaatatatattactaaagaaagtttattcgaatcaagagatctttgtgttgtgtgtttgcttctgcagaatttcctggtatttcgggattcctaattggatgtggaaaacgatcaggaaccctaattcttgccggcccatggtcatggagcctgaatctgaaacgcataagatgtggatgcgttatatgtggagttaatttagtaccacaacgccaaatcaggcgggaggttggacgtccgggggtataaaggaagaggcaagggtacctctgctgcatacttacctggacggggtcgatgggtgatcaataaggcccatggcctgggctaatggcccacattgcacttggtggatgcgttggcctaccatctccccaagtgggagagtggacgtcataatttgtggtagagggggtacgcgttcgcgcggccccttccaaatttatacaaaattttgattggcttcattttgaatcaatcccctaccaaatttatctaaaattttgattggcttcattttgaatcgaaactacttctgcttttcttggctgaattttgaatcgtttaagactaaagcttgtgctctgaaaatacttaatgggatcataggactttgcataatctggagaccggaatgcacccaactgaggataggatgtaccgtacaatgcatccagccataataaaattgcaatcttggaactcgaaagttcccagtttcagtttgaggataggatatatcatcaaagattgtcgcagccacatatgaaattcagaacatgttgcatctattgaaagttcaaacgatgtctggagtatttgacacctctgaagtgaagctgtggaaaagagaggaagcagtattcttgcacctacagaccaatgtacagcacaaatctcaaaccgcaaacctaaggtagcaacaaaaggcaaagagaaatccatgtgatctgcatccaacagagaaccccacaaaagaaacttcttaaaccaattgcaattacacacagaatgcgctgattacgaactggcatgtgccgggaggtctaccatgagctaacatcttaattctcagttgctggcgccggctctgaggcagctggcactgctggtttttgttgaagcagaggagagagcgccttgacaacaatgctcatgttgggcctgaactctgcttcgtattggacacaaagagctgccaccgcagcaagctgcagataagtgcaaccaagtacatcaacatgacattatttcaggactgctactccaaatgatgtaaaaagcatgtgcatcatagtgtgtgtatgtgtgggtgggtgtgagagagagagagagacgagagactgaccttagcaactccctttggaggatattcactctttaacctaggatctacacattgtttgaccttgtcttcgcttaatctaggagtagcctggagagaaaaagtacacaaacaagttaaatttggaacaactaccttttcttaaatttggaacaactaccttttctatctcactacgggagtagtctggctaattagatggaatcagaaaaggtgtaatatgtatttgagaaaaaaaaaggaaaaatgtaaactatttgagaaatcaaggttctctatagcaatccagatacaggttgttttttattcaaataatcaaatccaaagcgacctataaacctaactaattattatttagaaatcatttaagtctaggattgtcagtgtccagttagcagacagttattgctacgatttgcagtgctgattcattgaaccttcaataagttgatggactctgctagacgttcatagcggtatttcagcatgcttttgttggctagattcttttgtttcatgttcctcaatgatgtcttctcttgccactaattactttcttggtctttacatataaccagtagaaatgaagaaaattattataattgaccaaaaaaattagcaaccaaagcaaaaacaagataagaaaactagtaacatgtccgtgcgttgcaacagacgaatacaactgagaatgggttgcatgggcccatacgactgggaatgggctggatcgagcataaggcgcatacaactggtatttttctgttattttcaggcctagaaggcagtgcttgtgtgctttgtgacgcgtgggaaggagcgtatggacgactccgcttttaggtggtagagacaacttacccaagtgactagactttgctgtccccgaggcattgtgtggtccactggtttccttccagtcaggagttccaaaagaactacaccaaaactgtacacatcactcttctgcgtcagctggccagtcatagcatatctgcggcaagtagggttatataagttaagagaggaaatgcataaaaatacacggcatcaagtatttccacaactcatgccaagaacacttatcctcatttcgctgaaacgttcatctacctggacaaactagcaaacaaaagacttgtttctaaagaaattacaattaacttacacaagacggtgaaaagatcaaataacaacaaaacagataaaacacaaaattagtgtacagatttttcctttgtaggcagaggaaagtaaaggcattatgtttgctccagatataatagctttgcaggtagaagaaatatcgcaacaaacaaatataatatcataataatgctcaagaggtcagtcgtaaaaggttcctgcttaattcagcctaggtaatccaacatgatgttataaatcacttagatgcatcacactcattatgcaaattagcaatgttctgcataactttccagaatgaatgctgcatgcagatagtggttcacagaatatggagtataacatgtcagttgacttcccccaaaaagaaattaaggcactgcccaaatactggttgtgttgacagacctctctccaaaatggcatattcacacccaaaataagttggctttcccaaaaaaaaaatataaggcactatccaaagatagtggttgtgttgacagaccttaaatggcataatcacacccaaaataagtaaagttgttttttggcaacacctacatggtaccattgtcagctgtttttcaaacaaaaaaaaaaggttatgtaagaacagctacatgcataaatttcactacaacccaaaggcattcaatacttggttctacgtactatttgatgtttcctgccaaaccgattaactagatcagtttgctattctgctaacagaaaaatagcatacatagcttaaggcccaaataagtactacaatgtacaagacaactcaatatcaatgtataacaggatatcatactatcaaaatggaagtgtaatggccaagaaaaaaaaatagtcattgcttgattaaaacagtaaggtcagaattacttgtcatctcttggatacatagcgaacattaatttacttgccaaatgtgtaaaaaaaaactgttgcaattataaaaaccagacagatcttccacctcgtcaaggcccaggatcaccaagtcggccttagtttctaaaaagttatactatgaatttctatattcactagcctcagcagtttttcatgcaatcttgtgaaaaaagaagtcatcagtttggatcagggagttctttttcaaaagaaaaaaaaaaataccacaaccactcacactgtttggtccattgtcatttaggtcagtaagtctcacagtattgtgccatggcctccacatttgaggcttcatgcatgtggccctggtcggcagggctgccagccagccactgcctctggtgttactttggaggcactgagagtacacagttctgatcttaggagcacataagatagctctggtgatgtctattcgatatgaacctgaaggtatgtgcacccttgcccatgaatacaaccatacaagcacagcaaaaatatgaaagcaaactagacgaggataacctacgaatttgttcatccaaaaaaaacatatcagacctttgacatttcaaggcaacaatccttaaagatgggacctaccacattgacaagaatagacaccacagtgactctctcagtttttcaatacactatgtcagtattaacatattttagttggttcaaaacatatattttaactactgttgggctggattaaaaattgaagtaagacgcgatatagtgagttctatgaagaaatgcattggtataaattagacattactctggtgcatgatatccaaaggttcctaatacacgagttgaatgaaggcgtgctgccatatctggagcttgatttaagagattgaaatctgcaatttttgccttgaagtcctcaaacagaagtacattgcttgatctgatgtcccgatgaatgattgaaggctgaaccttctcatgcaggtactctaagccttttgctgcctctatagcaatttttaccctctgcgtccaatcaagtacaggaccaggctgcgcaccttgaactccttttcttcctgttgtgttaagagaagttgattataactgacctggatttgcattccacatgctaaagatagtaggtgctcaaggtcttaccatggagaacatcatgaagggaacccatggtcgcaaattcgtatgccagtatacgataattgccctctacacagtaacccaacatctccacaagattttcatgctttagccttgatgcctgggagacctagagtccacaaaaacataaacaaaagtaatagctttagaattgttgcactgtcatcaagtcctgagacagacaaatagacaatgtgaaatttaagctaagaaacctatgattctgcaagtgatcacctgtttcaaga

SEQ ID NO: 62557 - DNA, 3577 bp, Oryza sativa
aaatatactggcgcatatgttagtatggtccttactccaattgcatcataacaaaagaggagtaaaggatggttctatagcaatcttataatgggccaactgttactgaaattcacatggaaaacacacgacaaaataaccgcaccatccatcttattgccctgagcattggagcgttccttcccatggtcatcctcctcgtcaaagtggcaattacaacaaaaccactgcctcatattgtctcctcacaacttgaacacctgaaccaaatgcacggaatagttagcatacgtataaagatcagagcacataattgaccaatgcattaaattacgcaagaagtacacttctgtacagtgtacaacatctgtactctcagcaggttggaactaagtcaactagagtcttactgttttcctctacggaaaagcttacagtttccagattcaacatgcaacagtgtggaccaacatgccttcttagaagcagtaaacctaaaatctagtaatctacaaaccactgtgagtacggctatttcaggtactatgcgagcgtagcaatccaatcgcttaaataagcaataataataataataataataataatcaaagtgctaataaccaggatggattgggggtatccactcccagacagaagtatggatttgaattacgctgacagcaaagtgagaagcaaaacccacactgatggaacagcgatcagagcagagggctaccactcaccaagcaaacgaaatcaccgccgggttcgatggcgatggcgcgacgagagaattcgagacaccaccagggggagctagggttcagaggcgagacgaagtggagcttgggcgcgcacaggctcaggggagggtggaggaagtggccggcagcggcagcggcggcggcggcggtggcgcagcctccgcgtcctggttgcctgctcgagttaaagccgccgtccttatgggaggggaaggggattattagtattaatcggtattaatccggctcgttaatttcgcgattagtattaagagcggcgggattagcaggcgtgaggtggccgggaatgtgattgtgagctggtcggctgccgatttccttgacaggtggggaccagagacgtggggcccattagtcagtgcggttgggctggaaccaggtggccgtttttggaattttctggctgcgcacaacatcagcgtggactgatcctccccgtgtgggtgacatagggggacagtgagcatgtggggcccgcatgtgcttaggggaggagcgtgttaatccgcctccatgttcgaaatggatgtggggcccacgacagaaaacagcaccgaaaacgtgtgggtcccagcggcgtgcgcagataaaagcaagtttaataatgtagcctactactagctccaatttatctatagccaatctaatagccaattcatacgatagttgcttgctatactattaatatatggtcccacatatcatacacatgtcttggagtccgcgctgcagctggctacagatttatagcccgctgctcttctctctcatcttttatctcattaaaatatgcttatacctgactaatagcctgctattgtacctgctctaagggcaattattatgggcatgtgtaaacagtgaaatttggtaatcggcaaagacgtcatcggcttagaatcattatcggctgcagcatctcggaatcagtcgatgggagttatcaagtcaccaatagttggattcttgctatattcggttaaggaaatcaatctactaaagaaagcttatccctaagtgaccgagtttaaagaggatgtggcatggcagtttatctattaattaggaatagtttgttagtttccttttatctttaggaaagtgtgtttagtgtccgatgaggacttgtattttccttttatctttaggttagtttctttcttgtccgacaaggacttgtatcaacccatgggtataaatatgtacacccggggtctatgtaatctatcactctggatcaataacactctcggcgcatcgccaccctctttcccgaggtttttacttatcttccggcaggatttgggcacctgacgcggggctgcatcggttcagttcgatctccggcgaaggggtaagtcctacgttccgtcgggccctggtgaatctgtcatctacgtcggcatcgtttaaggctgcatcgcttcgatctcttggatcgctctggtttggttgattgatttgcctacctgatatctcaagtctatctccaattccattgtgtttagagacgcatcggtttagttgggactgtctcggttaggtccgatcttctgtcttagccgatatatctctacaatcacaatgctgttctaaatagatttgttatatccatcacattagacagatctatcggctcatcgagtattagattatcatatacaatctcgtgctgcatcggttaggttcgacctactagattgttgttgataatataagtcttgctaagctgataggttcatgctactgttttatcggggtgctagccgataagttatctggacgttgcatcggcttagagtgatagattacatagaccccaggtgtacatacttatacccatgggttgatacaagtccttgtcggacaagaaagaaactaacctaaagataaaaggaaaatacaagtccttatcaaacactaaacacactttcctaaagataaaaggaaactaacaaactattcctaattaatagataaactaccatgccgcatcctctttaaactcggtcacttagggataagcttcttttagtagattgatttccttaaccgaatatagcaggaatccgactattggcgacttgataactcccatcggctgattccgagatgctgcagccgataatgattctaagccgatgacgtctttcccgattaccaaatttcactgttaacacatgccccctagttttggagtatgaggactcatgctccaaaattctcttctgtctgatcttgtaatcggctttcatgagctgatactgatgtgtttgccccctagccgaggttgaatgatcttggcattgacttcttctttagacatgtggatataaaattcgtggtcccaccgggcgtgccaaaagcgtgttgacagaaaacacgaggcctgggagatctgcttaactcctgtgcaggtccaaatatgatgagatgtgggcgtgccagtcagtttgatcctgcaacggacaagatatgcaaatagtagatcaaaatagccgatcggctgacaagccgatggagtaattccagccgatggccgataatagccgatgccgataccagccgatagcgatagggtttaaacaatcggctatatgtccaatgtagatgatgatataaaggcaatcggctgatgatgatgtaataaaataacaatataatccagtataaaccaatcggctagcaatgacatgataaataagcatcgatccgaaagttaaagcacacatcggctggaggtccgatgtcatgaaatccacaagattagattaaacagttaatctttgttg

SEQ ID NO: 62558 - DNA, 3221 bp, Oryza sativa
tctttcgtgtgatagatcgattttttgatttagacaaaatttgacaaaattttgtctaaaatcaaaaatagtttgtgactaaaaatagtgcatacaagaggtgtaaagccaagcaaaggtggtaagaaagaagtacgtcatatattcagttttatgtattattttattttatgttatgcgaataaatattctgaaatttgtttatgttgttttaaattttcagaatggacgaatcaaacattccatcgttcacgttaggtgatttcgaccctaactacgtgtcgaggtcattcccaactagtgagtatgatgccaccggatcagctccaacaccaccagttatggagccaccggcgggttcagaagcatccggcactatgagtgggagtgcatcgacgaacaccggctcaaagagatcaagaacttccggtgtttggcaacatttcgatgaggtggccatgacaggccctgatggaaggcatgtaacattcgcgagatgtagaatatgcaaaaataagttatctgcaaaatcatctggtggaacaggacatttgaagcggcatgccgaggcttgtgcaaagaagcaaggaatccaactacgacagcaacaactactactaaatcctgatggtacggtacgtacgtgggagtatgatcctatggtagctcgagaaaatcttgcccgtttaattgctagacaagatttacccttgaactttggtgagagtcctgcatttgaaaattacataaaaaattctcataatcctaggtttcaagctgttagtagacaaaccacaacccgtgatttgaaaaatgtctatgacaaaggttatgaatcactgaaggaattatttagtacatgcaccttttctgtcagtgtcacctcagacatatggagtagtagggctaaagaggattaccttagtgtagttgtacatttcattgatgatgattggcaaatgcaaaaaagagttcttggcttaaggttaattgatgtttcacatactggtgaaaatatagcagagagaattcgagaggttattgatgagtttaaccttgcagataaaatttttgctgtaacaatggataatgcatctgcaaattctagggccatggaaattctacaaccattattttgtatttatgctcaatcatttcttctgcatcagcgttgtgcatgccatatcattaatctaattgttaaatgtgggtttaagagagttaatgtacacatcgacgctgttcgtcaagcaatcacgtggttaactgcttcaaacccacggattgcacagtggaaaaggtattgttgtgcatcgggtgagcccccacgtaagtttttaaccgatgcagaccatcggtggaatgccacttattttatgttaaaggttgtattaccttacaaggatttacttactgttttccttcaaacacgtaatggcccaaaaaacagtgacggccagccaatactgactgatcatacctggcacattgttgaaaggttcaatcaatttcttgaaacgtttcatgactgtactcttctgttatctcaagtatattatccaacagctaatttaattttgcataatattcttgaaattgccactttgttgaaagagtatgaaaatgatgaccttttaatgcccgttgtctttaatatgaaacaaaaatatcttaaatattggaaagacatccccatgttgtattcttttgcatttattcttgatcctaggggaaaattacggggattcctcaatattctttcacttattggagatattattaatgttgattattctacctattatgctgatgtcaaaactaaattctatgaggtatttcgaaagtatgaattaaagtttcagggagatcgcttgtaaagacccccacctgtccctgcagcaggtaagaaaaaattacagtggagcagaatttggggcggttcatcttctagccatggtggtggtaccagttcatcagcagcaagtggggacgctagatcgcatggtcctgctgaagagttgtccaactatttggatagcgatgccatcaggcatgaaacgtcagacttcaacgtactcgggtggtggaatgatcataagatgtcatatcctgtgctatcaaaactagcacgggatgtgttgacggtgcccgtatctttggtatcctcctaatcagccttcagtctatgcggaagaattatcgaggacaggagaacaagtctgagcagcgatcatgtggaaatactattaagcgtcaaagactgggaacttgctgcagaacatgcccaatacactgctgacaaccaagaattggccgcacagttcgaaaacctttatttagatgacgaacaattagggtagctagtttatattttttaagtattgacctgttggctgtactcttttctttgtcatggttttctcaaatatgagtttttacatgacaaagtttttaacgaggcagcatgtatcatgtaaacatcaataaaggtcattactcttttttccccatatttttctaatatttttctaagtctaattatttttctatttttctccaactatccattaattttctcttagcttagttaactttcggacctttctctttgatttgaattgttccactgacagagtgacaggcgatagacacacggacagaggcaagtcactgagtcagcattcagcaagtccagcgccacgtgtctcccttcggccggccggtcccgtggccccggccgctcgctcccgcgtgccgcgtccaaattttcatccgcgcgcgcgccttgtcggcgttgtcgccttgccagcttgcctgcagtcgatcgtgccaacgggccgaccacgacccatgggccattgacgtgcccgtgccggcacggcacgacacgacgttccctcgggccgtgcttgggccggggagtaggcacgtgggccggcacggcacggcccgctacaggagtcgtgcctaacgggccgtgccctagcgggccgtgccgctggcgtgcccgtgccgtgctgggccgggccgcccgtttggccaggtatactctcggcgcatcgccaccctctttcccgaggtttttacttatcttccggcaggatttgggcacctgacgcggggctgcatcggttcagttcgatctccggcgaaggggtaagtcctacgttccgtcgggccctggtgaatctgtcatctacgtcggcatcgtttaaggctac

SEQ ID NO: 62559 - DNA, 1908 bp, Oryza sativa
  unsure (1)..(1908): unsure at all n locations
nnnnnnnnnnnnnnnnnnnnnnnnnnnnnnnnnnnnnnnnnnnnnnnnnnnnnnnnnnnnnnnnnctccagcggaagtcaagcaattgcacgagctctacaggcaagtagtcaccagatatacgctgctgtctaaagctttaagaaagttatcggtagatgaggatcagctccttaattcagtagatgattgatgaagccatgtaaaaatgctgaccagagatgacatgtcctattaaccacataattgatcgagattgtacacgcacgcaaagttttccattgactgtaggaaagcaaacgagttccaggcatctgcaacatggttccagggattccaggatacactacaggtatggccaaatgatcatcagagttgagaatggattcttgtgcctttgcattgcaacttgcaagccctctgtaatagcgtccacttctgtaatttttagttcctgtctgccccactccttggagctagcgtagtctctaggtgtgcgtgaggaactgcatatggcacatgttgctgttgctgatcatgttcaaccgttctacctcgtacttcgtatgttatacagcaaatcttctgtgctgaaaggtatctgtttgccttggtgcaatggtgggtgaacgtggtgacattgtgagacatatgcatgatttgctcatgaagtcattatggctgtgttttgcaaaaagtttctatgggaagttgttcttaaaaagcatattaatctatttttcaagttttttattattaaaacttaattaatcaagcgttaatctatcgctccgttttacgtgtgttcccaaccccttcaaaagaacacagcctattatatccgagttctctgcttcattgttgagcagaacagtatactgatgctgccacaatctgctagtgcttgtgtaattaactgacaactggaagcatggggcaaccaatcatacatggcttctcttgctagaatagtaatatgcaaatatgactaattcagaatattcggtgatcaattctgagggttgagcttgaaggttttcttgtactcgtgaaagagtgattatacagtatcatgacaaaaaaaaaacagagacagtttgcttctgtcatgacagaacaaaagttcaaaaaaacgtggtcggcaggattcgaacctgcgcgggcaaagcccacatgatttctagtcatgcccgataaccactccggcacgaccaccttggggttgcaatcacatactttttttactaattgtttcatacaacaacactgcaatttgattcatattcgctacagatatcgtatcttttattcaaacaccgaccaaatcagttcatagatatcgcagtcaccaccagatatcacacagcaatatcatgcgatggcgcgaactcatgttcatacatatatcactgcatcgtgtcatctgcgcacagctgcacataacgcacgcagctagcactgtcgcccaaacttgtcgtcactccagcttgtgctgctgggcggcgcgcccggggctccgagccgacgggtactcgagcagcgggtggagcggcggagccggcagcgcggcgagctggtggcgacgggcgctcgccggcggcgacggcgatggcgtggacagcaggaggcggaacgtccaggcgaggacgtcgggcgcgaaggcgcggaagacaaggaagacgtcgtaccagttggggtgcttcacgtgggcgtcgccgcggcacgcgccggcgaccaccatcctcgcgtacgcctccacttgcccgccggcgagcggcacctaattacatatgattaatcaatggcaagttaattaatcgacgagcagctatagcatttgattgttgaactaatctttacctctcgctcctcccctttccattgcatctctgcgccttcctcgagcat

SEQ ID NO: 62560 - DNA, 2855 bp, Oryza sativa
ccatgagctgagggaacgcgaccgtgtcgccggcctcctcgaagcagaaatcgtggcccaagctcaccgtgttcaccagatggtttactgcatgcatcaatattaataagaaattcagaggtttgattaattgcaagtgatgcgtggtacaggtgactgacactggccgaagaagctgatggtgtcgccgacgagcctccggcagtcgtcctccttgacgacgtcggcggcgatgacgaggacctggccggcgccgagggcccgcgcgttctcccgcaccgcgaacagccggtgctcccgcctcgccaccagcaccaggttcgcgttcctccgcgcgtactcgtacgcgatttgctgcatgcaaacaccacaccgatgatctttgacgttcgccgaccgggcactggttatatgcttagcttaattacctctccgatggcggaggaggcgccggtgatgaggacgaccttgttgtgcatgttctccacggtgagcgtcttgacgacccactccacgccgcgcaggaaggagagcgtcggccacgcgaacgccagcatcaccatgctcgccggcggcaccaccaggtccagcaccgcgttcaccacctgctccatctcgatcgatcaatcaatcgatctctcccacactatacagttcctcttccgatccacagctcaatccaatccaattgaaagaatggatcaaccagcccgcctctggtttctggggttcttgggaggtgaagaaccgaggaggaggaagaagagggatcaaagatcgagtctctcaatgagtttgccaatttggtgaggacgatgagcagataaggacaggagaggacggacgggtgcaggcgtgcatggatggcagctgcgcaggcatgccgccatagacacacgtcgagcaggacgggaggcgccacggtgagaccacggggggaagaggcaagctttggccgctttcaaagccttgttccatatgcctttctcctccgatcggctgcatatattactcctccaccttaatccgcgcctactacaacatttacagttctgatcagatacaatatgcatcttgatgtgaaatcagagaaagggcctgtagcctatggttaatctccataatttgccttagaagatgttgtactgtgtaatttttttttttaaaaaagtcaatctccaggatttgacacagtgacgaagacctgctgagcggtgagtgactcatgcatgttagtcctccctcctttttttttaaaatagacgatgccgtttatcattcggtctaatttaaaatttttgtgcaaatacatatgatatcaattatgcttaaagtatttttagtgataaaatatctcacaacaaatatttttttaataagacgaataatcaaacgtgtgcttaaaagtcaaagtgtcctttattaaaaaacaatggtagtagtatttgcatgtgactaaaataataataaaaagaaattggtaatatcaattaggatgatacagacaaatatacaccaataaatttgatctacaaataaagaaataaaagtaataagatcagacattgaacaatacctatacaacgtaaataaaatttattatttttaattttttatgtatagatcgaatttagacttgtatatttatacaatatcttatatcttatatcgcgtgcaggcgataacagttagacgtagaaaatatttccctgtttacacagtgtgtaaactgtaaagtaattttgcacagcaacccttcgtttaccccgtattattattttcacgcccgtattctggatcgctaccactcgtcccgtttaaccgttggattttacatgggcggcctggatcgagaaggaggagggcggcccacgcgtatttctacgtgagcccttcccttttggaataactattatctttcacgctcctcccaagctttcgattctgaaccagaattccacggtgaatcgatcttccgacgccagatcgacgcgagttgagagacggccgtgctcaggacggcggagcgccggcgagatgcggaggcggcggcgccgccaccacgcgcgctcctaggttactttcctcttttttttttctctctttttgatgcttgtcttcagatgttcagagttcagaggagttagccaggtagggctcttgtgctacgtctgtgagagcttgtgtttagaactttagatcaaccattttatgtttttttttgggtgaaacaattgttgtagcagggagacaacgccctctctcctatccggtcgaaacatctaagatggtttatggaaagttcctaagtgtaaaacaaggaaaacactctcgagttggaaaacactctcgagtggaaaaacactatcgagttggaaaacattctcgggtggtttcttatcacttatatgtaactcatcttgtttggagatgatttctgaatacatggcaggtgaatctggcgatcgggaagttgttgaaggatgtgcaaaccctcaatcatagaagacattcggctaagagagctcgaaggaaaaaacctgctcgagtaaagatccggtcgaatggaagattctgtgggggccgtttctcaaccactcttgccagctggagccaaaagactagaatgaccctgagaatgtactaaaatacccctagggttgctgacatggcaagggcattataggaagatcactaaagcccatgagggtagaaatgtaacatcacatgtaagaccgtaggctataaaagccggtcaagtccctatagctagaggagacattttttaatacaaaaagtaatcctctaaagtggtgtttgctgtttgagcttatttctaaggataggtaggaaaa

SEQ ID NO: 62561 - DNA, 1723 bp, Oryza sativa
atctcctgaatgtaatcctttattcttgttgcatgacaccacattttgacaattacaaataggatcacctcaagcaatccaatggaaacgatatcgatggccactagaaagagcaacatcttgatgtaaaactgctggaatctgtcgcggagacttggatagattggccctctctgacagcaccagcaccagctccagcctcatctgcagccaatgccttcttgctgatgatccggtagatctcagtgagcactgtctgaaaagctttatccacattcgtcgcgtcgagcgccgaggtctcgacgaaggataggccctccctctctgcaaagcttgttgcgtcctccaaggacactgaccggagatgcttgaggtcgatcttgttgccgatgagcatgacgacgatgttggagtcggcatggtcacggagctccttgagccacctcttcacattctcaaaagttgtggcctttgtgacatcatagactagcaatgctcccactgcgccgcggtagtatgcgcttgtgatggcccggtaccgttcttgcccggctgtgtcccatatctgtgcctttacaatctttccttcaacctgggtcacaaaattgaagcaatttaacaatggacctttggggaaacaatagtactgaacataaaaataaaaatctgtgatatcatggataacagcctaacaggatcataataaaaatctgtgatatcatggataacagcctaacaggatcatgtattcatttgttgtatgcagctaattaggttctctgattatgctttaaagcaagtgagccactagccagtgttagtttcctgtcaatctaaattcgcgtgtactgcaattcagtttgtacaaaatttcaacaaagaaagaactatcctttggccattttatttttttttttaaaaaagaattctgctttggcgtaagcaattgcactgtacccatcgatgaaaaccaaaaggagggactgatttccaagagaaagcgaacaatagttagcaaatcaaatagagaaacttgctgaattcctctgtcttctactagctctgaattctactgtcaagcatgggtgtcaaactatcaggtcagtcggcgatcgtggtcaagcccgccggcagcacgcatgcacaagggcatcatccaattcgagcaactcaagaaacattcagagaaagcagtaacagcgaagcaccgaagcagaacacaaacagagcaagcactagtaagcagaggagatcaggagaagcagaggagaagctagcactagcaggcatggtgacctggatggtgcgggtggcgaactcgacgccgatggtggacttggagtcgagggagaagctgttgcgggtgaagcgggagaggaggttcgacttccccacgccggagtccccgatcagcacgatcttgaacaggtagtcgtactcgtcgccgccctgctcccacggcgccggccgccgagccatcgatcgatcgattcaacctcccttctccttcctcctcagattttcgcactttcttgctgctttcttggagcctccgcctccgatctccgttccctcctccttcccgagaagctagctagcttcttcttcttcttcctctggctggctacttgcagctttggtttcttggctttggacgggaagacgcggaggctgatggcgacctgatcgatttttattggggaagagagagagagagagagag

SEQ ID NO: 62562 - DNA, 5424 bp, Oryza sativa
atgtcactagaacagtggattatgtcactagaacagtggattaagggctcatttggtttggtgccctaccaaatcattggtagtgtcaaatcatgggcaagatttgatactaccaatattttggtatagttggtttataggagttgtattaactttgttaaattttgacatcaatccaaacatctataaggtactattcaaagtgctaattatttggtagggcaaattttggcatcaaaccaaaacagccctaagtactactccttccattccaaaatgatcaaatttgaactaaaagagtgtacttatttcaagacggagggagtagatcagtaaccaaataaattttaaatcgtaaggtttattagcgataaaaaaatactttgtaagtaaaacttttatatatgtattattagcgtcttaaaagctaatgttaaaaaataaattatgatgataaaaacatcaaaatcaatttaaagttaagttttaaaatataaatgttagttgcggctagcaagccgaagagcaaacgctggtgttattgtgtgaatcaaaatgatcaaaatacagtggcggagccagaatttttccaaacctagggcccaattagttgagtgtatatgattttgcctttatcttctagtttttgaagttttaaaatggaatttcaatgaatatttagaatcaggagtagggagtagggctgcagccctagctgccctactcctgtctccgccccctgtcaatatagcaattaaaatgactagagatatgaaaaaaactatatataggtactgtcataatggccatatgttgaaaatatttatctcgggtgcatgtaacattttttttctagaaaaagatgtagttactatataacaatttacacctatggtataatgtgttttcagagtagtttcgcaactttctaattcaattttaactcccaaatagcattgttgacacggttatcccttgcaccagtaccatcaaccttccgcactaatggcaaccatggtaattggatgtggacacatcagtgtaatcctaccaatattccactatgaaaaagaaaaaaaaagattccaaaaccaaaggcacaattttgagaccaccctatcaaggataattctgccattctgctgagctgggaagaagatttgatcagttggaatagggaagatggtattggaatcattctaacttccaaacagaaacacacaggctctataatattaacttcaatcatgacttgacctcaaactaacaattaaacaaactcccttctgcctttgtttccgtgattgaaagagttatggatggtcgatgaacaggcaggaagaaagaaagcaatggaaaagagcaagagaattaacggctggactggaagagaacttttaaagacacgctttcgatgagaaccacacaaattgcccggcttctcacgagttaacaatctgcagcttgcgtgtaaataaaaaggggaaaaatggaaataagaagaggggaagatgccaccgtgtcaacccaagtatgcataaaaatggcgagggctatcatgcacatgaaaagtcaaaaacacacttgcaatagcattatccgacacaactcatcactgattattcgttcaataatagcatcactcacaagcatacaagcatacgtttgttcctttaataatgtttgcataatcatagggtatgtttggctagccaatagagccgctgcacgcagccataactgttgcagctacagacacaaacagtacactgtttgtgttggctgcacaacagtgaagttaagtgcagccgaacagagccaaaatcaacaattaatagtatcattttttaaaagacccaattactccgtcagacagacagtagcatgaaacggaccaaaggaagcagacttgcagaatagtgacattagattgatgaaggccaggagcagaagtgcgtgtgcgtctgtggtccgtccgatcgggcatcggacggtccagatggcgcgggaggttatggctggcgtcttcgtgcggcggccgcaccacacccacccgttgcgttgcggcggcctctctctctctttctctcctctctctctgcggctgcgcggtctccacggcgcggcgaggcagcggcggtagggatggtgggctcggccgcgtactccgcggcgtcggccatcgtcgtggtgatggccaagggcaaggggcggggcggctagtatgcggcctcctctggcgccaacaaggtcagctcattcctcctcccctcaggtaccaacagtttgggtaatgggtacagtatgatcgaattcagcgcggggagtttggattgaactgaatgtgcctgtgaatgaacattgctgcaagggattagaggaattatcagttacgaatcattgcttcacaaaattctggggcacccacatggaaggggaaaaacggctgctgtgcgtgctcaaccatgcaaaaaaaaaagagttattcatgaggattgagttatgttttttttgttgttgtattaatcagaacatttagtgtggtacattctcaatttaatagcacatttgttggattatcaacaaatggaagatcttgtattggacccatgggtaacaggtcggctttatggctttgcgtcctcacacatgacacgctgcctatttatgtgtaggtttctgagcgacggcctcctaggataacttccaatgtgaagcagagcttgaggattctaaaattttggaaggtgcaagctttgttgcattaccttttctctcatatgctaaaatctgtgatctactctgctgcactttgtataaagtcgtagaacagcatgtaccgaattcatcaggtgggtatggccaaacaggggcacccgaagcatccaagattaatcttagttctaacagttatttacccttgtgtgtgccttttgtattcttaagcttagttctaacagttatgcccttgtcatcaggattatgaaaggaggcaaacaagtggacctcagcctgctactcggtaccgcaaaaagaaagtaataaaagaagtgcttcctgatgacacagacttctacgatgatgcttcttccactcttcactagtcaggcttgcctctcattgcattatcaggacctcactacattttttgattggtggttcaatgaaatgctgacattgttttgtcaattaatctagcacaaatcagggtttggaaattgcttccccggttattcttgtggacggttataatgtatgtggctactggggaaagcttaagaaggacttcatgaatggaaggcaagagattgcaagacaaatgctcattgatgagctagtatctttcagtgcagtaagaggtttgtttgtagtaggaaattagatccgttacgtatggtctcaagcatgatttccttaaaactcacttatgctgtttacttaagctgtagctgttgaagctgatagatgttagtatactctgattagatgttaggtacttcttatctctattagagcaaacaccagttcaatagtggcttatagtgaaaaaggtagtcatggcttacaaatgtatcatcttgccaagtggggagcataagtagatgatgatttgtttttatctgccggtggtgcgtaatttcttctcaatagctatctgatgttctcccattccagcattcttatatcatttgtcattgtcatgcttgcagagataaaggttgtagtagtatttgatgctgcagcctctgggctttctacacacaaagaaacctataaagggtgagataatattgtgagctgatatatctgtgggaattgttacttcaagcagtttagcctgtagcgaaacttaacaaatagattttacttcatggaatagggttgatgtggtatattctggtgacttgtctgctgattcttggattgagaaggaggtaatgctgataaattcttattcagaacaaaggatacccctagttgaccagacatgtgcatttaccgcagtgcaaaattcacacgtagatttaaattaagcaacaaaagcattgatttatgaagcatgcataactggatgtctttatgccagaaaatagttgggtccgtttcaccagcagtaaggctccagtggtgggccttatactagttatatttttataccaaccgttcaaatacctggtgcttatgcaaaagaagatcggtagagcaagcataatttattcaagggttgtacactaatactgatctcaagtgatgcactcttggctcttacctgctgtattttcatccatgggcattaatttctcatattaacatggtaacactaaatttccgcgcctgtgacatttgaattttgaagcaatgagcttcaaatttctgtatgaaagcaagatgtttctttctctgattctttgaccaacacaggttgaagctttggtggcagatggatgcccgaaagtctgggttgtaacatctgatgcattggagcaacaattggcacatggagaagtatgttgtcacccttttggggattagctgcttctatcatatctgcctgccgttagacatttttgaccggtttatggtttagaacttttatctttttgtcatgttctgcaacatattctgaactcacagtagcagaaaacacattttgtatcctatgcatttaatcaccaaaatttcccaacgggggtccgaaaaacacaagtactggatgttatatgtccaaactgaatatttccttcaaaagagtaaaggcaggaaagataattgataattgatatcttgacatttccttcaaaagagttaaggcaggaaagataattgatatcttcaaaagaggaatgtatcaaacatgcataatgtgaatctcagaagtgaaacttatatctcctataggattttgctttgtggttttatcatcaaatgttttattcttgatggttaaaaggttgttcccactgtgtagggtgctcttatttggagctctaaaagattggtcaaagaggttagttcttaatcttttttatcctgcacacattacttgctcaaatagatgctcttcacttgaatatctgattacatgcattgtgctggtatagcatccttatttttggaccaaatgtcttgttgtaactatggtacaaaatgttttatattgtttaagccatgctgagtaatcaacaagatacagatggctgacctaggactttcaccaccagcctgaggcctgggactaaaagtccaatgcgttgcatttttttcactgtgatgctctaaatgtgacccaatacatgctgggctgcccagggcttgacgccaagttgggtctgcctgagtaggcttgaatctccaattcaaacagacatactgtaaatacgctattgaaaattaagcataagctgaaaacattactttgcaaaa

SEQ ID NO: 62563 - DNA, 1173 bp, Oryza sativa
tgtgtttatttgagcatcgcactgaaagtattctcctcgagctgcaacagaagaaaagaatgatgccaccaaattatttaaaagagaagaaaatgctaaacctgtttatatttggatttcgaaattggcagatcaacatcgttgcaagggaagctttttcagcacaagctgaaacctaaagtagtgcatgcattgaaagatctccggaataagcttgaagaagaagagcggagaaagaggtgactactgtgtgactgtatgacctagaggcatgaacaaatggctaacaaccgcacctgggcatgaacaagtttgtaaaatggctgacaacctcacttgctgccttgcattggatccgtagggcattgacatgatgtaagataggatctggttttttgtaaagaccccgtttggacttcgtagagagaggcttcaagaggttaggcatgcttttgcatcagaacaattttgcaagctgcagagaagaaaggcatgaactgtacaacaatgtaaatatcagcagattcctctaaatcaagctcaactaacgagatcttggcaggagatcagtgtactctgtttactttattctttttgtttcttcgaaggatgcaagaaaggaagaatacatgtatgcgtatatgattctggttttccaggaatgctactgtctgtcatgaaactctctacgattatacatagcgaagacggtagccagcaatgcagagttgcagacagagcactggcttgtcctgtccaattagtcaaaatctatccaaatcatccgtaatggagtagctaaacacaaaccattcatcacattcacactgatatcgatggatgaatgcaaggtggctacctccagaaccatcatttaatcagcaaaattgacaaccattcttcagtttaccattggaacaggttcctgaacagcattcgccctcacaaccagtatttggggaaaacataacgaaaaatatcaactgaccccacaaagaacaagggcctgttgattttattatcaaggtttccaccacaaattaagttgtcccgagtctaataaacatgaacaaaataacgggaggcagctagatgagtaacaacacaacacagcggctcagctcagataaggcagccaacaatagcaccatatgcttcagagcacagggcatc

SEQ ID NO: 62564 - DNA, 4711 bp, Oryza sativa
acatatataaaagttttacccataaatttagcctttcatatataactttcattggtaagggatggcaattttgcccatgggtcgggtacccgcggatacccgacccaatgggcatgggcgtgggtgtgattttttacctgtggacacgcccgcccgaaatccgtagacatcgtgggcaacagccgggtttcattttttgcctatgggtaacccatgcccgactcgatacatatgtattagctaatttcgacttatctcttaattcttatacccccttctcttgattcatttgtgatactaactaatactaataagttgtgatgtaattcaaattattgttgataactgataaattggtaaattgttgattttatttctctttgttaaattatgtatctttcgagttactattcatgtgagatccattgggtacccgtcaggtataccagtgcccgtcgggcatgggtgcgggcacagagttttgcccgctaaccctagtgggtagggtttggacgggcgacgacgggcatgggttcaggcatggttttgctctacccgtgcccgacccgacccgttgccatccgtaaaggccgctaaaaatttaatacattactacgcaagtattttcttgagacaaatgtacgtgcatacgtcctatccaaatattcaataagaacgccatcaatcaaactcctccatgaatcggtagccagtaatcaccacaggattcacggctggtgtacatcaaccataactatgatgacagcttccataaaaaatggagtggccagctatttaccaattttcttttccagttgtgcctacctctacatcaataattaccgcacatcttcaggatctgcaacgattatgatgcataacaatcacaataatgggaggtaacaaaatatgcagaatgatccccaggcttggtcttttctttaccttcaatgttcaccgctcgggtatttacacaagaacaaacgaaagaattcacatgtcaatggaggagtactcttgattagactaaatttcaagctaggtcactgcttacgagaaagcgaccgaattttagctgcttcaagatctgagatgtaacatgactacattcctagttttctatagacgagacaaaatgaccagtttgtgccacattactgtgttccgattattctgatgttagatctgctctacatccagaggggaatgcctcccttgagtttgttttcttgagaaagagttctttccttctgtatgtctgatgaaaacctgcggcgtgaaagataatcattagaaattagtctcagaatttggaaatgtcccagaaggaatgctatctcctgattagaaacaacatagcttccttatccagtatatgcaatgagcttagtatttgaaatgctgaaatttccagatagccaaactagttggaaggtgtttctctgtatcttctctagcgaggcaacagttaatgtgttgaattgcaaaacaaaaggctataatttcaatatatgttacacactatcaaatacaggaactccaaaattcacattgattcagacggtgcagttgcaggtgccttaagtaattttcctatacatgcatataagtgaactccgtaagtaattattatgctgataaatagaaaaggtaggaatggacacaacatataaaaaaaaaaagatgtacagccattcaacagatgactgcacatgacgcagatctattaacacttgatatatgttatggtcagtgccaagttatggtgaatcatatattagtagagaacatgatgccgtagtcacagggactaattaaattcagaatttcctgggtttatgaaatatttctgcccctacaacatctcaattttatccatcaatgtttgtgtgcccaagagtgtgaatgtgaactgtgaagtatcattaccattgagtttgggggtatctaactacaaaatacagggttcctgaatttacagtgtagaagacttgcctacatatcgtacaattttgagtgtatctgtttgtttccatgctctgctcatcaaaatttgcaacattcaatcgtgatgactgatgagctgatggtgggactgcttcggagttagagctcagaagtcagaaccctaaaatggtacagtaactaaaatgagaaagaaacctgaaatggcaccatctgaacccagtatttgattgctgtcatgtccgtctgccataaggcacttgatcgtcctacatttattataacacataagtgcatatacaaatcacattactacagtaaaatgttgattctggcaaactctacaaaagtactagaaatgcaaagtaagcatccacctgaaatatattctggtacatccactggactctagagtgctctgctgttgatgtagtttggccaaactatccaattttaagaaattatttacttctttttgtcagttgcacatgtgggagaaaaatcataaatggaaatgcaagcttcttgttgaaaagaaaaaaaaaacctgcatagtgttgcttggatgcagctgattgccataatggtgtgggtggctagactgcaccccataacggctatcaaaagatagctcatttggattaacttcttcctggaaggtacacaataaaaagtaactacatagtcaagactatcataccaaacaatgtacggaacaaaacccagcatcgatcataattactaccataaggtcaacaacaccatttgtcctgacatgagtaccaagatttgaggcagtagaagaagaatgaaaagcatccttctgactaacgtccgatgataccagtaaagaatccttcaatacaagaatgaactcgattagtacaaataacaaactagcgtaaagtacacatagtcgacgtaaggagataccttatgggcatattgatttgacacggactccacatttgtatctttactctttttgggaggacggccacggcgcttttttgctggccctccctcagatgagccagcttgcatgtggctgtcaccattaatagcacgttcagatggtgtaagttcttgctccaattcccggcacaaattatcatcaagaagggtccgtcgtatgtctcttattaattttaatgcatgctgatgcttctcatctgatgatgctccaatctcaacaagacggaggcactgcaaagaaacataatcatagcgctcaatatgattacttgttaccaaatccttccatggattatctaaggcgtgaagctgcttaaagtcattccgccacctgttaagcacataacaggggggtatatcaaaaacatgctgacatttaagcaccgataatgtatgccgacaaacaatgccactgaactggaacaggccacagttgcattccatcctgtcggtctccatacagtgaacgacttcatattttttattcaccatttctccgcttgactcagctagatcaataactacaatggaggatgttgaatcatccaactgaacttcacaattcatggttgcgttcagctcattctggagtttagtgaacattttaaaggtgtatagtctagatagctgttcttccataggaaacttcgatactagcaccctgcttctactcaatgactcaagatcatcatcttcctccattttgtatttgttctgtaaaagattcacatagctgctaaggaatgtcaccaatttggtctctgggttgattgaatcttcaaagaaggcatttggactctcatggtggttaacagtagataacccagcccagaaggtatctttcagaaaggcggggacccagaaatggcgattttcatacagaaaagtgatccattcattatcctgaaggccaaatctactgatcaagttattccaccttgcctcaaactcgtcatccttcaaggaatcatatattacagtttccaattcggtcttcattccttcaaattgtgctgattctcctaacttttcagagatacttcttaacacatgccaatcacttattcgatggcgtgcatttggaaatacttcacgaactgcggcttttatcgcggcacaatcatccgtaactatggcattcggaggccatcctttcatacaagtcaaccacgacttcagcagccataagaagctttccgtactctcatccgaaaacaagccacagcctaacagaacaagctcaccatgatggttcacccctaggaacaaaacaaggggtgtatcaaacctatttcttaagcaggttgtatcaatccaaacagcgtcgttgaaatattggtacgctgccctggacctcgaatcggcccaaaaaacactcctcagatggccttccccgtagaaatccatgagatagaagaagttcgcctgcttcgcctgcatatccgcgaaaaagccattgatggccgctacatcatcttccccaatcttgagcctcccccaatcatcgaatatcgggacctcgatgtcgccggaggtcgagcattcccctctggcagccctcaccaccagatctttactcatcccactaggcaacgtcttgtagcacctcaggaaccgcgccgcggagggattcagcgcgtggttgtgctccagattgacatccatgaggtgcagcaggccatcgctccagagcctcgcgacgacggtggcctggcagttggtcttggccgtcggcctcgcctggtagcacgcgtcctccttcccgtccccc

SEQ ID NO: 62565 - DNA, 1901 bp, Oryza sativa
gatccatgaaaatgtttagataggcccacgtgtgaaattctaagcctccgcgtatcctattttgaactatttccttctttgtttcgaacatctatttgaaaggcaagctcatgtgttgacttaaaaagtttatatatagaatttttctataaaatgaaataagtgtttgtttgttagttatagccccggctcttttggctctacccaaaagggactatagtggctagagtgggagcggagtttagcttgctccaaaacttcactgcgtacttatttttttagttaaatttatgagttcgagctctatcaaacataccataagaataaaaaaacaatttatcaaaagattgaagtgtgtggtcaatccctaaactcgttgatttatatcatctagatcctaaactctcaaatacatttgtcattccggtcctaaaatgccataacccttccaagatcctacgtgacatatcacacgggtgtttgctcttttttttttcttcttctcccttttctcttctcttcttccttcctatctgtgtggcaaaaaagaggaaaaacaaggaggaaaaaagagaaaaaaaagtagaggagaaggaacaaaaataaaaagaaaatttgggttccgaatgtttatggagtgatgctatacatacgatttgccgtttacaatatttgtacgatgaaacaacttgtgtttattagcgtagatgctggtatgcagccgttaacccagtgccatgaattcttgtcatccgcgttagatcgtaccacgatcgtaagttcaaatcgtacgcatagcatttttcaatgtttttgtgctatgccatgttgtggcaatttataattgaaagacacagtttaataagttcggatgcctaaaactacattttaaaaattcaaaaactagatgacatatagggcctgtttggcacaactccagctccagctccacccctcctgaagctgaagctcaaccaaacagtttcaactccaccaaaattgggagtggagttgggtggagctctctcacaaaatatactagagttagacccaactcctagagttatatttaggagttggagctgtaccaaacatacccatacaagcaactgtgcaattttcttaaaaaaacaaaacacccatataattcggtcaagcaggccaccactcagattcggcctttcccagcacgacaagctcacaaacgttcgccgattagcctttccaatatagtactcccttcgtttcaggttataagatgttttgactttggtcaaagtcaaaccactttaagtttgatcaagtttgtagaaaaaagtagtaacattttcaacccaagacaaatttattatgaaaatatattaaattattgatttgataaaactaatttagtattataaatattactatatttgtctataaactaagttaaacttaaaacagttcttgaaacagtttgactttgactaaagtcaaaatgtcttatgacccgaaacagagagtagcatagtttatatagctcggtgcatggcgcgcacattttgtaccatataaaatttcaatgtcagcagtatgaccaattgtaccaggttactttgccatcttttgtcatacattagtgtaagatacgaatttgttgttcgcgtgtacagcaatcggagccaacggagtatttggaagtttctaacagagtacacaaaaaagatgtaatactatacaataaacaggatcgaagcccctctctaaaaaaacaaaactgatctaagcaaatcgtgcttggtgtttctcttctcatcctttctgcgcaatggcatggatcattcccgcacttatgtacattgcaattggcaagtcatagcccgagattgatcccaaaatctggttatgcattgctctctcgc

SEQ ID NO: 62566 - DNA, 3710 bp, Oryza sativa
taccacgtagcatgacctcaaagaaatttaactcctcatcttctcgaaggtagagatcagctggtcgtatttgcatctcgttcccctgcaaggaaagttcagatgccaacttggacattggtcagccagaaaccagagaacatgtctgacaacagacatttggacgagagaaaacccaacacaacatctttgcacgataacgtctctatagccaacaggtaaagtcaatggaattccctatcgtagtgccaggttcagacccctagtatttattttaaaatcagatgctccgataaaatattattaaatgatgacaacttcaacatcatttgcatatatgtttgtgaggaaacatgtgatcagattgttatagcctttttaggagcaactctagttcatacaatagacgatggagccatcagctctgagaatcatacctgctccgcaaatagctcctccaagacatcatttatttgtctatcttcagcaaccattgccaatgccatgctcactagttcatttgatagaacatagtcactgatttttgacactgacaataaattttttgtcctaggatccagaatctcactgattatgacagatttatcagatgcttgttgcatctccccaatccaagaaccttcacagaagcttcctcgagtaacatgtgaaaccatcgcctccctgaatggaagtcgctttgcctgcagtagttaaaggtgtgagccaactatctttgtttaaatgcaaaatattctaatgtaggcttgagaaatgaaaaatagtacatgatcgaagacaactgcatgtgatcagagatatgatctaaagcaatcctaagtaaaatccaaaattgaacaacagtttaaattagttccccatggctagagagaacctggatatccctgatcagcagtagtgttgcaagcgaccttgaatcagcttggattgctgaatcctcaacagattcatctgccagaatcagtatctgtgtgttgcatataagcatcagccggaggaaagaagcaagcaattgtactcataggaaggttcaacagtactgcttttttcctaaaggaactacagtctatgttctcagaacttacagaatcaaatgattctaaagggaggctctccaagtgacggcgaataacagcatttccttcacggtgaaccaaagtaatattttctagacgactgaagtccaggcctccgtctatcagctttctttctctgtccatctcaggaacgtcattgaacatccacaactctgaccctggcgctagaaaagcatcgagtacctgaatacctaaaaccaagtcacactgttgctctagatcgtaattaaatgcattatccattcatcaaaacaaaaaatcatgcactgcaacgtacatcatttggtaatcatatgttgctatataaacataactcttttttttaagaaaaaaaatgagcatatataaacaaaattctcatagtacttacattttcaaatggacaggcctgcattttttgatggacattcagtacaaaagggtttgaatatattttttattatactaaatgcaaaaatataaaaagaaatgtatgacaattggagaagccaagcacagcatatgattatagatgtttaagttaatgcaaccatttcaacatatgtatcaaactacagtattaactcatggggaaatcatgcaaaacacactatagttgctcatgatattagagctaaccatggatctgatcatgtgaagaaacaaaaggccaaatgccagtacaaactcactagtcactacaaaaattggacagcaccacagtgggataaaaacactgagaaagataaaacacagggcaaaaataagaatatcaggtctgttttccaaaacactaagcacttaatggcacattggcttgttccatcaaccatgctgccgtggcagtaattagaaataagtaaagctcagaacaggaagggatattatatcttttcatagttttgacacaggcaaattttggctccaaaacctttagtactaccatagcaataggaatattatattccaatagaggacacaaaatgttgttttcgatctatcatcaagttaccattatcatatcttccatatcacgccgccaaccacaaaacaatattctttcaggagacttgggaacaacaaaatctttaggtaggtaacctctcataacctgcagagttttacagaaaaaggaatattaggagcttcaacgaaaggcttaccacaatcatatcatctatatcccgtcgccatccacaaagaagaatcttctgaggatttctttcggggtgaacaatgtctatgtaaacagcttctttaacctgaataataaaattgacttcgcttttgtaagcttcgttacaggatgctctatatatgtgcagtatctatgttagaactttcctagtaagttagctagcttttgtagttttaggcttttagcaagtaacaacaaaggctaatactaccaccatcccaaaatatagcaacttttagctacaaatctggacatgcactagtccagattcatagctaaaagttgttatattctggaatggagggagtaattgccatctataaggcataaattgactcatgcagttgtcttttccggtgcttaatgagcaaagcaggagaaattacttttgaattgtgcaaaagcaatctagttccagttgggcagaagctaaaattctattgacaaccatgcggttgtctgcacttatggatctcaagagcctaacaatattacaaggagaagaattcgcataagacaccattggaagaactcgtgtgaaatactacagagttttgaagcaattaggttgatgcagtaagttgtaaataggatatggctagtgattcagataaatatatcaataaaagatgccaaatggtaaatgagaggaaatagcaatgagcttaaaaacaacgtcaaccaagatgagtatacttcatgaaatgcaacaagtagactagcaatgcacaggctgacaggcaccgataataagatatctaaggagctgtacagaaaatagttaaatatgtaaacatggcatgactaacaacagtaattcaatattaatgttacagagccagaagggatacaaaaaaaagtcctgatagatgatataaaaagaacagaaagtttcagataattttgttcttacagattaatggttaccttgggtaatggcgctggggcatatgtgtcatcatcttctgcaattactagcacctcatcaccctcttgcaagacataaaagtcatccggatttaaaataatcttgccaccataagatgccacctttatgccacatggaatggcatcaggaaagctaatgagcacatcttcaaattgcataccatccaactgaggccatcttttaatatagaactcacagttttcgaagccaaggatatcttcccatatctgtttatgcaactccattagtatttaaagggacacattaaattagtaaataggaaggctgtgcatgtagtagactatatgcaatactcaaacagccaggtaattatagtaagcattatgtacatgcaggaaatatttaagagtgaattattgcgcatgtagaacaagaagataggctagtttcttaagaattatgccgtgccaggctaaaaagaaccacagaagtagataaaatacta

SEQ ID NO: 62567 - DNA, 2066 bp, Oryza sativa
aattaactagcacaatgtacctggtcagcatttccttcttcagctaaaaccacaattgcacgcgctttagaaactgagaccttgtacatgaaggcagattcagttcaacaaagagttgcatatagatttagtaaagtaatagtgagtcattaaattaacataacaaccatccaattgtctattgattactgccaagtgccaacagatcataatgcgggttagcagaatcactacatcacaatgtttacctttttcaagtcagctagaatcagagggcttccacttctacaaattatagctgttcctttcaagtcaaactccattttagcaatgtctgcttccatttcctctttgtctttctcagccatcactacaatggttcctcctcccaaactttcattagcaatagcaatttggttcagcaatgatccctgttgccacaaaaggaaataggttagacacttagactacagtaatctggagaggaacagcttgtgctcagatcagttgatctgcagaaacagatatataagaaatttgcatatttaaactaaataccagaattcactaactactttacttttgtagcgagactgctatgcaataaaaagcaatgtaacagttgcaatgacgtccctagttagagctatatttaatagctattggtataacatcattcccaaacaacaaggaacataacaggacaggtaggtagaaatatggaattttgcgataaagattagcaggattgaatgcaggattaccagtttgtcactccacccaaggaccagcgtgtggctttgctctatgacctcacttcttcctttcctcagtgaatcaaacttctcagagatcgaatctgttacaagcccaagcatcatggcaaaaaccagcatcccaccgatactaattgaaactgaaactaactttggtccaaagccttctgcgtttgcatggttgcccgaatcagcaacaaaggtccaggacagccagaggcaatctaaaaggctatcatcatttacaccataaagagccaggccaccaagaccaataagtaacaatgtagcaacaagtagaaccaagggtttagcatatggttgaagtgataaaaatatatcaactcggtatgccaaccgcttgtttatgggaacttcttcttcggagtcttgcgaactcctcagctttaagaaaaggtccatgtacttaagaatgagtaatggggcgtacagcgtagaaagcgagagcagcaatgagaaattcttaagacctctgttctgcgaagtactgttattgctctgatatgataatatgctactcatatccatcgaggactctgtaatacaagactgcaattttgtagtagcttccgcaagctgagcctgatagaatccgcgtataagtgcgcagttatgcagaatgtgcattggaatcagttggaattttaccttcaaatggtggacctgatcatgtagcgaggagttactgcggacaagggaagagaagcagagcacaatagcctgcaagcatcaggtttacgcggttaaaccgtcagtcaacaaaagtcaaacgcgaaaaccccgcgagctcacccatttcttaccgccacggataccatccctgaccatcggagggtggtcgccgacgccgctgacttgctcccgtgcacctgcgcggccgtaggaaccgccgccgccgccgccgctttctcggcggtgagcgttcggacatcgccacggcggacgccagcataccgggggtcgcgacggcgcggggcgggaggaggcgtcgtcgggggcggctgctgctgcttctgctgctccggcggcgggaggggggagcgggagcgggagcgcggggtaggaggcggccggcggtccgggaaggagtatggattggaggagcgggaggtggaggggaagggggccctcggcgttcgggctctggaggacgggaggaagggcggcgccggcgggaagaaccagtcccggtgcggcggcgccggcgaggagtcggggtccaggggcattttcggaattctaggggttggcaggtaggcggcggatgct
